United States Patent 8,101,349 (GENE PRODUCTS DIFFERENTIALLY EXPRESSED IN CANCEROUS CELLS AND THEIR METHODS OF USE II) - sequence listing, part 5

SEQ ID NO: 17510 - DNA, 450 bp, Homo sapiens
gaaatttcagctaactctcaccacctcccactaaaccgctttcctgagggcagaaatccatcttccagctgtgaatcaggatttgccacaagaaacccctgcctgcctcctaacacctgccattcattagacactgaatccggtagggcagtcctgggatctgaaggtctttagatcgccagggccacgtttctgggaggctggtgtatttggaaccgccctatcattctgggagccctgtgcgtccccagctgccctgcggagtcgctgttagacattgtacacctgccctgcaccccggatgcagactccgtaattcttcaagtcagccccagttcatgcaactgacttttctcaatcaaaggcatttgccaagtgttcaaggattattacagcgatttattacactgagaagacttttcatctggatacatttgcaagtcaaagaaa

SEQ ID NO: 17511 - DNA, 556 bp, Homo sapiens
taggaggcttaataacatgctggcctctacccactaggtctactaacaaccagcaccccacttaacgtttttactccagacactgccaaatgtcccctaggggttacaatgccctggttgagaatctctgccctagagaatagtattagcatctcagtggtgacaataagataaagcagacccttatttataagtgagatacagctgggactctaagctagtactgttaatttatctcttcaacaaagttactattaagtgattcagaaggcacatgtggagagcaaaaaataaaaattaaaaaaataagctgggtgtgtgttgtgcacctgtagcacctatagtcctagctactcaggaggctgaagcaggaggattgtttgagcccaggagtttgagagtgcagtgagctatgattgtgccactgcactccagcctgggtgacagaacaagaccctctctcaaaattaaatgaatgagtaaatgaagatgtattctgatttaaccaagctggtacctcctagtgactgtatttggtagagaattacagttttga

SEQ ID NO: 17512 - DNA, 606 bp, Homo sapiens
tggtttctgtaatgttggcagtcactgcatttaattcaagtagcatttatttttgcagtgatattccttattgcagaagcatctagtctcacatcatggccactgaagtatcggtctggtgaaattgcttcccacgggagttagttgaaagcctgaagtcatcaggggtcaccatctgggtaatgtacttcgtatatatttcaggaagggaactgtccaacatacaagcagatctgtagttttgacaagccttggaagtaaaagacaaccacttgtagcattccttagcctgaaggaacatgaagggaactagtagggggagaatgctgacaaaaagggaaaacaaagtatcttagaaaatattatatgcttttgtcttggcatgctgcgaagcaggacatgatccataatggtcaggactttatttgtaagataggtttcaaactttctaaataggtttatttagtggatttagaaaataaaaacccaaaattcttgcaacaaataaatataacacccctagctgaatatctttgcatttcaaggtgcaagatgaattccttgaaagcaaagttacatttgtcttaaaagtcttataatttcaag

SEQ ID NO: 17513 - DNA, 537 bp, Homo sapiens
tgatttctcaccctcccaaacacttaccttatttttttctctatatctgtttgtttttgtttccttaatatattccaggaaatttatttttgggttgtcctacaggagaagttatgatgaatagaaaagtgtgaagaagaaccttctattctcctcagagtatagggcaaagagcgtgcaattgcacccaaaatatcagtgtggaagggtcatataactgatactagcaagtaacacattgtcttacagaattctcattcttaggctaaaatattaccttcctcatcaaacttaccctgaccgcatgcttgatgttgtttgattaaaatataatacgcttttatttcccaaatacacaaacacacacacgcgcacacacacacacatacacacataatatatttggggaaatatatgtgctataggatctatatttattcacttctaaaaattgtgctacatcaaaaatgacaaaaaaatgccaaaaagagttggtaaaatgatcacctgtattcagtcacataactattatttagt

SEQ ID NO: 17514 - DNA, 280 bp, Homo sapiens
ttatctttgacacagtgatacccattgtccccacttagtttttaattttcaaccccacctggactacactgaccaccctgacctcaacaagttcaatttctacctttattattgacctataattgagactccactcagcagacattgatacctaatcagtcctgcatttggacaatccctcttagattgactcagtcatgccaagagctcagccgctgcttccttctctgcctgctgtcatctgattcatcatgacacttcagtaacaggatgttaaatg

SEQ ID NO: 17515 - DNA, 641 bp, Homo sapiens
gattagacctaaatattctgatggtcttgcacgttcattttcaaaatcatttcttctgtcttttgatagaaaattcagaatctccaagtaaagtagatatgcaggttacttgatgtcaaatgccacttcaattttctgggccttcacacttttcattctcattctgttatattatacagttgacccctgagaaacatggatttgaacttcactagtccaattataggtacattttttggtaaatatattgaaaagttttctgaagatttgtgacaatttacagaaattttgcaaatgaaccatgtagcctagaaatactggaaaaaataagaaaaagttaggtgtgtcatgaatgcataaaatatatgtagatactagtctattttattatttactaccataaaatatacacaaatcttttataaaaacttaaaacttaccaaaacacacataaacacttacaggccacatatggtaccattgcactctagagaaatttaaacaaatgcaaagatgcagtattaaatcataactgcctaaaattaactacagtatatactgtactactgtaataattttttatccacctcttgttgctattgcagtggtctcaagagttgcaagtatttgcttaaaacact

SEQ ID NO: 17516 - DNA, 604 bp, Homo sapiens
gaacgcggttcccggggagactgtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtaccctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcggtgtgaaactgcagcacaacagaaatttgctgaagaacttcaaaagcgagaacgttttttacttgaaagagaacaactgcttttcagacatgaaaatg

SEQ ID NO: 17517 - DNA, 542 bp, Homo sapiens
ctcaccgagtaaatgagttgcctttagttttctctgttcccatgatgttgagctgagagatcctgacatgcacattgtcagagctgccttatggtcagaagagtggatggtgattttagggacacttgggagttgatttttctctaaagtattttaatgatggtacatgtaataccatcattagagacatgtttgtccactacttttagttgcttttgagaaagcaagcactttccataaattatataaatggtcatttatatttatgtgtgaattggattttcaaatggcatcatgagaaagtagttcctgcacatgaagttgctaaaatatggggcaagttacgtaaaggagaattgaaaagcatgagagacaggactgctgatttctaaacttaatgggagtctgtgtgtgtctgggaagatctagaagtttcttgcactggaacggcaacagatgaaaaaagtgctaggtcatgcactcaaggagtgcatgttcattccttaagaactctggaatcagatgcatcatgttgatgctta

SEQ ID NO: 17518 - DNA, 557 bp, Homo sapiens
ctagccttccagcaccagcaaccacccactccagccttcttgatgtgtgagagaagtaacctccaattgtttaaggcactgtattacttgctgcaaatagcattcatgacttattgcaagtttgtggaaacacaagtttttcagggtgcttttgcaagggatgatgctgagacgtcaagcaggtgccaggctgttgagggccctgatgccacattaaaggagtttagcagtgctttccaggcaatgggtcctttcccagtgggatacatcagatgactggaggcagcacacatataaggcaatgcataatcttgaatcacacaaccagacatttagctctgttcccattctcttccagtccttctaattacataaagaagatctttcaaaattggcctaggtggctcacgtctataatcccaacactttgggaggccaaggtggaaggatcacttgagcccaggagttcgagaccagcctgggcaatatggtgagactctgcctctacaaaaaatttaaaaaattattagccaggcatggtgatgcacacctgtggt

SEQ ID NO: 17519 - DNA, 576 bp, Homo sapiens
gtcatcaacatcctcattgtcatggcaaattgtgagtttatctttgccagtgtcagatagttcatcaacttccttttagccagattgcaaaaagtcccatgactctatttccaactccaatgccatctgacatgagacaaaatcagagtagattaagatagtggtcttaactgaatgtagttaaagtatgctacttgtgcaaatttttcagaaatatatgaccatatgaacatgttgctgaggccttgccaggccttgaaaggggcctgtgcaagtgaggggcacagagattaagttttattagcttctcagaaattctacctctgaataagatttttgagtactttgcatgccaggatgaggagagtgaatctaagagatgtattgaatgaagaagtaagatacattggataaaggatgtaaagtaaagaatatagagtgctggccgggcgcggtggctcttgcctgtaatcccagcactttgggaggccaaggtgggcggatcacaaggtcaggagatcgagaccatcctggctaacatggtgaaaccccgtctctactaaaaatacaaaaaat

SEQ ID NO: 17520 - DNA, 513 bp, Homo sapiens
aggaggtttgtgtaattatgattactgaaggaagaagacaattatgtcagagtatagaagtatataaaatagctaccaggaagttattttagagaaatttttcttaaaagactgtaatcagaaacaaagacaattaatgcagggacattccatgaacttattcacaaaagctggtaacaggacttaataatctttgaaagctgcatttccaaacattgacctaaccattaggaccaagatggacctaatattctaattaccaagaagagagtggtgatgaattaagtggggagagaaactgagtgtaaactggaagattttaatgttttatttaacttaactaattctggtagaattttttactttgaaactctattttatggtaatttaacaataaggattctaaatggtggctcagcattcagggctgagaaagacactgaagggtaatgccacaaggagaggctggataaagctctaataaaattatttcttttatgctacttactagca

SEQ ID NO: 17521 - DNA, 517 bp, Homo sapiens
tctgtatgtgtgtgtgttgtgtgtgtgtgtgttcgatgaaaaggatgtgcacatttaaacatgtttgcattgactgaattttaaaaaattcataataaaagagtcaattccaatgcctgtcaatgcataatagttctcactttagagtccttgatatttctcttcctgattagtgtcaccacatcattcctttaaacattttgataaaagagatatcaattaatggtgccctggtaaactgtaatcagaatagattcccaagatgaagttggttcacctgtccctttaacaaccagctatttaggcgatcaatgtcagaaaactagaacaaatagaaacacattttccagtagagagacattcagttgactccattttggttttctttctcggtttaacttttgatttacccaagaaagaccaggaaatcagtgattgcctagagtgaaaactgctagaagaagagattatatacaaagaaggataaggaatattttggatatgatgaaaatagtct

SEQ ID NO: 17522 - DNA, 517 bp, Homo sapiens
agagttgggaggaggaagtggccatgctgcaggtgccctaacagatccagggaagcatggagagcacagccactagcctgcctcgggctgcagggggcggggagcacatgcggcgtgcagctgtgagcagcgcaggtcggaagaggcatttggaaatgacacgctctgtccaggaactgcagtaaacgttctagcttgtaataatctttccttctggcagatggtgggttcacactgagttaagtagcttcacgactgctagtggctggaagcttccagattagtagtttaagccagaaaacaatgttgatacgtcttgagatgtgtataaatcatttgatttggctgggcagggtggctcacacctgtaatcccagcattttgggaggctgaggtgggcagattatttgaagtcatagttcgagaccagcctggccaacatggtgaaaccccatctctactaaaaatagaaaaattagccgggcatgatggcgcacgcctgtaattccggctactc

SEQ ID NO: 17523 - DNA, 371 bp, Homo sapiens
atggctatgtcaaatttgagatgcaggtggtgaagacagggggggagaatcagttgacatttgaaaatataggtttgaaacctacaggaaaatattggagtaaaaaaaataaagaaaatcaaacatcaaaggaaatgctggaagtgtgggaattgataaaaggagcacaggaaaagtgtgcagagcgttgttacccaaagtgctgtgggaattttatacacatatgaatacagctcacaaaacacacaaatatttttgcttccctggatcatttactggagtcttttacatacacattctgaagtataaggtatgcagaattttctaagcgtatcatagaattccattccaagaatacatttcaggaaaac

SEQ ID NO: 17524 - DNA, 317 bp, Homo sapiens
tttgtcctttttaaaaaaaataaatgtttttggcaacaaatcgacattttacattattcccatataagatgaaatttctaagccagaatttaccatgagaaaaaccttaaagaaatgggccgggcatgatggcttatgcctgcaatcccagcactttgggaggccgaggtgggtggatcacttgagttcaggagttcgagaccagcctggccagcatggggaatccccgtctctactaaaaatacaaaataaccaggcatggtagtgcatgcctgtaatctcagctactctggaggctctggagcgagagtctcttg

SEQ ID NO: 17525 - DNA, 617 bp, Homo sapiens
gtgcaggtcatacacaaaagaattaaaaccaatcataacagcaaaaacttgaaaataaaaagattgtcaattaagcacctcaaaaataaaatttagaaaataatggctctgttagcatcacacaagtatatgctgtagtttaaggttaaaggcatgaaacagtattgtgtcatgagaaaatgcacactttacaaaaagataaaacactagtaaacaggtatatagatttggtagctcagcagctaacttcataaagtgaaaatcattaaaaatgccagaaccttcattttccaaaagactttagaaaggaaacttcgagagaacaggggaagttggcaaagaatatgcagattccttgaggaactggcagctgatagttggagtcccagaagctcacttatgaatagaggaagaagtcaagatgatctgccagttcagataatcagtggaaaatcctctgcataaaatcactttagtgatgatggaaatagaaagctaagacactgaatagccagttgcaatatccagtgtgccagaggcatacaaagagagcactcattgaaacagagtaagctgagctgtctccaaacagaaatgtggtatgcttttgtcatatt

SEQ ID NO: 17526 - DNA, 551 bp, Homo sapiens
ctataagtgccagttactacttaactcaatatccacaaacagcgcagaaggactagattctttcattggtctgtttaagacaggtgagagctcttattattcctgaaagagttatcacagctggaggagcagcaatacaattcttgcaataaaagaggtggtaagtgaaatcaaaaggcaatgcatctctcttcttccaacccaacgtatttttatttttactggaatacaagttaagattaggttgcttattcttcggctgaggtatgagcatttatagctcagctgttcagagcaagagctgagcagttaaatactgctctgtgccctggtcctccgccagccgcccagcagacaacacagcacgccgagctcagaggaacactgtctcctcaagtgcttcttcttcctctgtgttgtttcctgtgtttccccacatactgtgcctttccctgtacaggtgctgtttccataagaatatgttgctcaattctccatgtggtcacctgttgaaatggtccatcatagccaccaaagcagcactaggcatg

SEQ ID NO: 17527 - DNA, 619 bp, Homo sapiens
tcagaaaaccttttttgaaattgttgaataaattgttttcagataaaccaagcaaaaccagaatgtggacggcagagccttgttgaacttcttatccgaccagtacagaggttacccagtgttgcattacttttaaatggtacttgtctgatctgtttcaaactacatcagatattttaatggaattgtttttttccaaaaaagatgaatttcttctcatttttagagtttcttagatttcagcattaaagtttatatatgttttgctttatggattatcttaaaaaatagttactggtgctactaaaattcagcctggcctgaaatattttatttgttgattagtagtatatatttcgtcttttcatttaaaatttttcttaatatttcatggtgtgtcactaattcaaaatcattttatatccaagtacatacaaaatttgcccacaaaatcacaaagagaagataatttgtatgtcccgacttttttgtagccctttttttgaattttagtaaagttctatatacttggctttatgcttactgttttgaccttagattgttcagaatactcttgaaacatatctatttattctagaactgaactataggtatcaat

SEQ ID NO: 17528 - DNA, 571 bp, Homo sapiens
cactcactcttttgctaatcgttctctaaatcagagcttcccaactggtggccacaaaacactggtgggcaatgaacaagtaactgatacgtcaagatattcatgctttcactgaccagatgatctccatgtcagataatgccaggtagatgccaataaacttggtgtgcttatagaggaaggaccacttgattctccctgcagagcatctataaataactgagagttggatgatgccagtttatattttgttaatgtaattttcaaaaccactctctttggggttgtcaagtattcctggggtgccacatggagaagagctatttccatagtactaggtaacttgagagcttttataatggcttgtaatcactggaaattattagcgtacaagtttcggtaacaattcttataaagtaggcaagagcagctgccattacttctaaggtcatacctgtaaggcttagaattggggactatgaattaataatgagtttgcaccagtaggattttccaagtacctagggcattagtaaaaccaatttaaaatatatttatatttgaggaaagg

SEQ ID NO: 17529 - DNA, 554 bp, Homo sapiens
ggggatagagtggtggataggacaggtttgtgatctcacagatctatagtttagggagagagacagacaacagaccaggaagcaaatacagatagggagaggtgcacagaggaaagtaagacaaggggtgtgggaacaaatgactggagatggtgctaatttggattggggggtggggctcagggaaggctgcagaggtgatatgaatgaaatttgagaagatttaaataaaaagaaaggtccaagaatgcaaatttctgggtagagtggtccagggaggaacaccaaggagtgtcttaaggtagaagtgtgtttgatgtgttcaaggaacccagagaaagccagagaatcagggggactgggatgaaatgagatgagagaaagacagggtggaccactgggaagggtctaacttactgcaactgcagtaggaagcagtggaggctcaaggcaggaagcatgatggtgaaatttatccttgtttaaaatcaatccagattttaagtggataaacaaattatcatgtatccatagaatggaatatatgatagaga

SEQ ID NO: 17530 - DNA, 603 bp, Homo sapiens
tcagccaagggaaatacacatctaagactaagaaaaacatgatctcttagcctgcccaagttgaaggcacccagaatttgtcccaagagcaaacttctagaattctcaacagagaaaacccaagcagagatcttccagagcaagccattctccatcacacccctgtccagcaagaagagagccatggttaacacaagcacctactgcaccacagttctcaattctggctgcgcgttacactcacacacgaggaactttgacaacttctgatgcaagggtcccatgccagagactcggatttaagtggcgtagtgtcaaaccaagtcaccagtacctctgaaatatcttcagaagctctgggtgcagtggctcacacctgtaatcccaacactttgggaggcagaggcagaaggactgctggagcccagaagttcgagaccagcctgggcaaaaatagtgagaccatgtttctatgaattttttctttttaattaactgggcatggtagcatgtgcctatagttccagctactccagaagctgaagtgggagaatcacttgagccaggaaggtcaaagttgcagtgagccataattgcaccact

SEQ ID NO: 17531 - DNA, 385 bp, Homo sapiens
  misc_feature 295: n = A,T,C or G
catatattccagcaaattaatctctttcttgagcttcagacttctttttttcaacttcttaatatatacttttagtataacatgctctagacctatcaaacttaatttcatttaatgtaatctcaattaactcatgttcttaagtggaaaatattgtagtcatcctcaaactccctgagtattttatcaatcacacagctaaatatcttaagcctcatattttctttcacagccattccactctcacctgacatgatgtgtgataatattaactcctgatcaagcttcctcattntttcactctcctgtatatttcacactcccagctcaggtttgcttcttaaacacagatttgaatacattactgtaaatctctgttttgctt

SEQ ID NO: 17532 - DNA, 520 bp, Homo sapiens
tcttttgtgggattttctctatcgatgccatccatcactgtggctgcaatggagctctctgtatcttccgcctccacagtgctcagctgtttttctcacctggcaccagaaatgcaactcaaagaaagaaacagcagaagggaaataaaacaagaacaagaagctgggattgaagccagatgaggtggaatgagcagaggggctgagagatatagaatctaaattctacattacgctttgccacaacccacctctgagagtgttggccccatctctttcatcatttcttctgcttcttaaaaaggttgatatgatgaggaaaataggaatgaggagagaggatctaaagtctcgttgcttcaaagctttagctgttcaatatcttctaagatttctgtgattctgaaacttacacgtttaaaaatttagagcctgatggactagcgctgaaacaagcaaagcagaaggtagagccagtgagcataggatttgctgtccatgtgtagggggaaaggagaaa

SEQ ID NO: 17533 - DNA, 517 bp, Homo sapiens
accaaacgacatgagctagaagctaatttgtttagttcagcagtgtatcctcttataattaggatagaccaaggcatgtagtaggtgctcaaaaaatatctgtcaaatgaatgaataagagtggcttggagccagcccaccctcttatgaagtaccagtttcctcatcttcaagacagaaacagtaataggacttagcccatgaggttgctgttgattcggtgaaatgatattcataaaggtctgagcacagtggctgggacataagcactcaaacatcagctgctatcactatcgtgtccttccagtaccttttgaaaccttgtgctgatgaattcagaaagcagccctaaggctccctttccctgtgctgctctagccagtcccctcccaggcaggcaaggaagcttctccaccaatgagcctctttatgcactcatggttccatgtccaggcaggcttgggcagctggggtacagagaagcgtagggtgccttcacatacctgggatgcaaacc

SEQ ID NO: 17534 - DNA, 619 bp, Homo sapiens
aaggctgcaggttttttaatgatgttttactcactctacatgggactacagagtggcctaaggctaacaattgtaaaaatgataaacttttgccctgccataccttctttgaagtgtcatctcccctctagaatctgtctggctttgtttactcttcaatggcttcaggtcatgtgtgtgcgtgtgtgtgtgtgtgtctgtctgtctctgtgtgtaaagaatatttatttacaggaatactaaattattggtatatctagaataccctgtatcatcatctaaatttgctgggagatattattaaattagaactagctgttaagagcacatttttagatgtcaagatcgttttgtgtgataatagagatgaacctatttgattttgggggactgcctatagcacaaattttgcttgtgaataactatactagtgtgatataaactcccaacatttctgatgtgttagtagacaactaattaaaatttctaatttctattcttcctttaaagtttttagttccttgaagcttggatgttcattgttttatcctaatgtctggtgcatttcctggcttatagaaaacatgatatatttttaaaaggataaattatatggaaa

SEQ ID NO: 17535 - DNA, 600 bp, Homo sapiens
gtaggattggaagcttgtagagtcttctctgtgccctcaatatccccagagttcatgacagtgtgctttgaatgggcctaattttacattgtacagagtatttggggcattctttcaatatgtatttcataactttcaactctgagaattcaggagagaaattagaagtagaagataaatccaggatgtccaagttggagttttgggaaaacgagtatataataggaaggaagttatttgtaaacatacatgaaaatttcccagaactgaatatcctgtctgcagattgaaaactctggtagcatttaacacggtgagtgaaatgacacccacagcaaggcacgtggtggtggcattttgtggtttgtatgtttgaagctgtgtttaaatatcacatagaatatgatttgaacttcaatatacagtccaggcaataagtattgtggctgagatggaggagaagttgatactgtttggctgcatcaagatacattcaggagtgctgggcgcagtggctcacacctataatcccgacacttgaggaggtcaaggcaggcggatcccttgagcccaggagttcgagacaagcctgggcatcat

SEQ ID NO: 17536 - DNA, 567 bp, Homo sapiens
gattagacctaaatattctgatggtcttgcacgttcattttcaaaatcatttcttctgtcttttgatagaaaattcagaatctccaagtaaagtagatatgcaggttacttgatgtcaaatgccacttcaattttctgggccttcacacttttcattctcattctgttatattatacagttgacccctgagaaacatggatttgaacttcactagtccaattataggtacattttttggtaaatatattgaaaagttttctgaagatttgtgacaatttacagaaatttgcagatgaaccatgtagcctagaaatactggaaaaaataagaaaaagttaggtgtgtcatgaatgcataaaatatatgtagatactagtctattttattatttactaccataaaatatacacaaatcttttataaaaacttaaaacttaccaaaacacacataaacacttacaggccacatatggtaccattgcactctagagaaatttaaacaaatgcaaagatgcagtattaaatcataactgcctaaaattaactacagtatatactgtactact

SEQ ID NO: 17537 - DNA, 575 bp, Homo sapiens
caaactcctggcctcaagcaatcctcctgcctcaacctcccaaaatgctgggattagaggtatgagccaccatacctggcccaaacccttatttttatgtgtcattagccagaattgtattacatggccactttttccaatgagatagatactttctcacccctagtcaggaagctagggattatagatattagggaggcaaatttttcactttgagacactacaacattggtgggggcttatgtgaatttaagttaaaagctcctgattgggatgttgtcaggagcacgcacaaggctgttggggttggaagagtagattcctggaatgaaatttcctagtaatttcctttctttatttagtcaacaccaaggagtagtctgcttctcccctttctgttgctaccacttctctctaatcaaactgtttcttctctgactcattgcagaaaagaacattgtctttccttcagcctttttcttactctcctcatttctaaaggaaatgcctgctcagcccatctttctgttttgaaggtttttatagaagattaaaatttcccccactctgttctt

SEQ ID NO: 17538 - DNA, 546 bp, Homo sapiens
gggttccactgtggtttcccaaggagaggtaaataataacagctagtatttattgagcacatactatgtgccaggctcggtgttactcatttaacactgtgttttctattaactaatttaattctaacaattccatgatgtagcttttattttcagatgaagtcaccaagacttgctcatggagacacagctggaaagcagaagcaccaggattcaagcctgggccggtgggaagcctgaggctcttacccgccctcccttcagtgctgccttccttcatgcttcacttgttcctttttcaatgtccctgcttttcctgccctcatttcaactgctcatccgtcttcccagacttttctacagacgtgcggcattgcagtactgctcttgctgcaaatgtcagatttccttggtcagatttgcttattgtgggactttctgctgagatatatcagagatgttacaactgcgagaaatgcaggcagttctctgcgatccatctgccatgcaatgacaagagatgcttaaaggctgtctggtagaact

SEQ ID NO: 17539 - DNA, 463 bp, Homo sapiens
ggatttcggtaaaagaaaagaaattgttctgttaaagttccttctcaagctcttcagaaaagatcagaataacaagattcagtttgagtcatttgcttaaggatcgtcttgattgagagttgagctggtattttactgccagggtgactaaaataactattttgcctactccttcctcttttcacattcatacacatcagacgtgacttggagaggattccactaactcagtaatttttatccagttcagatcagaagtttgtgtgaagctgatcaatgttgcttaggttgtaaatgcagaacttggagattttatgtggcatttacaaaggggtcattagtcatatattagcagaaaatcagtcaccgaagtatgaatccttgttatgtgccatgatccctgccttcatgaagctgacatttggttgtagagagggagaccaggaaaataatgaagaatgtg

SEQ ID NO: 17540 - DNA, 290 bp, Homo sapiens
ttagcattttttcccactggttctaaatgaaccccatcctccttactttaaaccttcagaacagttgcctatagatagagttattagtcagacatttgggaatatctaaactacagaggaatgctgaggaattgtagctacacatgatgattgcaatttcaaggaaagggaatttatgctgaaatatttgaataacttcccctcttagtttttactatgtcaaaaaaattcatgtaaatgtatccctttacacaattggtctactgaaatttttggtgaaactaaaacac

SEQ ID NO: 17541 - DNA, 205 bp, Homo sapiens
ctgttccctctgccccacaatgacatctccgcggactcttttcagtctttcctatgtgaacctgatgggatttcttacaagaaggtttggattctgccaatgtctacagcccacgatggttcccatagtcccctgtcctgcattctcatattcagctttcacccatctgtcaactattcttcctgacctcttcttgtcagtatca

SEQ ID NO: 17542 - DNA, 618 bp, Homo sapiens
acacctcagccaaacaaatcagaaagtcagctcacaaccctctatttctcactcctgagaaggctgctcataaacagtgatctcatttgatccccacaacaacactatgaggcatgtaaattggtattagcaccattttacacaagaaactgcaactcaaagaaataaggggcttgcccaaagtcacacaaatcaagatgtctgaaccaggaccagagcacaagtcttttacctactgacccaacattcctttcactcactacatctgtaaatacgcagttagaaaaacctgatatccaccataatctgcaaactttcataatatacatttgtgactacaacattcttaggtaggtaaccacccacataccagctatgcacatcaaaaacatttacacgaaagatcagctaatgacctgcttattaaaacaaaaccaggacttgcttatcaaaaacaaaaccagggacaagaggggctgccaatgctgtatctcagaactaccactcatacacatgccctaatgactaacacccattgactagcatcacccctacctacacaacaaaagaaccccacttttgaaaacctgccaactctaggattcaacatactacact

SEQ ID NO: 17543 - DNA, 371 bp, Homo sapiens
actcacgatggatatgcttttagagaaacactgtgacaaagaccctttgctccagaggaaggacctgcagtggccccaggctgtggctccagcatcacttaagacagtgtgaacatttggacacaattaaaaacaggacacttaatcaaagagcacacttacaaagtaaaggggcaggaaagctgggaggcaggaggtgcaggaccccacgtgggacaggcagctgtgtgttgttggtaccgccttcctgccatggctttcctacaccagcagagagaaagcccatttctgctctctgctgcaagactctctggatggaaggtccagttccacaggaaggaaatcctggtagctgaggcgtggctgtgcac

SEQ ID NO: 17544 - DNA, 473 bp, Homo sapiens
ctcttctaaaactgcctggaactgaattctgccaacaacctgaatgaacaagaaaatagattctcccttagcgacaccaggaagaaatgcagccctgatgacacctagagtttagcatagtgcaaccaatgtcagactttcaacctacagagctgaaagatacatttgtgctgttttcagtctctaagtttgtggcagcaatagaaaatgaatacactcttcttacaaattttgtctgcatatttttattggagtggggttattttaaaacaagaaaggacttgtgagtttaaactaaagattcttagaacattctggaatgatatttatttttatgaaataatttctagtttaaacacatgacattgattttagcttgcattctaagtcatctgagatttgaaggatgttccatgtcttagtcttatttattggggcaactttgcaattccaaaaattatatacacaaaatg

SEQ ID NO: 17545 - DNA, 501 bp, Homo sapiens
taattcctttggaaatctgaaagatagcggtacatgcatgtgtgagacttatttttactctgtctacagacagcatttgggagcatataggggatttgtagacaagatgcagtagcttaatctaccaatcaggaaccactagcttactgaaacagcactcaagtcaaagccccacagtgggagtgtttaatgggcagggcatcacgacttaaattcccatcacaattattaaaccaaaaaggaaaggcagtttcccacaagaaagccagaagtttacagaaaaaggatgaaacagaagatgtgtagccagaaaacagctatccattacaaacaatttcaaaagatcattcatatatttatttaatcatgtgtattgatcaattcgatcattaattgtaaagacttaaaggaaataagcctagaaaagtaaaacttgaggcaagcgctagggaaatggcctattctagctaatggaatatattccagcctgagatggcaggc

SEQ ID NO: 17546 - DNA, 619 bp, Homo sapiens
ctatgtaatacatctgcacatcctgcatatgtacccctgaacttaaaagaaaagttaaaacaccccaaaacacccactgtaattctaatccaagtagccactatagtaactgccattgtctaagaatttcaaaggcttttgttgattaattaatgagtataccctattctcaatgaatatgagatgacaatttggtaacataactaactgcacacacatacacagacctacacgtatattatacataccaatgtatctgagggtgattgcatttactaaagtggctacctggattaggattactttcagctttgctgatgaaagaattcaagagtattgtttggttaccctgtaactgtaatatcattactgcagaaactccctgagatatactcaaggatttacacacagggatgtatactgctgcaccattcccaatcagaaaagagagaaaaattaatattttggaatgctgaaatagtttagaaaactagaatttattaaaccatgaaaacaaactacatctgtatatattgatatgactagatttgctttatatcttatgtagtaagataattcctaatttttcctggtatttttattatgggcaggcataaaa

SEQ ID NO: 17547 - DNA, 480 bp, Homo sapiens
tgttcatctatgtgggtcagctccaagcacaaagctagaaagcatttgagtgaaggaatattgacatagggaggaagtgaaaagactacattttccaagcatgacattacatccttcgcacagtgcaacaagcagacaaactccaaggctccatgttaaacacacacacacacacacacacacaccacacaattggttttagcaacaaaatttcagcccatttaaaacctttggtgttatgttctcactcataagtggaagttgaacaatgagaacacatggacacagggaggggaacatcacacactggggcctgttgggaggtgaggggcaaagggaaggagagcattaggataaatacctaatgcatgtggggcttaaaaacctagatgacagcttgataggtgcagcaaaccaccatggcacatgtatacctatgtaataaacctgcatattcagcacatgtatcccagaacttaa

SEQ ID NO: 17548 - DNA, 540 bp, Homo sapiens
ataacttttaaactgagccagtggtcacaaactcatttgtatcaaggggctaggaggcaacacaagagtttttaaatttttttttaattttttggagatggaatctcgctctgttgcccaggctggagtgcagtggggtgatcttggctcattgcaacctctgcctccccggttcaagtgattctcctgcctcagcctcctgagtagctgggattacaggcacctgccaccacctggctaattttttgtatttttagtagagacggggttttgccattgtggcccaggccggccttgaactcctgacctctagtgatccacccaccctggcctcccagagagctgggattacaggtgtgagccaccatgcctggcctaaaatttgtttttttaaaaagaaaatttactaaaaaggactaatatgctcatacttactcatttttgttaaattctgtatgttatatatgtaaaagaacattttaaaaaatgcaacttttaagaacttggcattgggtttatgttgcctagaattgaaacata

SEQ ID NO: 17549 - DNA, 324 bp, Homo sapiens
ctgccagagtcaccacttgctgagtgattaggcctccgagaaagcaaggcggctgggggacatgcgaacacgacgagttcggctgtgcctgccttctcctcactgcccaggtgtgttctgcggccaagcgtccgagtgctcttatcttcagtgcctatcatgcacatacgtaacccacaaatactgactgaattagaattagggttattagggttatgacttagggaaatctttcaatgtccttggcttctatctcctcatttgtcagatgaaactgaaatacaagcaatgccttataaatttgttgtaatggggccatgcatg

SEQ ID NO: 17550 - DNA, 573 bp, Homo sapiens
aatatttatattgacagaaccatattttcccaaagttaatgttatttctgggtgataaaaatgggcatttcttgataggaatttggtcctgtatctaagattaaacttcctttctcacatacatctgctctgtgttgccatataagtgatgggcagtaatgacatttttgaaatcactcaagccataatcctgctactccctcattccttacatagagatggtcaccaggaatactatctagttgccaatccctaatacctctctaatcaaggcacttgtttctttctcaccgtcttagttaagatatcctcatcattcaccagcagtttttaaactccagtgagcttcagaatcaccctccagagcccaggaaaaaatccgaaggaccagcctctacccaggaggttctgattcaaaagggaaggacaggacaggcctggtggctcatacctgtaaccccaacactccaagaggtcaagtcaggaggatcccttgagcccagaagttagagaccagcctgggcgacacagtgagaccccatatctacaaaataaaaaataaaaaaaaaatta

SEQ ID NO: 17551 - DNA, 504 bp, Homo sapiens
attcttagtaaacatttaggagcaaatgtaacaggagtataatttaccttgaccaagtataattactcttaacccaagagtactgctcctgctttttacgcaaagacaatctcacataggtcgataaggggacaatttgaggctagttattgtgaagttatctgggggcagcctgggtggcctgtcactgggaaagcaggcaggtgagcgggggcggtgaggcactggaggacgtgcagtaggtagtaatgacagtaacagcgtggggtgagaaggaaaccagaatgaggaggggcagctcatttgaataaagtcaatacctgctattaaaataatcattttggccgggtgaggtggctcgatcacgaggtcaagagatctagaccatcctggctaacatggtgaaaccccgtctctactaagaatgcaattagccgggcgtggtggcaagtgcttgtagtctcagctactcgggaggctaaggcaggagaattgcttgaaccc

SEQ ID NO: 17552 - DNA, 606 bp, Homo sapiens
actggaagggcttggggaattcctaaaaactccatttacagtgtaggagatccccttctgttactcaaagttcccttcttacagagtattctgagacatttgtgattagtatccccttgagctttgtttctaatttccaccttctttcagggctcagaggaagaaaactgaatacatatacatacacactcacacacacacacacacacacacacacacatatatataatgataaatatataaatacacaagcatgcatactcaatcacacacaaacacacacacatcaccctgatactgttagttcagtggtcctagaatttaagtcatttatttgtaccacttgactctagtgtcattcattcctaattagtccatgtttaaacataacttcagatagaagacaatgaggattttataaaacataaggtaagatatatgtctgagaaaaaggcaggtctgacacaattatggatttaaacgtttttggttgattctggcactattagcaaaaataatacataaatttatatagtgcctactatgtagtaggatacgagataagaagtagcaaagatttgaatttaacagtttttgaatgaaaac

SEQ ID NO: 17553 - DNA, 599 bp, Homo sapiens
aatttatctatgtcaggtacctcatataatatttatctcacacatatgtaatgcttctcaaatttgcatgtcattctggtgcattctagtctactctgtattattccaatattagtaggtgtactgtcaaagtgagcagtgtttttatttttttagaaaatttcttatcagtcattgctagtctatagaaacataattgatctttgtctatccaccgtgtatcctgtataattcagtatttgctattattgtacatagtgaattacaggatgcatatcttgtgtcctgtatcattcaactgttttcttacacttaataaaaatgaccatatttctccattgaattacttacacatctttgttgaaaatcaattcactattcattcttataggctgtttttgtagagtccatcaaattctctacatatatgattaaatcatgagaaaaatattatacttcatgctttccaaaaggaatgtctttcatttgcttttcttgtctaattgcattggctagaactcccttacaatgttgaatacaggttcagggctataagtgcaggtttgttatataggtaaacttatgccatggagtttgtt

SEQ ID NO: 17554 - DNA, 580 bp, Homo sapiens
agctattggaaatgcaaactggcagaacctttcttgaggataactgacaattaatatgaacaaattgggggtacttttagcccaataattttagctataggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataattccttccttataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgccttagttctagctagtgatgctctgtctttacagatttactgagatgtttgatgattttccac

SEQ ID NO: 17555 - DNA, 316 bp, Homo sapiens
ataataataatggctgcatttgttgttgtttcccctgtcttgatcccctggtggatggtcattgtgcagtagaaacaagagataatcctgtgtgcttccttcttgtttcactgaatttggccccaagtctacctgaatgcccttaaccagagttctggaacacttctgacttaggaagcctcaaacaccctagtatgtttccagttttccaacagttgagaaaaacatgataaagccgcaaattctatatgtggaaaagcagtgctgtgtgaagaatggtgtacacctgagtcatttgttggcaacagtgtgatct

SEQ ID NO: 17556 - DNA, 318 bp, Homo sapiens
atttcttcaccagttcgcacaattgcataagggctaatctccacaataaatctcttatttcaaattgatgataatagttctgattatttgaatgaatcctaaccattacatcccacatcagaccttatgtaggtcttacatatgaccttggcagcacgggtagattaccactgctgtgatgtgattacactgattcaaagatgctataatattttatattctgtagtgctgaaattgagaattaccaaatctagcatgagcagtgaaattagaggcattttattactgcaatatttatttatagctacctatttatat

SEQ ID NO: 17557 - DNA, 288 bp, Homo sapiens
tctgtacagcagcagtcacctattttttctcgttgaatattttcgatccatggttggttgaatccacagatgtcacactcacagatatgaaacccacagatagagagggcttactgtacttagatggaaagtaaagaagaataaaaggagttagagagaggccggaaggatcttttagaaaaggtggttgggaaagagctttctgtgctggtagcatctgaccagagacctgaatgatacaaagaagctaatcataccaagatcagaagggacaatgaactcttaaca

SEQ ID NO: 17558 - DNA, 266 bp, Homo sapiens
tttagtagagacagggtttcaccgcattagccaagatggtctcgatctcctgacctcgtgatccacccgcctcagcctcccaaagtgctgggattacaggcgtgagccactgcgcccggcctcaggtttcccctttcaacccacaagggaggtccctaagaatatggccccaggctggccgcatcaaagaaggcttgggtaggaactgttacaagtctgactctccccctcaaagaccttattagcactgggcgtggtggctcacg

SEQ ID NO: 17559 - DNA, 419 bp, Homo sapiens
ccaaagacctgccgggactgacaaaaagcaacaaccgataaacaagagcaagctttagcatcttaaaaatacgctcgccagagtttattttacattttcaattgaagggtggcaagataaaagtgagagactcttgtacgcgtatgcctcaagctcagaagatcaaacaattcaaatataaattccagaaagatcttttagaacagggagaaacctagtcaaaaatgaaaggaaatttcccccagctacagggaaacactgattttcaaattaaaaggccccataaagtgctggggcaggatgactgagaaatgaccccactcagacgcatcattgcaacatttcagaacaccaaaaatgggtcgggcgcagtggctcacttccgtaatctcagcactttgggaggctgagatgggtag

SEQ ID NO: 17560 - DNA, 578 bp, Homo sapiens
acattgctaaggtctagatgtttgtctcctccaaacctcatgttgaaatttgatttctagtgctggaggtgtggcctaataggaggtgactaggtcatgggtgtggatcctttgtgaactgattaatgccctcctttgtggtgagtgagttcttactctcttagatcctacaacagctggttgttaaaaagagcctggcacctccccttctctcttgcttcctttgttgccatgtaatctctgcacatgctggctttccttcacctactgccatgagtggaagagcctgaggccctcaccagatgcaactgctcaatcttgaactttccaggcatcagaatcatgagccaaacaaactttttaaaaataaattacccagtcttgtttattattttatagcaacacaaaatggactaagacacgcatttattcatgaatgatagaatcacaatagttcatcatgaagagaacatggttgtgtagataatggaatgagcctgatgaaggtaaggatgttgatgattaagctggtgggacagacacaaaggtttgtgtgaggcttatgtcatatgttatgt

SEQ ID NO: 17561 - DNA, 491 bp, Homo sapiens
ttatggcacaaccttggggcatgcccactcttaggaggatatgaagtccgggaaggaggctgactcaacctggggatctccagagttgggggacacaatgaaagagaatcatggcaagaagaaagtttcagggcagacgggataggcaagaggatcaaaggaaacagaaaaaaagtgaataggccaggcatggtagctcacacctgcaatcccagaactttggaaggccgaggcaggcggatcacttgaggtcaggaattcaagaccaacctggccaacgtggcaaaaccctgtctctgctaataatacaaaaattagcgtggtggtgtgcgtctgtagtccctgctacttgggagtctgaggcaggagaattgctcgaacctgggagacaaaggttgcagtgagcctttgctcactggagtgcagatcatgccactgatctggttggagtgcagatcacgccactgcactccagcctgggtgacacagtg

SEQ ID NO: 17562 - DNA, 365 bp, Homo sapiens
ataaatatctcactttgtcacttgtctgccccaaaaaaaacataaaaatatcttcttggtctagaaagtaaaattataatgcttggcataatgtagacagaaatagaaattcccatttatcctttttctcctttgcccccacacttttcttccatgttcacatcagtacctaatgtcccagacatatggaattcattgtttcatgaatagagccaacacattctaactaccatgcatttagtcaaaccatctggccacctggaatttcctaccatcccccataaaatttaaattaaaaaattccactgttctgtcctctctgaagatgtccctgaacccttattgaaactcattgacatatcctt

SEQ ID NO: 17563 - DNA, 382 bp, Homo sapiens
cagcctcatgtgtacatatgtcaaattttccaattcatgtcataagaaagtctttaatcaacctagttcctcagcaaatagaacatgatttgtcttaactccatatggtttccatgtttggacatacatgttcctacattgcccattctcccctttgtggcctttccaacgttcctttaatctagtctccccatggtagacataaacatccttgggaatcttaatgacaacataaagggccagttccatggagccttactaactgccactcaggaatgaaaggatgagatttccctgtgagccgccatccttttgaacatagaattcatgtaaatgaaatatatctgagcaatgtatttctaaacagaatcttgtggtactg

SEQ ID NO: 17564 - DNA, 611 bp, Homo sapiens
aagtagggacagatcccttccccaggattactaaggaacaatagaaagaactttgaaactccatttccactctaatgatttcccctgcactcctccacacctgctgtgtaagaagagtgagaagaggaggggcagcaggaaccatggctctactggaaatgtggtgttagtgataaggtgttggagtgggaggtcacttccttccctcttatttgggaagggggtttgagccccagttctctcaaaggcaaatgaattgacagctccaagaaactggctggtataataagggaagggattttctttgcctacctgctcaactgctaaagttgagtcttctctgctgtggccaaaacagtgaaatgtggtgactaagtaccagcaagaactggactgtgtttctggagcctaggggcaagtatgaatcttgagtattgagataatatcttgtgtgacgtttctgaatgtagaggcttttgagagtagccacaagcaacttggaaaaggtccatggaacagtgtccttgagaagatgaaagcaatagaccccccatgttcatctctgcacttcttgaagaagaaggtagatgccataaaaaagcatggagtct

SEQ ID NO: 17565 - DNA, 619 bp, Homo sapiens
aacacaagtcaaagacaagtgtcaacatgctttcaaccaacattaatgaggaaacaagacacaaattctttttctttttttattttattttatttttgagatggaatctcgccctgtcgcccaagcttgagtgcagtggcgtgatctccactcaccacaagctcctcctcctgggttcacgccattctcctgcctcagactcctgagtagcggggactacaggcgcctgcaacaacgcctggctaattttttgtattatagtagagatggggtttcaccgtgttagccaggatggtctcgatcttctgacctcgtgatatgcccgcctcaccctcctaaagtgctgggattacaggttgagccactgagcctggccctgtttgttcttttacattaactttacaatatatttgccatgttctaaaaatgaatttaattggaattttattgaaattatatgagacatgatttagtccaagatgaacacacaacattattattactctttccatccagctatggcatatttctttgttttctctagttggcctttgtatcgctcaataaaatttgtggctctggtatatttcataataatcatacattatatttcattatt

SEQ ID NO: 17566 - DNA, 474 bp, Homo sapiens
ttacataacttaatgcataagaaaaaactgaagcaataagaaaacactctttaagcatattaggagggcaaatcaagttgagaaaacattttaaagagaaagtgtcctctgagatgacttttaagattagaggtttatgaaccaaagaaagagctggtgcctaggcatgacctgtgacaggctcacagcagtctttctccatctcatcactattggcacctggggctggataacactgttttgtgggctgtctcgtgcattgtaggatgtttagcagcacctctggccactgcccactaggtgccagtaattcatatacatacacagacacagacacacacacacacacacacacacatacacagagttatgactatcaaaaatgtctccacatgtttactaagtatctcatggggtagaaggcaaaatggccccttgttcaggattgagaacaactggtctatatgatgctaa

SEQ ID NO: 17567 - DNA, 330 bp, Homo sapiens
accagaaggatatcccaggcaacctcaaagacttctgttggtttcatcttccaaacctaccactttcatcacagcacctctgccttaagaacatgtaaaaatgtattacccacagaacaaaatccgaatgccttggcctcagctatacagttgcaaccttacttttccagtatgcactaaacaatatctaccttaccccttaaaatgtgaatgcaattttcttttattcaggtcatttctttctaaaatgtcttatccttttatttcttattcttcagtaacagccaccaattgagtacttctgtgtgtccaacatgccatgctaaacac

SEQ ID NO: 17568 - DNA, 504 bp, Homo sapiens
ttaaatatgattaagctcaggaagcagggcacatttaaacattaacaaaattttgtaattttaaaaagctggcatggaaatgagattataaaaaggtgcagccagtttctggttatgtacaggaagcagtgataaaattaactataatgaaaactacctgaatgtcttactcctcgggccgatttataatatgctcatgcttcttgctcctcagagagagaaacagctgctcaagtactcgtgtgtgtgcgtgtgtgtgtgtgtgcgtgtgtgtttgtgtgtgtactgtactgtacttttcttagctttcagaacaaagaaaataagtgggttgggtgtggctgcctatgcctgtaatcccagtacttttggagtccagggtaggaggatctttgagcgcaggagtttgagacgagcctgggcaacatggtgaaactccatctctacaaaaaatacaaaaaaattggccagacttagtggtgcatgcctatagtcccaactact

SEQ ID NO: 17569 - DNA, 357 bp, Homo sapiens
tcaacttcatacacaaattcactcttgaaagaagttgcattggatacgtactaaagttggcagagaagataaaacctgaattgtatcttgaggctatgtattggctttgactaagctgagaagggtgaggaccaagaaaataatgagattaaaatgacttgacccaagcaagctatagataaatgtgaaggcagcaggcaacaaagagcacagtcaagagcactgggtcagaaaacagtgttattcatgtaactacagggcatcattcagctgctgggaaagaaacctaaagaacttctgtcttctggagtcctccgctccttgctttctcctgtttgatccttgcaggcaggggta

SEQ ID NO: 17570 - DNA, 432 bp, Homo sapiens
gaaagtaatgaatgtgcaacatccttaaaattctcatgcactttcatttctattagaaagatattctatgggaataatatagacaatgttgttgtaaatgacaagaactcattctttatgactaaaaattacaacaattgaactcatggagacctagaaaatagaatgatagttgccagatactaggaagggtattgggtggggaaaggaattggagatggttaatgtgggtacaaaaacatagaatgagtaagatctagtatttgatagcataacagggtgagtgtagtcaacaataatttattgtatatgttaaaataactaaaagtataattgattgtttgtaatacaaagaaaggataaaagctggaggtgatgggtgaatatccatcattttccctggtgtgattattaagcattgtatgcctctat

SEQ ID NO: 17571 - DNA, 476 bp, Homo sapiens
ttgcagtgagctgagatgttccattccattccagcctgggcaacagagtgagactccatctcaaaaacaaaaatgaaaaacctgcagaggtactaataaagtttgcaagtccttggtctaagttgcaatttttttctccacacctgagaaatctgttaagttgtacaaataaataattcaaaggccaaagtaccacatatctcatcttaggtgatcaacaagttcacgccaagccccaacagcccagcgctaaggaaggccacagtgtccatgtgagcagtgactcccagctaaacttagactcagtatctgtccatacagaggatcaaacatcccagagttccacctcgaggaacttccctgattgaccccatgagtggactcctcggtaacattcccgctgtgagaaagcctgccagacctatcagggtcttcatgccagaaaggatgcagctccaggaagccctggctctcgt

SEQ ID NO: 17572 - DNA, 331 bp, Homo sapiens
gtattagtcttccttcttagcttctgtttctcccatctccttctttttattctttaattctttacttttttaatgaaaaaaaatcatagcaactaacatttagttgctatgtgctaggctctctgctaaatgctttgcatatcctagattatttaattctcacagtgatcctgtggggattgatggttatctccattttgcagatgtggaggctgaagcttcaaagtttaattagcaagtttgaagctttgtatgctgtatagcagtgagtctcaaaatgtagttcctagaccagaagtctcaacttcatttgggaacttgttagaagtgc

SEQ ID NO: 17573 - DNA, 591 bp, Homo sapiens
gtaggggggataactaaacctaacagagaattaggaagctgttctgaagtgagatcaaaaggcctcagtgggtaactcaataaaccagaaaggagtctaaattaacctcttaagttaacttagtttctctttgttactctttgcacttaagttactcttaagttactctttgcacaaaaatgcatcttcccctttcaccttaaccatcctaagagctaatgaaaaacgacctttggccaaaaggtccaggatgtgctccttattctggaaatgcaatagcgtctcacctcaccaccctgtccagtagttgtggcttgttacatgaaaattaacctgtcccttagaattcacatcatgcggctgggcacagtggctcatgcctgtaatcccagcactgatcacgaggtcaggagatcgatactatcctggctaacacggtgaaaccccatctctactaaaaatacaaaaaattagccaggcgtggtggcaggcgcctgtagtcccagctactcaggaggctgaggcaggagaatggcgtgaacccaggaggcagagcttgcagtgagccgagactacgccactgcattccag

SEQ ID NO: 17574 - DNA, 458 bp, Homo sapiens
ttgggagcaacccctggaagatagaaaaggcaagaaaactgattaatcctgagagcctccagatggaatgctgctgtgctaacaccttgattttagcccactgaaactgattttagacttgtctactctagaactggaagagaataaatttgtgttgctctaagtcactaaatttgtggtaattcgttacaacagcagtaggaaacaaactcaggaaccaacatgagcatgaagcatatgtggcctgctgtgctgtaatgaagatttttgtctctgacccaagactcttgtgtcttctggcagcatccatgagactatggcaagctgatttgcagaaggggcaaaatcttggaccattcacagttcttaacatttagttcataaaaatgatgatatagtcatgggtatttgtctgacgtttaagtatctttcaatcttctgatcaataaatctacttc

SEQ ID NO: 17575 - DNA, 455 bp, Homo sapiens
actgatgaaattatctgtacaccgaaattccatgacacctcccagtacttttgaaggtcaaggcaggtggatcacctgaggtcaggagttcaagactagcctggccaacatggtgaaaccccctctctacaaaaatacaacaattagccaggtatgacagtgggtgcctgtaatttcagttactcaggaggctgaagaaggagaaccagttgaacccaggaggcggagtttgctgttaggcaagattctgccattgcactccagcctgggcaacagagcgagactccgtatcaaacacacaaacactccatgacatgcagtttacctatatatcaaacctgcacatgtagccctgaacttaaattttaaaaaaagaaagtaaccatttttttaaaagtttaatatttcatctttcaaatttcttgaatattcatgtatttatgtaatacatacat

SEQ ID NO: 17576 - DNA, 456 bp, Homo sapiens
tatgtgaagttcttgttaagatcttttgccatttttctactgcattcttccttgttttccacatggattttttttaactttattacattaaaacaattaaccctcagccttcatgaactaacttttttcaggtcaactagtatcttagttcatgttctgctgctttaacagaataccagatgctaggtaatttacaataaacaaatttatttgtttcatggttctggaggctgggaagtccaagattgagaggctgcatctggtgagggccttcttgatgcatcatctcatgatggaagggcagaagggtaagacagcacacacatgagagaaagagaagggggcaaacttaccttttgccaggaacccacacccctgataagagcattgatccattcttaagggcagagccctcatgacataatcaccctcttaaaggtcccacctctcaacatt

SEQ ID NO: 17577 - DNA, 644 bp, Homo sapiens
gcactaagacattcatgagggatctgctttcatgatccaagcacctcccacaggccccacctccaacactgggaatcaaacttcaacatgagatttggaggggacaaacacccaagctatatcaaccagatacaagaaattttgcctgtggtttccctttgtagcaatgtattctttctaccctctcagtcagctattgtatcattcagaatatccctagttaataagaacttaaatttaccatttataatagaaagtgtaaaagaggaatgttttataatatttattatatttttcaatcttcattgtagtcgttaaaatacaaaagacgtttcggccaggcacagtggctcactcctgtaaccccagcattttggtaggccaaggcaggcggatcatgaggtcaggagatcaagaccatcctggctaacacggtgaaaccccgtctctactaaaaatataaaaaaaattagccgggcgtggtggcgggtgcctgtagtcccagctactcaggaggctgaggcaggagaatggcgtgaacccaggaggcagagcttgcagtgagctgagatcgcgccactggactccagccagggtgacagagcgagactctgtcccaaaaaaaaaaaaaaaaaaaaaaaaaa

SEQ ID NO: 17578 - DNA, 414 bp, Homo sapiens
aatgtgtaatctgctgctgttgagtagagagttctaggaatgtttattagttcctttgggttgatggtggccgattcttccataaccttacagatgttatgtctcccagttctactgattactgacagaacagtgtccttgactgtatattgactatatttatatatacagactcttctattattattgtggattaaaataattttgtagccgggcgcggtgactcacacctgtaatcccagcactttgggaggcctgaggcaggtgatcacgagatcaggagattgagatcatcctggctaacacagtgaaaccatgtctccactaaaaacacaaaaaattagctgggcgtggtggcacgtgcctgtaatcccagttactcgggaggctgaggcaggagaatcacttgaacct

SEQ ID NO: 17579 - DNA, 463 bp, Homo sapiens
gtaggggggataactaaacctaacagagaattaggaagctgttctgaagtgagatcaaaaggcctcagtgggtaactcaataaaccagaaaggagtctaaattaacctcttaagttaacttagtttctctttgttactctttgcacttaagttactcttaagttactctttgcacaaaaatgcatcttcccctttcaccttaaccatcctaagagctaatgaaaaacgacctttggccaaaaggtccaggatgtgctccttattctggaaatgcaatagcgtctcacctcaccaccctgtccagtagttgtggcttgttacatgaaaattaacctgtcccttagaattcacatcatgcggctgggcacagtggctcatgcctgtaatcccagcactgatcacgaggtcaggagatcgatactatcctggctaacacggtgaaaccccatctctactaaaaata

SEQ ID NO: 17580 - DNA, 490 bp, Homo sapiens
ctcttcaaccattcgtgctgagccctgataatgacaagtgggcactcccttgctctaaggtcaccaaagaccccagaggtggctaaagcttgacctaaggagggaggaaaagcttggacacatggaacatttcatagagaaggggaagtcaatgtgaagttgcaggtgggagtgcccatttgcagatcctacacatcgtatttcacaggtgcatactggggaaatctactacgtatttctacacttggtcaggtttggtttatgctaatattgaaaaatgtggccaggcatcatggctcacgcctgtatcgggagattgagaccatcctggctaacatggtgaaaccccgtctctactaaaaatacaaaataaataaataaataaaaacttagccgggcatggtggcacatgcctgtagtcccagctacttgggaagctgaggcgggagaatcgcttgagcccgggaggcggaagttgcagtgagccgag

SEQ ID NO: 17581 - DNA, 559 bp, Homo sapiens
caccatccacccagttaacatcaggttggccttgagaatagagtccactgttcacactggggtcctagaataggagaggctgcgccagtacaggatggggccccggtgtgcccgggatccgtccggccgagaagcagcaagtccctggaggaaactgcaccagggaagatggtcagaaagaccagcctgcatggggtgtgagctgctgggccgtgctcgccaccacccgcctctctttcctctgcaggacacagaaggctctgccatgtggctgtgctctctgtggtgtctggaatattttcttccatttcctcactactgaaatctttccctttactaagaaatgcctttaaaatggaaatgtctttgaaacctgggtagcagttttaataactcccttccaccccatgtctataactagcattggggtccccaggagcacccccactcagcgattcactgggaggactcctggagctcatgcccagcaggatggccatgatttgttacagagaaagcacgcggagcatggtcagcagagcgagaaggtggaggagag

SEQ ID NO: 17582 - DNA, 372 bp, Homo sapiens
tacggctgatggtggctatagctatttgtttagccaacatttatagcgctacgagccaatatactaagctgaaacgatttgctttcccagatactatggcagctagggatagccacatgacacagttttgaccaatgagatacaagagagagagctctgagaaagttcattctcatgatgtaaacaagtcccaatccctcatttcctggaaatagctcctgagtggtgcagagccatctcacacctatgaagacaaataaatgctaaatgataaggagtggtgagaaagacagaaggaacctggttccctgatggcactgctgagatgccacatctgcccaaaatgcttagattcccaagcgtgcatttctc

SEQ ID NO: 17583 - DNA, 467 bp, Homo sapiens
gcactctacatgttcttatttgggtatgcatacatctagtattgagcctatgtatttcaggaacaaaccaaccagcaaagagaagtggagagttggatgctgggagtaagagcagtttggtagaaaggttctgttctgttaaaccaaccaacattttccattgccctagccataatcatcaattccactgtgggagaatacagtgctgtactttgtatagctaggtctgaagtgcttttttctcacctacaaggagatgaagacactcactgttagccataatcacttttaaccatgagggaggtcagcctaaagacaaacaaaaaggacaaaagtgaagaaacagtaaagaaacggagaaggatccttgataaaaccaggtctcaagcctttcttacctctaaactactcagatacatgacctgatacatctcctctatttgagatgaatttcatcttagatatat

SEQ ID NO: 17584 - DNA, 405 bp, Homo sapiens
gggtgcaaaccagtgtatttcattacattagagattcatgtgagtatacagcccttgaaatgttaactagtccaagctgacatatgccatcagtataaaatacataccagactttgaagatgtacaaaaagactgtaaactatgtcaatttttatgttggtgaaattacaacatttttggtatagtggattaaataactttttaaaactaatgttattttatgagggaacattttggatctactcctcttaaatgtattaatagctaacaattactctgtaattctagcaccataataagcaaagtactcagcaaacattatgccttaatcacaacagcttgaagcagatattattacctctagtctatatgtaagaacagagattaaaaaaacaaacaaaaaaa

SEQ ID NO: 17585 - DNA, 565 bp, Homo sapiens
taattgttgaacatctttggaaagctataattttcacctgcttgcaacttgcataaagcaaattccatagcagagtgaagaatattaaagacctctattagagggagcctcttcagttacccaagggcacacagttcacttggatagtcagtctcctgggagtaattattttagattgtattccttattccagaagacaggtgttttcacatcacagatcttgggaaagtgtccatgacctctgtaggccttctatcctattgccctgaattagagaaaggaacgcaccaacagttctccagaatcaattctaattattaaaccctatttagaatttatgcttaattctcttatatagttattttataaatttgctcagtaaaccagtatatacagcataatccccttatttaatgtatgtcagggccaaatttaaatgaatattctcagccgggcgcggtggctcacgcctggaatcccagcactttgggaagccaaggcagacgaatcacgaggtcaggagatcgagaccatcctggctaacacagtgaaaccccgtgtctac

SEQ ID NO: 17586 - DNA, 650 bp, Homo sapiens
cgggttccgaagccacaggtcaggactaataatgtaaatcccagggaagggaccaccctgacagcatttcctgctagtgtgggtatttcataggatcctgcgcttctgtgatcaccagatgaagaaaacacagcgtaagtgaaaaccggggagagaaacacaggggcaagtgaagcccgcctctttggtaagaagtctggcagcgtagcctcgggaggtaccgggcttggggctccgggctgggcttcagcagtgcgggccgcggaaatggctcctcacagagcgcgtgtgcgccccatgctggggagggacgccatgcacggcttgctgcctggacacattcttcaattataatttataaactttttcctttgcttataaaaaattaatatatgctaaacttaaagtacataaaagtatacgtaggaaaataaaatgaagaagaaaacatacaagaaggaaaggcacagcaaaacttgaacatttaagagttccacagtaaaagattttgatttttaaaaaatacatatttaaggttttctaattaaatgcctcattggaaggcttttagggagacagcgctatgtatactttctgtcagcgagaggcagtaaatggaggaatgaataaagcctggccacagggaccat

SEQ ID NO: 17587 - DNA, 502 bp, Homo sapiens
ctggccttgagctcctaggctcaagcgatcttcccaccttggcctcccaaagtgctgaatttacaggtgtgagccacagtgcccagcccattgttttctaatatgattttatccacttaattatatgtgtgaacttctttccctcctgttacatgatagctacttcatcatcgcatgtggttgcctggttttgttggttccactgtgtgtgggcaaataccatatcatgcagggcctccttgtagataactgtagattattttcttgggttctttattagaaatagaatggctgggccaggggcgatggctcacgcctgtaatcccagccctttggaagatcacgaggtcaggagatcgagaccatccgggctaacatggtgaaaccccgtctctactaaaaatacaaaaaattagccaggcgtggtggcgggcgcctgtagtcccagctactcggaaggctgaggcaggagaatggcgtgaaccagggaggcggagcttgc

SEQ ID NO: 17588 - DNA, 517 bp, Homo sapiens
agtgaagagaaagaaacctgttctggagatatgaattgaaggttcataaactcatggagagatgtgagaagagaaaggagttgtgaagtttgtcccacaggaatctctaagatactaggaatcttgttatacttactttaagagaagtatataaggagtgttgtggaaggacagggaaatggaaaagttaatttcagccaagcatgtgggtgggtgggtggagcatgtagtggattgggaaaggctccctggaagaggtgacagttcagcattcatcatgcagtaaaccatttcaagcagggctggtggtattgccgagtgcagccaacccccgattttgatgtttggagcaaccagctgaggttgttgatgtggatatacaatctagaaaatttggcttgcctggttggtggaaatttttctttaatcacattctgctataggaaatgaacaggtttggggaattgaccaatcctaagtttcttcagtctaagaaaaacttcaaactcggacactg

SEQ ID NO: 17589 - DNA, 559 bp, Homo sapiens
aaccgtaagtacccaggtgtgtgctgcgttgctctgcccgtctgggatggttttcagcaccgctgctttgtgggagttgagtaagggaaaataaagagccaaaataaagccaagtctgagagtagcccccagaagcatgcactgtggagtcctgaggctgtagagaggccgtcacccagctttcaaggagccacattaaaacaagcttttggaaggtgatttgtcactgtttctcgagaacttttctgtttggcttagaaactccactttggggatttaagggaagaaagagaatttggacaaaagcaagagaaaagatatttatcggctgggcacggtggctcacgcctgtaatcccagcactttgggagtccgaggcgggcagatcacgaggtcaggagatcgagaccatcctggctaacacggtgaaaccccgtcaccactaaaaatacaaaaaaaaaattagctgggcgtggtggcgggtgcctatagtcccagctacttgggaggctgaggcaggagaatggcatgaacccgggaggcggagcttgcagtgagc

SEQ ID NO: 17590 - DNA, 526 bp, Homo sapiens
gtggatgccacatcttggaaagtgctgcctggacacacatctgtgtctctgcttccactgccccattccctggactgagcaacctcctgcccacccttcagagcccttccagacttcttctcttctctttgcttttcaggacacatgtgcttccaggcagaaggatggacccccaccacccatcagacacagcctagaattatctgtggatgaacctgccttctccatggactgccagcccccaaagcaggaaccacgtccttatagagggcctggcacacagtagggaactggggtggggtactgccatgcagcaggtatgtgggcaatgttgaatggattaaactgtacttggctagggtggtggctcatgcctgtaaaccgagcactttgggaggttgaggtgggaggatcacttgaggtcaggagtttgagaccagactggccaacatggtaaaaccccatctctactaaaaatgcaaaaattagctgggccttgtgtcacacacctatagtcccagctacg

SEQ ID NO: 17591 - DNA, 561 bp, Homo sapiens
gggctctgaagtctttttatttcaacttcttggaatcaccaccttgttaatgaacatcaaaatcttttgtgtcatttatcagattaattactttttccataaaaagagtgagttgagaggataacaagaaactccctgtccctgcttcatcctgaaaacaggagaatcaatatcttaaccctgtttttgagagatgaatgggtaggtcaacattgcttggctatttgtccttccatttgggacagattaccactgcactttcccctcaatctctagaatcatggcttatagaaaacaattttgtactgaattactaaatgcatcaaaactttattagacttattatcaaagagcatgctcagatgtatctattataaatagtaataaaaatataaaaacctaaaaacaatattataaataacagagaaaagctatgcactgttatgaaagcctttcatatttagggatatcaggtaaggtttcccttggtggggaagatgaagagcaaaccaaaataagagtaagagctggctgggtgtggtggcttacgcctgtaatccc

SEQ ID NO: 17592 - DNA, 628 bp, Homo sapiens
aaacattcatcaatttggcccagacaaaagtattcttgcttgctttaggatttactcaacttgttctaattttaaccttctgttgctttaaaatatggtaatggatttgttggttgttgaaggaattgaatgtgattgtggtgttacatcttttcttatattaaaatctttaattctaaaatcagtatgtcacatacattaccacattaacacatcaagactggaaactgatgattggaacagagacaaatgtgttggtgagttgtggtgagctgtcaggggacttatggactatagctgtcctatagtctataacgagccagctgaagatggacagaacaggaacaatgagaaggtacatagaagatgcagatgctgggtcaaattggtggtgataaaatctggtcattatctctttgtagcaagtaggggatctttcatggtttgggcaaaaattttctgaatcacaaagaagtcccatgtaacaatcgtgagatgtatcattctatatatttattctctgataattatgtcatgtctatcaatttctcaccataggcatatataaaaaataagatgataaagtaatggcattaggtgagttaattagcatactaaaatatgcacg

SEQ ID NO: 17593 - DNA, 518 bp, Homo sapiens
gagcagagtcatcctaagtgaacacatggaaggccctgaaaaattaaacttgggcacaaagttctctgcacattctcactggagaggcaggaacatttagccaaagtcaaagaccagggcaggggtaagaggaggcacccatcctagcctcaaatctctgccctgctactcaccagacacatgatcttagacatagaaatattgacaaattagctaactgtgccctggttttcccatctgcaaaatgggtataatcatattacttacctcaaagtgttcttggaaagatttcatgataatagcactcactatgtgcattagttgagcacttattaggtgccaggtggtattttaagtattttttaaaaatatatcaattcatttcatacatgaaaatcattttatgcagggtatataacaagtgcttggtagatgttagttatcttcaagatacctgtcattattagtgaaaagaaaaggtaggccgggcgcagtggctcatgcctgtaaccccaaca

SEQ ID NO: 17594 - DNA, 660 bp, Homo sapiens
ttgcagtgtcttcccatgcagcccacctttccccttagcccacctttcctctggcctaaagagtaagatgatatttctattagagacaggaatttacttggcctaactttgaaatggtccagtcagactcttatgaatggccatttgctaatttatcagttaagttcaatatgtttatttattcatggtttcatcctggctgttttcaaagcattattttgtttttgtcaatatttcctacttgacaatgtcctaaattgaaacaaatttattgctcccattacagagaatgggcaagtgccaaagcatttaatggggccagaggttagtgcaaaatatctctttcaggaatatcaaacccatcagttttctttcaatggcaaatgtccccaggctataaaagaactgaaagacttggcaaccaggtcatggttctgcttgagccattaggcaaatatccaaggtctcagcttcccccatttttaaaggaaaaagcaattaggcaaagaattatgaataaggaaaaatgcagtgagaacttaaagtgtgtattaattccttgatggctcataaattattaataggctcaacagtaacctaacaacactaccacctctcaatttacctactaatttaagcaggtataaatgagtcagctga

SEQ ID NO: 17595 - DNA, 455 bp, Homo sapiens
gaaatgatttgacaccatcagttacgacaatatacattatgtagtttggcagcattgtattttcttgagcaaagactcagcgcagggcctggggttaactactccaagtggaagccaggctaatgttaggtcaagtctcttagcacagtgtttaggcaaatcctttttgcttcagggaagttcacagtccctcctcttgttcaagagaaagaatgaatttctttctcgtagaataaatatagttgttgcactccaaagtcctcaaaagaaaaaagttcagccattgtttatcatcattgtgcaattcaggaagagtcaaggtggtaaatgcaacaatcgaggaggtttggtgtactatcaatggtggcacaattgtctcataagaatagagatgcacttggtgggtcatgcctgtaatcccaacactttgggacgctgaggtgggtggatcacga

SEQ ID NO: 17596 - DNA, 434 bp, Homo sapiens
gcagtgagctgagatcgtaccactgcactcgagcctgggcaacagagagactctgtctcaaataaataaataaataaatagatagataaataaagtagaatcctattttatacatttatctgggccttactttccacctaacaatatatgatggaaatccttcaaataaactgttatagatattacaccttcattctagcgactgtctagtactcctgtacacagatcttcttcttaaacagacagatttaacttcgattttcttgccaaattccactaaattacagtaaatggattgttttaaaggcataaacccacaaagagaatagaagaaacagcagcgacacagtgaaatggcatctaacttagcagactttggaaagttgtaggaaagccaagatcagtctggtatacatcgcagaaccccaagaagc

SEQ ID NO: 17597 - DNA, 386 bp, Homo sapiens
attgcatgagctttgtgatcctgcttcatatcccgcatgtgattttttttgagttccacctttatatttaatagttttcatttacacagcattcctgtgtgtttggaggagaagttcactctgctatgtcgactggacatctttatatttccagtgtcttcccaaatctgtgggccatgcttgcatctcctgaattaatcatttaataaatgaataaagcaggtgcgactaccctatgagagtcacaatgttggtgttcattgagagggtggacaatagaccccatgacatttcaggaaaaatgataagaaataatgggaaatgggagagtataaaatagcagacaacccaacactaaggaataatttctgttacttgcataaact

SEQ ID NO: 17598 - DNA, 426 bp, Homo sapiens
ttgggaaaggcatttcactcttaaatcctcaattcctttctctgtgaaataaaaactctatagaaactacataaaactaccctagataattttgtctattagaatctcctaaaaatcttccaacttgctgggcgcggtggctcaggcctataatcccagcactttgggaggccaaggcgggtggatcacctcaggtcaggagttcgagaccatcctggccaacctagtgaaaccccgtctctactaaaaatacaaaaacttagctgggtgtggtggcgggcttctgtaatctcagctactagggaggctgaggcaggagaattgcttgaacccgggaggtggaggttgcagtgagccgagatctcgccattgcactctagcccgggcaacaaaagcaaaactccgtctcagaaaaaaaaaaaaaaa

SEQ ID NO: 17599 - DNA, 136 bp, Homo sapiens
ataatggagacagagaacccaaggaagccaagcttaaaaataaaaataaaaataaaaactgaaaagagacatcagcagctgcatactgtagagacttcacagatttagtccaagcaagttactaaacaagcaaaac

SEQ ID NO: 17600 - DNA, 407 bp, Homo sapiens
atgtttgagaaagagcgttactctgtcgcccaggctggagtgcagtggtgcagtggtacaatcttggctcactggaaactctgcctcctgggttcaagtgattctcctgcctcagcctcctgagtagctgggattacaggcaccgccaccacaccaagctaatatttgtatttttagtagagacagggtttcgccatgttagccaggctggtctggaactcctgacctcaggtgatccacccgccttaccctccgaaagtgctgggatgacaggcgtgagctaccgcgcccagcctaaaaatttattttgaacaataatttgcagtgccctgaatacacaggctcatgcatctgtactttgtttagatgtttctccgtgcttagaatattcttctgcttctacccac

SEQ ID NO: 17601 - DNA, 408 bp, Homo sapiens
tgatgttatgctatggaagctaagcagcagaacctgggcagacagccatggacacatggatggctcctcctaccatatttgcttgaagtaaatgagattcagatctgagcctcagaggaatttcaaattgcaccctgccatggacctttagcctcttaccttccccaactcccccctctccacccaccaacaaatccattaaggtaaaatatctatagtgtttttaactgttcaaaatagttttcttcaaatgtgccaagagggcatttgcttaggcagattaagaaatgggccaggcatggtgactgacgcctgtaatcccaacactttgggaggtcgaggtgggcagatcacgaggtcaggagatcaagatcatcctggccaacgtggtgaaaccctgtctctact

SEQ ID NO: 17602 - DNA, 563 bp, Homo sapiens
ttaactggaaaacttgtagttattcaacaagcaaactaaaagtgttggcagagatgtaattctaaagcacgatcccacgcattccttcagtattacagctgttccttgtttgtttaataatagaactgatgagtagttaatttgagaggaaagctggtgcaggtgtagtgttatttagatgtcatggaggacacatgtaacatctgcagctagctatatggtaaaagcaaaacagaagttaaaatcagccctgtgtcaaatctgcatagttttaggcttcagggagtttctctgtatgttgaggcagaaagtttagtagaattccaagggaataaaagaggaaccaacatttgtagattttgccttctgtggcggaactcattcaatcttcaggagaacacttcaacggttgtatttgctccagtttacctagatgaaaaattgagacccagaatccatgcttttctttcctggttacacattagaatcaccaatgtggcattaaaacacacacacacacacacacacacacacactgcacacccattaggatggctactatc

SEQ ID NO: 17603 - DNA, 551 bp, Homo sapiens
tttcccacagtggtaaaatcttactctaaaaaaaagctaaatttagaataattacaatgatatgcatgttaagtcacttaggtataatctacacagcattaaaaaagatctttggggaaagttcaagaaaaatctctgaaaattaataatgtgtgatgtttttgctaaacattttaacagactgatattccacgccattgtgagttaatttatatcctgagcaccaaaaatgttgtcattgtaataaatgatgtgtactctgtaggacaatataaccacagtgttcagtggaattaatagcagcgtttgtacaacgtgtgaaaaagagaaaggaaagtgaaagctctgtagcctttattcatagaaaggcaatttttaaaaatcacccagaaatgtgcagccttgtgcatctattgtttaatccaacactctaccaaaaatagttacacagtgccaggccctatgcttggggctgggaatgtagcacatagaacacagttctttccgaactgcaggtagccgtgaagtcaattaaagagtcatcattggca

SEQ ID NO: 17604 - DNA, 596 bp, Homo sapiens
atagaagagtagggaagaaggaaaataaaagtggcttagtttggagcataattagcttgagggctgacattttaaatcctccagtagggagtttatgactgaaacttaatatgagtgatagttattgaccaacactcaaggtttgtttatttaaacagccaagaaagccaagagaatagaggtatacaatacaggagaaaagtgaagaaactaatttctgcgactcaagtatttaactttcagcatgtcatttaatttctgtacttcagcttcctcatttttaagtgagggtaataaatctagccctgtccgcctctgagcagcgttctgatgaacaaaggagataatgcatgtgaaagcactttgtagattgtacagcactgtgcagctccaagttgtttttagtgcaaaataaaacataaaattttgaagaataatttatctatagattctgaaaaagaaacaaagacagcagcataaggttgccaaggtagtgcccaggtaaattctatagagtgtttctgggaaaggagatacagttgtatgatcactaaattaaataggagatcaagggaggtaagaactgagaatttatc

SEQ ID NO: 17605 - DNA, 621 bp, Homo sapiens
ccaagtgggagcttcaagttagtcctgcctcatatctgccatttttcctaaatggcaatacttttatactaaatatataagcatatgaatccactacaatactgactgcatagtgaatttatatcttcttctcaatatttgtcatcaattagtgtagacagctagtgggcctgaaagtaccgagctaagcttttcttagtttgaatggcccttaccaatgagtttaactacatccagtttttgttattatgtaatgttacattgaaccattttaggttataatgatgaataaagatatgcaaatgatgatgttgaaagtgccacaaaagtacaccaaggaggccaggtgcagtggctcatgactataatcccagcactttgggaggctgaggcaggtgggtcacctgaggtcaggagtttgagatcagccgggccaacatggtgaaaccctgtctctattaaaaatacaaaaattagctgggcatggtggcatgtgcctgtaatcccaactgctcgggaggctgaggcacgagaatcacctgaacctgggaggcagaggttgcaatgagccgagattgtgccgctgcactctagcctgggcgacagagtgagactctgtct

SEQ ID NO: 17606 - DNA, 562 bp, Homo sapiens
tgtatattcatctcaggcttgtactttactattttcctatcttcctcctctttgatatgtttcatgttgttgttgtttttttatttgcttttctagcgctcattttggcggctcatatactaaaactggaataatataaagattagcttgtccctttgcaaggatgacatgaaaattcatgaatcttccaaacacacagccaacatcacactgaactggcaaaagttgaaagcatttctcttgagaactggaacaagacaaagatgcccttctcaccacttccagtaacattgtcagagcaatcaggcgagaaaaagaaatgaaacacatccaaataggaaaagaataagtcaaattatctctcttcactgacaatataattctatacctagaaaactctctaaattctgccaaaagactcatagacttgataagtgactttagtaaggtttcaggatacaaaatcaatgcacaaaaatcagcagcatttctatttatcaataatattcaagctgcccccaaatctagaaatacagcaagcaaagtagttgaaagatctcta

SEQ ID NO: 17607 - DNA, 475 bp, Homo sapiens
gtaaatagaaaacagctgtctatgaaatgggtcagagcaaatatatttggtcaggtgctggataaatagctcacagactgactaaaatagtcctaaacaaaacaaaacaaatctctaagccacacagacccaacctgaaggctttcaaaggcaaaaaacaaacaaaacaaaaaatctaatgtatttgtgactcattcatatttctattaaatgtgtgtttcctaaagctttattttcacaattagagctcaccaaagcaccaatcaaccaacccaaaactctaagcctggaagaattcttataaactatgctattccctggtgccctaaaccccatggtggtctagagactctggaaccttcaaaatctcagaggacataattgaatgattactgcctcaacagacaggaggaaagtatgacaggttgataaccaagtctgatatttcagataataatcagtattcttttaatga

SEQ ID NO: 17608 - DNA, 267 bp, Homo sapiens
aaaactttaattttaggaaatactttgattttaaagatatatatgaaaaatgatactctgcaactctgactccaaaatcacagggaaacaaaagactaaggtatccaaacacacaggccaaaaataagccccttagtgtcataatgataaacataatacttaggacagtagttaactcaaaggaggatataaagaaatgagtttgaaagaagcttcaaaagtaatggtcatatttcatttctttaattggatcaatggctcatgggt

SEQ ID NO: 17609 - DNA, 419 bp, Homo sapiens
ggattttgctgttaccgaggctgggctctaactcctgggctcaagggatcctcctgcctgagcctcccaaagtgctgggattagagacctaaaccactgccccggtccaggtctgaaactttttaaaggagagtaccacttgttgacccctttccttttgatactgggaagggagtgcttaagtgggggatgcctcctttctcaatgcaaagaggagactcttactagtatatttaggggtaatggttgccttttgccaaatgaaagtttgtgtctaccgtctggggagacataaacacagccaccaataagcactgtggttacagccagaaaggcctggtcctgaggctaattacactggagaagtctgaatgtgccccagggactggagaagtcccaccttcttcttgactacttct

SEQ ID NO: 17610 - DNA, 448 bp, Homo sapiens
ctaccaagtgacaaaaaaatctcaagagagttatcaagagagggaaaaagagagaaaacactaatcagcaatgaaccaattcctctcatatgtatgtaaatagataaatcagtgtataatgttaaataatgatgcagcaattaaaaaatttaaaaatagtctgggaccaaaagaagtaggggattttgtcaaattcaataaattgaggtaggaaaaggaataaaaaagtaaaaaccttttccaaaggtaatttagagtgaagcagtaaagatattttacaagtttcatcttttgggcctgagggaaggcacattgttggaggagaaatggtggctgtgttgttttcatgtaacagttgagaataagtactcaatgatgcgtttcattaggatcctattattaacactttgtagaaaagcaaagaactttcaaagaaacaaaggagata

SEQ ID NO: 17611 - DNA, 415 bp, Homo sapiens
tccaggagagggcctggctctcttctcctgctgttagcacgatacgaaaataaagtacaggaaaacccacttggaaaactgagcctggctgcctggcagctgtttggtgagaacatagggaatgttctgaagtcctggagctgtcaaccaaaggaaaaggaacaaagggcagaatgagacaggatgtgaagggcttctgtgggcacagaagcagtagggtaaggaaagaggatgggcctgctcttgactggtatgagaggcatccaggactcctggagcagctaagcgcaggtcctcagctccagcacatttattacagcatgttagatgggcgggaccctgttactttaagcctaccatggcacacactcacaaaagtctctttttaagaaaaaaaatctttttttaagatagc

SEQ ID NO: 17612 - DNA, 568 bp, Homo sapiens
cttatatatttaaatcaaaatatatattcatttttcatgttagttaattttcttcttctgcatgatttttaaagattgtaaaggtcatatgccagagtaatttgagggtgttgaagtgaaagaagctgatgttgagatacacatagctagaaacatttagaccatgagatacacaaaaatttgatagaaacatatgacttcttttgcagatctgcagattactaaggttcctaagttaaagccagccaactccatgacacacattttgaataaggaaaaacaatagggtaacttatgatagtcttgacgactgcttgagaatggtaagaatacagcgacaaaatacccccagtatgttaaaaagtggctatctttaagttttaccataccatagtacagaaactagatttaaataacgcccatacaaatataatgtattcttaaaacactaggttgggggaagttgtggagggcaacccctgaaagtaaatatttttacaaagccttttccctaaaaaataggtataatgcttttaaagttaataaaaccatatgaaaatctagtaat

SEQ ID NO: 17613 - DNA, 463 bp, Homo sapiens
gcatggatattcatgacagctttcatttaaaaaaaagaagcttcaggagagtcattaagagttaggagcatattaataatagaagacctaaaatccatctcagttcaagatagatcaactggacaaaaacttcagtaaggctattgaggacctagattaacacaactgaaaggtagatcttagggtcatctattgcatataagagaatatacatttttgtaaatgcgcatgggatgctcatgaaagatgattattgaggtacaaagaaaactcttaaaaatttctcccaggccgggcgtggtggctcacgcctgtaatcccagcactttgggaggccaaggtgggtggatcatgaggtcaggagtccgagaccagcctgaccaacatggtgaaatcctgtctctactaaaaacacaaaaattagccgggcatggtggcgtgcgcctgtaatcccagttactca

SEQ ID NO: 17614 - DNA, 122 bp, Homo sapiens
attaatcttgccaatataaaccctttattttaattaagatgaattatttttcttccagttattggctcctagagataagtgatgactatttaaatttctgaaaatgtagttgaaatgagtat

SEQ ID NO: 17615 - DNA, 528 bp, Homo sapiens
tgttactttaacccataaccatagatgcattggttgctatatttgtctccaggaataggaaggcacaaagaaattggaccacagaggcgttgtgggggacagtggctagctgctatgactgccaatgtccatttcccttccttttgtaaggcatcccaatttcttctggggactgaacctctgaccctctcaattcacaaacttctcctggaattggctcccctccagctctaaggaagagcatgtgacttaggcctggcctatcagagcaccacattcccctggccaggattagtttaggaacgtgcatgtgatctacttcagactaacgagagtcacactaagaatatttgttggaaggagcgaaacactgttcttttatcactggatttgaacatgaagatgaaaccaaaattcagatgagtagggctgaaaggagaggcaccaggtcctggtgacactgttggagcccctacaacaacgggtgctgcaactagcccttgagccaatgaatactcaccacccccc

SEQ ID NO: 17616 - DNA, 508 bp, Homo sapiens
ttttattaatggtcatctttaaaatgtcaattaatgccaaagctctgcactgtgataatgcaaatctataaagaaactagcttgacactttatagtaagtagggcaaaaggaagaagcttttatgtttttattatacataactgaatatgacagaaggaaagaagaaggttggaaaccctaatgttttgagctgtgattgcaaacccaatttaaaaattaaaaataaataaataaaattctgaatttaaaccaacaggcttttctcttaggcctctacatttccacaatataatactggctaccatgggatgataaacaatttaaattactatggattgaatgctactgcaaatatgagtctttgtactacaaaaccaatattacctattttaataccactggtgaaagagaaatgccattgcatgaatgtctgctgcgcattatggagaaggctttagatcattaaattttcatccaccatcctttaaacttttttaaatgtttttc

SEQ ID NO: 17617 - DNA, 327 bp, Homo sapiens
ctcagcctcccaagttgctgggattacaggcatgtgccaccgcgcctggctaattttgtatttttagtagagacggggtttctccatgttggccaggctggtctcaaactcccgacctcaggttatcctcccgcctcagcctcccaaagtgctgagattataggcgtgagccaccgcacccggctaccttgacattttctaacctagagtcaccttaaccactgtcgtctccctctggaatcccctctagaagatccccttaatttataccactctgtctcctggcattggccacattcctgtcttcagatatcccagggactcacc

SEQ ID NO: 17618 - DNA, 373 bp, Homo sapiens
agacatgcagcctttatacagcctccaccctgctagtgttatcacgattccggagttcattgaggcctcagctggactaaagcaacatgctccagtgcaacatctggacccttgcagacaaataattgcactattctttacatcctgtctaagttcccttgtcaaatctgtgaggaaggcctccctgttctactttcctcagccatgctctccacacatagaaaaggacaaagacttagctacttaggaacatcacttggctgcagtgagctatgatttcataagtaatacttattcattcactattattaaattctagcattttcttctatctgcttcagaatttcgtttattaaaaaataaaatataggct

SEQ ID NO: 17619 - DNA, 618 bp, Homo sapiens
tgcatccaattttgaaaaccatggccttttaggaataatctttgaaggcaacgatattcctcaagtcagaaaatgtgtgccttgccttttgctgttcatgttatattactcaaaatataaacaggagatcctacttttagtagattaattaatgacactaagttaatttgcttctcagtgttttcttcccattttacctgtttggttcaggaccttttatgaggctattagcttgattttatcacattgacattcctgtatttattgccaaactaagtgtataggtttctagctccaaaacaaacaaaccaacacacaaaagacaaagaaagggaaagatgaagaaaagataataactgaaatgtactcatacatttttcaaaccagagaatgatcaaacaaaaataaattagtggaaactgaagaaacaaatgagaagggaatgagtagcacatatattctgtaatcagcttgtcatatacacatttgaagaaagaatatgtcaggtatatatttttccaagtcaatatacgagacgtaaaatgagaaatggccaacttcataaaattacacatttcttttccattataagaatactggaataaaattaaaagttag

SEQ ID NO: 17620 - DNA, 391 bp, Homo sapiens
gagtaaataggtcagccaagttaagagtataaagtgtcaaaagcaatgtttgttgagctgggcaacatgatgacttaaacttgtgtttactctttttccgaaggtttggttgtggttgtacttttaaacaacgttttgatggtctaagaattccaaatgagagcagtttaaagaaagaaacaaaagaggaaataaaatagatacgttgtcttaatgaatactggctattgcatatatttcaaacatatgtccataggaacttttcagattaatttatttgttctggaatttcagcgattacttagaaggaacaagatttcatttaatgtaattaattacattaagatatagggaagcataattttctgaagtatttagcagaccttataat

SEQ ID NO: 17621 - DNA, 413 bp, Homo sapiens
ctctttttttgtagagatggggtctcgctatgctgcgttggctggtttggaactcctggcctcaagggatccaaccattttagtctcccaaagtgctaggattatagacatgtgccatgatgcctggcccaaagacatctttaatctgaattgcacttcattaactattagacacatttatgtttattatgtaatgctttcttcacatccatactgaagaagatccagtacgtattatatctattttatagatgaagaaaaacaaagcttacatgttacagtctttgtagaacatagactgtagtgggggacacaacttttaagtaaatccacacctggataaatatattattgtaaactttcattcgtgtgagggaggtaaagagcaaggtgtttaggagataatatcaagg

SEQ ID NO: 17622 - DNA, 440 bp, Homo sapiens
agaagtgtaactgacagataaagtgctttaggtatgaatagacagggagaagccagatggaaaagcagagttataaatacatatgaaacttacaactccacaagataaacatattctttcttaacatctaaggatattttcaaaatatataatcattggtcaggcacggtggctcatgcctataatcctagcactttgggaggctgaggtgggcagatcacttgaggtcaggagttcaagaccagcctggccaaaatggtgaaagcccatctctactaaaaataaaaaaattagctgagcttaatggcgtgtgtctgtaatcccagctactcaggaggctgaggcaggagaattgcttgaacctgggaggcggaggttgcagtgagctgagatcccgccattgcactccagcctgggggacaagagcgaaactccgtctc

SEQ ID NO: 17623 - DNA, 83 bp, Homo sapiens
tctcacctataaaatgagaaccacatgtcaacttcatgaaattgttgccagagttaaattcacaaagataattaaaaatgact

SEQ ID NO: 17624 - DNA, 435 bp, Homo sapiens
atcgcctggggttaggagttcaagaccagcctggccaacatggtgaaaccctgtctctactaaaaatacaaaaattagctgagcgtggtgggcacctgtaatcccagctacttgggaggctgaggcaggagaatcgcttgaacacgggaggcagaggctgcagggagccgagacagcaccactgcactccagcctgggcaacagagcaagactccatctccaaaaaaaataaacaaataaacaaaatgccaagagtatgctgatgtaaaggtttaagtagaaactctggttgttttactcatgtgtgtaaaccaagcccccaagatgtgccaccaaaatacagagtttgtgggtggatcagcctgtacctgagccccctctgccacactgacatgatcctcattaaagaaagaaaagagggggcaggtggatcac

SEQ ID NO: 17625 - DNA, 543 bp, Homo sapiens
ttcacctaagcgatgaacacacatatttacataaaggatgttatttaaaattctatgcagaggaatgtttccaattttgtatgctaatgtaaaataggaagtaatattcttttacaagttcagttccactggaatcagatcaaaatcagatgagctcaaggtcacataataaatagcaaaggccaaattatctcataaaattgtcgaagcatttatgttaaacccatccctgcatgaggaccaaagcagcacagaaatcaggaaaaagttctacttttcaactcaagaacactattactgatgcactgacacacatggaaatgacttcagggcattggcatagaagcaacactaacttataagctttaaaaatcaagagtttccaatgcagaccgacatctattaaaccctgtcattgtgctcagttagaaaccttgatacttctgtaaaggaaaatcaaaccacagggaataaacattccaataaacactttgaaacaccgaggattatggaaatatttcccaggtttgtaacctgatggtg

SEQ ID NO: 17626 - DNA, 601 bp, Homo sapiens
tgcaccaaacccttctggaggcggcgggctcctgggtagcaggggcctggggacaggaagacgccctctccagggtcacagcccaggtggatggggcctggcatgtggggcctaactctgccccctccccatggctcagccaccctcctggctgctccctgctgcccctgcctgtgaccccattgtgatgcccctcaactgtcctcacccagctggcggtgagccttgctcacttcctccctcacatccgtgatgcccaggcagtgcctgggacagagaaaagcctcaggacgtgctaactacacagagtctgtgtattaatatgaccataagccgggcgcggtggctcacacctgtaatcccagcactttgggaggccgaggcaggcggatcacgaggtcaggagattgagaccatcctggctaacgtgggtgaaaccccgtctctactaaaaatataaaaaattagccgggcgtggtggcaggtgcctgtagtcccagctacttgggaggctgaggcaggagaatggcgtgaacccggggaggcagagcttgcagcgagctgagatcgcgccactgcagtccggcctgggcgaaagatg

SEQ ID NO: 17627 - DNA, 621 bp, Homo sapiens
catctatgccttcaagattgtatttgttttgttttttggcagtgaatatggtgtgtgtgtgtgtgcatttgtgtgtgtacatgtgggagagagggagatagacgagagattgaaaatgtatgtgtgttagcctacttggtattctctgagtttcttggatttgtgatttttttgtctttttttaatttttcaaaattattgggtattacctcaatgctcagataaataattttaaatgtggaagcatctctaaactgaggaataggcagaagctggaagagtttcgggtgcatgctagaggcttagattgttataaaaagaacttttaaaggcgattctggtgaggactcaggaagaaaagagaagagctaaagacaaagcctccattttcttggagaatacaaaagtaatcatgaacagaatgttggcaaagacatggatggtcaaggtcattgtcatgaggtctcagacagaatcaagtgatattattattggaagctagaggaaaggcaatctctgttacaaagtggcaaagaatttggcagaattctgttcatgttctagtgttctgtggaaggtagaacttgaaagcaataaaaatgtatatttagcataattaaa

SEQ ID NO: 17628 - DNA, 547 bp, Homo sapiens
atgcaaaatggtatacacaagcttcatctatgacatactcttgcccctcccccaaaatgtttacactgaatcaaatcaagcttcttaggttagacctgcactttctaatataatagccactagtcgcatgtggctactgagcacctaagaagtggctagtcttacttaacatgtgctgcaaatgtaaaatacaaactggatttttgaagactttgtgagaaaaaagttatgctgattccatcttgaaattatattttgggtatattgagttaaatgaattattaaaatgaattttacctatctttttacatttctaaatgtggttacaattttaaaatcacacattaggctttcatgtgtggttcccatgtttctattagatagtactgctacagtttgcaggaaatctaggggatgtggaaataagtgaaacaattgcttcatttataaagtgagataggggtctcactatattgtccaggctgggtctcaactgctggattcaagtgatcctcccaactcagcctcccaaaatgctgggatcaca

SEQ ID NO: 17629 - DNA, 550 bp, Homo sapiens
  misc_feature 335: n = A,T,C or G
agtttaattagtttactgaaatggagtcttcatagtggctaagtgtgatatattggcttttgtcacttgaaataaaaaagaggtaattagtccctactcaaatatattgttttctcagaataggttgaattttattttaggcagtaatccagaaccaacttccaactgatttataaatgctacaagaaaagatcatccttcagacaacttaagaatccaatcgcgtaaaagcaggattctcaaagggagaaacatttcatcccccaggggacagtgagccaagtctagagacatctttgggcatcacagtgtggggagaactacagttggcattnctagagatgccaccaaatgcccaacaaagcactcagcagtccccacatagagaatgatccagcccagcgtccacactgccaaggtggagaaaccgtgatataaacagtaaattcagtatccaaatgcctacgccaaccattaagggaaagtgtgcccactgttcctgacttgcaaatcccaaatccatacggtgggacatttgcatttttcctac

SEQ ID NO: 17630 - DNA, 546 bp, Homo sapiens
cattcttttcagcttggatatggagagtttcaaaaagatgctacttgcccagtaggtgtcattaatccatcaaacaaaatttacagaaggataaattatgtggagaatatatctatgcctggaatttgagaggaatgatgcgaattatgcaggcaatgtagaagactgtccaaatggaatctccttccacaaatttgattcctcaaagtagcacatatcctttttcagactgctgagtttttctgtaggaatgtaaatgaactctatgcaaaatttggggaatgtttcagtaagctcaaaagattcttctttttcaagaaaattttaatatacccatagactacactaccatcaaagcagccaagtatttaatcttgaaaaatactatttttatttttcaagataaaattgtccccaaattgggaaagtatcatggattggatagaatttggactattttattctttaagttttaaagcgtatttcagatgacaggtacatgaaccaaactaaaaaacttaatgaaaaatgctgatgaatcgaaat

SEQ ID NO: 17631 - DNA, 540 bp, Homo sapiens
acatctgttgaggaaagataacagggaaataagaggggacaccttctcttttctttttatttctcctctgttctctcttcacagatgagcaatcgcatctccataccacatgacatacccctttgatgcatcctcaaaaacttgggaaagttcagtttcctgaaactttaaaacaaaaagctagattttctttgtaatatggtttggcctaaaaatgaactgggagaaaattacaaaagtcagcctcagaacccaatgcccctatataggaaattctcaaattaacctcctcagttatttaactgagataaggacaaagaggacagggctaaggagaaagagaagcatagagatgagaggcagactcaatgactggctggtttacaagactgccagcaccctccaggttgccctaagaacactccttcaggtaacagccattattagtatggggaagccaggccactggaggccaaactgtcccaatgggataaatggcataaagccctgcatagcttgccccttctgctacaagcacag

SEQ ID NO: 17632 - DNA, 470 bp, Homo sapiens
tattgaattatagaaagcaaaagttacatttcttcagcactagtgtgactgggtagacaaagagtcatactatcaaaatatctaaaaaaagttttagggtaaaataaccaaaaaaatctttcaaaaccttttattcaatatttgcatttaaatttatgaatcactaagcttaacattttgtgttaatgaagttcgttgcaggcagtcagcacttattccacatgtgctgtggcctccacacaccctgcatttcatcagcttgtgcctagggatatttcctcttcaccttaacaaatactcatctaccataggccaggcattatataaaagtgaactgttaattacaaggaggggctgggcgtggtggctcatgcctgtaatcccagcactttaggaggacaaggtgggcagatcacgaggtcaggagatcaagaccatcctggctaatgtggtgaaaccctgtctctact

SEQ ID NO: 17633 - DNA, 489 bp, Homo sapiens
tttttgaggcagagtctcgctctctctcccaggctgaagtgcagtggcatgatctcagctcattgcaacctctgcctccagggtttaagtgattctcttgccttagtctccagagtagctaagattacagacatgtgccaacatactcggctaatttttgtatttttagtagagatggagtttcaccatgttggccaggctggtcttgaactcctgatctcatgtgatctgcccgccttggcctcccaaagtgcggggattacaggtgtgagtcactgtgcccagccttacttagctttcttataacttatatcccatgagtttaaaacctttattataaatatagttattttacaaggacaagctggacagcttatattgtaggcaacaatataaaaaatgtttatttgaatgggattattttctatagggcaaaaccaaaaagtgaaataaatagtaagcatttccaaaagctcatttattatacta

SEQ ID NO: 17634 - DNA, 438 bp, Homo sapiens
gagacagagtcttgtcctgtcacccaggctggagtgcaatggcgtgatctcggctcactgcaacctccgcttcccaggttccagcgattctcctgcctcagcctcccaagtagctgggattacagaaaaatggatggacatgttttactgcctgaacgctggtgccagttaggccaacagtcatgtggcaatggctatgaattgcaagcattgctgattgttatctgctgctactgcctttgagctggagcggaacagatcaacatgggccaaacaagagcctctttggagatttctctactgcttcaagcacacagattccaagtttagaagctcaagagaaggttgaaaataaaatacatttagtttttgtcatctacctgggattacttcactattggaaaagaatatcacaagataatataaataacaaattac

SEQ ID NO: 17635 - DNA, 535 bp, Homo sapiens
tgcaataaatacgttgcatgctgcggaggcagggaaggcattcttctgcatgttgtgtcctgcagtggagggaaaggcattcttctgcaggatgcatgctgcagagaaggagggaaggtgttcttctgcatgttgcatactgcaggggggaaggcactcttctgcatgttgtgtcctgcagtggaggaaaaggcattcttctgtaggttgcatgctgcagagggagagaaggcatttttctgcatgttgcatgctgcagaggaggagggaaggcattcttctgcatgatgcatgctaatccatggacatggaggccatgaaagaggaaggaagaggcagtaacaatgggtactccaatcgcacagcttttcaagcaagtgttgtttgctttattcttttcctttcaaaggagagagaaaacccaaaaccacctccaattacaatatgtggaagatgaaataaaagaaagtcaagttaatttgtggccttttaaaaaaacaagaggttgagcatggtgtctcacacatgtaatccc

SEQ ID NO: 17636 - DNA, 517 bp, Homo sapiens
tctgaaatgtaaatgactaggtagaataactcagagagaactgaagagagctgggaagtgggtgagattcctgagaagaggccctcagaaacagagtagaagtgactatgtgatacatgcttgataaagctccttgatccatccagcccctagttgttcatagccttagagtaggcagggagtgcagccaatggttttacacactcgcggcagaagttttgaggcagtggagaaagccagacctggagcaaatgatagcacagcagcaatctgtagggattgatgacccaggactggcacagataactgatgtcacagaagatgcctgcatagtcaggtgacagtcaggaaccagacatcactgtgccctgcaacatgggctaaggaatttagccaccatcctggggaaaagtggcagaaccttaaataggttgacatttttgttcctgttgttaggtaaaaattataggaaactattgttgtggactaaactcctgcactaagccccaacagatca

SEQ ID NO: 17637 - DNA, 580 bp, Homo sapiens
tgaataagtctcaggagatctcatggttttaaaaaggggagtttccctgcacaacctctcttgccttgtctgctgccatgtgagatgtgcctttctgaggcctccccagccaggtggagctataagtctaatgaacctctttcttttgtagattgcccaatcttggaatgtctttatcagcagcgtaaaaacagactaatacaaattcttactgatacttgtattctcttttaatcacaaaatagaacatttcccagagaagaaaatactatttcaagaaaatactccaagaatgtttctggtcatcctaaagtgatgttaacaatgacttctttatgtaaaaaatccctttctcaaactcataaactatgtaaatatgtatgataaatattaccttctgtgctagaataatagataataaaagatataatcaaaaataatacaaaaaggtcaagaatgcatcagaaaacttctttagtgacagatgctatctgaggaaatttttttattctggcatgaagagcccactaaaagtaacagacatggccaggcgaggtggctcacacctgtaatcccagca

SEQ ID NO: 17638 - DNA, 358 bp, Homo sapiens
atctccttcaaatatctggtttattattaaatatatgtgaaactagtggacaatttgggagaggtcaagagaatgaaacagatatgttcactattacttatgaaaattattttatgaatagccaagcatatatatcctcttttttattgatcaaagatgctttacatctcattttaaagtaataggcttcataatttcacacagctcaatagtgtaaaaagaatgtatttcttaaaataatgtagggtcggccgggcatattggctcatgccactttgggagatcaaggcgggtggataacctgatgctaggagttcgagaccagcctggccaacgtggagaaaccccctttcaacta

SEQ ID NO: 17639 - DNA, 448 bp, Homo sapiens
cttttcatcaccgtcatcatcatcattgtcatcatttgtctggattcttgcaaatgtgcttccaactctgcccaccttgcaatctcacccacacggcacccaaaccatttctgcatggcctccgtgggaccaggggctccccagctccacaatggggagagccccccagggtagagccttaaaggcccatgtgactcccaccagtcctcaccctgcaccacatggctctgggacctctcctgggtgcaacctctcttgttccctgccacacttctgcctcagtgcctttgatgaattctgccctctgcttggaatactcaccacgtccagacacccacctggcttacctcctcacatcctttcagtctttgctcaatgatcacctttcccgaggtctacaagacccctgtgtttaaaagagcaacttagcacacttcccttcctctgc

SEQ ID NO: 17640 - DNA, 554 bp, Homo sapiens
ttcaatatgtttatttattcatggtttcatcctggctgttttcaaagcattattttgtttttgtcaatatttcctacttgacaatgtcctaaattgaaacaaatttattgctcccattacagagaatgggcaagtgccaaagcatttaatggggccagaggttagtgcaaaatatctctttcaggaatatcaaacccatcagttttctttcaatggcaaatgtccccaggctataaaagaactgaaagacttggcaaccaggtcatggttctgcttgagccattaggcaaatatccaaggtctcagcttcccccatttttaaaggaaaaagcaattaggcaaagaattatgaataaggaaaaatgcagtgagaacttaaagtgtgcattaattccttgatggctcataaattattaataggctcaacagtaacctaacaacactaccacctctcaatttacctactaatttaagcaggtataaatgagtcagctgagcaaaccattaagaggcagactttgcatgccttgactgctaaaactgaggaacatact

SEQ ID NO: 17641 - DNA, 172 bp, Homo sapiens
ggaagacacaatacagatacatagggaaaaatgtgctgtggtccccagttgtaaacaccatttagtgtaaattagggattttctcttgataaggatgagaaggtaatcatgaatcagttagtcgagaagttgttatggagtacctactatgtgcactataactattcaagaa

SEQ ID NO: 17642 - DNA, 527 bp, Homo sapiens
ggctgggagaggggcacccgcgcacgggagcagccggtgggaactcaggggcgactcagagggatcagcctgcaggtcacagcccgggctgtggtcccatgggctctgtgctgcctgtgtgcttgcgaagttaattacagccacacacaaactcactgcaaattgttcccagttagaactgcaaattcactggaacaaggagtgctaattacattccacttgttcccactgcctcttgttaatattccaacagctgcttcagcaagataatgatggctccagccgaaatgattgaacagatagatttaaaaatcagtactggctgggcgcggtggctcacccctgtaaccccagcactttgggaggccgaggtgggtggatcacctgaggtcaggagttcaaggccagcctagccaacatgatgaaaccccatctctactaaaatatacaaaaattagctgggcgtggtggcgttcgcctgtagtcccagctactcgggaggctgaggcaggggaatcacttgaacc

SEQ ID NO: 17643 - DNA, 624 bp, Homo sapiens
ggcatgagccactgcgcctggcccagttttcttttttaaaagaaataaaacttaccaataaagtcagaatgtttgttagaatctttcattcctgttaactccagaagtaaccactattatgaatttggattgtatccttccagagcacaattttactatacttttacaatatgtgtggttttccatcaacaatatatagtatttttatatgcttttacatttttatataaatcttatactgtagttgtcttcttgcactcaatatttttgaattcattttgtagatgtaatcaatgatatgcatataccaaattttatttattaatttccttattgatggattaagttgctttaaaatattttgctattagaaacaatgctgtaatgaacagctttattcacatctccttgagtatacatcaagatacatcaagattatacctaggatgttgctgagtgcagtgtttcacacctgtaattctagcactttgggaggctgaggcaggtgaattgcctgggctcaggagttggagaccagcctgggcaacatggcaaaacccatctctacaaaggatagaagattagctaggcatggtggcatgtgcctgtagtccgagctactcg

SEQ ID NO: 17644 - DNA, 90 bp, Homo sapiens
aagtcaaaacaatgaaaggtctataaacattgaaatggataaataaattatagtagattcgatacatgctaacaaacatgtatgcattta

SEQ ID NO: 17645 - DNA, 495 bp, Homo sapiens
atcagttcatacacccaatatactgctacaacaagcaaggaacccatgtagagccttggcctcctgaaagcacctagaaacaaagccaaacaatcatatacaacaaactccacagccatatcctcaagggaaaaaagagtaaaaatttaaatgtcccatccaaatgatgactaatttaaaaataagaagtgacagcttcttcacatgagaaagaatcagcagaagaactctggcaatacaaaaagacagagtgttttgacaccttcaaaggagtgcagtatgttccctcaaacatatttgagggaatgattcagaaaagttttcctgatcttgatagagaagtatttattcagatacaaaaaactcagagaacatctgggaggtactatatgagattaacatcatcaagaaatataatcaacagagtatccaagatcaacactaaagaaaaaatcttaaaggcagctagagagaagtgtcaaatttacctgcaaa

SEQ ID NO: 17646 - DNA, 498 bp, Homo sapiens
actgaaactgatgcagataaaagtacagaggtggctattggtaaatgccaccactattccatttgaaagacaatcttgtttctaaatcaaaaagaaaaacaagtaatatcaataactcctaaagagataacacagctctttatatgtttatatggcatggtgcataccagcactactcagatgaaggtcagcaaactgttcatttcagatccacaatgagataagaggcttaggccagaatctaaagcttcacatcactaaccactgtttagtttcgtagcaagattttctgaataaagaaagcagtgccaaggccaggagtggtggctcacacttgtaatcccagaactttggaaggccaaggtaagaggatcacttaagtccaggagttcgagaccaccgtgggcaacacggcgaaatataaaaattagctgggaatagtgatgaacgcctgtagtcccagctactcagaaggctgaggtgggaggatcagttgag

SEQ ID NO: 17647 - DNA, 521 bp, Homo sapiens
cagcagttttaatctattctaaacatccctttatgaaaacacaaaacacaaatgtttaggacatggggaaatatagctcagaccacctaaggctaaagtaggggtcagcaaactcacagtccatagatcaaatctgacccacagcctgcttttgtaaataaagttctattggaacacagccatgctcatgcatttacatattgtctatggatgctttcatgctacagttgtaacagaccatatggcctgcaaagccagaaatatttgctatctagaccctgtcagaaaaagcatgccaattactggtctaaaaagtggaaaaagaggtggatattaaacttaacattgttagttaaggggcagtgctactcaaagtgtggtctgtggaaaagtgtccccatgcgatgcaataaacacagaaattaagagtaaaaatttaaaaacgtctctagcaatgtgacaaagtattttaatgtctgttgaatctatagtaattaagatatttggcttgtattttgcat

SEQ ID NO: 17648 - DNA, 488 bp, Homo sapiens
ggaaactgggaagttcagtggagctgaggtacagactccactccaggaggaacaagggcacagaaagaagactgcagagcagggctgagcttgattgcaaaggttatactgcatgctgggaagtttacaattaatctgtagacaataagaaaccactggaggtgtggaagccaataaatcactcaatccgagaaaactggagcagagcaaggatggattactagtagggaggaacagatggcaagcaggccggttaggtgtctaatctgggcaagctgacaataaagcctggtagtgggaaatcaagaggacccagcatagggtaacaatctggagataaaattaatagactcaagaaacgcattagatgggaagtcaaggaagatgctgagatttctggtcaaggtttccacccggtcaataaagtgggttcttaaaccattaatgaagacagagatttaggaacagggagaagcagcaggaagagc

SEQ ID NO: 17649 - DNA, 645 bp, Homo sapiens
caagcaacagctgagtagaagattttaatctcattacaactgatgtcagcattctacctgaggcaaaactaattgcagcagcttcctcccacagccccacctcaccacatactcatcccagataaccatgcaaaagaaaatgtactaataaaggaagagttttcatttgcgcctttacagtcatgtataagctagagcacaacgtcccccatgtacctaacagaaagtgtccatgccctttcccacgcctctccttagtgccaatatctgggatggaatgctggctggatgtgctattttatgagaacaaaaggaatataggtgtcttcaaggaggatgaacctaatttagagtctcaggtcaaccttgagtaagctactcaacatctcagaacctcggtttccttgtctataacatatgggctccgtttgcttttaattctcttgaagaattaaatgaaagtatgtacctctcagagccagtacctggctcagaaaatgctaaataagtacatatttgactccctgagttggcaatgacaaaacagtggaacttggaggagctcacataactcaggaacaccagaattggtttaaattagaattctcccaaattctactagaattttaaaagaatatattctac

SEQ ID NO: 17650 - DNA, 616 bp, Homo sapiens
gacagtctgtactagaaactcaaggattagaactgaggttgaatcccactttcgcacttggaagctgtgtgatcttgagcaggtgttccaacctctctgagctccagatacctttggattgacaaggtcagggtttctccctgagaagtaattttctaacaccttgacatacacactctcctggcctgtgtcctggaccactgggccagtttcaacccctctgctggagacagcagcaaggtccctggcgatccctatgttcgaagtctgcttgccactgcctccagcagcctgtctgccattccccaggcctcagtgctattctgtggtgagcacagaagtgtccttgcccagtctcagtttttatttattttttattgtcagcctcagttcctaaaatcttaccacgttattagaggaaggtatatttttgacaactttatccacagttaccttaaatcaaggtgtcatatacacagtgccaagactgaagatgtttttcaacataaaaatccattttgatgatgcaaaggctgttgagaatcccttttgaaatttcatcagccagtactcagaagacttttggatttgactaacacagaggaatctcttcttg

SEQ ID NO: 17651 - DNA, 543 bp, Homo sapiens
gccttgggctccttaccacatgcctcaattatccttgcactcttaaacatggtggtgccatgagagattcccaacaggtcaacacacagctcttgtatcattttcttctttcgggaggctggtagtatctccccacagaagaagagtgatctctaacaggtcaaatgcatggttttctgcactgtgtttatgattctggaggccggcagtttttccattcagctgataagtggcagatcccgggatggatgagattagcatctgggatggcaagtgtccaggatggctcagaagtagctgccaaactccacttgactctcagtcccagcatcacagggtggcaagttgctgcagaggccatggatctcaaccatgtatcatttggaagtgaaaactaacagatgcgaaatagctttttaaaaatcaagacatggccagggatggtggctcacggccatattcccagcactttgggaagctgaggcaggagggtcgcttaagcccgggagtttaaggctgcagtgagccatgatggcactactg

SEQ ID NO: 17652 - DNA, 593 bp, Homo sapiens
caggtgcccagcaccacgcccagctaatttttgtatttttagtagagatggggtttcaccatgttggccaggctggtctcggactcctgaccttgtgatccacccgcctcagcctcccaaagtgctgggattacaggtgtgagccactgtgcctggccatgccgaagttttaatggaagttaaatataaggaaaaacacctgggcctggctcagttactgttaacaactattaattacttattctgagaagatgtgagggatacacattgctgccctcaaggagcttgcaatctagttgaaaactataatagcacaagaacaaagacaactctatgaaatggaaataacatagcataattactgtctgcctataggttactacttgcccatagcaaaatggtgattttgaatttttgaaagaacactttcctttcagaaatgcagaacaaatgtattcacttagcaaaaagttatggaataactactatatgccaagaattgcactaaatactaggcatacaaagatggttaagacattcctcataccctcatttcacttggaaagaggcagtcttagaacagaagtcagaat

SEQ ID NO: 17653 - DNA, 592 bp, Homo sapiens
gaaatcatgaaacttattggtaaaagtaaatatatagacaaaggtagaatactgtattactgtaatgttggagggtacatcactttggattgtagtattaaagttaaacataaaattattaaaataacaaccactaaaatattttcaagaataaacaattgaataaatatctcaacaaactggataacccaaaagagatgaaaaaattcccaaaaatgtacaatccataaagcaaatcaagaggaaatagaatgtttgcacagccttctgacaagtatacagacagaatcaataatcaaaagtctcagagaaataaaaaaagtccaggaccaggtgacttcaccagtgaaccctaccaaatattaaaagatgaattaacaccaatctttctcaaagttttcaaagaaattgtatagcaggaagcatttcaaaactaattttgaggtcagcattaccctgataccgaagccaaaggcaccgcaagaaaagaacactacaggtcaatatccctgaagaacatagaggcaaaaattcctaaaaaaatgccacaataccaaatataagaaacatattaaaaatattacattataac

SEQ ID NO: 17654 - DNA, 562 bp, Homo sapiens
ctctaagcctttggtgtcccagcaactattgcagtaggcagtgatctgggagaggggttcctcctgcaaaaatcaaaggggggtggtttcagagctttcggatgcagcgctccagtgctctatgggatgaaaattctttcatcatttttactttcctgctgttttactatttcccccaattttaagcttctcctggcccacgcaaagcatgtcctccctgccccccaccagtagaccaaaggctaaaatttaaaagagtctcttttcccactccgcagaaatagcacctggcttgcaaaaacaggtaagttatgagacataggtcatttttccttgtttctgacttttccctttaaagatccatttaacagttacatataggccgggcatggtggctcacgcctgtcatcccagcactttgggaggctgaggcgggtggatcacgaggtcaggagatcgagaccatcctggctaacacggtgaaaccccgtctctacaaaaaatacaaaaatatagctgggcgcggtggcgggcgcctgtagtcccagctactcgggaggct

SEQ ID NO: 17655 - DNA, 579 bp, Homo sapiens
aaataggtctttaggcagcagaattgagaccgtgatagcaagagaggatatggacaggctaaaccagggcagtacccttttctggacttggctaagaatttttatcaattcctttgtaagaaaggtttgagaagtgaataccagaactttatagtacagtgtttgtaatttgttttctgggtgtggtggtggcagctgtggcactgctgtggggtgtgtgtgtgtgtgtgtgtgtgcacagcgcttatattaattggtagtctccttctgggtttttatttcatcactttcagtagattctttataaagtcttgagttaaagaacccattcagatatttttatacacatatcagtaccaggtgggatgcactgataaattcatatgagtttcagatcctctgaggaggctgaccacatacatagctctcctcccagagtgtgcccagataagcttgttccagcctgggcacagtctatgttacatgagccagcagcactcttgctagtggtcctgtatgaattgtttatatttggcagagatagggaaggaaatccatttccatattttctttttcctc

SEQ ID NO: 17656 - DNA, 442 bp, Homo sapiens
cttgtattattttcctccacggcactttttactatttggcattttctgccttgaatggttcattattttattgtttgtctctcctccctagaatgtaattcttatgagggcagaggctatgatctacccgctgctgtgtccccagcacctagtatctggcacactccaggaacttgaacattctttgttgaatgaattactgactgtgcaaatagaagaaatttccaaatgtttgaaggtggacacgaaaaagaaatggaaaagtgagcaacagaggctgctggaacgtctcctatcacagttttgccacacacttttagaataaatggcacattccactattttattagggaagttcctgcctctttttattattgtgcactgactgcccaaactgatatatattttatatctttcactgatatttgacttttaaacctca

SEQ ID NO: 17657 - DNA, 569 bp, Homo sapiens
atgagatcttttggcggtctaatagctattaaaatttcaaagtgatgatcataaatgatgttttgagataatctataacaataataatgtggcatgaaaatatctgatttctatgggtgacaacttcacagattctgccaatcctaagagatgctaaatttttgttaaaagttcatgaaaatgagatgcaattcaagttgacagaaccctgtgaattctatccatggatccctttaggatctgtgcattacaggtaaagaacacttcctttacagcattgtaaaccagtgcacgaatgctcattagacatgtataatacaataaagttctgctggctaagagcactctagaacattggaagcagggagatgagggtaggagaattgcataaacagcatagtctctggagccagattttctgggttcaaattccagctccacctcttactatttttgtgatcttgaacaagtgacttaacctctcaacactatttcttcaacttttaaatggcaataatagggccgggcatggtggttcatgcctgtaattccaaggaggggaatttgga

SEQ ID NO: 17658 - DNA, 621 bp, Homo sapiens
gaatcctggcatctactaggtgcaacttctagcagtgtgctttcaggcaaaactatatttctctgtgccttcagttaccttctttgtaaaatgcggacaataatagcataaaattcatacagttactatgagaattaagtgagtctatatataaagtgctcggaacactatctgatacaaacaatgactaacactcaggtagcccttcctattattcactttcacttttgacaggcctcctatctgcacagtgtattctctttcttctcaacctggccaaaccatatctagcttcatgacctacctgaagcttactttcttctccaagtttcaccaacctttcttctctttaaactctaatggtatttggctgtctttaaatgttatttaaactatttcaaacatatacatattgctattgtagaaagacttataaattactcaagaacaaagatcttattactaattccctctctatccaccaagtgcctagcatttaaacactacagggcaatacatgcatacagaatgacaaatacatcaacttctgtaagttcagataacaagctgacagattaatctaatcgtgatataatgttgagtaacacaatcagcaatatt

SEQ ID NO: 17659 - DNA, 610 bp, Homo sapiens
tcatttgaacaggcagtgcgaattcttccagatgatgttgcatgtaacatcattaaaataggttatttagtaagaaataaagagatttgtaaaaagacaatggcttattggtctcaaaggatctacactgaagaactcttaatgtacttgctccattatgatgcagggaaacacagtttcagccactggaccttttagtgacttaaaaaagaggtttgaaactggctgggcgcagtggctcacgcatgtaatcccagcacttagggaggctgatttgggtggatcacgaggtcgggagatcaagaccatcctggccaacatggtgaaacctcgtctctactaaaatataaaaaattagccgggcgtggtggtgtgcacctgtagtcccagctacttgggactgaggcagaggaattgcttgaacccgggaggcggaggttgcagtgagccaacatcgcgccactgggctccagcctggtgacagagcgagactccatctcaaaaaaataaaaaaaaggtttgaaaagtagtcctatatactatgaagaatatgcatcctatttataatattaaaaccttaatgactaaaagagttggcaaaagactctga

SEQ ID NO: 17660 - DNA, 618 bp, Homo sapiens
atagaagtaaataaaatgtagtcacttccttctcactcttctgtgctttcccacacgctgctccttcccttggaaacaccccttctctgcctcaccacagtaactctaatcatctcaaaaactcactttaaacatttactgcttccaaggctctttgcttctaaaccagcatttggcttggtgttattggatgataatatttttcccatctaaacaaaaagcttcttgagggcaggggctgtatcttttgtctctatatcctcaaccctaagacaaattgtgtataaagcaagaatctgcatgtaaaatatttctttagtttcatgttttaccaaaagttcaacctccaacatgcaacaaaaattgctattaaaactcatactgcccatttgaaaaaattttccaacatttatttatttaaaatctatttgtatttaattttcccagattgttaactaaaccatcagttcataggactactgaaactaaattaacagaattcctatctgtattcttaataactccatggtttttagtgtttaaaactgccatgctgattatgccaaagctctacatacttaagagacacactggatagtccataatacagcgtcaatt

SEQ ID NO: 17661 - DNA, 620 bp, Homo sapiens
ggaaagctagtgttgtgccttttacatattagagcatcataaaatgttttgttcttgtgttttttatttaactctctgctcatagccattcatacctgactatagtctatttacttggatctcttttctatgtgcctgtattatctatttgtttgctttcttgcttttgagttgacttattgtactttaggattcaggaaagagaaatgagaaatgctgagagaattggagttttattatcagtggttctaggaagaagcctttttccaactcatcttccaccacggattaactggaatgctatgacactgctatttgttatttatgccattgtttaataattggtatgctgaaagtagtatctactatgagtcatacactttagatattttcctagaagctactttttggtgggggaggtaaagagaatgtgaagggcctagatacgaaaaaatggaactagaaagaaaagtactaaagaagagtaaaaccaactctgttttggaattatttttatatctcagtcaagatacctacaggaagaaatggtacactgaacatgagtaattgaagaaagcataagaaagagaatatttacaaatttgtgtgaaaaaaaaaaa

SEQ ID NO: 17662 - DNA, 568 bp, Homo sapiens
cagattggaagctgctgtaatggaactaaaggagaaaaatacataagaatatatttttaaagtgtgtttcaaatgggtttagcagtgcattagtcatctatgtcaagagtttaacatgtttaaacaaagaaacacagtcacaatgactttcaattctgaataagtaatgcaactcacaataaggtcaaatcaagaactctagttgtgattagaatggagaagagtatttcattctatttagaccaaaattcagctaatttctaagcaacgactaagtgaaaaagacttaatgttccccaaatgttataaaaggtagttcacacatcctaactgtatattgcgtatagtaaattaagttgataaaataagaaaaaactccagattataatgtacaagtcccataataaccatgaagggttatcactgtagtaaaagaaaaacagccaagcaataatcagtttaacatcaaggtcctctccccaacacacacaccacactataaacactaaattaatccagcaaggtccgaattaggtcagaagacacatgggacttcatctggtgggaa

SEQ ID NO: 17663 - DNA, 639 bp, Homo sapiens
caagccaaagaactccaagaattaacagccaccaccagaagctaggaagtctcattcccacttggtgctactgctaaatgactatcaatgaaattacactttcatcacatgtcactcaactagccaaaatccccaggtgcctagtaaccactggattcatgtgccatctgaaattctacattaagagtccacgctaatttcccactacaatctaatctgtatattcccagtagcaaagactttgcaactatcctgccagaagtctccataatgtgcctctcactttctaaccctagcatatttgctcatcctactccaatcatctagaacacctgtgcacctccccttgtcctaatcctgtgattccttcatgacccatctaatactgcattctctataagagggctgttacggcttctttccttcacacagtattacctccttctcccctgtactcaaatatcacacttacagcacttcccgtgttttcttttgtatttgccttcatgtgtagtctttcatgatcttggcaatccaccttttggactatcagccatttaagggcaaaagtgtgctttattcatctctggtttcttgcactccactgccatacacatgtagtcatttaataaatatacc

SEQ ID NO: 17664 - DNA, 509 bp, Homo sapiens
ctaagaagcggagagggatactcctagctgggagcctttcatagcactcctgaattcacaacctcacggatggcacaagtgcaacttaaggtcaacactgggttgtttttgtttgtttgtttgtttggttggttggttgttttttgttttgttttttgtttttgagacagagtctagctctgttgcccaggctggagtgcagtggcgtgatctcagctcactgcaaactctgcctcccaggttcaagcgattctcctgcctcagcctcccgagtaactgggattacaggcatgagccaccatgcccggctagtgtgtgtgtgtgtgtgtgtgtgtgtgtgtctgtgtgtgtatgtttaatagagacagggtttcaccaagttggccaggctggtctcgaactcctgacctcaggtgattcacctgtctctgccccccagagtgctgggattacaggcatgagccactgcgcccggccagtagtgtgtattttttagaaacaacatttgg

SEQ ID NO: 17665 - DNA, 469 bp, Homo sapiens
cttgtccccaaaacataatttccctgctgtatttatctcaatggaatttagaagtagcgtggattatgtcaccctgagagttatttcttgtgtccactaaaagagaaaatgcacagaagaacgtgtctatcttaccgagaccactcatacagtgttggcaagaggacagtccccagagtctcaccatataatgaagctaatcactctatgaattatcttaattgaatttgaatgtattgctactgagtactatgggaagagcggccagtaaggacgcggtattttcccacagcattcagttagcaatgcattcaaatttaattaagatcattcatcactggggatgtccgtgctacagttgcctgcttttggtctgcctaagataggcatatctactttcacaggttgtctcttgtattgagtacaggattgtttgatccatccttaagtattatcctgagatgtgctt

SEQ ID NO: 17666 - DNA, 511 bp, Homo sapiens
gtatccatgtaataggatgttttctgtcaccttgaatggtttttgccctaatactttttcttaaattaatagagtccaacctttaattttacttattttctttttacatattttcccattcttatgccttaaaacatctttgccaatttgttttagatatgttttagggagtagcaaataatttgtattttttattattaatcatttcaatgcatcctaattttctttccattttaatagaagtaaaatactgatataagttgttatcattgatatgattcatattatttatttgttttttcatcattttattttgcttacctgctgtgttttacatttcttgtaatatgattgttttgtttgagttttttggggggttattggtttcctatttgttttccgtataaataagtgatttatacactagctacatagaaataggacattctcttttagtttcataagctttgtttattattatttatcctagttactttcccatacatttact

SEQ ID NO: 17667 - DNA, 573 bp, Homo sapiens
acctttgtaatctactcttccatggataaacatgtacccttttgaacaaagaaagtaatatgtgtgaaacacttctaaagtctgagtttttaataaattctccaacctagtcataattcaattggccgatgatgaaagccattgttgactaggcagtgtttaagctccaagtgttaaagcacaacttataactaatcataggctaaaaaataagctatgccaatccagaagcaaccctaagaaggctggctaaaatctaataacacgactaaaaagataaataaggaatagagccaaattgtgagattcacagatgtcacacaattaggcaaagcaagtcactaaacatacaaacacaaaaatagcaataacaaacaccaccatgaaatggaaaattagattccaggtgttttagaatatattacctaagatatccagtttttaacaatgacaatggaaaaaatgtgcaaaaaaattataacccatgcaccggggaaaaaacaaacccaaaataagtcccatacattggacttagcaagatgttataactgtcttcaaaaccccgggaaacta

SEQ ID NO: 17668 - DNA, 477 bp, Homo sapiens
gagcctggggactttccacacccccgtctcccgggttcaagcgattctcgtgcctcagcctcccaagtagctgggattacaggcatgcgccaccaccccggctaattttgtatttttagtagagacggggcttttccatgttggtcaggctggtcttgaactcccgacctcaggtaatccaccagcctcagccttctaaagtgctgggattacaggcgtgagccactgcacctggccgagtagttgatgactttttaaactgtggttgaggttccatgcacttctgacgcctctcccatgttggttcagcagctttgcgccccctgcctaactgcagacgtggcgggagatgagtccccgaacgcttggctgctcggtcaggcactgccacagcggccagcgtgctgcaggggttgctcagggagctcctccgtgttgtgaggccttattgctcacggcttacgtccagctcttctc

SEQ ID NO: 17669 - DNA, 545 bp, Homo sapiens
gacagaagggcaggaggtcctcctatctctacttgaaataccctcagaggtagggagctcacccccactataacagtccattttatctttgaacggaattgattgctgaatagttcttccttgtctgtgtgaaactggtccccctctaatactgtctatttttctcagttctttctgcaggagttagtaagtgatgaatctagtccctctgtcacacatttgaacacagttattctctctaacctaaacattcccaggtttttcatgtgatatggcttccaggttcttcctcaaacatggaacccagtactaaatgctgtgttacttttgtgattaccatgaaaccattatctcccttgttctcaacattcttctttgaatgctgctatgttccgttcttacaaatctccaggggagaaattccacagttttgttaaggtcttacattccagtgcctcccacaaaatctttcttatgcttaacttaaatcttgtcttacccttgttaattggatctaagaaaacacatattcaggcaggggatca

SEQ ID NO: 17670 - DNA, 525 bp, Homo sapiens
ctgtactccagcctggctcaaaaaaataaataaataaaatatactgaagttgtgttgtttgagaactgcattgtatgtgcattatatcttaatgaacaatacattttttaaaacaccatgacaaatgacatcaggaagagtgtcatattacagcccgaggcaaaggaatagttgataatactgatctttatttgaaatgctcataatttgttcatcatatgtttttggtattaattttgattttttacaattttgccttaaattatcatttatattgggggaaaaaagagaaagaactgtatttataattatgacacagtacatctgcagctcctaaaattcctgacactattgtcttcaggtaaatatatgctgtggttattattcagcttctctgttatgaattaaaacccaaagatcttctcacaagagtaccgttgaagttcatcatgagtgcagtaaggaaaaatcatgaagttcatcatgatgaagttcattatgagttcagtagtaaaaaaatccaag

SEQ ID NO: 17671 - DNA, 396 bp, Homo sapiens
ggagaaatccacagtgataacattttgtgtatttccttccagacatttttttccctctacatgtgtcagcacttcccagatgtgatgatggtatttgaaagagcatgatctggaaatcctgagccgtgctgccacaagaaaatggatgcacagaggacaaggccaggcagcgcaggtcttcattacactgagactttgcctgagtcccatggtgccccagtgccctggcctgggcacatcagcactgccttctgtccaggccccatgagtctcagatggtggaccctggtgacggaaggctgggtagatgccatggacctttcataggtcatagccacagctgagcacttggtgtcttactactcagtggagaggagaagtgtgctgaagggtggt

SEQ ID NO: 17672 - DNA, 629 bp, Homo sapiens
tataaagcgtcttttctgactgtaatgaaataaaactagaaatcaataagaagaagaactttggaaactatacaaacacatgaaaattaaataatatgctcctgaacaatcactgatcaatgaaaaaactgaaaagaaaattttaaaatttcttgaaataaatgaaaatagaaacacaatataccaaacatatgagacacagcaaaagcagtattaagagagctcacagcaataaatacctacatcaaaaaagtagaacaacttcaaataaacaacaatgcctctgaaaacactagaaaagcaagagcaaacaaaacctaaaattggtagaagtaaggaaagaaattctctcacatcagcggccctcctagggaaccctcaaaataaactaatatctggcccttaaagataacaacaagctttgtgccagaactcttgatgatggcagttttctttgaggaaaaggaagatttttaacacaatttttagtttgcacataggaatttagaaggagcaagaaggagaagagaatacttccaaacttgtttcacaaggcaaatattaccctgataccaaaatcagacaaaaatcagatctaaaaaaggagaaatctataggccaatatctct

SEQ ID NO: 17673 - DNA, 603 bp, Homo sapiens
tatgttttcttccaaatgttttatagtgtagttcttatatctaggtctttgattcactttgagtttttatatataatgggagatcacatgctgtttttgaaaacgagttaaagtggtaaacaatcaggagtttaaaaatatgcatctatctttggttttactgacaatcatgtgatattttgttaaacataccatttaatagaaagaaaacaaactttaacctctaatgaggctgatattctcaatatttactttaaaaatgtgataagcttagagttattagaaaaggcctttgacatttttgtttttacaaatcaactgctttcaataaagacttgaataaatgaagccatatttttatgttatgtaaataatatttttgaaatacattaaaaaatctgtattatataacatgttataattatatggctttttgtttaatgcagtggctctcaatcaggggcaattttgcccctcaaaggaaatttggtggctgggcatggaggctaatgcctataattccagcactttgggaggccgaggctggtggatcacctgaggtcaggagttcaagaccagcctgaccaacatggtgaaaccccg

SEQ ID NO: 17674 - DNA, 590 bp, Homo sapiens
agaatttatgcccttgcctgactggctgccttatccaattcagcatgctggaacttaaaaatattggccgggtgcagtggctcacgcctataatcccaacacatcgggaggctgaggcgggtggatcacttgaggccaggagttcgagaccagcctggccaaaagtggtgaaactccctctctactaaaaatacaaaaaattaccggggtgtggtggcagacgcctgtagcccccgctactcgggaggctgaggcaggagaatcgcttgaacccaggatgcagaggttgcagtgagcggagatcgcaccactgcactccagcctgggtgacagagcaagactccatctcaaaaaaagaaaaagggggggatactggatcatgagcaaatgtccactgatgctatcagcacggcgatggagactggcccatggatgggggcaagccgctttgtgggctcttgagctaggaagtcacagtttctcttgtgcccctttgagaaatatttagcacctttgtattcagccaaccaagtggctctcagtccatagaaagacgtctagaagttaactgtgagaattccttacccatg

SEQ ID NO: 17675 - DNA, 500 bp, Homo sapiens
caatctaggttgtggcctatgcaaaactctccaaggacattgcttgtttggatatgttagctgtctgtgtggagagaacctggaggacagaattctagcctggagaaccagttcaacagacagggcttctgtaactctactggagcaaatagatatgagcagctgcaatactcaatctcctatagcactgttcctccaaatggagtccttagaaccctgagagttcccatatgtgttctcaagagtcctcaaaataatattctccaagataattttttaaaataatagacttggctgggcacagtggctcacgcctgtaatcctagcactttgggaggctgaggtgggcggatcacctgaggtcaggagttcaagaccagcctggccaacatggtgaaaccccgtctctactgaaagtacaaaaattaaccaggcgtggtggtgggtgcctgtaatcccagctactcgggggactgaggcaggagaatcgcttgaacctg

SEQ ID NO: 17676 - DNA, 676 bp, Homo sapiens
cagaagtttaattttttataatgatggatgaagacagtaatatctaccttgagtggcttgtcataagtattaaataataaaaactagcattaaaaatatctagcatacctagatatatgttatatgttatagttatatgtttaaaaatttgtgtttatttcatgccttatttatctttaagaaactttatagcctgatcggtgctgattctttttccaaaaagtcacgtaaaattttatcaggacaatgttttctgtaacaaccattatttcttgtctttctgccataagtggagaaaaaagatgtgaaggatcttgagttttcatactttctaaatgggctaagagtacagatgtcagaagctatgccatgctacactatgaaacatgtttgttgaaaaagtttccacttcaacatgattttggaatgaggtgcagacttttccatacaatatctatgaataaaaatattcatttggtatttgattactaattaatcagatattaattgcattctctattataaaagccatattgtgcaaacacacacacaagtcaaattcctaaaaatatcctatataaaaggtttcaacctcagtatttctatagatgctatgagaaattataaagtatagtcattaaagtaatcctcttaaaggccaagtctggcatgattc

SEQ ID NO: 17677 - DNA, 612 bp, Homo sapiens
acagaaagtttcacgcaccaagatccatcaggaactataaaatgtttgttgtagaatctggcactgtacatacccactaaggcaaggcagatatggaagagtctgagatgacagtagaaatttagactgttggtcaaggcatgttgtctccaaggtaaaatagttttcgattaggatataggaaaatagaactatgtggcgttctgagaagagtgaaattcccagcaggtggtaaagcctagagatgcagactctagatgggcaatttccacgttcagtgttttagtcatatctcatttaatgatcagaagcaggaagtcatgaaatctagcttaagtataaatcaaaataagagttacgttgaggccgggcgcggtggctcacgcctgtaatcccagcactttgggagaccgaggcgggcggatcacgaggtcaggagatcgagaccatcctggctaacacggtgaaaccccgtctctattaaaaatacaaaaaattagccaggcgtggtggcgggcgcctgtagtcccagctactcgggaggctgaggcaggagaatggcgtgaacctgggaggcggagcttgcagtgagccgagatggcgccactgcac

SEQ ID NO: 17678 - DNA, 598 bp, Homo sapiens
  misc_feature 394, 395: n = A,T,C or G
accacataaaacagcagtcttcaaaaaacggaaactgcaggataggtaggaataaaaaaacacattcataaaggttaacattgccactctgaatccaagacaggttaagaggccaaaatgaaattatctagaagccttcagtttctcatggatatgataccaagcattgcgcttcaataacagagaaaacacctttccaacctcccttgaaacgtttatggaaacttgccacatattaagacacaaaggaaacttcagtaattccacaaagcagagagaatctaaacatattctctaatcacagtacagtaaaactagaaattaaagactcaaaaattccctactggaaatgttactaactctattaaattactcttgggtcagaggacaaatnntaatttgttcaaaatggtaacaccttgtatcagaatccatgatgcaattaaagcaatgaggcaaagaaaattacatccaaaatgaaaaagaaacatcaaatgcaaaattaggaaaagattaaagtaaacaaaggagaaacagttgcaaaataacaagcaaggctgggtgtggcagctaatgcctgtaatctcaccactttgag

SEQ ID NO: 17679 - DNA, 302 bp, Homo sapiens
tagaagagtattctcaagtgatcccattttggaatacattttagaagagtattctcaagtgatcccattttggaatacatttttgattattgctgtgtgtattatatatgtgcacatgtacaaatgcatagaaaatattgtggagggatacacattcaacagtgattgcatctaaagaatacagctgggcgcggtggctcacgcctgtaatcccagcactttgggaggctgaggcggttggaatccttgaggccaggagttcaagaacagcctgaccaatatggtgaacccccacctctact

SEQ ID NO: 17680 - DNA, 473 bp, Homo sapiens
tctagtactgcctgtcctcaaattgtccttttcttttcatttattttttaaattcggagcagcactacagaaccttatagatcaagcttatccaacccacggcctgtaggcctcatgcagcccagcatggctttgaatgtggcccaacacaaatttgtgaactttcttaagacattatgagatttttctgtgtgatttttttctttttttagcccatcagttatcattagtgttagtgtattttatgtgtggcccaagacaattctttcagtgtggcccagggaagccaaaagattggacagtgctgttgcagatgtattcaagaacaatagatagaaggactaatcaattgatcctggaaaaactgcagataatggcctggaaaaactaccactaatcagaggattcaggctactgaggaccatggtttctagaacttattaaggctgccatgaacttagaactcacatact

SEQ ID NO: 17681 - DNA, 151 bp, Homo sapiens
acagaaggtagcatcttctaatcttcagacttgcttgccttttcaaactcccactgtgattattttctactacctgtttcatatagtcagttaatctcatgaatttcaaatgctgacctagatgcagatgtttttgtggatacactatatt

SEQ ID NO: 17682 - DNA, 492 bp, Homo sapiens
ctgatagttggagtcccagaagctcacttatgaatagaggaagaagtcaagatgatctgccagttcagataatcagtggaaaatcctctgcataaaatcactttagtgatgatggaaatagaaagctaagacactgaatagccagttgcaatttccagtgtgccagaggcatacaaagagagcactcattgaaacagagtaagctgagctgtctccaaacagaaatgtggtatgcttttgtcatattaaggaaactgtcatccttttaaaaggaaagtatacagagtggaagattatagtgcagacctatcataggaaagcttaaaattaaataaacctgaaacactttttttcctactaaaaatcagaattaaaaatcacaagttagaatgcttacctcaatctatactaatgatgcaccgggcaccttattaaacaaactggaagtaaaaatcaaaatacgtgatattatttttagatgatttataagtt

SEQ ID NO: 17683 - DNA, 505 bp, Homo sapiens
cactttaatttcctctgaatggtcgttgcaaccccccccaccgccccacccattcctaattacaagttgctgtttccgacttgcctcctggtggcccaatttcaaaacagtgattaaaattaattacctgggggccccctccccggaggggaggagccccaggagccccagagatgcatccacgtccccactggaggttctgcctgggctcccacaccctggcttcccgagtggcctggggacagggacagcctctctctgggtctctgcttgcttatctgtgaaatatttcagctggccagatgcggtggctcacgcctgtaatctaacactttgagaggctgaggcgggtggatcactagagatcaggagctcgagaccagcctgaccaacatggtgaaaccctgtctctactaaaaatacaaaaattagccaggcaaggtggcacgtgcctgtaatcccagctacttgggagcctgtggcaggagaatcgcttgaacctgag

SEQ ID NO: 17684 - DNA, 546 bp, Homo sapiens
aatataaagtcaagatgaaggaaagaatcttaagaggtgtgaggcaaaagcattgggtaacctataaagaaaaacctatcagatcaacagcagattttgattggggtcctatctttaaacaaaataattgtcagccaactattttgtatccagcaaaatgaagcttcataaatgaagaggagacaaagtctttttcagacaaacaaatgctgagagaatatgccactaccaaaccagcactctaagaaatgctaaaaggagttctaaatcttgaaataaaaccttggaatccaccaaaatagaacctccttaaagcataaatctcacagggcctataaaacagtagcacaataaaaaaccaaggtatttaggcaacaagtaacatgatgaatagaacagtacctcacatctcaatactgacgttgaatgtaaatggtgtaaatgctccacttaaaatatacagaatggtaaaatgaataaaaatctacaaacaaatatctgctgtcttcaagagattcacctaacacataaggactcacataaact

SEQ ID NO: 17685 - DNA, 574 bp, Homo sapiens
ttttcaacgagaacttattcatctatccaacattcttcatccattcaacactcataaatatttagtgggcattcacaatattccaagttcaaacttgactttcagtgagttcacagataacggtttccaggtggctaaatttgacacatctgggagtcaggcaacaggaattcaggttaaagaaaacaaagagaaagatcagatacttgggcagatagtgaagccagtgagagaacctgggccctcaggcccctggatccatcctctgcagagaggtgctcaatcctttgcagctttgcagagaggtgctcaatctaaattcaggaaaacaaactctcctatcacagatagggaaattgaggctgatcaaactcttgtacaattttgtttattccatagcccctatgtcaccctatcaccgtattaccacttctatctttgtaagtttctactgaaaccccttatcttagtacaaaaaggcttccaagaatacaaaaattagccaagtgtggtggcaggcgcctgtaatcccagctactcaggaggccgaggaaggagaatcaattgaacctgg

SEQ ID NO: 17686 - DNA, 421 bp, Homo sapiens
gctgggattacaggcatgagccacgcctggcctctaccatttttctgtgtgtactcctcaactctgcctcctattacttagctgaccttttaatctacattcagctcatgctctctacttcaactatagtaaaacgtccataaatgtttgttgagtaaatgaaagaaagagacacgctctgccccattttctctaagtgtcccaactctctgttccactaccatcttcaagtcttaggaatatgctattcattgtgccagaaatgtctcccagtctctcccaagactgtatttccctttctgtcttacaacgcagcaatagtcacctctttcatggcattttcttaaattacacctccttggtttggctttatagtcactcttaaaaacttgcacggtggctcatgcttgtaatcccagca

SEQ ID NO: 17687 - DNA, 461 bp, Homo sapiens
ttctgtgcttttcagtgccacagtcagttctgttacaagtcaacagagcagtgaagatgctggtctattgtttagaaaaaatataatcctcaaacagttatttatcttcattttatttcttgttttggaaagcagcaaaaacttcaacatggttgtatactttgtacttagatcatggccagaaagttaggagacaagctgagaatattttattgtctgcacaaagatagagatcatattgaataatgaagaggtaagtcaaatctgaagaacgacttaaaattgtaaggaacttgatgttagtaacactacttactttgcaattatccaggataattttagcagatgggaatgattccccgctccctgactaaagaacaagaccataggtattcttgtattgtaaaagtgaccagtcattgagtgtagtttgtaatagtatttttaaatgcttattacat

SEQ ID NO: 17688 - DNA, 448 bp, Homo sapiens
aatttaaaataattgaaaagaactctgttgaaaccttgaagtagacttaacatgcttttcaaaagtatgtgtactctgactaagtgaaaaaacagttctggacaatgttttttcactctccaattaaaggtttatatttttaaaagcattaaagtacactttagaaagcaattatatttacctatcaattttagaaaatcaagtatttaaccaaataatttttggtttgtatccaaatgtgatcattctaaagtttgtacatactgtaaaatgaaagaactttgggaggtcgaggcaggtggatcacgaggtcaggagatcgagaccatcctggctaacatggtgaaaccctgtctctactaaaaatacaaaaaattatctgggcatggtgacatgcacctgtagtcccagctactcgggaggctgaggcaggaaaatggcgtgaacc

SEQ ID NO: 17689 - DNA, 405 bp, Homo sapiens
atacatcccataaaggacttttaaaagactaggtagtctcaaaagttcggtcgagctctatatgctgtactagtataaatcctcctttcagaatttgaaggagaaaaagacattttatgatgtgagggtcattcagatgagaccagaacaaactgaagtgtggttaaaggtgcagggccagttggccagaatgcccctgcgacagttttacatttttaagtgatatcatattacataataatagcacatgactatttctattctgtgaattataattgctaaaggaaataccccgctatttatgagatgcttagtgcatctgtcaccatggccttctggcccaaatcaaaatgatcggagctattaagatgatttccctatttggctgggttttaaagactatag

SEQ ID NO: 17690 - DNA, 461 bp, Homo sapiens
gatccagtaagacttgaagaatagaggtttggggtttatgaaagaattctagggccaataatacggatttgggaatcatggtggcattttatggcgtgagagttgatgtgatcacaaagggaaactatgggggattaggaaagaaggaaaaggatgaaatcctaagaaactccagcatttagaaagattgtataggtacaaaagccaacaaaggaggatgagatgaaagcgggggaaaactaaggagaaattaggagagagttgccatgatagaaacaaaggaaaggggcgttttaatgtgggagtggctagcaatgcaaatgctacaaagtgcaaaaaagccaaagactaaatcgggtttcctatgggcattggcagcctcactaatgtagcttcagatgagtattaggtgttaagccagccttcgtgaagtatgtcagaggtccagccagcgtccacat

SEQ ID NO: 17691 - DNA, 473 bp, Homo sapiens
gctgcaaatcatcaaaattagggatattttgttaccactttctttattgtttattttttctctctgctcctctccctgcatatggttgttattcaatgtatttgttaaattcattatttttttctgaaaagaatgaataaagagaaacaaaagattttatttgcagaaattacataaaagacagtcctcagttaaatcttcctgattaataggttgactgtaagtcactcgggcctgaaacagtatgtgttttgagcactccctcttgaatttctgattcaactgtattggggtggatcatattaaaaatgtttcatgttctactctgaggcactcatcctgagcaccagagacctaagcagaatggggctaattagtggggagagaatcagcaaactgagtttaccaggtaaaaataaaacgatttgctcctttacaaggacttaagcctttggaaactggaaagtaaaaat

SEQ ID NO: 17692 - DNA, 618 bp, Homo sapiens
ataccaggacctggagacaaccaacattttggagaccttcatcaaacagaattaggcccctctggtgctggctgccgagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctgtaagtagggtcaagttgatatttcttctcaatctggtgtttcagggctataagccataagcactgctgctctttaaacaaatcctttgttattccaataaaatggatgctggctgagcgtcacagaaatacaacatggttctcttcctccaggcctcattcctcaagatgttaagggaaaggaaataagctgttagggatgcctgtgagcttcctgccctctcttaccacttccttcaggaaaagtctgcccagagtttactaacagtgatgttttaaatccaggaactactgggcgtggtggcacgcatctatagtcccagctacttgag

SEQ ID NO: 17693 - DNA, 524 bp, Homo sapiens
ggtcataagaaaaaatacttgctaaatatttgaaagaacagctacaatatctctcagtgggaaaaatagaggcagaaagctagtggcaaaatctctgagtgactgtttcccattcttaacccagtatcaaatatgctatggaatcagcactacagagaagctgatataatgggaggcagaatgccattacaccctttttttcccctcaggatcttagaatcagtcaccggtggttttgcaaaaactactactaacaacaacaacattttaaaaaagaaacctcatcttcagagaaagcactggctaaccggtctccattttcagttgctgggataaagaacctatgtgggccaggcgcagtggctcatgcctgtaatcccagcactttgggaggctgaggcaggcagatcacttgaggccaggagttcgagaccagcctggccaacatggcgaaaccctgttgctactgaaaatacaaaattttagccaggcatggtggcatgcgcctgtagtccctactgctc

SEQ ID NO: 17694 - DNA, 561 bp, Homo sapiens
gtgtatccaggtaaaaagggcattttgcagtcttcctcgctgtttatgatggccaggtaattcagttctcttcagtgcagatgtctcctggggactttttgggaaaagtagtaatctcatatctgtgtgaaaaggcaacacatccagcccaaagtgtatgctatcagtctcacttgtagttaagggtggctgtgaaatacaattctgtcaatttggacatatcacacttctcctgggtatctgagaaaaatttgcctttcctgacatggacaccccttcttccttactatatccagcttatttctactcaaagtgtgccatagcttgggtaactcgggcagcagactctgcgactgagattagtatgcagagagcttgttaggagttctcataggatcaaaacttgaggagcaaagaaaggagagtatgattgggcacaggagggaagaggagaggtaatgcagtgtgaacagaaagttcagacaaagctacagggcgctctcgagataagatgacccttcagtattattccatgttgcacaaaaaagactgatctctatg

SEQ ID NO: 17695 - DNA, 567 bp, Homo sapiens
tacattttattgtggttggagagatcaaaatgcctaagactgtggtctaaagagaagccatcaacatgtacactgagaagctttcctttttagagtccattacagtatccttgctctttgagttgttccttcttctaggtactcataagtttaatatttctgagtctaactctattacaagctctatgatgaagttcaaccatggagtcatgaaagatggcttcaccattattgatatcaaaatgataactagtgatattctcgtcatattacccaaataaaattgtataaaccaggcagggcgcggtggcacacgcctgtaatcccagcactttgggaggctgaggcgggtggatcaccaggtcagaagtttgagaccagcctgaccatcatggtgaaactctgtctctactaaaaatacaaaaattagccaggcatggtggcgtgtgcctgtaatcccagctactcaggaggctgaggcaggagaatcatttgaaccagggaggcagaggttgcagtgagccaagatcacaccactgcactccagccagggcaacagagcgagac

SEQ ID NO: 17696 - DNA, 563 bp, Homo sapiens
cagctactcgggaggctgagacaggggcctaggattaaataaggagttttggcaaaactaggctggaactccaaaacctgctacgtaagtactcacgagggttgctagttattagtattattactttgttgttatttttaggagtggagcaggttgtatttgtatcttacatcaccggctctggtcagatttcaattaatgtcacagataggatttaaacatttcttttattatttttaagattttaggccaggcacggtggctcccagcactttgggaggctgaggggggtggatcaccagaggtcaggggttcgagaccagcctggccaacatagtgaaactccgtctctactaaaaatacaaaaaaaattagctgggcatggtggcacgtgcctgtaaccccagctattcgggaggctgaggccaggagtttgagactagcctgggcaaatagtgagaacttgtctctaccaaaacaaaacaaaacaaccaacaacattaggccaggcgtggtggctcacacctgtaatcccagtactttggggggccgaggcaggcagt

SEQ ID NO: 17697 - DNA, 525 bp, Homo sapiens
tgatatccctttaactcaattcatccctcaggcttgacttggaggccacttactcagggaagtctctcttgttggttcagacaatgctagtccccagttatttactctgagaatgtcttctactttttctttcaaacacacataattataagtaaataattatctaggtaattatttaatgcctatctctccttctctcaccatcaaacttttaaggacagagagggcagaatcatgtctgatcagttcaccttacatgcacagtgccagttatatagtaaatgacctaaatatttttgaatgacgtatacttgtggccatttttcctttttagagcttcaccacatttagatattgtgcaaaacatcccagaatctggaatgtactctagttccacaggggctgttcctcactttgcctgatggccaataacatgcataagtctcctttattcccgcctcaacaggagtgtgtgcacacacagacacacacacactcacttacacacagactcacacactcaca

SEQ ID NO: 17698 - DNA, 594 bp, Homo sapiens
aaacaacacttattgaaaggcatattttaactagaaactttctatatttcaaaaacacttaagatgtcattatattaagtcaattgctactattgagaaactaagcctcaaagacaatttgtctaaaataatgggatcagaattcaagtccatgtctatcgaaccaaagtgattgttcttctacttagaagagagactattttagctggaaggggcttttttgaaatagttcaaaacagattcctaatgttattgataaaataaaacaagggttaaagagaatgaggtccattggatgcttgcagagaagagaaatgcaaatgaaacatgatcctgaagtgtctcttggaaaacaaatttctatctttgttattggaaggtcattcaacatcctttaaaggaatttacttttgtataattagtgaccacaataagcctaatctgggaacaattgtttttggtcaactcctacaaatttcttgtgggaggaagatggccttccttttctatgaattcagaattcatagcacatggtagtcacccaacatgtgtttgttggataaatgatgaatgaaacagaataaataacagaac

SEQ ID NO: 17699 - DNA, 571 bp, Homo sapiens
atgcagggtttcggctttgcgcttgtgtaagttctcataacaccacctttctctcctttttctccctgcctgacagaagcagccacttcctgcagttactgatgtctggattacctcaacatcccgtttgctacatcaactttctaaaatacatgccgtctattccctatactaaatcccctctatttgaaatttctgatttgctttccatgttcctgactagaacctgctggaacaggacattcatacctttagtgaggtcttgtcaaatctcttacaaggataattacacagaaataaaattttagctcctaaaaagagaaaactatcctattaggttgctatctctgtcaacaagaaagaatatactaaccccataggtacaaaatttcaggttcttcattcactcctgaatgaatgtgatccgggccccagcaagataaagatgtcttaggctctaggaacaaaacttggaatgagacatgatctctaacccccaaaaggagactataattaggagagaagaggtcagttataatgccacagtggaggaatctattagagcaactag

SEQ ID NO: 17700 - DNA, 536 bp, Homo sapiens
gctcaactccactaggtgacttcttcagtctattctgaaccaaaatctattctgctgtaaatagatggagaacaacaggatagactgtcagaaactgtgtaagatctaggattcactgtttcatggatgctatcagaaaaaaaataaaaaaacctgaatgagagacaaaacacttcattgctcatggcaaaagcagtagccagatctttatgcttatttgcataaattccctatgtccaagtcccaaggtggtgacatcaagaatccatgacagctgctttcattgaaagggtagaatgctgagtttggggtcatcaccactttcatggtaattgaaagtaaacctactctttgcccgatggagacagtacctcatccctcaaggttaagggttgcaaacaaaacaaggatgagagatggctcagatggtcaaggccttgcattctgggaatacacagcaagaatatgcagggacactcagggcgtatgctggattgcctctctcaacacagactaaaaagccattcaaaattgag

SEQ ID NO: 17701 - DNA, 552 bp, Homo sapiens
tggatcacgaggtcaagagtttgagaccagcctcaccaatatggtgaaaccctgtctctactaaaaatacaaaaaattagccaggcatggtggtgcgcacctatagtcccagctactcaggaggctgaggcagaagaatcgcttgaacccaggaggcagaggttgcagtgagccaagatcatgccactacactccagactgggtgacagagcgagactctgtctcaaaaaaataaaaaaaaaatctgagattgtggaggcagaagaggtcattctctttctgaataaagttgttagagaatctagttaggaaaactgtgttctagtccctaagaaacatataaaattaaaatctctcaagaacattctcacaaaggcaattattttgcttgttttcagatcaaaatgaaccatgtaatttcttttaggaagtagaagtagtatacaaacaatctgtaaaagagtttaattcagccgggcgcggtggctcacgcctgtaatcccagcactttgggaggcagagacgggcggatcacgaggtcaggagatcgag

SEQ ID NO: 17702 - DNA, 418 bp, Homo sapiens
cagatcacctacaggagagatggccacaccaggaacctgtttgtgtatcatgaaagtgggaaggtgagatgcctggagttgccacctccgcctccagctcgcaccccaggacttggcaggtgcagctcaccacctcccctgctcactggtgctgtgctcagctgcctcttgagattttctgctaccatttgccttaatctatcattgcctcccagtctgagataaagatatgaggagggcagggtgagatcagggagaggaacctggcaagtaccatggctatatctggacagtgcacagccaccaatgaaagtccagttacagaagggactatgcccagggatgcaaagccaggtagggccagaggttctgaatacgggggaggaactgatggacagtcaggcagcagtgcaccccg

SEQ ID NO: 17703 - DNA, 125 bp, Homo sapiens
ttttggggtgggtaaggatcgtatgttgaattccttctagctggctggtatgctattcttagctgggaaaggaacataattgtgatggggtgtgtgtgtgtgtgtgtgtgtgtgtgtgtgtgtgt

SEQ ID NO: 17704 - DNA, 442 bp, Homo sapiens
  misc_feature 385: n = A,T,C or G
actcaaactaaacttgaaaaacaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctggagttagaaaagttacagcacagtactgaaactgaactaacagaagccttgcanaaacgggaagtacttgagactgaactacaaaatgctcatggagaattaaaaagtact

SEQ ID NO: 17705 - DNA, 456 bp, Homo sapiens
  misc_feature 103: n = A,T,C or G
tacgaccagaaaaagagaactttgacattatgtgtaaaaatcagcctaaagacttcattcattcaagttcacggtgagtcatagctcttccaggctgcaagtngatctaattggcaactgacttcttaaaaaagagaagcaaaaagacaattttcaactttttcttgtcaactcatttcaaaaggaagttaaggtcatcatattcaatatcaccgtctcttagtacaaactggaatgttatttttccctgttatggattcctgatattttcagttaagtttatttatttaattcctcccatacagcatacatcactctctatcctggagatgcaacagtaaacaaggaaagcagtgtcccttctgtcatggagtttatattctagtacaggaagcataaattaataaattacaaatcaggattcatgacataatagtttataagagcttagataca

SEQ ID NO: 17706 - DNA, 568 bp, Homo sapiens
attcattttatacataggcataaaaacacacacatacacactttcagttaattaagtaattctcaaagctgtactctgaggtaagtcactattattatcatcactattttacaaagaaagggaggtttaggaagagttaggtaaattgtttgaggtacagctaatgaatggcagagatggatttcaaaaacaattctgtctcctgcccacctgcacaattacctactttgctttttcacagaagtagaataaattagatgtggtgagtagagaagtgaaataaaaaataatcacaaagcatgccatttggataacttggaagacaacagatacaatttactatgcaattactatgcaccagcactcactatgataaaccctttaaaaagtcaactttgggaggccgaggcaggtggatcacctgaggtcaggagttcgagaccagcctgaccaacatggtgaaaccccgtctctactaaaaatacaaaaaattacccaggcatggtggcgggcgcctgtaatcccagctacttgggaggctggggcagcagaatcgcttgatcctggg

SEQ ID NO: 17707 - DNA, 480 bp, Homo sapiens
aggcgtgagccacagtgcctggccctagagtagtttctgtgttctttactgataaaagcaaatggctgtatttgaagctatactacccttccacataaaatggacccaaaaaataaagagttgtaaaacaggaagaaaagatcacagtattagagaacaagttcaggaagcccaatattcaaataggagttctagaaacagaacttggaggaaaactgagagaaggaattcagcaaaaaaaaaaattcaaggccgggcatggtggctcatgcctgtaatcccagcactttgggaggccgaggtgggcagatcataaggtcaggagatcgagaccatcctggctaacacggcgaaacccagtctctactaaaaatacaaaaaattacccgggcgtggtggcggggcctgtagtcccagctactcgggaggctgaggcaggagaatggcgtgaacccgggaggtggagcttgcagtgagccg

SEQ ID NO: 17708 - DNA, 560 bp, Homo sapiens
acaaggtccacatccaggaaaccccttgtcactgtgagtggtccttggtaaatgtccagtgcagctggaccctagagaactggggctgggttgcagcagggttggaaaagagagatagcggaaaaggtagccaggagcccaaacaggaagccaagccgagcagttaagactttatctccaagatagctgagcaatcaggacaggattttaaagacgagagtgacttgctaagactggcatttgaaagagctctggcttctggataatgcaggagaggggcaacactgaagaccagtttggggccatcacagttttccagggaaaagatgctggtgacttgaactgaaagtagtggaggagggtaaagagaaaacaaggaggttgtagaatgtcttcaggagaaatagcagaacttagaattttcttagccgggtgaggtggctcaggcctgtaatcccagcactttgggaggctgaggtgggcagatcacaaagtcaggagattgagaccatcctggccaagctggtgaaaccccatctctactaaaaatacaaaaatta

SEQ ID NO: 17709 - DNA, 603 bp, Homo sapiens
agccagccacctagctacccttgactactgttcatttctgaaacttgtttctctagaacttttgttcattcttaaagcgaaccaagatatttcaaatacatgaatttttttacttaagttagctaaagtcatatttggtagttttcaccatgaaatctatggtctgccaccccaggtcttccataaggcaacccacatggtcctaccttctgtggagcacagtcattgctgcattctgaaagcccctgggttaaacagatgtttctcgagagcagctgatatcagctaggtaaggagcatcaccatcatataattaacaagatgtgcatgtatcttaacagtcaattttaattttcaaatcagagcctactaacacaaaagaatctcccttggaaagaatatacacatacatataactagctagctagatagacagacaatcagactgattgattattcattcaacatttattgtgttcttattatggaccaaacttcttaggtcttaggcataaaaagacaaagaagataccacccctccctttcaggagctcacaatcttggtaagagactgaaatgtgatcgggttatggcaataacttt

SEQ ID NO: 17710 - DNA, 637 bp, Homo sapiens
cagcttcctgtcacacatggatagtcctccagccctggtcaaaatgccagccgactgcagcaaaatgacaagaccaggtgaaatctgcaaaacctacctgcggccagcccaaaatatgaacctaccaaattatgtgctaataagtgattttgttttaagccattgatgtttaggattgttcattatacagcaaaggctgatacactgatagagggatcacgtgatatgaaaaatacgtggtgactaatgtgaccgttggcttgctgggatgcccatgatgccagaaactcctaagctagtcttggagaacagcagattcagtcctcccatttctcactcactcctgggcatgaattcattaaatgggaaaggaaacagattgacctgacctacttttatttttctcctcttttttcagctgagtggataaaaagtaaatgtatctaagttaaaagtacacaaggccagacgcggtggctcacgcctgtaatcccaggactttgggaggccgaggtggatggatcatgaggtcaggagatcgagaccatcctggctgacaaggtgacaccccgtctctactaacaatacaaaaaattatccgggcgtggtggtcggcacctgtagtcccagctactcg

SEQ ID NO: 17711 - DNA, 629 bp, Homo sapiens
tcacgtgatgactggatgtggaggcaagcttcagagtcagggaatcatctgagaagacccaagaatttgactctaggagccataaacactcagatcaagacccgaggagtcaagagctgcttccaggagaaggcaggttcctgctgggctcagcagcagctgtgcgcagggccgtcaggctggggacggacatttgaattcagttgactgatggaggagcagtgagcctgtgagccagcctctggggtcaaggctcccagacagtggctgctctgttactccatgtgttccctaccagctcccccacggtggctgcggggactgagcacacagaccctgcaccttctggggcatctcccctgcctctcacaaagtcctgctgcttcctctgctgtattcatcacagtcttcacaatagtcatgtcaccgatttctcaagaatgtgtaggaatcatgccttgccccatgccctcagcatttgtgggccgttcagaggtatgttatgtgaaaacacgtcactacaatccgctgaaagctggtaggtgcaaagctcctctatggagtttccaaagcgccccagcagcctgggaggcctggcaagttgactggcttcctcagtcccagctcat

SEQ ID NO: 17712 - DNA, 559 bp, Homo sapiens
tggtcttcactatttttaaaccatctcagctaaatcttttatgttattgtatttttaattctggtttgatccctggaggtgaaggctacagtgaaccatgattacaccactgcatctcagcctgggtgacagagcaagaccctgtctttttataaagagagaaagtgagagaaaaagagaaagagaaagagagaaagaaaaaggaaagaaagaaagagagaaaagaaagcaagaaagagagagaaagaaagaaaagaaagctgtgaagatgatacttgttaaccagaatgaaagctcatttggtcagtagattaaatacaaataataattctatcattatgtctcaggcagtgtgctataagtgattattacgtgtcatcttatttcatccttacagtaatctgttttgggtaaattttaggataatttctggctgggtgcggtggcttacgcctgtaatcccagcactttgggaggccgagacaggcggatcacctgaggtcaggagtttgagaccaggctggccaacatggtgaaatcctgtctctactaaaaatac

SEQ ID NO: 17713 - DNA, 518 bp, Homo sapiens
ggaatcccacagtgagctataatcactagtcccagtaccttgctcagtccttcgctggggctgcctgagaacagcacaacctcagcttaacaggtgaggcagaggccaggctcagtggctcacacctgcaatcccagcactttgggagtccgaggtgggaaggtcacttgagcccaggagttcaacaccagccagggcaacatagtgagacgtcatctctactaacaataaaaaagtaaattatctgagtgtagtggtgcacacctgtagtcccagctactcaggaggctgaggtgggaggatcacttgagcccagaaggtcaaagctgcattgagcctgggtgacagagcaaggcccatgcctcagaaatagaaaaataaaaatagctggaatctgtcagctcccagcattgctcacagccgaagggcaagctccttcttgaagggagaccagaacagcacaccctagagctgccccacccatattggcgcacagttggatgactctgatgatccac

SEQ ID NO: 17714 - DNA, 520 bp, Homo sapiens
gtacaaagatgttaattggttctaatcctctcctagaagctgttttggtagcctgacctggcaccctgaaggacaccttggtgtgaaaaactaaagggtccattgaggagggagtgaaaggcagccaagcattccaacacattttaatttcaggaattaaaaaagaggaacatcatcatggagatcctagagaaatcttacaaagctttaataacagtgaagtaagtcctacaaacacccaagcgcgcacgcgcgcgcacacacacacacatagacacacacacacacacacacacacacacacacacaaaggaaaaaggaagccctagagtaggggcaaagggaaattcagattctcaaattcttcatttcataacttcttcttataaactggtttggctctctgaaatccaaaaacgtaatttcactagttgagacatttgttttttctgtcctgatttaccaaactgacatcctcatgaaaatcagattcccactctgctcaaccccgacagactct

SEQ ID NO: 17715 - DNA, 564 bp, Homo sapiens
catttatataaaatataatgattgctttgttatctgtcagcagagactttgaaatattgtatatttgctttgagtggacttaactaattctgctaagatgcttatggagaggtgggagagaggaaaatgtttgcagtacagatagacctatttagaagaaaagatattgctagtgggcagatctcaactctggatgagatgcattaggaataatggcgatgttagactcaaacacagtaagtgacacaaactcctctttctcttttttctgtcattgaatggccccttcctccacccagttgtccagtccttatgttttggtaattctgagtttgtcctgactttctgcatccaattcatcatgaaaccctcctgtctcataaacatctttcctcttctccatgccgctctgtggctctagctcagaccctcctcatgtgaagcttcttcccttgtgatgatgtcttgttgatgtcacatccctggcctccagacctcttactgtgccacccttttcctcaggactcttcagggccagcctcctccctctttttgtaaaccacg

SEQ ID NO: 17716 - DNA, 349 bp, Homo sapiens
gattctcctgcctcagcctcccgagtagctgggactacaggcgcccgccaccacacccggctaatttttgtatttttagtagagacggggtttcaccgtgttggccaggatggtctctagctcttgacctcatgatatacccaccttggcctcccaaagtgttgggattacaggcatgagccactgcgcccggccggaattcctgttcttttaagcccatgtctaatgccatttcctccatgaagtctctcctggtgcatttcttctcccagggaaccagcgctctccttcagctttgtcaatgtaagttgtgaagaaagtatttgttggtcgggcatggtggctcatg

SEQ ID NO: 17717 - DNA, 488 bp, Homo sapiens
tgaaaggtcaaggggattgatcatagggagcctggatttcagagggagttaaggtaggacagaggagcacgacttctcattataagcccctctatgctttttgatttgtacatggtggttattcctctggttcaatttctaaaattgcttttttaaattggaaaggcctttggtggtaactgtgaggtagaagccaaggggtgtgaatcctaccctgctgccaacttgctggcagagcccagaggatgactgctggcaactgctgatgaaggagaggaagttgcttggaggtcctggggcccgtggcaagacaaagggaatttggtaaaggagcagaggagacctaggctgggcccgcatagtgtaggggccacttaggatgtcttcctgccacctggttattttatgtagctttttaatatactgaagttgacataattttcaataaagcacattggagctgaatggagacgtttgctcaattctgc

SEQ ID NO: 17718 - DNA, 469 bp, Homo sapiens
tcactacgttgcccagtctgttcttgggcccgggagctggaggctgccgtgagccgagatcgccccatgccagtatgggcgacaaagcgagaccctgtctcaaacaaaactcacaaaatcaggggacaaggaaacaaaacaaggcttgatagtcaggcctagctgtggggacaaatgccataggtctgtggtttgcagcttcttggggtcctgagagaacaggcccctcccccttttcacgacagtgtgtgcatatgcacactcacttctgtatccagtttcagaggttctcagatctgaggtcccctatggactcctccgctacccccggttgcaaggtccctaagccattgaagaatctgacagaggcacaagtccaccctgacctttggcaggactgttctgctgccagagggattaccgagaaaggaaatcttgtcctggactcttcaagtggggtgagtgagct

SEQ ID NO: 17719 - DNA, 387 bp, Homo sapiens
atttattcagcaaatatttttaaaccactttctttggggtaaacagtgtactaagcactagagatatcatggtaaacaagccaggtatgatttcagtagtatacttgcttctaagtctattttctttcagcctttggatactggtttaaatctcttgtgggattttaagtttggtaggaagacagtcatgggtcaaataaatacacatgcttttagaattactacggacaagttcgagatgagttttaagcccaggccacatgtcagctttgtgtacttagataagctaccttcttagaacctcagggttttttttgtttcattcctaataaagaaataacaaatactgcctcacagactagttgtgataaaataagatatttgata

SEQ ID NO: 17720 - DNA, 162 bp, Homo sapiens
aaagatcattgcaagtaaaatgaatcattaagctgatcaagcctagaaaccaccaccagaagtatttatagcattattagggcggagtatctacaatccattctcagacttattataagtctcaagatccaccctttgaaaagctaatcctatcctcaatct

SEQ ID NO: 17721 - DNA, 536 bp, Homo sapiens
aattgaaataaaatataaaatcatttaaatgtttaaccatgttaaagggagcatcatgacccagagcgttattcttagaagttgccagccttataaagacccatcagggtaagcaagtctagggacaagcagttaaaaatgaagcacttctaactatgtacctcaaggtgaaatagattttatagaaaaagccatatatgataaaaatctaaactttcagaactagatgactttgatggatggctttacaaaatgatagctaatataacataattcaaaatcaaatgagtttttaaaatagagcatctgggccgggcgcggtggctcatgcctgtaatcccagcactttgggaggccgaggtgggcggatcacgaggtcaggagatcgagaccatcctggccaacacgctgaaaccccgtctctactaaagatacaaaaaattagccaggcgtggcagtgggcacctgttgtcccatctactagggaggctgaggcaggagaatgacgtgaacccgggaggtggagcttgcagtga

SEQ ID NO: 17722 - DNA, 655 bp, Homo sapiens
tctgttaatatctttaaaaatgaaaaatatacttttcttgagatccaataataccccttctggaatcatatctcagaaacaaatgcatcagttctttaggataattatagaagatttgtgtggggcaggaggggagcagaggaggaaggaaagtatacactgtctataacagcaaaatttcataaaacaaagagaatgctcatcattgtggaaattactaaattaattgtgatatagcacacaatgagatacatacatagttaggcctgttcctgctgacttagagggactgccacaatttactgggaagtagatgaagagaaagtaagatgtagaagtatataatatggtctagtgttcctagctgacaaaactatctctttcatcacattcatgaaaaacagaattatacacatctagctaacagtgataaggtggggagattaaagaaaaaaaagtggctggcatggtggctcatgcctgtaatcctagaactttgggaggctgaggtggggggatcacctgagatcaggcgtttgagaccagcctggccaacatggcgaaacctcgtctctacgggatgggggggaaaaaaaacccaactagccaggaatggtggctcattcctgtaatcccagctacttgggaggaggct

SEQ ID NO: 17723 - DNA, 429 bp, Homo sapiens
tttgtgcacaaaaggcatactgtttaaacaaactggtatctacctatcttagaaatttttattattaacagatttaaagccaaatataacaatatacgcaaaagtaggagaatgggtttctaaatttttggaaaacaataataggagttcttaagatgcatgaaaggcaactgaatttcatgacagaaatagtaagaaagaaggaataagaaaatgtttcttggccgggcgcagtggatcatgcctgtaatcccagctctttgggattacaaggcaggtgggtcacctgtcagaagttcaagaccagcctagccaatatgatgaaacctcgtctctactaaaaatacaaaaattagctgggcatgatggccagtgcctgtaatcccagctacttgggaggttgaggcaggagaatcgcttgaacctgag

SEQ ID NO: 17724 - DNA, 503 bp, Homo sapiens
catctatgccttcaagattgtatttgttttgttttttggcagtgaatatggtgtgtgtgtgtgtgcatttgtgtgtgtacatgtgggagagagggagatagacgagagattgaaaatgtatgtgtgttagcctacttggtattctctgagtttcttggatttgtgatttttttgtctttttttaatttttcaaaattattgggtattacctcaatgctcagataaataattttaaatgtggaagcaactctaaactgaggaataggcagaagctggaagagtttcgggtgcatgctagaggcttagattgttataaaaagaacttttaaaggcgattctggtgaggactcaggaagaaaagagaagagctaaagacaaagcctccattttcttggagaatacaaaagtaatcatgaacagaatgttggcaaagacatggatggtcaaggtcattgtcatgaggtctcagacagaatcaagtgatattattattggaagctaga

SEQ ID NO: 17725 - DNA, 529 bp, Homo sapiens
taccctcaaggagtgtacagtctgaaaaggaaattgtgatgcacactaaaattcataggttgtataggaaaatggcacaattgtagtccctggagttaggaagaggtgaatcagaagatgggcaacagagctcctacctccacaactataggggaaataagatgcaaacaaacattagaagggagaatgttataagactaccaggagaagaaaccctggtcaaagcataaaatataattatatattgaccaagttcaatgcatttattattcttatcatcatctgccagcatcatttgattcagatatttatacccaccctaaatgtaccaaattgtcagttcaattagcaaactatgaattttgagaattcatctcacctcaaactctagttgtgattcttattgaaattatgtatataagcatcacacacacgcacccacacatacacatatacactcacacacacttctaataatttaacttccaaagagatacacaagttgtattcttcactaggaataaattat

SEQ ID NO: 17726 - DNA, 526 bp, Homo sapiens
gtgtaaatacttactacttgcttgttgttcttgttgttgttgggggtgatgatgatgatggtggtgatggtggtggtgtcttctctgaaaacactgaatgcatatggctacatgttcttttaagaggtaggaccttccagagggtgtcaagtgaaataagttcatactatggcacctgacatggaacaactggggagcggtggtttggaggtactttatgagtcaggattgcattaagctgcatggaatagagacttgtctgtaaatagggctttgtccttcccaataacaagaagtggatgcagcctggggctggcacagctgctcaagatagtggtcaaagacccagcttctctacctgcctgctgtgcatcctcacgctcctgcatctccaggcatcatgaacacattccaggcaggaagacagaagggcaaaaagtgtgtaccagtatgtttattcctttttatgaggaaaccaatagccttctcagatgccccatcagcagacttctgcttgcctctcatt

SEQ ID NO: 17727 - DNA, 575 bp, Homo sapiens
gtgtgcacctgtaatcccagctacttgggaggctgaggcagagaattgcttgaacccgggaggcggaggttgcagtgagtcaagatcacgccactgccctccagtctgggcaaaagagcgagactccatctcaaaaaagaaaagaaaatgggaatgcattcaggtgagtaaagtatttaatatgtttgtgttattatctgaaaactgcctgtggtgcctaggtccagggccaacaactcatgaatggatttgacagataaaatgttcagaatgtgataatacctaattaggaaagaaaatactagagctatgataattataatgtaacatcatgtctctctccaccccatctccaatggaaaaatgctgtcgttgacttaaatttccctgaagtgattttaaataacccagtgaaatttgagagagggaaatttgtttaaaatatgataaacaagatgaaagattttttttatcctaaaggttaaagtatcccctgaggtaaatcatctttgggaatagatgtttatattggttcctatgtctcccaaagacctccatgtcaaaccagcaatttt

SEQ ID NO: 17728 - DNA, 562 bp, Homo sapiens
ctctctctaccaactagatcaagagaatcctgaaagtcaaggttaaccaagacagagccaggctctgaaaaaatctagaggcctcaaggttccaggaggaagatgagctctgtggctactaggggaagccctggtgccagctgactggccaaggatctcattacctttataaacacattgattgattgattgagacagagtcttgctctgtcgcccaggctggagagcagtggtgcgatctcagctcactgcaagctctgcctcctgggttcacgccattctcctgcctcagcctcccaagtaactgggactacaggtgcccaccatgccaggctaatttttttgtattcttagtagagacggggtttcattgtgttagccaggatggtcttgatctcctgacctcatgatccgctcacctcggcctcccgaagtgctgggattacaggcgtgagccaccgtgcccagccacagaaaatatatttttaaaattagctaggtgtgggggcacacagctgtagtcctagctacttgggagtctgaagcaggaggataacttgag

SEQ ID NO: 17729 - DNA, 571 bp, Homo sapiens
ctgaattatagttactaaatgagaggaaattgtgggtgatgtatcttcacagatattcctgggatagatgaacgtgacttagattatatagaaatcaaagattatatttcagggataagaaaactaggcacagaagacactaagattgaaaaataattatttctgagtaactgagtcatgcctagagtaaagaaatagtcaaattagccacaaggcaagtagtatgtgtttgcttaagtcctgaggttgaacgatctcattaatggctccaattcctcacacgcaccccgccccctccgagatcagcatccttgagcatgtggtcttccagtaccctcctagtctgtgcccactgttcgatttgttgggaatggggtgttaacatatgcaacaggggccgggcgcggtggctcacgcctgtaatcccagcactttgggaggccaaggcgggcggatcacgaggtcaggagatcgagaccatcctggctaacacagtgaaaccccgtctctactaaaaaatacaaaaaattagccgggcgtggtggcaggcgcctgtagtcccagctactcg

SEQ ID NO: 17730 - DNA, 558 bp, Homo sapiens
ctgctcagtttgtttctcagcactgtgctttgcttaaagtcctgctgtaaaactctgagatattgattagatatggacttcaggagtcatgatttttaccatcttattttgtccctgggtcatatgatgaaatacttcagttgttttttatctgtgtaattgcttcttgcattataaggtttttgtaacactcaccattcttaacccaaagcaagctttattaaatatgaaaataggtcatcaaccacatttcattttgtgtacgttaagaactattagtttggccaggcgtggtgacttacgcctgtaatcccagcactttgggaggccgaggcgggtggatcatgaggtcaggagatcaagaccatcctggctaacacagtgaaaccccgtctctagtaaaaataaaaaataaattagctgggtgtggtggtgggcacctgtagtctcagctacttgggaggctgaggtaggagaatggcgtgaacccgggaggtagagcttgcagtgagccgagattgcgccactgcactccagcctgggcgacagagcgagact

SEQ ID NO: 17731 - DNA, 544 bp, Homo sapiens
ggctgaggcaggagaattacttgaacccaggaagtggaggttacagtgagccaagatcatgccactgcactccagcctgagtgacaaaagacgagaccatctcaaaaataataataataatttctggcttcttctgcagatgaaattagataatctttggaaaggcttacacatagtaccagatgttgtaaaatttactaattaataggaattaattaatgaatgccaaggggcagagccacacttcctatgatagttccttgctataaggtgctattttgttctctacatttactccatagtaagcttttgtttgagaaaaaaaatgccagtttggtgcgtagtagatacgcagaggctgagaaaggaacagatgacacaataacacaatggtaacagaatgtataatgcttccctctcaacttggttgatttgttttttttacatttacttggaccaaacaagcaaaaatacatgctccccagaagaacagaaataaggattttctttgggaggtggaggcgggcggatcacctgacattag

SEQ ID NO: 17732 - DNA, 325 bp, Homo sapiens
tgctcaagtgtcagggtaatatgtattgatgtctacaacttattatgaaatgtaccaacaaaaagaatgaattgatagatggataaatgacaaagcaaatgtagcaaactgttaaccatagaacctaggtggtagtaatatgggtgtttgctatgcacttctttccattttactgtatgtttgattatattcattataaaatgttagggtggggtttttaaaaggcaaatggtctgcaaaccttacccaaatacagtcacccaagagtcatcgaggtgatcttctgaagtcaaagaatctccttgagtataaaaaggatccaact

SEQ ID NO: 17733 - DNA, 371 bp, Homo sapiens
tgttttttgtttgtttaatcagtatgacttcttacatttttgtttttctttagaagtgcattttggttattcatttatgcttttataaaaaccagactgtatagtggtgagcagaaataatgccctttaatgccttagtaaggtcagagacctagcaggtgatcgcgtgtgctcccctccaggatcccagggcagcgaagcttgtgatcagttgctgcctcttcttgccgttgtttcctttacccctctgcttaccgaaaataattgctgttcttttaatgccaagaagttcccatttataaactgaagttagttagataattaggtagcttagaacagtggcttttaaactttttgattggctctactat

SEQ ID NO: 17734 - DNA, 380 bp, Homo sapiens
gcaccaaaagcactcaccactccgtgtctctcttgaaagctaatctctgtggtggtgtttttccactgtgccaatctgaagcggcccagaggagggagaaacagtgtaggccacttttcatgctgtgatgacagacagctgaatcatcctgaatgtgtgcaattgcatgggtgtttattactacaagttacatggtgtttgccacagatatgagtcaacccaggagcatcctcatatttgtcatcttgtaataataatcagagtatgaaagtacaaaaaccatttgggggcgttgatgacctctcagaaacagagctttcccatccaccatggccacattaatagaaacatctccttattttcagatgatttacttttta

SEQ ID NO: 17735 - DNA, 464 bp, Homo sapiens
acagcaaaaatctaatgtgttctttagatgcagttggtgtagctggacattcagtatttgttggtacttggcaaaatgatggagagtgacaggtttttattctaaattctatccacaaacctgctttgtgctagaatctgaaagccccttctatattcatgatttctctgccatttctccactaaaatctttttatgtatacaacaaacagctttatgaaataatgataaatttcatcacattagaagtgttaaggccgggcgcaatggctcacacctgtaatcccagcactttgggaggctgaggcgggaggatcacctgaggtcaggagttcaagaccatcctgaccaacatggtaaaaccctgtctctactaaaaatacaaaacttagccaggcgtggcgatgggtgcctgtaatcccaactactcaggagtctgaggcaggagaatcgcatggacctggg

SEQ ID NO: 17736 - DNA, 401 bp, Homo sapiens
tagaggattacaggcgtgagccactgtgcccagctgttttacatcatttttttaaaaaaattattttttatttttttgagacagggtcttgctggtgcctaggctgcagtgcagtggcacgatcatggttcaaggcagtctcaacttcctgggctcaagtgatcctcctgccttggcctcccaaagtgctgagattacaggtgtgagccactgtacccagtctgttttacatcatttttaatggctgacttttccagttgtaactgcaccataagttatttatttaatgtctttactggtggacatttttactattttcagttttttcctacacttatcaatgaacttcattgtggatacatcttgtagactcatcgcttctttttttttttttgaaaaaa

SEQ ID NO: 17737 - DNA, 589 bp, Homo sapiens
tcaagattaagctagtatggcctcagatgagaagacacatggaaacttgagaaataaaagggaaagttaatgaaagatgttagtgaaatttcattcaccagcagtaatgggtgttcatgcatgttcctaagacattacaaaagttaaaatttaaactcatatgttaattcatagagaacttgatggcaaatttaagtcttcatagcaaatttaaatattaggaaaacatgagggtatgtgtgaaggttaacagagagtatgagagaaaaaaacactgattacaaacaaatatcagcaatatagcgaggtctcattacatgtaaactagtacatgcaaagaagtataaattgttgaattgtatagctggaaatgtcctctaacgcttccctcaggtagtaatttaggtagcgacataagggattatttaacccgatcacgatcactgaagaccctgtatcaggctaaatggagtaaagatgagggctagctctataattttggattttgaaagtccatgctccttatcccttttaagatttggataagaaacagcaaaactgaaaatcggtccatctatttactctccat

SEQ ID NO: 17738 - DNA, 366 bp, Homo sapiens
taggactgaagtaatacagcagtggggcattatacatccatccctctacctaacaacagaaggcaagccagacccatatttgccaattcccaatgaagtaggctcattcctctccatgatcaaaccatggtccctctgacaacatcaggcaggaccaacaccatcgagttgatcaggagccccttttgttgttttctgattgagaaaaagtggtcaagggaagaattcatccccactcctccaccacccctttccatttcacgcaagagtgtattttaaaatgacccaactatatctgtttacaataaagcactttcaatccaacaacataggcaagctgaaactaaaaggatgctacatagtatt

SEQ ID NO: 17739 - DNA, 444 bp, Homo sapiens
atggaggcccagcactcccctagtatagctttaaaaggcaacacaaagcttattatggttgtggcttatccagactcccacccaagtacagcaagtaacaggcagtgactcaatgtccatttaaaaaaatctgagtcttgggccggccatggtggctcatgccggtaatcccagcactttgggaggtcgagatgggcggatcacgaggtcaggagtttgagaccagcctggccgacatagtgaaaccctgtctcaactaaaaatacaaaaaattagctgggcatggtggtgggtgcctgcaatcccagctacttgggaggctgaggcaggagaatggcttgaacctgggaggcagaggttgtagtgagccgagatcgcaccactgcactccagcctggatgacagagcaagactccatctcaaaaaaaaaaaaaaaaaaaaaaa

SEQ ID NO: 17740 - DNA, 573 bp, Homo sapiens
aagctggatcaaggtgctccagaggagagttgaaagggtgatagaaatacatatgcacgcacacaccacacacactcacacactaacatgtgaagtcaacagacaaaagtaatctggtctagacaaacatacttgacgaaatgaaaaaatggtagaaacagtggactaatttggggtacaagaaagcatccagaaagcagttagtggatttttgcctctgaaaagtatttaatccctaaatgccctttatattttgtagcagcccacacataatttaatgtcatgtttatttatgtaaaatcctctgcatggcactgaaattgagtgaaacagccactgcataccccttgaggaaattaaaaggcaagccaaccaacagtgtcgcagacagagctagggacatacagataaccgaatcaacattagacacagcaaattgtagcacatggagagccctcgtgaagagcaaaaaactttttgtaaatttgctataccctcctgactctgtttctccacagagccagaggtcatttgtagctaagacataaaatctgcacctgagttgcaggactc

SEQ ID NO: 17741 - DNA, 486 bp, Homo sapiens
gggagaatgatttttcatgcctaataataatagttaagattattatacttgcatgcattttcttctagaattgtgttaatagtttagaaatattgtgtattacagcactcaatgctgaaattataggtattaacattttactttatgcaaagagaaacagaagtccagagatgaagtggtttatcaaggcttgaagtgccaatgaatctcagatctcctgaactgaaactaagaaccataccaacttgcaataacaaagcaatttttaccttgtttctgggatcaatcacatatttttttgtgtgaattccctgcaaatgagaaatttgctttaaattttttttaaataaaataaacattttagaataaaatggatccagtcattaaaatgactggaaaacctgtagtttagatatttaaggaagatttgcttttctgttatttatttccattgccccttatgcctatcaataagctattaacagt

SEQ ID NO: 17742 - DNA, 508 bp, Homo sapiens
ataatcaagttatagctttacattgattgatatattcatagtgagaagagcatcttcattgacgttcttgattttaagaatcctagagaatcgtattttttaatactgaaaaatgattgtttactagcaattgttcagtatgaagtacaactagtttttttaaatgttatattgaaaaatgtttgatcttgtatatttggttttcaaatctgtttcctatacaataattttatattctaaatgtggaaaaatttgtattattttaaaagtagttgaaaatggtataatacaaaggcagtttaccaaatattctaggccacatacatttctatgaagtgtcgtatgcaacctttgaaatgtctgtggagagaacgtcatatggatgatattaatgctttgattaatgtagagcctttctgtgaaaacctatggccagttcaagtacccaagcctttctccttatcactaccactttttgaaattagaggtggaatgcttgaattctaat

SEQ ID NO: 17743 - DNA, 455 bp, Homo sapiens
  misc_feature 361: n = A,T,C or G
cagtgttccttcctttagggtatgacacaggacatctttggaaatgaaggtcttatgacccaagatcagaaaggcaggagaagattagagtgctgccctgggcaggtgagaggagggcggaagaaggtcagagagagagagagagagagactctgttttctgaggcctacttctgaggcctaatgtgccccaacgttaaaagatagtgacaagggctatgggagttatgagccaggaactgtggacaaaatctagtatgtgttaactagttgtcttgtttaaacctaagaatatactaatataaaggataaaaaagaaatttaagtttggcagcataatgtaatttcagggcatatgattntatcacttactatctgtgtaacatttggcaaggaacctaacattacaaaactacagttcacttctattaaagtgggtataatcatgcttacctc

SEQ ID NO: 17744 - DNA, 439 bp, Homo sapiens
  misc_feature 363: n = A,T,C or G
ggggtttgatgaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacagganacagaagaagagttaattgaaaatgattatagagttagtacctcgaaaataaccaagcagtcttttaaagaaatag

SEQ ID NO: 17745 - DNA, 528 bp, Homo sapiens
ataaacaagcgaaatatctaacagttatgagatactgttttaattctgttcattaaaaagaaaacataaacatgctaaaacgtctttatcagcaaaacctgttcaggcagttaaaaaaatttctctctccaacaaacaagatttaacttgcaagtaaactgtttcatttctgtgaccctttattctcccagttaatacttccattttcttagaaaagacatgccctagtgcaatggttcccccatctgagaatacagcagattcccattagtaactgtttcatgctggcactgattgggggtgaaaagccagggatatgttgtttcaaagttccccaggagattttgctacatgacacgcctcccccacctccaattcccacacagcataactctcttctggtagaaactgtattctgttataagaagtttcactcttacacggaggcacaccaacaactgaaagcaagatttaaaggtcatctaaatcacttcatgctcattattaggtgaaatgctctttcatata

SEQ ID NO: 17746 - DNA, 421 bp, Homo sapiens
gacggggtttcaccattttggccaggctggtctcgaactcctgacctcaagtgatccacctgcctcagcctcccaaagtgttgggattacgggcacgagccactgcacccgacttcccttggcttttaattacagcactaaccactcttaggtctaatgatcaccttaaaatagtggccaaatattggccttgggagaacatccccgaggagggaatgttcccttccccagccacttcccctgccccggtccctgtccctgctgcagctactgggactgagtcccaccacgtggttcatggaggctgacccagggaaggacctgcccagcccccatgcagggcattcttgcattatctgggaaattcttctggcttctccgtacctgttgagactgcagaatgggtgacatttgctgagct

SEQ ID NO: 17747 - DNA, 489 bp, Homo sapiens
ttagttattcacacaaaaacaaccataggactggaactttaaagtgtatgagaatttattcccagtcctaaatggaatatatttttaatgttatcaatacttggggtgaatgaaggtgagttggtggtacccattaaatatcaaggttaggagtggtggctggaaaatcaaccctggtggaagtttaggaataccacggttcaattatgtacatttctgtctgtgagttatggagcaataagacttaaaacaagacttaggctgggcacagtggctgacgcctataatcccaacactttgggagaccgaggtgggcggatcatctgaggtcgggagttcgagaccagcctgatcaacatggagaaaccccgtctctaccaaaaacacaaaatcagctgggcgtggtggcgtatgcctgtaatcccagctgctcagtaaggctgaggcaggagaattgcttgaacctcggatgtggaggttgcggtgagt

SEQ ID NO: 17748 - DNA, 335 bp, Homo sapiens
ctaacggtggagcttcaggtctgcatttttctttctctttttttagtgggcacagctatgatatcaaaaggtaggcctggaaccaagctgatgggagagggaagacctgaactggtcagtataagaaggaaatgagaaatgaacaggaatgaaatggggcgcgagtggtcagagagcaaagaaggaagtgtgggcagtgagtgcctgatggctgcggagtttctgtttcaaacgataaaaaaaaattttagaaatggacacaacattggccgggcacggtggctcacacctgtaatcccagcactttgggaggctgaggcgggtggatcacctga

SEQ ID NO: 17749 - DNA, 509 bp, Homo sapiens
aagtggggccttgtcaatcaagaaaggtaaaagtaaggctgggaaggcaagcagccgcctttgtcaaagtgctgatttttatttccttctacgtacaatgggaagtcactggcaggcttaggaaaggggagtgaaagattagagctgcattttttaaaagatgatcatgtgaggactgggcctaaggagcaagagcagaaacttagggcaggagttttgaggcaggagatgctggcctggtctgggatagagaacagtgacattatccaagatatatttgaaagatagaatcagcaaaaatattggcaaatgagagagaaggaggtaccaaaaatatctcctaattttctggagctcctaggtaaatagtgtaccatttactaagataagaaatacttaggaagatgctacaggatgaagcatcaagaattcagtcttggaaaccaaacggcatcagcatagctgttagaaggacagtcagatttactaacttctgtgttagcatctgt

SEQ ID NO: 17750 - DNA, 522 bp, Homo sapiens
gttctggtacaaggtatttccccaaggtcttacagaaatgtaaagggttgatactattctgagtgcatataaaacttttaaaactgaagaacattgtttagcactatacaaactatagcaataatttaagatctgccatagtggccttcttctgtgcctcagagaacttggaaatcatcagtagcttatgctaacataaaaatacattaaccatgagttacacattctcatatatatgttttcaaataccagcaatcatttcattaaaaataaaacaagcacttccacttatcttaaagactacttctcggctgggcgcggtggctcacgcgatcacgaggtcaggaaatcgagaccatcctggctaacatggtgaaaccctgtctctactaaaaatacaaaaaattagctgggcgtggtagcaggcgcctgtagtcccagctactcgggaggctgaggcaggagaatggcgtgaacctgggaggcggagcttgcagtgagctgagatgtgccactgcactc

SEQ ID NO: 17751 - DNA, 580 bp, Homo sapiens
aattactttgagcagatgccagtatttcttctcaatgagatttcaaagaataagaaagctaaacacagtattatcaagaattaaatgtgagcattctgcctactttctgcaagtggcctacattcaacctttggaggtatgcttatacgtttaacgactaaagtaacataacataatacttaacagtgccactcaggggttttagctgtgaaaaagcagtggatcctaagaacagtgggcactgaagttgcctgtctctatgtcaggttacagctcaagctgtgtatatgctgcagacgcccaagctgaatttaagagaatccgctctaaaacattacttgctatttagacacatgcttaaagttatttccttttaaaccttaggcagattgtgaaatattcccgatgtattgtctcacaatgcataacaaagcttttcacatattttcagatatttgggaatgtttccatatgtctggcatgcctgtaatccagcactttgagaggtggaagcaggagaatcacttaagcccaggagttcaaaatcagcctaggcaacaaaaggagacccccatctcta

SEQ ID NO: 17752 - DNA, 407 bp, Homo sapiens
tgtagcaactaattctgttgggcttatataagtgtgtgattgactaaaccccaaagtttatacatacatgaatttctgtgaagacagatgtccctaatcttgaacatgtggaattaatgtttttaagcctatgtacaaaacattatttctactaaatttccctttatgcattttggcccatatttccaggctgctaaagtattctgaattttgattcagttatgtaacatattagttactccagctttgtgctatggagatactttctaggtgtgccttctatgtctgtgtctttgtaaggttgtttttggtttttgcctttagttggcgagttctgggtttgttgactctaataagtaaattattaattaacgtctcaaagtttctaaataagcatattactgcac

SEQ ID NO: 17753 - DNA, 452 bp, Homo sapiens
gacagaagggtaagaggctcttcagccttgacgttccttcacaagctctctcacctgctgccattaagacatgccttcttccccttccaccatgattataagtttcctgaggcctccccagccatgtggagctgtgagtcagttaaagctcttttctctataaattacccagtcttgggcagtgctttatagcagtgtgagaacagactaatacacagaccaaaagaaaattaatagaaaggggcatggctgtgctgaatggaactgctcgttacagaagaccagacatctatcagaaaaacctgcccaatgccgtagctaattccaaaactaaagattaacccagcaaagccacaatgtacttccaactcttggcagttccaaatgaggtcagcatttaataatggcagcccctaaccctagcaggagcacagcagtaacacagatgaaag

SEQ ID NO: 17754 - DNA, 541 bp, Homo sapiens
gagacagcccttctgtgccccctgcctgggcaaatgacacctccacccacataggctcaaagctggggagcaagatatcctccttaccactgccctctcccaccccccacctttcccaaaccctcacagggcacagcacagactactctgcaccccaatatccactctccccttcttccaaagcaataggacttccaatacgtagctgggcacagctacccagaaataagaccacatttcccagcctcccttgtatataggtgtggccaaggggttaaattctagccaataggatgtgtgcaaaagtgaactgcgcaggtccctgcatgtgtctctaagggaaagggcaggtctacctccatcattagcttcccttctcctttccccttcctggcagttggagtgtaggagagggtgaccatccgatttggacaataagagcaaagacaatcgtttagggaaaatggagcaacaaggtaggaggagcctgggtccctgatgccttggaatagccaaaccagagctgcgacacttacttaca

SEQ ID NO: 17755 - DNA, 555 bp, Homo sapiens
tatttagtgggatcctcccagtcctacggtaccagcttgcattgtgaaggaaaatgaaggacagaataaagcccttctcccagtctggtttatttctgtacacagaacctctgaaaacaggaggccaaggctgacctctttagtcaagagtcagctcaactttaaaattataattgcatgtgaaagctaaaatgggaaagagaaaaaatcagttctcaggaccgaaatgctaaaaacccttgggtcacattccagttagggtcctggccgtgcacacagagctcccattgggggaaggtgggcaagagaccagccaagaccaattcaaactatagggtgttggggatcatggcatttattctagaagtgtccagtttacagataaaggaatgtactatagtgataatgctatataatcttttaaaaaatagaagcttatggtcagatctcattattgagaaaggtgccaaagaatctacccactccaagtgaactatttgcagtaaagaaatcagaggaggctgggtgcggtggcttacgcctgtaatcccagca

SEQ ID NO: 17756 - DNA, 261 bp, Homo sapiens
tttctaggatcaaccacaattgtctatcactagaatatctctaaaaacttcctaagtagatggagttcataataattaggtagaaaataaataataaattttgataaaatatttaaatcactattttcatcaaagacatcgaatgaccaaaatgtaattgtcctggaaaacttgccttctaaaaaaatttagaggattaggtaactccaggataatatttaagttttgtttgtttgttttttgtttatgtgtgtgtgtgtg

SEQ ID NO: 17757 - DNA, 511 bp, Homo sapiens
tgctgatatcgcaccactgcgctccaacgtggtcgacagaacaagactcgtctcaaaaaaaaattaaattaaaaagttgtaccttattataataaagacaatagaaagggaggaatctaggagaataagttgttgtaagggtgaacaaggttcataaaacacacacgcacacaccctgtggtggttgtgaggactggtgtggtacaacagaggaagagaaggcagggagaccagagttgaaggctattgcatgttgtccacgttttaatctcttaggcagaaaagggcaaagacatgcccttttcattgtcaccagctttacttttaccttttaaaagtaaattgttggctgggcgtggtggctcacgcctgtaatcccagcactttgggaggccaaggagttcaagaccgcctggccaacatggcaaaaccccatctctactaaaaatacaaaaagtatccatatgtggtggcgggcacctgtaatcccagctactcgggaggctgaggc

SEQ ID NO: 17758 - DNA, 471 bp, Homo sapiens
atttgtagtaaagtgatatcacaagaagaaaaatgtggcttttgtatataaaataccactgggtttttttgtgccatatttttcctaggtaaagacaaagagggagagtggaggggttggactggggtatggaagggagaactggatggcatctagaaaataaaaatgacctgaacttgcatcagcctatcatccagtgctgcatggtggctcagatctggccaccgtgaatgagctcattggagctatcttttatattgtctcctgggtctgacctgtaagtgtgactaatttataggaaatttcctagactccctttacaatgttctactaattacagtgagggaaagtcagtgataaagaagcaaaaagaaaaggggaaaaggaaaatgggtgaacggaggaaggaggagttagtgtttcatgggaacagagtttcagttttgccaaatgccactgaaatgtacactg

SEQ ID NO: 17759 - DNA, 569 bp, Homo sapiens
ggaatgatggcacatgggaatgaaggttctcggtagccacagctgtactggcattgtggaagtgctccatgagagattgcctaagtgtgactatcattctctggccctcacacaattctatggcagagacaatgtatctttaaaatataccattctctcatcctagacacagaagacaagatttgccagcctctattgtagttgggtagtgggcaaattctagcaaaatttaggtggaattgatatagaccagactcaggcctggaacttcagagcactgggcatggtgctcttgccccctcttggggaagcttagaggccacatactccagatggcatagctacaggtatagggtagtcacttggccctgttaaatcaatgtgagcaaaaactaactggttattgcttttagatttgggaggatggtctgttgtagcagcagctagcattgcttaccctaactaaaacatttgaatatcctttatttaatactcctctgcttgaaggaaatataacagatagtaacagctgaacttttatcctgactgatagtttcaattattcaata

SEQ ID NO: 17760 - DNA, 397 bp, Homo sapiens
catgaggaaggaaaggaataagatcaggtcaagatgagaaagtgtaatgagaaaatgccattaaaacaagaagaaattcaggtaatcattcagtattgcctattaagggtattaataggctgggcatagtactcatgcgtataatcccagcactttgagagacagaggccggtggatcacctgaggtcaggagttcaagaccagcttggccaacagggtgaaatcccatctctactaaaaatacaaaaattagctgggcgtggcggcactcacctataatcccagctacttgggaggctggagaattgcttgaacctggaaagcggaggttgcagtgagccgagatcgcaccactgcactccagtctgggtggtagactaagactcagtctcacaaa

SEQ ID NO: 17761 - DNA, 532 bp, Homo sapiens
agtgatctgcccacctcgggctcccaaagtgctgggatgacaggtgtgagccactgcgcctcgtctaatttttaatatttttagtggagacagggtttcaccatgttggccaggctggtcttgaattcctgacctcaagtgatctgcccacctcggcctcccaaagtgctgggatgacaggcgtgagccattggtcccggtctctttactttcttaatgttctttgatgcacggcagtttttagttttggtggagtcaaaatttgtttgtttgttttttcctgttgctcatgctttgggtgtcatatccattggcaaatccaaggttcatggaaatgtacccctatgtcttcttctaagatctgtacagatttagctcattgttcgattttgagtcaatttttgtagatggtttaacatgggagtttgtggatgtctgtctgtctcagcgtctcttgttgaagagacgatgctccccccatggaatggcctggcaccgttgctcacagatgtatgggctcatttctagactc

SEQ ID NO: 17762 - DNA, 441 bp, Homo sapiens
tttttggcatgttgcaccctgggacctctcctgttgatcatcccatggccattcccatggccacaatggcagttcttcctctcaatgtatctcaaggactataccaatggttctggtttccagccactctctaaactgctggttattggcctcttcaatccaacatatgctgagcctccagatcaattgtcttgatactccttatgaccaggctattcctatgtttacaaaacctcaggagttctctcatccctgtagaccaaagcccaaaatctttagtcctgaacataacacagcatttgtactgtgacgcagcacaactttctacttactctccttcatggatcctgtaactctagccagactccgttttgcatcagatacaccagaattttcctctcctattactggcttgtgtagttctctttctgaaacgaacct

SEQ ID NO: 17763 - DNA, 574 bp, Homo sapiens
cgcctcgcttaattattcacttttaattaagcaagaaaacttattttaattaatgagctcaagcttacagaaagagtgtgagttttttctacaacttccaatcattcaccagcagattgatatagtctggttttatttctgatctccatggcctagttctacccaagacatacacctgcatctctggaattctaggtctgatttcaggttatttttgtaaatgttgatgaaaatcaaatgtacttgagttgaaaataaaactcatatttttccattcaaaaagtatttattgaactccctactcaatgctatgtactacatgagagactgggaatataaatgtaatatagatatcaatgatgtatgcaagatgcttgagttctgctggggtgggacacagaggaggagagggttagtcatacctacttaagaaaggaaaccgggctgagcagaaaatgaagttaatcatcatcctcatttttctaaatgcacattatattaggcatgccattattttaaaacaaccatgccattattttaaaatctccatggtagagatttgttgtggtatatt

SEQ ID NO: 17764 - DNA, 570 bp, Homo sapiens
gagacagcccttctgtgccccctgcctgggcaaatgacacctccacccacataggctcaaagctggggagcaagatatcctccttaccactgccctctcccaccccccacctttcccaaaccctcacagggcacagcacagactactctgcaccccaatatccactctccccttcttccaaagcaataggacttccaatacgtagctgggcacagctacccagaaataagaccacatttcccagcctcccttgtatataggtgtggccaaggggttaaattctagccaataggatgtgtgcaaaagtgaactgcgcaggtccctgcatgtgtctctaagggaaagggcaggtctacctccatcattagcttcccttctcctttccccttcctggcagttggagtgtaggagagggtgaccatccgatttggacaataagagcacagacaatcgtttagggaaaatggagcaacaaggtaggaggagcctgggtccctgatgccttggaatagccaaaccagagctgcgacacttacttacaccaggactgactctatgttaaagggaaac

SEQ ID NO: 17765 - DNA, 542 bp, Homo sapiens
cagagtaaggaagggcgtgggttgttcttggccaaccttctggaattaggaaacccagttcccactggtaaagccgggctgcctggcctgccctcatgtgacaccagggaccacttgctgcttgcaatgggcttagctgagagccaggcccccccctctgttttctggcttctgtgcatgccctttgttggcctggtgggaggggcgtgggcatcctctggctgcagcagcctggctctggctattctatgtccttaccaggcccatgttcccaagaagtgacctttctaacatgatcccgggcccctgaacttccattgcctcggaaggcaagttctcagctgagaggctcacaaatagatatatgtatgtgatgatgagtacaggagtgtgggcatgtgtgtgaaagaaaaataatttttaaaaatagaaaaataagccaggcatggtggctcactcctgtaatcccagaactctgggaggccgaagcaggaggattgcttgaacccaagagtttgagaccagcttaagcacaaagtgag

SEQ ID NO: 17766 - DNA, 549 bp, Homo sapiens
atatgttcttaatacaggctgtaatatataaattggaaacaggaggaaaatagagtcaatctaataaaggaaatttttttaaatgaatgcaaatgtacagaaaaaaggcattaaacaactaggtgaaagataaggaagacagataaaggtgatcctatgattgggtccctgaaataaggaacatttccatgaaggaagaattggatcgtctaatcaaaagggcacaccatatattaaggaacactcacacaatgcaaacatcaccaaaacatattctggttattaaaactggagtatgaataacaattatttaagtagtcaggcagaaaaagcaagttatgtgcaatgggggaaattctccctagcctcagactcttctgtagaagctttccatgctagaagatagagccaaagtcataagggaaagtaaatgtgactccaaaatactttaccccagacaagttgttcaagtgtaaaagcaacaggtagatattctcagatatgaataaattaaaatttcaggaaatatagccctaatgagctcctctt

SEQ ID NO: 17767 - DNA, 544 bp, Homo sapiens
ctgtactctgaatcagaataatatactccatcaaggagactgacattggcaccaccttcccagaaatccaggagcgcctttgcatgaggaaaagcagaagggagtaaagtcatgaaacattgtgtgtgtgtttgtataaaactgtatatttttgctcacatataataactatatatttctgctaatttttccttttaaaggctattaagttacttaaaatccattgcctaataaaactgcaattcacctttgtaattcactcatttgtttgctgtcacagggaagatagaaattgagcacgttttcggctgggtgtggtggctcacgcctgtaatcctagcacttggggaggccgaggtgggcggatcacgaggtcaggagatcgagaccatcctggctaacatggtgaaacctcgtctccactaaaaattcaaaaaattaactgggcgaggtggtgggcgcctgtagtcccagctactcgggaggctgaggcaggagaatggcatgaaccccgaaggcagagtttgcagtgagccgagatcga

SEQ ID NO: 17768 - DNA, 594 bp, Homo sapiens
atcattatgctacactgctggggagaaagtttggcttgcatttgagatccttatagcacatctaagtgtaaatttccaaaaggcaattggaaatatgataataatggaacccaaatgtcagagctgaagatgtggaattcttcagcgtatgaatgttcattggagttgtagacactgtccaacaaataatgtataattttattggcccaaatgagagtaatagggacttcaagacagcttgatgccatcaagagtctacttctagaccccttttatagcgttaatacaaagcaacaactactgtattatttcataaatatatttggtttcatggttgtttatatattcaaaacaattattttactgtggtacttgcaaattcatagaactcttttgcacctaactacattaataccagatactaaaagttaacttaagaaaataaagaatcctaatcaacatttatctattattaaatttggatttgaagaacttgcgcagtctgtcttctaagtccaattgtaaactccctaaccaaagctttactgttgttacaagacaactggagttagtcatttgtcttccctggtagca

SEQ ID NO: 17769 - DNA, 282 bp, Homo sapiens
gcagataaggatgaggctgtttggtttgacgtaagttaaattgcctgaactgcaggtggctctcaagcttgccatccctgatgaagactgtaaccatgatgcattaatgtgtattataaaccaaaagaattgaaatattttgccactttactagggcagaaacttggaacatatgtttggaaatgaattttcagtattttaaatcagagaggatgggatttattgttgaaccaagcacaattttagatatatatagatgaaagtcatctggaggtgtccgga

SEQ ID NO: 17770 - DNA, 620 bp, Homo sapiens
aggctatgaattcaagaccatcctgagcaacaaagcaagactccatctctatttcaaataatttttaaaaggcacattctaataaattctactgccaccaaagcaaaacaaaacaaaataaaaacaataaagagaaattatctggaagctgagtatgaaatgtggtatcaggattcttcaattcattccaattttctgaaatccattagatacagtgcaaccaaactatgctcagtggccactgggacagatagaaaattctataactgatacattcggggaggagccaagatggccgaataggaacagctccggtctacagctcccagcgtgaccgacgcagaagaccggtgatttctgcatttccatctgagacctgcagctgagggtcctgtctgttagaaggaaaactaacaaacagaaaggacatccacaccaaaaacccatctgtacatcaccatcatcacagaccaaaagtagataaaaccacaaagatggggaaaaaacagaacagaaaaactggaagctccaaaaatcagagtgcctctcctcctccaaaggaacgcagctcctcaccagcaacagaacaaagctggatggagaatgactttgacgagctg

SEQ ID NO: 17771 - DNA, 612 bp, Homo sapiens
ccattaaagatttaggttaagacagtgtaaacaaatgacttattataatgcaaatattccagagtttcccattcaataaaagatactcatgaaatatataattatgatttataattatgaataatttattgaatatctaaattatttattgcatagatattaatgcttagtaataataagcattttatttcctcctgtgtaataggcactgtgatagatattttatataaattatctttaaccattccaactctacaagatagatgttatcacctccactttataaataaggaaactgaagcccaaagaagttaaatcacctgcatagcgccaaatgtcctttcagttgcagagtctgcattcaaactcaagactcggaatttttccattacggtttttttcttttcttagagattgggtcttgctctgttacccaggctggagtgcagtggtgtaatcatagttcacagcagcctcaaactcctgggctcaagcaatcctcccgcctcagcctcccaagtcacagggattacaggtacaagtcactccattacattctgcttcttctttcactatgtaatttactattctgaaaaatagaacctggcgcag

SEQ ID NO: 17772 - DNA, 386 bp, Homo sapiens
gtgtttggataactagtcctcccaaaaagaagtggattggcactcacagtaataagatctacttgtagcgaagagctttctgagtattattcactgcactggactgtttactagattattaagctcaacttatctgtatgtaataaagaaatgaggaaggacattaaaaacacaaaaggaatatgtgaaggttatggtgatgactgtataccagaagtttcattcagtttcattaaattcatgacaacctctaagctgagacttgttattttttcggacatgaaaactgaagcacaaagcgatgaaataaggtctccaaggtcaaatagccagccaatgtagatcgggatcttaatataggtctattttactctaaagtactttct

SEQ ID NO: 17773 - DNA, 659 bp, Homo sapiens
acactagactaggttcagtctgcttacatgagacttctctagtggagagaaatcttccaagtagcagcagcagcctgatttctatgaatgagaaagacatataaacaaagaggaagagtggcctgatacaccttaccaagtaagagagttgaaccatctccacatgacaatggaagctccactctcaagcaccacagccacaaaggaacattctattgattctgacccatcctcgggaagttggggatgaacatggtagggagttcttgagtaatgagaaaaacatcctgagaatacaaactttatagggttgttaagtatatggtatacagagtagtgaattggcatggtattcgcttacagggaactcacagtcaagaaagttaatttgctgaatgatactaacatctcctctgctacattcatttctttttaatgatttaatggataattttttaggatttaatggttaattaggatttggacatatcttggccaacataaaaagagactaatgatgtaccttgctcttttgaaaaggaatatgatgttcaagcagcagtaacagatattctggagccaatcagtatgaggattagcagccgatcttctacaataatgtatatttaaaaattaagtgaaaatgcaataacgtacgt

SEQ ID NO: 17774 - DNA, 653 bp, Homo sapiens
aggtaacaaggaatcttagtactggtaatatcatcttcaatggtcatacataaattaggggtgcaaaatgaacagtaactactgaaagctagatctccccaattttcacctctatctagattcaaaacataacagtctattagtcttatatcctcagagaagactggaagactctagttggaagatcatgatcagcccaaaggaatagaccagtggatatgtcatgaggagcttttctgggaaaacttctcgacctgattgccctgtctggaagccacagttgacaattattacctaagaacctgaagcttaccgtaaacatttattgtattgctcttgaacgcaaacagataacaaacaatcatgagattctaggtacagccaataacaaacacagaaacaaaaaataaacaaaacaactgaaagtaaacagagcctatacagtgtgggaaaaaagtaattattaatttcctcagagagggaagataagataatacaacaagaacaaggtgtgatataaaatggatattcaaaaaaatagaattcttaaaaattaagaaatttattgcagaaatatataacttaatgggagatttggaaggtaaagctgactgcatctgcagaaaagttagtgtaaacagagttgggaatga

SEQ ID NO: 17775 - DNA, 542 bp, Homo sapiens
tctgcgtaatgtgtaagatcttggaatttctggaatagctatggggggaaagcgctaggacctgagagtcactcccaatttattattttattatatatttgtcatagagacgggagtcttgctgcgttgcccaggatggtctcaaactcctggcctcaagagaacctcctgcctccgcctcccaaagtactggcattacaggcatgagccgcagtgcctggcaggttccacttccaattgttaagagtctgaagccagagacagttggttctttcatgctcaaactgggtagcgatggtgcactgcaggcgagagtgcctagcaccatgagtgcagtgaggtggccctgtggcaaaacccaggagcctggagggtccaaaaaggccacaatagactgggggagatttgaagagaaagcctgaaaaactcaaggtttcaagtatcagcaaaaccatgggagacggccaggtgaaatggctgacatctgtaatccccgcactttgggaggccgaggcaggtggctcacctgaggtcaggagttc

SEQ ID NO: 17776 - DNA, 426 bp, Homo sapiens
atctaatgtatgtggtgagcattaatgctactctgtttaatgattcatagctgctagtaggagtctgtctaaacagtatgttaggaacaggttttaagctttcatcttttatattgatccaagctagttatccacatctccaaaatttaaagccacatgtataggtgtatgtagtggactgcaaagcattggaccagggttttgaaggctgggtccttgaccctactctgctgttaaccagcagtgtgactttgggtcaggcactttccattttcaagcataagtatgttcatccacagaatgaaggcaagtttcttccaacaaaaattctgtgaagaataaaaatgtccacacacaggtctctgttttagaagttaagtctgcattaactatgactaagttgaacgagttcgatctttttaaatg

SEQ ID NO: 17777 - DNA, 213 bp, Homo sapiens
tttaaaggcaaggtgagaggagtgcttgagcttgagtctgaggccgcagtgagctatgaccacaccactgcaccccagtctgggtgacagcgcaagaccccaactccaaaaagaaaaaagaaaaatcacaaagaattgcatggcagagtgcctgtctttcacagctttaactgctgaaggaactttcttttttttttttttttgaaggggggg

SEQ ID NO: 17778 - DNA, 534 bp, Homo sapiens
tacacatttctgaattatttgaattttttaacaggagcatatatgattcatattaccagaaatagcaaacatcaagctgaactgcagctaaggagtgtctgtgataaagagaaaactgtttgattattaaacaaaagacaattgaagcctcagttcttttaatttgccttgttcaattagttacttaactttatgaactcaagtcatacactgagaccctaaagttgtttttgttttgaattaatgccatatagctgaaagtgacaaacactttactcatggcagtatacagaaaattttcagggaagattaaaaggcatgaaaacagcaggttgtggtggctcatgcctgtaatcccagcactttgggaggccaatgtgggcggatcacttgaggtcaagagttcgagaccagcctggccaacatagagaaaccccgtctctactaaaagtacaaaaataagccggctgtggtggcgggtgcctgtaatcccagctactcgggaggctaagacaggagaatcacttgaaccct

SEQ ID NO: 17779 - DNA, 455 bp, Homo sapiens
agaggaggtggggtacagaggcggggtgtgagcctagccctttgcctcccacccatgtgccctcttctttccccggggagggagggactcacctctgcctggagccccacggaccctctgcctccagagcacgatgctgagggccaggatgacaactccctggcccattgtgagcagcagcatcagaatccaaggcatgtcccagcccgtggaaggggcacagagggcaggagaagcatcgatggaggctgtagcctctcaccctgacccatagagaatggcggccaggcacagtggctcatgcctgtaattccagcacattgggaggccgaggcgagcagaccacttggggtcgggagttcaagaccagcctggtcaacatgatgaaacctcatctctactgaaagtataaaaattgaggccaggcgcagtggttcacacctgtaatcccagca

SEQ ID NO: 17780 - DNA, 360 bp, Homo sapiens
aagcacagtccaggttataacaggagcccaggcacttgatgtgggaaccctatttgtctcattcagcacctagagttttaacgtcctatgaggcacagctaatgcccttcattatttttttgtaattgactgcatagtttagaactatgtcttgaatttaatatctatctgttgaataaatgaattaataatgatgaaaatctgtccacaggttatgtgcagtactgaagagcaacttcaactattgaggtatctatcagaagtcttactctctaaaaagcctctggttagttactgatatacgttgctgataatttcactctcacaacgtaggtgaagcaggaatgttatctggcctct

SEQ ID NO: 17781 - DNA, 347 bp, Homo sapiens
cgtttctttaattctcccaataactctgtaaacgaggtactatgattatcccattttcagactgaagcacaaaactggggcacagggtcacttgcgcaggcttacacagttagtaagtggcagaggcaagattcaaacccagaccacatgacttcagagccaaagcacgtaattgtggtgcaataccacctctctagttctggaattggcactagctgcttaaattggtgggaggtgggggtggttacagttttctaatgaattaagaatttgagatattggagaacatttccagccctaacactaaaaatgtcatgaaagccatgaccttacagacaatctcctct

SEQ ID NO: 17782 - DNA, 294 bp, Homo sapiens
catcttgaattaaaatactactgcaggcaacaagaaacttctttgagatagttgagtacaaataatacatagcaataaatagcttccacaaaaccacaacagatataagatataatgaaagacaatgacctatttatattagcaacaaaaatgtaagtatctagcaaaaaacaaatagaaatatgtgagttctatagggagaaaacttgaaaacactacgaaggatacaaaggaagacttgaacaaattgaaagatatatcattactggacagaaatgctcagcatcataaaaa

SEQ ID NO: 17783 - DNA, 576 bp, Homo sapiens
caccaccacacccggctaattttttgtagtttagtagagacgggttttcactgtgttagccaggatggtctccatctcctgacctggtgatccacccacctcggcctcccaaagtgctgggattacaggcatgagccaccgcgcccggccaaaattcacggtggtttttatctgagatgtccgcatcacacatttcctcactgctcttgaggttccactgacaatcagaagaatttcaatttttacattaattttgttttgttactgctttggggaggcaactggagatgattcaacatttattaaatcaactctttgggattaatgggtgttctcttcttctgaaatacaatgttctgttctgttttcatgaggctccaattgaaaactcattcctgcccctgtcctcatttccctccctgggtctgtgaacagctttctgaagagacagagagaagtgagctagctctgggagtaggcagtggaagagcactacagtgctttccatacctagctgaaaaggacctgtagaaaatctgcagacacatttatgatcagggacttctttcccttcct

SEQ ID NO: 17784 - DNA, 567 bp, Homo sapiens
tcccatcgccacaaatgcaatatgtttggaactaaactcatcatctggccatctgtttcattcctggttttgtttactagttttaacgcctctcttacttgctcatcctgtcctcctttgcctgcagtttaggaatactaccactaggtggccatattgggttatactttcttgcattctaagccagaagctggctttcacaaatattcaagatggtgggtgggccacctcagagtttcacccaaatttttagcaaaaagaaaacatgatagttttttttagtgtaaacattttatgccctaataaaatccttaaatatcataaactttctaaactcatttttaaggataattttgtgggccaggtgcagtagctcatgcctgtaatcccagcactttgggaggtcgaggtgggtggatcacttgaggtcaggagttcacgaccagcctggccaacgtggtgaaacccccgtctctactaaaaatacaaaaattagttaggtgtgatggcgcacacctttaatcccggctactccggaggctgaggcaggagaaccgcttgaaccca

SEQ ID NO: 17785 - DNA, 517 bp, Homo sapiens
agaaactccgaacacatctgaacatcagaagggacagactccagaagcgccaccttaagggctataacactcaccgcgagggtccgcagcttcattcttgaagtcagtgagaccaagaacccaccaattccggacacactatgaactgagctaaataagtactttacatacattatttcagttaatcttcaaatgaaccagatcggagaagtagaatcctccttaaacagctaacaaagctgagcacagagaaattcaatcatttgttaggaggcacacagatagttctttgttggattccaaagccaatgatattaactacaagttatactttttccctatttcaggaaatgaagagaacctaatgaagtcacactaaaacaatctttgatattctaaggtctgttttctggaaggcaagtggattagtttcctcttactgctgcaacaaattaacacaggcatggtgtcttaaaacaattaaaaaaatgtcagcaccatagggaaaaaaaaaaaa

SEQ ID NO: 17786 - DNA, 458 bp, Homo sapiens
ttctcaaatgtgattgatctgatataacttgaacattttcatgctctgagagtcattcctgctctggtaaccttctctaaaaatctgagacctgttgttagactgtacagtggaagatgctgtcgtcagaatatacagtggaaaatgctgtcagagatacaaataattatagctcatgcctttggctattgtttagttgagatgaggccaagatgtatgtatgaggactgaataacaacacaggggaataagcaattgaatgcctgagttagtacacaacaattgcttagaaagtcagaagacagaagaatgttgtgggttgaaacatcctcgaggcagttctgacaccttttcaaggaggcatgagctttagggaggcttcatggacaagtaggagtttaaacagaagagagacaaggaaagattatttcaggaagtggtgggagtaattttagcat

SEQ ID NO: 17787 - DNA, 620 bp, Homo sapiens
atctttcattacatattcttccgtagtcatatgttcataaagggtagagtgcatgcacaaaacacctgcacttttaaaattctttctctcctcttttgttaagtatatttatttgaacttgcttaagttaaatacatgcatgagacaatatcaacatatgctaaaattatttatcacagctaaagacatctcaccgaattccactcatctgatttaactgtttatgctatcttaaagtttcctgtatttctcgttctgttactttgctaatttcgtatactcaaccctgatttggaacatagacatctacctttaaaattcaattaagatttttggtaacttcttaagtttttttaactgtggtaaaatatacataaaatgtaaccatgaccacgtgcggtggctcacgcctatagtcccagcactttgggaggctgaggcaggaagatcacttgaggtcaggagtttgagaccagcctggccaacatggtgaaaccccatctctgctaaaaatacaaaaattagctgggcgtggtggtgggtgcctataatcccagctactcaggaggctaaggcaggagaactgcttgaatctgggaggcggaggctgcagtgagctg

SEQ ID NO: 17788 - DNA, 445 bp, Homo sapiens
aagtgctgggattacaggcgcccaccaccacacccagctaatttttgtatgaaaggtaattttttttaaagccagaaaacacagaagtgaaaatctctttccagtccaggcaaaagaagggcatgtattcacacattcattcattttggtagagcgttggtcacgggcacagacccagctgccccactgcttattagccccatcgtttcccagctaggtgacctttctgccttggtttccccacctataaagggggatagtaacagtacacctatcctctagtcaattccagtgaaatgctcagaacagcatctggcatgtggttcttgctcaattcatggtatcttttactcggaccacaacttctaaagcttaaaattaggttagataataagaaacatccagaatgaggccaaaatgaaaccagggctgtcctggaaaatct

SEQ ID NO: 17789 - DNA, 492 bp, Homo sapiens
attgccttttgagagatctcatccattcttaagatttgaatgtccacttctgcatggatggcatgcaacatctccagtactggcattttccatatattgcagtaccactttggaaatgcactgactctttaaaagccacataaatgttcagccattaaattcaaagttattatgtcttaataaaaatgatttcctcccatctcaaaacattattttctttcaactatcatatacaataacctgttacacaaatccgtacgttgtttatggtattttgaaaccatatttttatcttcattcttgtttgtaaaagataatctattattgaattctttcacacatcactctaaactcctttgcatttttctcttatccacttttactttcaagatttttatctaaccgctttatcccctacattgtgattcatacgcagcccctgggaagtgaggagtgcctctgcccaaccacgatgcaaccctccaggtgtga

SEQ ID NO: 17790 - DNA, 457 bp, Homo sapiens
gacagaagggttcaatatgtttatggattcatggtttcatcctggctgttttcaaagcattattttgtttttgtcaatatttcctacttgacaatgtcctaaattgaaacaaatttattgctcccattacagagaatgggcaagtgccaaagcatttaatggggccagaggttagtgcaaaatatctctttcaggaatatcaaacccatcagttttctttcaatggcaaatgtccccaggctataaaagaactgaaagacttggcaaccaggtcatggttctgcttgagccattaggcaaatatccaaggtctcagcttcccccatttttaaaggaaaaagcaattaggcaaagaattatgaataaggaaaaatgcagtgagaacttaaagtgtgcattaattccttgatggctcataaattattaataggctcaacagtaacctaacaacactacc

SEQ ID NO: 17791 - DNA, 459 bp, Homo sapiens
aatattttgttaaaaatgcccccacatttattattgaagtatattcaaaatatattcaagatttgatacattggtttagccattcagctgatgttgagattgcagcaacctcagcccacaaaaacacaaacctgaggtggagtgtattcatccatttttgtactgctttgaagaaatacctgagactgggtaatttataaagaaaaagaggtttaagggactcgcagttccacatggctgggaggcgagggaggagcaagggcacatcttacatggctgaaggcaagagagtgtgtgtaggggaacggccctttataaaaccatcagatctcatgagacttattcactatcactagaacagcgccaaaaaacctgcccccgtgattcagttaccttccatcaggtacctcccatgacacatgggaattatgggagctacagttaagatgagatttggct

SEQ ID NO: 17792 - DNA, 426 bp, Homo sapiens
tgaaaggtcaaggggattgatcatagggagcctggatttcagagggagttaaggtaggacagaggagcacgacttctcattataagcccctctatgctttttgatttgtacatggtggttattcctctggttcaatttctaaaattgcttttttaaattggaaaggcctttggtggtaactgtgaggtagaagccaaggggtgtgaatcctaccctgctgccaacttgctggcagagcccagaggatgactgctggcaactgctgatgaaggagaggaagttgcttggaggtcctggggcccgtggcaagacaaagggaatttggtaaaggagcagaggagacctaggctgggcccgcatagtgtaggggccacttaggatgtcttcctgccacctggttattttatgtagctttttaatatactg

SEQ ID NO: 17793 - DNA, 542 bp, Homo sapiens
ggaacatcacactctggggactgttgtggggtgaggggaggtgggagggatagcattaggagatacacctaatgctaaatgacgagttaatgggtgcagcacaccagcatggcacatgtgtacatatgtaacatacctgcacattgtgcacatgtaccctaaaacttaaagtataataataataataaataaaataaataaaaattaatgttaactaatttgagataatgcctgtttatttatcttgattcttaactgaattataacgtgtttatattttattaattgaataatgttttattcttatcttgaaaattatgtgtttgcagctttgcggaagtgtgaattcagtgaattttccctagtgttatgtacattttgccataggagagatttaatattactaattaattttaactttggctttaacagtacattttagagattaaacagatatcaatctagaaaagttgtactttgttattaacttgtaaacaaatgtaataatgtccaactttaaagtctcatgtaatggaaacatc

SEQ ID NO: 17794 - DNA, 573 bp, Homo sapiens
acagggtcccacactttgattttgcaaattacgcagcctgtcccatgtggagttttagatttgaattattattttattagtatttttaggctatatatcttcactctaaaaaatgcacgtgtatgtattagttttataagtgagatttacagcagtcattgaacttcttgcagagctttgctgccagtcttaactgtagggtgtggtctgtcagccaacaaacagctttttaaagaatgttgcatgttgtgtgagagggaaaaaatacgacacaaagggcctttaatcaacatgcttgcaaagccactctcacagagtagacgccttattgggtaatttctgggtcccaagccccatgctgaccacaaggatacagagagaaacagagcacagcccctgccctcaaggagtgccttgtctagttgaaatctgtttcgtaactttctaaacctcaagccactctaagaaatatgcaacccagaattcagtacacatagagataatacacacatagaaagatgaaacagtaggccgggcatggtggctcatgcatgtaatccctactttttggga

SEQ ID NO: 17795 - DNA, 597 bp, Homo sapiens
cccaagagctattagaatagataatttgagtacataaaaattaaaacttctatataacacaagcaatgttagagtcaaggaacgtatgaaaggaaagtcttctcataatattaatatccgcactggataaagtatttcaaaatcaactagaaaactgagcaaaactctgagcaggaaatttgctgaaattttaatttgctgaagttataaatagccactaatcaaacaaaaatatgcccaatcagggaactgtaaacgaaaagattgtggtataacttttcacacatcagattttttaagtaaattaagtacatgcagtgttggcaaggctgaggggaaataagcactcttagtgagaaaataaatgctgctgcctggactggaaaattaggaatgccttttagaaggatcaatttagtggcatttatccatttttaaatgcatttcatttgccacaataatttcaattacaggtgtctattctatagaaataattgagcttgtttatgttaaaagatattcattgcagtacttctcaaaatagaaaacacatactgtaatctaatatttacatgtatattatcaatagtggaaatt

SEQ ID NO: 17796 - DNA, 494 bp, Homo sapiens
ttatagaagtaaacagagggcttgggtaccctgagaaaaaatatggaaatcctctcacacaacagttggtcaaatcctaggaatgttctgtttgcaagatgaaaggagttctgaattggatggtggtaatggttgcacagcaatatgaatgtacttaataccaccgaacggtacacctaaaaatggtaaaggtggtaaacttcatgttttgtgtattttaccacaatttaaaaatgtgttattaaattaagaaagcaagctaggaatggccactggctttgttaaaagagtatctcatctaactgatctaagcctcccttttgataaggtgaaaactgaaaaaggagcattagttaaaatctacctcaagagtaatgagcccatctttatgacatactcaggacagagggagaaaagtgatctaacttgaccacagtgaactgtctggaaaggtaattgagctgacaggatgtggtggctcatgcctggaattc

SEQ ID NO: 17797 - DNA, 540 bp, Homo sapiens
cctgtctctatgacattctgcttccaccaggaagccttctctgatagactcaactctgtgcttttccaaggccctattctcctttttaaaacgtacttctaaggatgcctagtctttttattcatacactatcttcataactccatgtaatggtcctattatttttatacagaataaaacagagacactaaaatgttaataatagaattcagtaactttttttaagaaacctattagaaatttaaaaatgtgggcaacttcgccaggtgcggtggctcatgcctgtaatcccagcactttgagaggcagaggggggtggatcacaaggtcaggaattcaagaccagcctggccaagatcgtgaaaccccgtctctactaaaaatacaaaaattagccgggcgtggtggtggactcctgtaatcccagctacttggggaggctgaggcagagaattgcttgaaccctggaggcagaggttgcagtgagccgagattgcgccactgcactccagcctggctgacagagcgagactccgtctc

SEQ ID NO: 17798 - DNA, 504 bp, Homo sapiens
agtgtggcctggcgatgagccacaagttgaaagatcagtcctgtagctcatttagagaaaaatgccaaaaagatgaaatctgaggccctgtgaaagagagggcccacggcgtggcttacggtccctccataaatgtcagcaaagtgacacctgagatgtaagtgctccttcccctctctccatcataaaaaaaatatgggtgcaggccaggagcgatggctcacgcctgtagtcccagcactttgggaggctgaggcaggcagatcacctgaggtcaggagttcaagaccagcctggccaacatggtgaaaccttgtctctattaaaaatacaaaaattagttgggcatggtgacaggcgcctgtaatcccagctactccactcaggaggctgaggcaggagcatcgcttgaacccaggaggcagaggttgcagtgagctgagatcggaccactgaactccagcctgggcaacttgtggctcatgccacaccagccgtcccaaa

SEQ ID NO: 17799 - DNA, 448 bp, Homo sapiens
actgtcatcattctgatgtgatgacatactagaacattgcctgtgtagttttcttgtaaatcatgaaaggaatttagttagctgttgagtaggaatattaaattttatgtatttttctacctttaaataaaacattgaaacttcatctaaaatatttggaaagttacatatgtcaagcttaatattttatgatgtattatgtaacattaatttttatatttttttcaaacaaaatgatactattgaaaaagtttagaaatgcagaaagaacagagtcactgttattctagtaccttggtaaaattacttttaatattttgttatatatcttacatactacctgaacatatctttctaaaatgcacagccatttgcacgttgccagatgctcttaatttgctggtagactaggtatagaattcttgctggcagtttctttctttcagca

SEQ ID NO: 17800 - DNA, 105 bp, Homo sapiens
actacagagtaaccggcactccactttcgaaaggctgccatgaacagagttttgtgatcaccaggtgtcccttttctgagaactcttccttactccacctgcgtg

SEQ ID NO: 17801 - DNA, 542 bp, Homo sapiens
ttggattttctctatcgatgccatccatcactgtggctgcaatggagctctctgtatcttccgcctccacagtgctcagctgtttttctcacctggcaccagaaatgcaactcaaagaaagaaacagcagaagggaaataaaacaagaacaagaagctgggattgaagccagatgaggtggaatgagcagaggggctgagagatatagaatctaaattctacattacgctttgccacaacccacctctgagagtgttggccccatctctttcatcattcttctgcttcttaaaaaggttgatatgatgaggaaaataggaatgaggagagaggatctaaagtctcgttgcttcaaagctttagctgttcaatatcttctaagatttctgtgattctgaaacttacacgtttaaaaatttagagcctgatggactagctctgaaacaagcaaagcagaaggtagagccagtgagcataggatttgctgtccatgtgtagggggaaaggagaaaaagtagtttcagatatccttgaagtaaacc

SEQ ID NO: 17802 - DNA, 560 bp, Homo sapiens
tcttttaacttccttttaaaccacgcactgaatgcatctgtgaaaaagacctgcatactacaagataactttaattacatatcttctgtggggtccgtgcttttagtttagtataggtttatgcaaagtgatactattggtaatgtgtaatttaaacacacacacaaactaacaggccctgccgcctatcaatgtctgggtgatatcagagaaggccgtgtgggaatctagaactttcttctctgccaggtagttacaatgtgccccgtccttctccaccagattccttaggtgtcaaagtaaactaagtgagaaggtggaactttcaccatcatctagtggtaaaaaggtccaaggcctcctgatgtttgccttcccttcagtgtaggccatagtgggagcagaaacaagaaaaaaatcccccactctccaaaggtggttgagcagggataaatttttatcaccacctagcaataacaaggcacccccactttcaccatgtgtggtgtcacaggaggtttatttccaagagttaaaatacagagcctcatagcataata

SEQ ID NO: 17803 - DNA, 359 bp, Homo sapiens
ccactggtttccccgtgttcacacacttgttctctttctctctttctgctgactggtctgaggtttagcatttgtatccgcaaaatgtcttttgagtcctcacagacagtggctttgagaaacctgctcttgttgtccccacgtgacctcattggtcaaccttagtgctgctaacagcaagacaagcagatactgtgtgcattccgacatgaggcagtacaaagtacatagtatcacctaggaactagtcttgccaaaagcagaggggggcagggggagacagagagacacagagagagaaacagagacagtgacagtgagaaatttaacctaagtctaacccagcctttggatctaac

SEQ ID NO: 17804 - DNA, 447 bp, Homo sapiens
  misc_feature 342: n = A,T,C or G
gtagtggcatgatctcagctgactgcaacatctgcctgccggtatcaagcgattctcctgcttcagtctcccaagtagctaagattacaggcgcctgccaaccacacccagctaatttttatatttttagtagagactgggttttgccattttggctgggctagtcttgaactcccgacctcaagtgatccacctgcctcagcctcccaaagtgctggaattacaggcatgagctaccacgcccagccccagacttcaattctcttccttcagccttcacccactatgggctcatccaatcttagaacttagacctagaagttcacctggatcttatcttanactctaatctgttctgctcggcagggccaggtaaatactattaagggtaagcactcagcccaccacacacacctgcacaaaacaggagactgggccgggcgcggt

SEQ ID NO: 17805 - DNA, 538 bp, Homo sapiens
gcgagaacacgacagacgggttatagaagtaaacagaggcttgggtacctgagaaaaaatatggaaatcctctcacacaacagttggtcaaatcctaggaatgttctgtttgcaagatgaaaggagttctgaattggatggtggtaatggttgcacagcaatatgaatgtacttaataccaccgaacggtacacctaaaaatggtaaaggtggtaaacttcatgttttgtgtattttaccacaatttaaaaatgtgttattaaattaagaaagcaagctaggaatggccactggctttgttaaaagagtatctcatctaactgatctaagcctcccttttgataaggtgaaaactgaaaaaggagcattagttaaaatctacctcaagagtaatgagcccatctttatgacatactcaggacagagggagaaaagtgatctaacttgaccacagtgaactgtctggaaaggtaattgagctgacaggatgtggtggctcatgcctggaattccagcattttgggagggcaaggcagca

SEQ ID NO: 17806 - DNA, 412 bp, Homo sapiens
cgtgtctcactgtgatgacgctggccttgtgtttcgtcaggtggtgtccacaggtgccctgctggttgctttttctctgccctgggagaggctcgctgaggctgcacggctgcctgggagaggctcgctgaggctgcacggctgcctgggcggcctctgacgcgccctgtggactgcagcatccaggggatcgcgtctgcaactcttattgctttggcgtttacctattggggatttaaaaaaaaaattgttcatttttataaaaaagacatgggctggctgggcacggtggctcaggcctgtaatcccaatactttgggaggctgaggtgggcggatcacctgaggtaaggatttcgagaccagcctgatcaacatggagaaaccctgtctctaccaaaaatacaaagtta

SEQ ID NO: 17807 - DNA, 431 bp, Homo sapiens
gtcttgtttggtttagtatcggttttccaatgtcattcaagtaatttgggtactggaagaatcgggttaattgattacaaatatactgcagtgcaagaaatagggtttaataaattcaatgtctcatttgttcaaataggatttaatgttcactgccagtctcacattggctgaattaatatttcccagaaataacaaagggtcacaacacaagtcagaatcgtcatcctgggagaaatcatagagattaaggtcgccaaggaaacttttttgttatataattacttttatttatgtgaaacaaaaccttgccttatctagatagcatatgacttagtaatagaaattcctatacaaattataatgtgtgtagcaatttatatcactgaagcagccattgtgaactaaacaattagtaccagataatgagt

SEQ ID NO: 17808 - DNA, 449 bp, Homo sapiens
ctgtgtgaccttttcagtattaaaaaaaatccaaatagtattattaagcagcacgttagcatattttatagtattatatataatcacaaccacaatctagatatgtaaaactatgtcatactttcagtatactaagctattttatatagatttcctacagctagtccatgaaagatactcagatgtaagagtgtttcttaggttgtcaaaaagcataaatgcatacactcacaacaaaatatttttgccatccctgttttcattagcaccccacaagaaggtatataccacacctagatcaaaatttccttaagtttaacagtcgcaacaattttacctcatttgggaaaatgttactctaacaagtaacctggcttttaattaaaaagagactaatttgtttctacctcaatattttaaatattttttgttctaactatatgaataaa

SEQ ID NO: 17809 - DNA, 418 bp, Homo sapiens
tccttccaggtcaatggcctccccagttgcaggagaatggcttttctgcgaagaggagaaaatgatgcactcccaatagtacctcggactcacagccttcccagggagggataaagaaatagaaatgagaataactaaaaattatgaacaattattccctaaactagcacacgtaagtaagaatgataaaataacatgtttgtaaacatggaggcatgtttgtacattctcagtaacattaatgtttctgagaggaagtctagcactatataaagtaaaactgtttatgtcatttgaactgtattgcacgtacaaaaaaaaaattaaaagaaaatcccaaaagaaagttatgtataacttattaaagaaaaaattaaaactgcaatgtccaatattaaagaaatgctgacttggcatg

SEQ ID NO: 17810 - DNA, 420 bp, Homo sapiens
ttgagtatgcttgagaatctctaaacagcacaactgcaccaagaattctcttgcattattactctgtactattaatttgtttgttgatagcagcaaatgagctttcacttactgagtcctgtgtgagcccagactatttcagcacttaagagtccttcaatgactacctcagaggtggatctcagggtgtctggggctcctatgcacatatgtttcttgttgtttacaaagctctttggacttaatctgaatgacagttgccctaaaaagctggagacaaatgactagccataaagttttatttttcaacatttaatttttagaataattaatttaataacagattttagggcatgtattccttgctacttagtggtttatgtctcttttaggagaatacctcattatgttctctatatt

SEQ ID NO: 17811 - DNA, 390 bp, Homo sapiens
gggtggggagaggaacaaggcaaggctggacggacagcagggaccaggtgggaaacaaggcagacactgaagacagcatctgtgaggtgaggcctggacactggcgtaagagatcagagtaggctgtggacgatgttaaatgacttgacggtggtcaattagatggagagggcaagaaccttgaaggtcctgacacttgttgaatggaacttaagtattctcaggagtgatcaaattggagactggacatcaaaaactatacctgatattaaaaacagcaacaaaaggcttagctcacacttgtaatcccagcactttgggaggccgaggtggacagatcacgaggtcaggagatcgagaccatcctggctaacacagtgaaaccccgtc

SEQ ID NO: 17812 - DNA, 440 bp, Homo sapiens
gatcggtcaccaagggtcatgtctgcacttcaccacgtgccaaaacaacactagatcccgcccactcagcccctagcacgggaattggactgagattcctccaaccccaacagcagcgcccagtggggtcaccaaacaagactccaactgaccaagggcagcaggctggggacactcacacactctgggggagtcctctgaggctggtgtggaggaggctccaggggagaagccagcaggaacgtgggagggagagggtggtgccaagaggagtgggaggagccctgggaggggagaggaggacaggggaggaccgactagacagggtgcaaggcaatgacgcaggcctggccacgccagctttctcgctgggtggctgggtggagggagggaagtgctctaagccaggcagccatggaggtgggagggatggggatgga

SEQ ID NO: 17813 - DNA, 440 bp, Homo sapiens
actcgtctgagaagaagagctatcacctgagcgctctggagaacttagccggagctttcaggcagtctgggagcctacatggaggcgtgtaggcttatgtctcatgtccacgttgcccgggagacaaaatccttttctatttagagctgccccaaaatgttctgcaccagcttctcactgcggtggcttcaccttagcatacaggtatgtggacggccactgtgctggctcaccttggacactgccttcatgggcctgggtcaggttctcagtcagcagctcttgccaactccaggaggcccagacccaggagtggcctcctgctgccggacacgaagagggaaagagctgagctgcccggccctcttcttctaacaagccctcctgggttgacaaagaaagtctctccctgcactgggtgacactggacactgtccctg

SEQ ID NO: 17814 - DNA, 447 bp, Homo sapiens
gcctcctcgggccccccgctcaggccgccgccgcctcccttgggagtcagggtgtgccctggtcacagccacattctggccaggtcctttacagctgccaagacagggaaggtggtgttagtaagagaagaaggctgggtggcgggtggtgcactggtaatcccagtacttgggaggcctaggcaggcggatggcttcaggccaggagttagagtccagctcaggcaacatggggaaaccccgtctctacaaaaaatacaaaaattagccaggcatggtggtgcacgcctgcggtcccagctaagtgaaacaattgcttgaggccgggtgcggtggctcatgcctgtaatcccagcactttgctgggagaccgaggcgggcggatcacgaggtcaggagatcgagaccatcctggctaacacggtgaaaccccgtctctactaaaaa

SEQ ID NO: 17815 - DNA, 448 bp, Homo sapiens
taattgataacacatatttacatttttctatctttaagaacaactaacatgttacaactactcatcataaaaagtttccattgttttaaggaaaacaacatgttgcatcatagaatcacaaaacagcagagctggaaagaaaatctgagaccacttaatttggttcgttaattttactgttgaaggaaccaagcctttcctaaagatctttatgaaccttatttctattttgcctcccatatttatttggaaattgtgtggaatgcttgggattatggtgactaatgcttgggattagtcatacagcaaggagttcaaacatagtccacggtgacaattaacacattgaactggattgagacaatctgataactgagtagacagtcattatactgccttcccagaaacggtaagcaccttatatgacacttttctaaaagaatcctta

SEQ ID NO: 17816 - DNA, 368 bp, Homo sapiens
tcctgattcatggtcttccctctgaagcttaccacagtgtagcgaaagtggtgaggcctcctgtgatggactactggtttgctgatttgggaaaaaggggaaattccaggcacaaaagagcccaggaggttaagagatttcacctatgggaaccaggatagaaagtggttcaagccgggcgcagtggctcacacctgtaatcccagcactttgggaggccaaagtgggcagatcacttgaggtcaggagtttgaaaccagcctggccaacatggtgaaaccctgtctctactagaaatacaaaaattagccacacgtgatggccagcgcctataatcccagctactcaggaggctgaagcacaagaat

SEQ ID NO: 17817 - DNA, 366 bp, Homo sapiens
tttcagactggagttctgtcagtagagaactcttaacagttaagatcatcaaaggtaaaatgagctgctgcagaactccctgagcttcccactctcagaggtgctcccggaggggtagaacccatagaccatttgatggaaaatctgtataacagatttttagatggtgagagtcaggaattcaaatttctggcacttacaaagatattcttctactttaagaacattaggcggccgggcgcggtggctcacgcctgtaatcccagcactttgggaggccggggcgggtggatcatgaggtcaagaaatcgagaccatcctggctaacaaggtgaaaccccgtctctactaaaaatacaaaaaatt

SEQ ID NO: 17818 - DNA, 442 bp, Homo sapiens
ctgtctcttacacaactgaatgctcaccagcccattccctgggtctctggggagtagacaactgagctgaaattaattaggaatctatgttgtgtgggtctagtgataataaaagagatcagaaaattcatccaaaggcagcacagacaggcatccaaacagggactgtatctattctcctatcatctacacagaaagtgttccataatttactgactgaaaaacaaaaatcattataccaaaagagttggctttttctttaaaacctttgactaaatatttccaaaccagcagaattccaatcaattttgcttttaaatgaaccctgacttactgccccaaatgacttattctaatagttttcaagaaaagtaaaattttcagccaaaaccaaacaaaacaaggggatgagaggaaagaggttcagactataggatgaccc

SEQ ID NO: 17819 - DNA, 399 bp, Homo sapiens
gtacatctgttacaataacagtacataaaatcacctacagcctggctagttttaccataatcattgttcatagtgatgatacttcctgggacttcaaagtcagaaaatacttaactattttgaaagatttttcaatgtctcctcagttttcctctgaattcaataaataaaagtattacatcccctgagaactctgactgatagagttttctgacaatggctttttattttcaacatttcatgctttaattctgatatactttaaagaagatgtaacaggtaaaatatatagccagagttaccccctaaagtcggattggtaattttaacttaactatctttacttttgttaagtcatcacaaataatttttttgtgttaaattataaacataggccac

SEQ ID NO: 17820 - DNA, 447 bp, Homo sapiens
gtacctaacatttcacagctattataacaagtaatagggccacgattcaaacacaggaacatgggctttaaagcctcttgctcttattcatattgccacccttacttttcctgaccccacttcacagacatatttgtgaactgtctggggattcagtcttatgcagttatccaaatcacccttatcgattacctttaaaatagtaccccatacttcaaattacttcatcctcaaagatgcattagctttccatggctaccataaaaattaccacaaatatagtagcttaaaataacacaaatttattgtttcctataatgctgtagaattcaatgctcttactatcaaaattccaatgtcatttttcacagaagtaggaaaaaaaaatcccaaaatttgcatggaaccacaaaagacatcaaatagccaaatcaactttgagcataa

SEQ ID NO: 17821 - DNA, 433 bp, Homo sapiens
ttggcaggaacacattgaagactaagagtttttaggccaaatcatcgaaaataaataacatcacttgagaaatgatcagagaaataagaaagggccaccataacatgaataagacctactgtgaaggagaaggctttgccatttctatgctatttagggtgaactttgagttatggtgttctgttgggcacatcacatattgaaagaaaagtttgaaaagctaaagtcattgggagagcacacaggatggcaaaaagtcataaaatctttcttaacagcagtggttgaaatagttggagccacttagtttaatgaagacaaattagtgaagacagtgtggctgaccccaaatatttgacaggctttcataagtaaaagggatattggcctcatatagctctgaagtatgaatggctgtaaatggaaattggac

SEQ ID NO: 17822 - DNA, 324 bp, Homo sapiens
tttgtgaaaaataaaaacggatttaaagcaatggccctcaagtatcctaaatgccgggaaatggaaaagtaaaggcagattatgccagaggaaataagtatgctgaccgcctttagccatgtgatgaggaacagagatcttgggccttggagaatgtttttatgtggttgtgtggaatgaggggtattggggaaaagcaagggctctggggccctacagacgcaggttcaaatcctgtccaatatagcaaataatacccacctttcaggtgtgatgtggaagaaattaattcattatgggtattcaatatatggttttcccttc

SEQ ID NO: 17823 - DNA, 430 bp, Homo sapiens
ttgggaaattggccacagggtagcgttaaaatcctgtgaccttgaacaagtcatttaaggcatttgtccctcagtttcctggtctataagatggagaggagataatattgacctaattaggctttttgtgaacattaaatgatttgatatacataaaaagattagaataacacctggcaattaataagaactcaataaatgttagctattataatgaatagtaatcaaatatttctgcccttttatattagtttaacacaaaagctgatatgaaaaataataatattctataatgaaatattatactgccaaacgaatgaaaatataggtatgatttagaatctctccgccattttttcgaagtgtaaaaagcaaggttaaagtcacagaagctctatttgtacagatgagtatggaagggactgggcat

SEQ ID NO: 17824 - DNA, 408 bp, Homo sapiens
aaaccacactagcaagctgcaagagttggcactgctgctgcccatagccctgaagacggggaccaagaagctcacaaaggtacagggactagaggagaggggccagatttgggacgcaggtctttaaatagcagcaaatgggtcaccctctcctgggaaacctggacagatcctttcagtggcagcattcaaatgggaatggtgctactctgaacgggaatttccgggagtctgtgatcccataactaggtgcctggaggatcctttttttgcaaaggagagaggagaaaccgggctggggaaatagagatagcacaaagatcattgttccaggaatcaaatagccatgggtttgagccctctagcttcacagctacagaactctgggcagtttctcaggctacccag

SEQ ID NO: 17825 - DNA, 398 bp, Homo sapiens
taactgaaagatacgtatcagtccacactcccaccagaaatgcctgaagttctaactgcagaaaagctcctagaccctcacatgtcctgagcctagtctggaaagctgcctggaatccacgtgactgcatttgttccagggagagaatttgcacaggggcccacccctggaatgcaggctgctatagtatggtgccattttgagagcaaatacaacaacagactatatcccgccatggagaccaatagctcctgcatctccacaaccctgagacctcaccaatatccacccacacccactcaaagggctgcagcatcatagtgctggctaagcccagtggcacaaccacactgccagcatctgagaccacacaacatcccacaccccagggaacagat

SEQ ID NO: 17826 - DNA, 413 bp, Homo sapiens
tctggctggcattatcttcctctaggtacgattccccttgctgtctggcaggcagctatggtagagcagatctctctaatcagggcctgagcttattaacggctgggtttccattgttggcaggcacagactagaatggatcatcccagtctaggtgtactactctccagaggcaccagtttagagcctggattgtttgttaggatctttccctgcacccaggaaactctaaattttttcacctcggtaccttgtaacttgaaaattctactctgttatccagctctttttctgtttgttttcttagcctctcatcctgcacagcttaagaatttgaaagatcatgatgtcaggagatcgagaccatcctggctaacacggtgaaaccccgtctctactaaaaacataaaaac

SEQ ID NO: 17827 - DNA, 132 bp, Homo sapiens
tgtctgtagaaagtgtgcccattagtttatgtgggatcccagcccccatagactctcaaccctctaccttagcttacccgaggtgagcattcttccaataaacacccgtttgagtgtctttaatgatttatt

SEQ ID NO: 17828 - DNA, 558 bp, Homo sapiens
gctctgatactgtatttctctttactatataactttttgataatttgattagggatataagatgtatataaaagggagaaagtcgaaatttataatttagtttgtgatttcgaactaaatagaaaatttgcttatatattttgagcacataaatatagtttattgcctattgtttttagtcagatcctttctccttttcctcccaactttatctacactgttaaaatgtggaaacatatattcaagttcacttgttagtctctgctgtgcttggatagagatggtgatgcagcaggtactcaatgattgtgtattgagttaaaccatgaccaaagtagttaaaacagaaattttcctcctcagcattcatactctgatttagtctcaacctaaatgaatagtgcagtagaatcactgccttctcaggcctgtttctaggaggcatgtgaaacatatcagagtttcaaccctgttcccagtagacaagtatatagatcacaaaacacattcatatgcctttctagttgtcagtctatgcagaggatctaagaatggaat

SEQ ID NO: 17829 - DNA, 435 bp, Homo sapiens
aactcacttcatctcagccacccggttccgtagaagcgtttcatccgcgttttacagacgtgtgcaggcaaatagatacaagaaatctgatcctgtcctctcaaagaaaaccctctgaaataaacttatcacctttaaaaaaagggatgttgaagaacaagatggatttttgttgttgttgtcgtttttttgagatggagtctcgctcttgtcgtccaggccggaatgcggtggtgcgatctcggctcactgcaacctccgcctcccaggtttaagcgattcccctacctcagcctcatgagtagctaggattataggcacctgccaccacgcccggctaatttttgtatttttagtagagactgggtttcgccatgttggccaggctggtctcccaaagtgctgggattacagacgtgagcacccagcctggat

SEQ ID NO: 17830 - DNA, 590 bp, Homo sapiens
aagaaggtgattgtgaagaaaagactggaaagcaaagaggaagtggtttccatacatttacttatttatttctttcaatatacttttgatatactcgttatttttctaactcattaattttctgaaatttagaaggtgaggttagagaggttaagtgactgtttaaagctccatggctgaaaaactgccaaaccatgatggtcttaagtcagaccgtcttcagtatcctggcctcttaccttgttgcttcactacgtgtcaagaagtaggatctattagatgtagtatctcaccataagaaaggtagatacaaagactagaaggaaagaagtaaccttaatctgcacttgcatgtggaaaatgcatatttttaagaggtaagaggtggaaagaaagtagaacaggatttgatggaaaggtaggaggaagtgaaagactggatggagctgagagaagttcacagagatgggacagttaaggagtatgagaaaataatgcatatgttgattgttaaaaactcattactcttcttgaaaagattaccttctaagccaggtggaggaaaaaattagattgaaaagatctgatag

SEQ ID NO: 17831 - DNA, 509 bp, Homo sapiens
caaatcttctatatcttcacttattttctgcttacttgtaatctctatctataattacatatttatctatttctccttgaaattatatagattttgtgttatgtatagctgttattagatatataaatatttaggatcattatctcctcttcatgatttcacacttattatgaaatatctcctttatccatggtaataatctttgctctaagatctactttgatatttatatggtcactccaaacttcttttgatcgatgctagcatgatgtgcataccttttttccatcctttacttttaatttgcttgtgtctttatattgaaagtgtgttcttataggcataaacaagaccttatacttttatccaatctgataatagtctttgtcttataattggagcatttagaccaatcatctttaatgtaattgtctatttaaagttgcaccttaactccatgctttccaccacaactccatcctttccacctcagcccagatactcccaat

SEQ ID NO: 17832 - DNA, 451 bp, Homo sapiens
taagatcttatggacttacatgcatagaaagtaaataaaatgtagtcgcttccttctcactcttctgtgctttcccacacgctgctccttcccttggaaacaccccttctctgcctcaccacagtaactctactcatctcaaaaactcactttaaacatttactgcttccaaggctctttgcttctaacccagcatttgatatggtattattggatggtaatatttttcccatctaaacaaagagctccttgagggcaggggttgtatcttttgtttctatatcctcaaccctaagataaattgcgtataaagcaagaatttgcatgtaaaatatttctttagcttcatgttttactgaaagttcaacctccaacatgcaacaaaaattgctattaaaactcacactgcccatctgaaaaaattttccaacatttatttatttaaaatcta

SEQ ID NO: 17833 - DNA, 386 bp, Homo sapiens
ctttgagtattccatgtcctgtaaattgtaaggttttctactttggctgatggaaataagcactatgccttgcccatgttcacttcagagattgctcctaccaatcttgtctgtagttctgtctcctgtctttatacatatgcactgttctgtgccaggtaaatacttaaggggcactatctgtaaattgtcagagttctgtctctttgcagctcccttttcttcagtagtctcccatatgaactgtaaccaccttggttattacttctatcaacagctccttaactcagggaatttgacaggctctgccttaattctccttcccagcaccacagtttgaaagctgtctctagtcaataaactaaggcagtcatagagtttacctt

SEQ ID NO: 17834 - DNA, 520 bp, Homo sapiens
gatactgtagtattacagttaagaggtgatggggtttggatgaagataatgccagtgggaatggagaaacacaaacagaattttatatggactatagatatagaaattaggaaacttaatgtaggggaggacaagaaagaaagggagaaataagaaatggcacacaggtttttaacttgagcaactatatgatttgttttgtaacttagtcaatgagctcaaagtaaaaatggatgaataaataaataaatataattattaatgaaaatgttaataaatttatgaaagtttctctatacctaagaattagggtatatgaataatgccttcacatcacagagccccactcaatattattatttttcttaaattctaccaagatgaaaccttgattctttccagcttctggatgagttacctaacccccacatccacactaccctctgaagcatacaccaagaggttagcaatatccttgtcctcttccttcattaattaattccgatatcctagcatttat

SEQ ID NO: 17835 - DNA, 486 bp, Homo sapiens
tgtactgtaggacattagcagtatctctggctatgaaggcactagttgccagtagcgcacacacccccacccacccaatgagacaataaaaaatgcctccagacattgccaaatgtctcctgggggtggagggaaatccctagaaataaccgaaattggctttttttccctttcttttttgctgtcataagcctttataattctacagaatcttttggccaaacccataagtgaactgtgtgtgacttaattgtcttttattacaacttcatgtgaaatcagtgttcatttcctattaatactggcaacagattcaacagcttaatcacatacaagattatttctatatattcttacaaaaaaatttgtcataaattgcttctgccaaaacacatgaccaaattttcaagtttcatgaaaccatacagacataaatccatgcaagacgaaagcacatagaagaaacgactaccacatacaaagcgt

SEQ ID NO: 17836 - DNA, 476 bp, Homo sapiens
gtgaccacagttaataataatatatatttcaaaagtgctaaagagatgtttaatgttcacaccacaaataattggtgaggcaatggatatgttaattaggttgattgaatctttctataatgtgtaactagatgaaagcgtgacattgtactccacaaatatacacaattgttgtgaattaacaatttttttaatgtaggaaaaacttgatattttggtttccttttgtggcctccccttagtaggtgtacagtttccactggctctggtaacagaatgctcactcacatagtctgtccctgagagctcaggagctgggagctgtgcacgctgactgcctggggtccacctgggccagttgagggctgcctgctgaggcacttgaacccataatccaggaggaggaaggtcttagaagggaatggaagtggagtgacccaagaagaagctagaaagagtgctgggaggtcaaagct

SEQ ID NO: 17837 - DNA, 531 bp, Homo sapiens
tctgactcctcagtttatctgtcaaatggttccaaacttgagtagggtgagaggatcatcccccgtcaaatgtacattattcatacactgtaatggcgtaaaagaaccctagacacatgactcccttgctaataagtgcaccttcaaagcgatagtcatcatttagcatttatcggaagaggctggccccagctctggtgaagggcagagaaggtgtgggtggcctcacgtgttctcagtgtcacaaaatgatagcattaaacagacccactccctcatggaaggcaatttgacgaccttctattgatattgcaacatgtgtctctggcagcagatctcaatccttatgtaagggatatgggaagacttcctccacttcatgtatatgctttccctaagcagatctggcagatgcaaatttatccatatcttttcatttccattgaagttttagtatccacatcccctcctgaagacagaaaacttgtctttgtaaccctttttatttcagctgatctaaataattagttc

SEQ ID NO: 17838 - DNA, 228 bp, Homo sapiens
catggcccattccagggtgctaaggcattttttcagggcgcaagggtcttggtgaacagcatgctcttgaggctgtatggtcgccactccccattccattccagaggagggcacagaggccggactgtcgcagtcctcactttagtgggtgaggacacctgcctccaacccactacctacctcagaagcctgcaggctttttcttattacataccccacccaaagacc

SEQ ID NO: 17839 - DNA, 450 bp, Homo sapiens
ttcttaatgtagcctatttttaaaatatctcaaagtttgccatacagtctttatttcttatttcttaaaatattttctacattttgatacaactaacctttctaaagcataaatatctcactttgtcacttgtctgccccaaaaaaaacataaaaatatcttcttggtctagaaagtaaaattataatgcttggcataatgtagacagaaatagaaattcccatttatcctttttctcctttgcccccacacttttcttccatgttcacatcagtacctaatgtcccagacatatggaattcattgtttcatgaatagagccaacacattctaactaccatgcatttagtcaaaccatctggccacctggaatttcctaccatcccccataaaatttaaattaaaaaattccactgttctgtcctctctgaagatgtccctgaaccctta

SEQ ID NO: 17840 - DNA, 441 bp, Homo sapiens
ggaaggcctgctccctcctgcactaacccggggtgctttcacccactttagaccagtgtgaggtacggctttgcattccaatgacgacacattccaaactgatttggcagcactgtttaagtgctacaaggaaaccagtaaaacagaatcctgaatcagaatcctgacgattcatacaaaaattaaaacaggccttaaatctcaaaagtacttattaccaccctgtggccacatacccctacactatggcaaaaatggaaatcctgcagcagccagatgtgtgagagaagggaggtagccctccgtcccagagcagtaaacaaaggagctgcagagccacggagcactgaggagggttgtgctctccaaatatggccccactgagacacgcctccctcagcagactttcctgcagacgggtgtactgacagacggatgttc

SEQ ID NO: 17841 - DNA, 429 bp, Homo sapiens
acttctagaatgatggaggtgataattctgcctaactccacattggtagaaccacatctgggatatcatgttagtgcccggtgacagattagtgcaaacagaggaacatgactggattgctaaagagctcaacattctgccacaagagggacaaaaaaagtaaattggaatatataacttgaataagaaaatactcacggaggctgggtgcaatggctaatgcctgtaatcccagcactttgggaggctgaggcaggtggatcatttgaggtcaggagtttgagaccagcttggccaacatggtgaaacccggtcctactaaaaatacaaaaattagccaggcatggcaatgcatgcctgtaatcccagctactctggaggctgaggcacgagaatcgcttgaacctgggaggcaggggttgcagtaag

SEQ ID NO: 17842 - DNA, 112 bp, Homo sapiens
ggaattacagcagtttatttctcctcttcttttaattcttgtttcagtctccaggttttgtttcactgaacttgcaagatggtcataaagtagagtcttcaacataattagt

SEQ ID NO: 17843 - DNA, 444 bp, Homo sapiens
aatttttgtgtttttagtagggatggggtttcgccatgttggccagcctgttcttgatctcctgacctcaggtgatccgcacaccttggcctccccaagtgctgggattacaggtgtgagccacggcacccagcctgggctatttctttctctcctctgggatgaggggtgggggattgctctccagggcattacaagataaatgatcagaaaaacctacaccagccattagtggtgatgtaacagacagggtttctaatacagagaaaccgtaaagcaagagtaacttactgatctgttctactaacttgagcatcactcctccaacatgaaggtctccagatactctcagtgtgacgtctttctgctgctcttcattgggatggtcaacgcggaccacaagctcccaggaagcaaatgtaaagtcagtggatgacagcattg

SEQ ID NO: 17844 - DNA, 308 bp, Homo sapiens
actccagacacatcttcaattgctgctggaagattaagggaaatttaatttaatcttctataaccaaatcaacagcaatggagttagcacccagaaaaactggataagccctatcaatgaaaaacaaagcaaagattaacagaaaaacaaaaaaatcagtgattgatacaattaaaccaaaatcattaaaaaattaagttcacaattcagaattaaaagccaaaaaataggctggtgcagtggctcacacctgtaatcccagcacttgggaggccaaggcgggcggatcacctgaggtcaggaattcg

SEQ ID NO: 17845 - DNA, 443 bp, Homo sapiens
cagaatagatgatgttcatttatataacattctagaaaatgcaaactaatatatagggacaaaagctaatcagtggttgtctgaacccaggagtggagggaaagatgaaaaagggcatgagaaaacattttggtttgatagtaaaggtggtttcatgaatgtacacatctgccaaacctttaaatggatacagttagttgtatttacagtatactttaataagttaaattatcagcataaaatttttaaaaatcagtaactggtcagctgggtgtggtggctcatgcctgtaatcccagcactttgggaggccgaggtgagtggatcacgaggtcaggagatcgagactgtcctggctaacatagtgaaaccccgtctctactaaaaatacaaaaacaaaattagccgggcgtggtggcatgcgcctgtagtctcagctactc

SEQ ID NO: 17846 - DNA, 423 bp, Homo sapiens
ctctgggggcagctttcaacttgcaattgaaaaggcatgggggaggaacataggaaattcttaacaaagagaccgtcgccatgggaagcccttactcattcttacatctcagaaagccaggaaagtagaaggctcaacctgttgataggagtgctaatagaagattcaaaatgtgctctcccttctctcctgctcgtatcagtcatcatctcatcccactgcaacttcttgcagagatggcactgttctttaagattggtgcagtgtctctaacacagcagaggcagtgaatttacaaaaccctggtcctactgcctttgagccctccaactggaaattagttaaacaactttagctggccgggcgcggtggctcacgcctgtaatcccagcactttgggaggccaaggcgggcggatcatga

SEQ ID NO: 17847 - DNA, 258 bp, Homo sapiens
caataaaagcaaacacacaaagggttgaagcaagcgttggagactgagggcccaaaaaaagttccatttacataataaaactggtgtgttttaacagtaactatgccagctctaaagggtattggcaggccagacaatttgaggagaaaaaggatatattaatctaatcatatgtttattaacttattttcttaatatacaattttaaatcagaggtttttatttgtagacttattaaaaagaaaacatggcttaaaa

SEQ ID NO: 17848 - DNA, 388 bp, Homo sapiens
ttccttgagatatttcccacctatctaatgcacgcacacacacacacacgaacacacacaaaaacacacactcaacaggatgattagtagtactagaaactcctttgacaatttgtctacatttttgtttctttttacttaaataacacacacacacaaacattgttattctggaaaatactcaaattttcattgtaattactaatttatgcaggcactaaaatttgtttacatatggcctacaaaaatatttcaattaattgacaaaacaaatttattgttatgtaaatttgtgtgtttatatgtggtgagtacatttatataagagttctaggttattcaacttgcaatatctatatcagcaaaagcagtgctgcagaatatggac

SEQ ID NO: 17849 - DNA, 336 bp, Homo sapiens
gtataaataaaacaaatacatttgaatacagttgaatatacaatatacaaaattttcttccaagtataaaacgaaaataaaatacactactttctttaatagaatagaacattgtaataatgttccattgcatttgaccctcacataaatgctatgaggtagcattaagagataagatttgaggctgggcatggtggctcatgcctgtaattccagcactttgggaggtcgaggtgggcagatcattaggtcaggagtttgagaccagcctgaccaatacggtgaaatcccgtctctactaaaattacaaaaagtagtcgggcatggtggcatgta

SEQ ID NO: 17850 - DNA, 447 bp, Homo sapiens
ttggatagttggtggctgacccctgtccttaagcacacagccccctttcctagcctctgataactcaataaaatgcagtcctgcaaaggggtagctgtttgctaatgatctcagtttcatcattcttaccactattataattttgagacttggcttttttgtgtatttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaaggggacagatgtgaagagccaggatgctgccgtttccccgcagcagcaacagtgctcaaagagctatgtcgacaggcacatgga

SEQ ID NO: 17851 - DNA, 401 bp, Homo sapiens
agggatcccagctccttgggaggctgaggcaggagaatcgcttgaacctgggtagcagaggttgcagtgagccgagatcacgccactgcactccagcctgggcgacagagtgacactacatctaaaaaaagaaaagaaaaagaaaaaagaaaacatttagctccaactggctgctaattggtcatatgtcaaacaacaaaaaagtatcttgttttgtttttaggtaaaagagatcaaacaatgtaaaagatttgatgcataatgtcattcttctagtcttaatacttcacctacaaataagcttatgacacctccccaccttctgttttaatcctgttctcgatactccttagaattcactgatcacgaggtcaggagatccaggccatcctggctaacat

SEQ ID NO: 17852 - DNA, 407 bp, Homo sapiens
ggtcctggggctgcacgtgtggtgaggcctacagaagcggccttcagctggaccttggtctccccgccggacttcgagggtgtcatcgccgcccctgttgggggtgagcgccgcgcggctgcagcatgcctcacaggaagaaaaagccctttatagagaagaaaagctgtgtcttttcacttggtccaccggagccaacgagatcctttagcagcagatgagagtgcaccccagagggttctattgcccacacaaaaaatagacaatgaagaaaggcgagcagaacagaggaagtatggagtgttctttgatgacgactatgactacctgcagcacctgaaggaaccatctgggccttcagagcttattccctcaagtaccttcagtgcacacaacaggagagagga

SEQ ID NO: 17853 - DNA, 445 bp, Homo sapiens
tccacaagactcttgaaattatatattctgcagtaggataattatgttatctaaccagaatagtaatgacacatgcatttaaagctgataaaaatgagtcttgtcaaaaggaagtgacagcccaacttgtcaggccaaacacgctttggcatagaactttatatgctctttaaaatgactttaataaaaacaataagctaaccaatgcaatcaaactttgaaggtaataacaatatcagttatcaattttgtcctctcgatactccttggctagttttgcatttctgctaacatcattggtcctggatgattctgaaacttcagcctacaataccgtaaagtctttactgtatacgttcaacttcaagcataagataaattacaattaaaagtataatcagaggctgggcacagtggctcagccctgtaatcacggcactttggg

SEQ ID NO: 17854 - DNA, 444 bp, Homo sapiens
cagtatgcacaatgttgaaacagagttgataaacaaaaggtgactgatgttcactatcatcttttttaggaagtcaagtaagtttgtgatatagtttacagatacttctatcaaatattaaaatgtcttaagatggaaaaaaaaacagttttgacactcaagtaggttttacatattaacatatatagaatgcacatagaagaaagggtcagagaggtccctggaagtgccgtgtactgattcagcatcatgggggctgcacagcctgcactgtgagtaataactataataatagctatcatttaatgagcatttaccatgtgccaggaattaggttaaatctttacatgaattatagtattgagcccttttatccatgccttgagtaggtattattatatctattttaaagataaggaaattgagggccgggcacggaggctc

SEQ ID NO: 17855 - DNA, 373 bp, Homo sapiens
gggtgctgatggggccctgcaggctggagggtggccctgtcctcggctcccaggctctgttgctccctcgctgtgtgccctggggcagcttcctgatttctttcctcctgcttctcagaaatcagtctggatgggtaacaagacatcaaactgatactaatccagtggcctctggagtggatgcacaagatcatttactcacgtgagaaaaaaaaataacactttctttttaagttattcttttctataaaataagaataaaacagccgaggcaggaggatcacttgtggccaggaagagttcaagaccagccagggcaacatagtgagaccccatctctacaataatcagaaatcttaaaaaattagccgga

SEQ ID NO: 17856 - DNA, 443 bp, Homo sapiens
gattacaggcatgagccaccaggtctggcccccccattgtcatttttattagaagtttatttctcttcatatgagtaaagttttattaaagcagcttaactataaatatataaaaattttaaagacaagaaacatgactaatgaggtaaacatcaatggctgaaaagttggaaaattaggtgtgtgtgtgtgtgtgtgtgtgtgtgtgtaaatttaggcttccagtaatcataagcattactgtaattttcaccctaagtgaaccactttaaaatgtgtgcctttcttgagtaaccattgtaaatattaattggacattcacagactgtaaaggtttaaaactaatgactggatgttatggcaaacagtgtggagcttcctcaaaaaattaacaatagtactgatctagcaggcttgctactgagcatatatccgaaggacat

SEQ ID NO: 17857 - DNA, 277 bp, Homo sapiens
cgatttgcaaaagaaattcttcccaaatatttcaagcacaataatatggcaagctttgtgaggcaactgaatatgtgtgagtatggacagcagtttattggagtaccattatcagctactgatgaagccattttttttcccattagggtggtaaaggaaaattattccatacaagcaccgccaaattttggcttgtttattttagtcatttgaattttgaatatttttcagatggtttccgtaaagtagtacatatcgactctggaattgtaaagca

SEQ ID NO: 17858 - DNA, 298 bp, Homo sapiens
actttttgatatcttacagtagatttttttagggagtagtgagcacatgaaactaaactttgactttagagaatatcagcacacaatgttcacatggtaatttcactctcaggaatttattctaagaaatagtgaaagatgcatagtgaatgtttgagagagacagaaagcaaaatattaaaaatatataataggtgaacggtaaagtaagttatgggtacttgtaaaagaaatattatgcagccattagaagtcagatttttgaaaaatatttaatgaaatgagactactgagtttt

SEQ ID NO: 17859 - DNA, 439 bp, Homo sapiens
tgcttgaccacactttcactggcaaagatttaaagacaatcagtattacagctatatgattaaaataatttaagcaataaattaaataaaatttggggaattaaaatacaacctaactttttatccagatctagcaagtggtatttttatttttattgcaacctttcagaattcatattaggatattttaaagtctaagtgttgtatgaagagtagtatattaattataatggtgttaacttcatttaaacttacctgtatgttgattattcttcctctgtaaaattaagccacacagataaaacgttctgctatacttaacaagatagatatttgtataaaatgaaagttaagatattatccatagtgtaaatatttatcattcattacaactaaggggagactgtacccagatgatttcttcttggaaacaatattt

SEQ ID NO: 17860 - DNA, 611 bp, Homo sapiens
aacgcaagatgataccaggaaggcagattgggagtgagtttctagtggactctggatgccaagctaaagatgaggactttattttgtgggcaataagaaaccagaggaggcttctggatagagaagcgtagaacaagatgtgatgaggacagggatccagggagaagggctcggtgtcagggatatgcagaatggcaatggggaggggtcccagaagcaggagatggcccagcagaagaatgaaagacacagctggaaaaacacagtggaaagaattacacacccagagaaggagaggccacaaagcagacatggacacagacatacgccaaacaattgtcagctgacatgcctgttgcctcctttgggggccaatgaccttctcttacttgtccttcatacctgcacctagctcagtgtctgtttgagtagacactcaatccattctcgacaaatgaatgaactaatgaattccacatcctgaaaggtggagggaaagggagttaaagcttcaacatggtattaaacagggcagcaagacccagtctctacacaaaattaaaaaattagccaggcatggtggcacacacctgcagtgccagttacttgaa

SEQ ID NO: 17861 - DNA, 609 bp, Homo sapiens
caggttcagtgggatagcttatgtaactgcctaacaaggtctttggtatagtagacgcttagtcaagattgggtagcacccccttttcttaggctgtattccccagcttaaaaaggagttgctgtgtctctggtcgtgtgattgttgccccaggaatgagggactcactcattctagcagagaggcagttccctaagccatctgacaaaactcctagtccattctctttcttggatcatttcccaactaaccaaggtaacgcagtctgtttttcctgtgattttttttttctttttttaaagcattcccttttcttctttgactccgtttttctctctttctgtctgatgatgattgatatttttaaccctccttgcttcctcttgctggtctgtgccatagaatctagactctgggaggaggactctcctcttggaagactttgctccagaaactcagagctgggatttgccattctggactttgtttggtgtcttgccagaaagtggtctattgcatgatgtgtccacattttttcctccatgtgatccaaagagacatctgtctgggaagaatgtgatgggccccacaaatagactgcctggggta

SEQ ID NO: 17862 - DNA, 541 bp, Homo sapiens
tccccatctggaagtgctgcctgtgatgggaatcactgcagttaacacgtgtcccttagctcttgcaagaggtaggccttctgcctttggctctgacaaggtgcaggaggcctacccctttagcatctctaatggtgtcacagtctcacagcttggcactctggcttgttgtggttaagtgctgttttgctagaaaacatctgagcataatacgacaaaatatttgttttctcctcaacatcagcacatgtttgacctgttagaatttctaaaatgccaaagtagcaaggtgctacaagttagaactaacagatatgcaggttctcttggaactctgctttcaatttttctcttttcaaaaatctattgatgcttcagatgttagcagaggagtatcaggagctattgtttactgaaggaaagacgattgacctttgacagcaactcatggctggcattttggatattagtcacctatttcttttcattctttgtataaacatatattaagcacctgccatgcagtaagcatttgagtaac

SEQ ID NO: 17863 - DNA, 527 bp, Homo sapiens
agaattaatgcattttgtgtcccaagaaatctgggcctgtgccagtcatggacatatttatctatgttatctactagaaatattgttttcagctttgaccttaaaatttaaaatccacttttcattggaatttgttaataatataagataggagtgttttttctcacataaataactggttgactcaaggctatttaccgagaagactgccttcactcctcttctgtgcctgttttgtaatatacaaaatgtccaaatgtgtgagtctgagtgggactctcgagtttttctagttttctttgtgcctatttttgcattactaccatagatagcttttattactatagctttaatctaagtctgaatatatgtcattttaagctcacaaactttgttattcttcaggacagtttttacatttcttcgattttttatatgtatttaaattttttaaactgattagacagtttccacaagatttctgccaaaatattgtattgtgaaaatggaaatctatgaatcaattt

SEQ ID NO: 17864 - DNA, 330 bp, Homo sapiens
ctcacacctgtaatcctagcactttgggaggcccaggtgggaggatcacttgagctcacagaccagtctgggcaacacagtgagaccttgtctctctatattttttttaaagtagaagaaaaaaaaaagaagtaaactaagcttctagggtctttttgttggttttgtttttttatcactgtactcttcttccagaagacaaagactactaatacacacacggcaatcttaatactaagtaatctgacaaaaaaaaattacagcagctagaattttatctaagatttatataagtttaaatgtttaaaaaaaagaattttatgaggctga

SEQ ID NO: 17865 - DNA, 452 bp, Homo sapiens
ttctagagtcagatgtttcacaactatgtcatctttctgttgaatagtctatttcaaatactttattccaattatgcaagataatgggatgaagctcctaaaagttggaacgttaaaataaatatttttttgttgtcatcctgagtgttctgcacttaggaggcattaagcggatgttgctgcatgactgaaaaatggggaatctatgcttaagaacttgataaactaccatgttgcagttttcagtaatagactgaaaatgtaataataactcatactggccgggcgcggtggcttatgccggcaatcccagcactttgggaggccgaggtgggtggatcacgaggtcaagagatcgagaccatcctagccaacatggtgaaaccccatctctactaaaaatacaaaactaagctgggtgtggtgggacgtgcgtgtaatcccagctactc

SEQ ID NO: 17866 - DNA, 524 bp, Homo sapiens
aacctggtgagggcgtgttacatgctgcccagggccaggctgtgagtgctgtcttggacatctcgcccagaattgtgtttttgtttcaaggctaacacagaaaaccagtcttactttgggaaaggagaactggtttattattgattggatggaaagcaaatggccaggtctgtagtctccactgtaatttaaaaggctctatattatgataatcttttgacctgccaactttcttgttttcgttcaacagtgggagagtgggtcttgctcttctgtactactctgattgacaattctcaccaggttctactgaaaagatctagatcatagccatttgtctcataagccatttggctgaactgaaagatcaaatcatgtattcacaacattttgccttagtgttgatttctaaaagatcctagttcttaaaaaacacagcaaaaatctaatgtgttctttagatgcagttggtgtagctggacattcagtatttgttggtacttggcaaaatgatggagagtgac

SEQ ID NO: 17867 - DNA, 518 bp, Homo sapiens
aacctggtgagggcgtgttacatgctgcccagggccaggctgtgagtgctgtcttggacatctcgcccagaattgtgtttttgtttcaaggctaacacagaaaaccagtcttactttgggaaaggagaactggtttattattgattggatggaaagcaaatggccaggtctgtagtctccactgtaatttaaaaggctctatattatgataatcttttgacctgccaactttcttgttttcgttcaacagtgggagagtgggtcttgctcttctgtactactctgattgacaattctcaccaggttctactgaaaagatctagatcatagccatttgtctcataagccatttggctgaactgaaagatcaaatcatgtattcacaacattctgccttagtgttgatttctaaaagatcctagttcttaaaaaacacagcagaaatctaatgtgttctttagatgcagttggtgtagctggacattcagtatttgttggtacttggcaaaatgatggag

SEQ ID NO: 17868 - DNA, 547 bp, Homo sapiens
tattttgctctactgggccctggagtctttgcagatgctgtcaagatactgcactttttttttctttttgagacagagtcttgctctgtcacccaggctggaatgcagtggcatgatgtcagctcactgcaacctccgcctcccaggttcaagcaattctcctgcctcagcctcccgagtagctgggactacaggtgtgcgccaccatgcccagctaatttttttgtatttttagtagagacagggtttcaccatgttggcccggctgctcttgaactcctgacctcaggtgatctgcctacctcggcctcccaaagtgctgggattataggcatgaaccactgcgcctggccgatactgcagttttgatggccatcactggtacaacaccctgcgtatgccaagactgtcatgccttgtcagctataataaaaagcaggagacaaatggccttttgttacctgaaatgatggatcagtatgtatgtgcaaggatgcacgctgtcaagttcttgtgggttaatcatgccaggctgatggaggggctc

SEQ ID NO: 17869 - DNA, 116 bp, Homo sapiens
ttccaactttgcttttactttgagataaatgctaaagaaagaaaattactcagagcatctctcacaatccctgagcatctctcacaatcacatacactgatgatatatcacacatt

SEQ ID NO: 17870 - DNA, 552 bp, Homo sapiens
  misc_feature 433, 438: n = A,T,C or G
ggggtctcagcatttggggacgctctcagctctcggcgcacgtcccagcttccttcaaaatgcctactgttcacgaaatcctgtgcaagctcagcttggagggtgatgtaagtatatcactttcactttatataatttttgcaagttggacatctctctggataaccatattactctctatccttgtacatctaaggaagatggggacaattcagacagtcatcatttggttctcctctttcttaatacttcagctgttcctagtagttcaatttgaaggaaatatcatggcactggaaacttttcttggcctcacattaaaattggaaagaattagtgacactggaatggctggaattttattctgccatacttagcatgtcattggtaataactgttatgatggtacatgacttttaatgtcatgtcctgngattntattactggttggcataagccacagccatatcaaaactaattctgcatcttttggatttcttacagtgtccaggaagttattccagatgaagacttatacttttattttattta

SEQ ID NO: 17871 - DNA, 380 bp, Homo sapiens
gtgtagctgttaaataacatttgttgctttccatgacagaggtggctatattccagaaatgaatgaagtgtttcctgtgccttttcagtaatgaaggaaggagagggaagaaaattggtgatactagtattgtcaattaccattataagatattcaggagtgcaagttttaatcccatttgtaggtctcatttacatggaaaaaaaatttgatttatatagtaacataaatttagtttattttcctcccgattcaatcccacctgaagggacttgaacttgaacccttcagcatatagagaagagggtcaaaatacaattggtttgctaagctgtcacacagattcccttgctaacatttgcagtatttttcttggctga

SEQ ID NO: 17872 - DNA, 491 bp, Homo sapiens
caatcagtcaattatctgcagcctctaacacttgggctcatgcttcctcatttgataggtagttcctttaagatatcttattaacaaagagtctaattccatcaatattaaaatgccatctaagccaggcacggtggctcatgcctgtaatcccaagactttgggaggccaaggtgggcagatgcttgagtccaggagtttgagaccagcctgggcaacatggcaaaaccccatctctacaaaaaatacaaaaactgagctgggcatggtagcaatgagcctgcagtctcatctacttctgaggtgggaggatcacctgagccagggaagtcaagactgcagtgagccatggtggcgcccctgcactcgagcctgggtgacagtgagaccctgtctccaaaaaataaaataatacacaaaacaaaaacaaatgccatctaggaaagccttcattaatgtcttttaaactacttcctctactctctatactt

SEQ ID NO: 17873 - DNA, 546 bp, Homo sapiens
  misc_feature 147: n = A,T,C or G
attgtcttccacaaaaccagtccctggggccaaaaaggctaggaactgctgctctagaagaaacaccaaacgtaccaagatgtaaacagaaaaaagtaaaattacaaaagtacccaaaggaactgaaaaatatgagacaggcaaagncctctccaactttgactaaaaatacagaagccataaaaaaaaataaatttgactacataaaatgaaagagacttccaaagggcaaaccaccaccactaagtaaaccaaatcatgcatgatcaactggaaaaaaaatgcaactcatagcaaagactatacataaagagctttcagaataaagaagaaaaagaccaacaacatagtgggaaaatgtctgaaattcaaaacacactccacataaaaataaacacaaaatgacatttaaatacatgaaaatatgatcaaccttacttataataacagaaatataaattaaagctataacaaaataccatttctcacctaccagcaaaaattcaaaagtttgacaacagattccatgggtgatgttctagggaa

SEQ ID NO: 17874 - DNA, 616 bp, Homo sapiens
gacagagggattcacctagtctactattgaatataacccattcttcctcacaagctgaagtaaacttggattccttatttccatgcagcggagttaaagaaattgctgttcttcctgagggacactttctcccatcgaaccctttcccgtgttagaagatacactgtgtgattattcacatctttatgactctcctttcagagaattcttgagggtccttggactcttgctaattccacactctggagctctacctagatttctcctcttttcccttcaggagctttcaaacatttgagagagaagttagctgtgttgtctctctattggctcagggaattacagcagcttatttctcctcttcttttaattcttgtttcagtctccaggttttgtttcactgaacttgcaagatggtcataaagtagagtcttcaacataattagtaagatttgtctgacaactcaatgtcatgacatacaaaatagcattgctgatttacatttacattatataaagaaaatatttattaaaagatttagctttatgtctttaacaaaattatggaatagttgaggactggatgcagtggcttacacctgtaatcccaacactt

SEQ ID NO: 17875 - DNA, 449 bp, Homo sapiens
cagaaacaagaatgtggccctttcacagcccgtctggctcatctgaaagcttcagagaagcagccactttccgaggcagctgtacctaccccaggcctttgcaaaccagtggctccagcctggggcccagacagggatggggagggctagttctgcacccagctccgtggcctctgcttcctcccaggtaccaggaggtccaggcggcccagaaagcactgaggacggctgtggcagaggtgctgcctgaagcggaaagcgtgttggccaccgtgcagcaagttggccgcagatacagccccgtacctggccttgctggcttccccgggagctctggtcagctcagttgtctcagagctccgtgtggggtcgggaggatctattatagaagctggaggctgggcacggtggctcacgcctgtggatcacctgaattcaggagtttgaga

SEQ ID NO: 17876 - DNA, 312 bp, Homo sapiens
ggacggccagcgcacagccgcgcgggcggcggccaggagtcggagtcggagtcgtggtgaccagctgcaagcatccgcgttgcgtcctcctggggaagaggaaaggctcggttggagctggcagtttccaactccctggaggtcatctggagttcggtgaaacctgggaagaatgtgctcaaagggaaacctgggaagaagcagctcttcacctgaaaaatgttcactttgcctcagttgtgaattctttcattgagaaagagaattaccattataaagtaagagaattatatataatcatgcatttttctt

SEQ ID NO: 17877 - DNA, 293 bp, Homo sapiens
gatttcagatttcaagaaaagccagggaaacttagagtacctagacccattctgtataagggaagacatgcttctttaggtcattgaaataatgacatctgccatatatggaataaaaggctgccttgcctaggaggaagggcttgggtgctcactgaaagtgtcctgtttctagaatgccaagcacatatgactaattggcagtagtttcctccaaagcaagaaaatcctgcctgctgaccagagaaaagtgcctaatacggttaaagaatcactaagtgagacttttttat

SEQ ID NO: 17878 - DNA, 483 bp, Homo sapiens
aactaaaatatgtgagatgatggcaaggtgggcagaaggaaagttcaggaactatggacacaagactgtgggccctatgctacggtcaaagccaacgggttctctgaatacccaaaagctggttctctctctggctgcattctacaatcaccttaggagcttcaaacaacaccaattcctacgtgccctccagactgaatgatcagaacctgaaggtacagcccaggcaccggcactttaaaagagctccccagaagattctaatgtttagcgagaattgacagtactgtcccagtgggtcaatatctccctagcttaagacataccaggcgggatgtggtggctcacgcctgtaatcccagtgctttgggagaccaaggtgggcggatcacttcaggccaggagttcaagaccagcctggccaacatgatgaaaccctgtctcgactaaaagtacaggatcacctgaggtcagatgtttgtg

SEQ ID NO: 17879 - DNA, 485 bp, Homo sapiens
ccctcttgtctcttcatactcaggccaaaccaataggaatatttcacaaggtcagtaaagtgaatcagttaaactaaacaaaacggtttaaaccaaaccacctcagatttgctttgtatttttgaaatatcttaatttattttaattcaatgtaaaaagaaaagaatctattccatccaaaatatcaacaaatgcattgatcttaggggctacaactacaggagagggaataatttgggtttgtttggtgaaggcctgatggccagggagccccgctctgccattcctagtcatttttgttcccccaccggaaatgctgctccctcattcccaggatctcagagtgtctcaaaagcacagaggccatctttggaggcagtgggtgtgctcatgcttgtgctcctgtgtactaggggcagagagtggagggatatttgagaaagcagacacaggagaacaagctcaagcccttaccccagaatctc

SEQ ID NO: 17880 - DNA, 437 bp, Homo sapiens
gaattcagagataaataagaatgttgtacttccaggggctaacaattttcctggagataaagaaatatggcaactggtatctgtatcacatggtaaaatgtataagtcaaagtcctgtagaagcacagaggataaagtgttactgtgtttgcaactgcaatttgaaatacagaagaaacaattatttagaccagtagtcacaaattgcagagcatatagcctgcattgcaggcaccctaatgaagcagatgtgctaggtagaaatattagcagtcttttatcaaacgtattgcatggttaattccttggtactgcaggttttaaatatacagtcatcattttaaacttgagacaacatacagaatcggataaaatatttgcaaactatgcatcttatgaatgactgatatccattttctacaagaaactcaaacaac

SEQ ID NO: 17881 - DNA, 547 bp, Homo sapiens
gtgaaaccccgtgtctactaaaatatatatatacacaaaaaattagctgggtgtggtggcgggagcctgtagtcccagctattcgggaggctgaggcaagagaacggtgtgaactcgggaggtggagcttgcagtgagtcgagatggcaccactgcactccagcctgggcaacagagcgagactctgtctcagaaaaaaaaagaatcctacaaaaagatattctcatggagagccctaagccaacataagtgactacagtagagtagcaatggccacagggcaggtccagccagagaaactatctaagagagacccaccatctccacctccatgtttccagaaacatcctagtagcacagaagggcatctgaatttttcccatggtttccccgacatccttccccatgagctccaacaatagtttggctgagagaaatccaatggactgggaatgtccttatggttgcatagaccggggcaagtttagactgtgaacatcagcggcagatggcagtgaggatagatacctaaaaccaaagccatctc

SEQ ID NO: 17882 - DNA, 472 bp, Homo sapiens
ggagtattgctgattgtgttaatttttatgcttatattccctaatatatatatgtatatatatatgtgcacatacatatttaaattatttccttgattaatcaaacattactaggattccataatatgaacgtattaatcctacttcacaaatagaacaaagtaagaggataataaagcaaaacagaagtttttcaaaacttcacaaatttaagataatttgatattgttagtgaataagacaagcacctaataaagatgtattaaatgtccaatatgtacttaatacaaaactatatgattctaatattataaaataagtaacttcaaataactcttcaagagctaatagcttatttattaaaataatattaaaatggataatactggccgggcacggtggctcaagcctgtaatcccagcactttgggaggctgaggcaggcagatcacaaggtcaggagatcgaggtca

SEQ ID NO: 17883 - DNA, 400 bp, Homo sapiens
aattggaaaactgaatgaattttctcatgcaatttttctaatgtggtgattagattttactggatgcctgaacacttatagtacattttggattaataataatagttaagatgaattgcatacttactttgtgccaggcacatttctaatcagtttacatgattatctctaaacctcaccactgtctgaagtaggtagtatcatcttcatgttaaacatgaaaaaactgaggcacatttatatttggtgtttttcttcattcagagaaaacttctttcaggttatacaggagtatgtgcagcctagcattccaagacttgcatttttcttctgtatcaggaagggtaatacccttttagctgcataaacaagagtgttgctgccctggaagccgaataaa

SEQ ID NO: 17884 - DNA, 389 bp, Homo sapiens
ggcataaaagcaaggatggtaatatctgctaatagaacttcccatcccaggagggggttttcatttcttttgtttgcacaatttaaataggcaaagctacccctttaaatgacacgaaccttttgtccctatgagatttcggttatcaggccacagtctgtcagtttgaaaccatttccttcccaattagcttgcagttgggtggtgtgtcatgctgttttgcggtttctccaccttcatttgaccttcagcatcatctgcaatgctctctgtttagcaccaaaaatcacaatcaatgcagagaggcacctggtgtgtttgctcaagaattttgtgcttgaaaccttatagcttgagaggatttggggactgtggtttgtctgtagttg

SEQ ID NO: 17885 - DNA, 433 bp, Homo sapiens
tctattacacagtactaggcaagcagttcatagctcaattagatctaacttgcttcatttttaggcattatgttattctaaattaacactgtatttcatattctccaggtctgactattaaccagattttggaacctttagggcttattatttagtaatccctgaagctctcaagtaggcgtttttaaattcatgcattagaacggattaaaaattagctagaaacgcatgttaaatggcccactccctttcttttgctaattgtgctagaaatgaaaaagaaaatgcaagtgaggtcagatctagtgtggtacaaatgaacttgctacttggtttgctgccaattgctgccgaaacaggagttatttaaattagtaaataatttttgaaatcttcttagaatgtcacaggccacaattcaaattcacagacc

SEQ ID NO: 17886 - DNA, 477 bp, Homo sapiens
tccatgagtgtctgaggcccgtcccagtctgtgcggtgcggaggagagagcacctgcccctccacccgatgctttgtcctccttctcattcctgggaaggaaatcctgtgagctactcagctgcgagtgctgtgataacaggaacgcacctgtctgtgcttagttgagcactgcctagaacagtctggcacctagaacatactcctaagcacgggttgaatgaatgaaaagacccatcatttctgtttctgtttcaatgaagaatcatccacaggcagagggctaaggttttccctgtcagtaatcaaacagtcaagcccacaagattaagaatttcaggactacattcccctttccccatctctccctaccaaatacacgatagtaactgttttgtggttggtactaaagggtctgtttctgctcttccagacgtgctcaggcacatctgaagcacgggattaaatgggaccttcg

SEQ ID NO: 17887 - DNA, 339 bp, Homo sapiens
attcatacacatctgtgtagcagataatttcctgccataaatacagtagagaacaaacaaaatggtcagcagagtagacagcaacctacttcttgtgatgggaaaactgagctgtccaatacacagacttgagagctcactgagagtttttacacactagccagtcattgggtacagttcaaatttgtgcctgagcaaaaagtacaaatgttttcatactgcagaccttcaggatctcatgtataactggggcggcaaatcttgaatctgtaactgccaagggcctactttccaactctctctctctatctatccatatattatctataatttttcagc

SEQ ID NO: 17888 - DNA, 588 bp, Homo sapiens
gactccccaaacacagtttttccaccaacaaaaggttttcagtcctttaaattcatctaaggacataaactatgcagagcagtcaggatagaagccatgtgagccacaaacaacaaagcacaaattgcctccagtgggcatagagtttcagtgacttcatgttggctaaatataggcgaacacatggtgtgttgtgagtgccagggagaaccatgatgcaattatcccctccccttgatggaatagagaggaccagggtcagagggaagaatgagattacctaataaatggtcacgtcacggtcctcaactccactcccatccaagggttgcgcgcgcacacacacacacacacacacacacacccccaatacatgacaaagcaaacattatcacacagctttagaacaacatatttatcttctgattgtagttaaggataaattgctttaatattaaatttaattgttgtgattttctttttactccttattacataaaaaattcatattcaccatagaaaatttagaaatcagaataactattaatttttattgagcgttaatatatggcaggtattccctgtaat

SEQ ID NO: 17889 - DNA, 471 bp, Homo sapiens
aaatttttttaggggaattggaattggaagacaatagaattagagactgaaagttcaataaagttaaaggaagagatatagaaacaaaatctgcaaaatgctactactgtagtctaaagttgcacaggttcctaacctgagttaaaccaaaggtttgccagatctgtatcacaattcaaattcctctaatgcttccaccttcttatttccaaggcattaatctttaagaaatttctttacataccaaattgcatctcaccgtctgcttctggggaacccaacttgcaacactcagtatatgtccagtaattttctcttatatttttaatctaaattgagttggttctgtcacttgcaaccaagagtattaagactttatagtatttacatagtgagtagcataggtaatcagcagggatgtttagcagctttgataatatcctgattggatgttgaaagtatttaaatttt

SEQ ID NO: 17890 - DNA, 464 bp, Homo sapiens
cagctgcatttcagattgcttacattcactgacctcaaagacctaattgctccccaaaactgtgtctgacccggtaatggacacatactgtcttctcactcagatagctcaggaggatataagactgttcctcagtgtcctcattcttctttgtaaacagctggtggaggatcctcttaatcacagggtaagtagcagtaccttccagagccaagcactgagctgcagcccagctatccacactgttacctgccacagttgggtgaaaaagagttcagaatggtgatgtgttttccccctagagaacagcctttggattgatacccaaggctgctaccccacctgatatctcacttccttgtgccccactcagtctagaaatacaatttcttatttaaaccatattgagaagaatcatattggctgggcgcggtggctaacacctgtagtcctcacattttggg

SEQ ID NO: 17891 - DNA, 422 bp, Homo sapiens
gaaataccaaaggccaattagcttacaaagagattttttacctcagtaataagaaaaaaaaaattaaaacagcgatgagatagatggcaaaaatcaaaatgattaataggagtctaagaaacactatacagaattataccaggcccagcatggtggctcacacctgtaatcccagcactttgggaggccgaggcaggtggatcacgaggtcagaagtacgagaccagcctggccaacatagtgaaacccagtctctactaaaaatacaaaaattagccggagtggtggcgcacacctatagtcccagctactcgggaggctgaggcagggagaattgcttgaacccaggaggcggaggttgcagtgagccgagatcgcgccactgtactccagcctgggtgacagagcgggactcttgtctc

SEQ ID NO: 17892 - DNA, 605 bp, Homo sapiens
agtagtgtcaattttgaaaaatcttgcaatcttgctgtagattacaatgatatctaacaaataaattaatcccatcaacaactatatgccacctttgaacagttaattgaaaaaattcctagaaaaacatagttttaaactgactcaaaaaatgaaaactttaaattattctttaaccattaaaaaaagccaaaaatctttccacaacgaaatcactagattcagatagttttataggcaagtagagttaaatttctaaggcaccaatctcctacaaactattttaaggaagagaaagatgaaatattactaaatacctctgtgaagaaagcgaactggagagcaaagccagacaaagaaaaacaagctcaatttctctcctaatcataagtacaaaatattctaaaccaaataagaattgtttcagttaaacaatatgtaaaagttatggtacataacgaataacttgagtatattccggggatgcggagatgatttatagaatttataaatgtaattaactacgctaagacattacaggaaaagccgcagtgcatttttcataaatgcctccgataaaaataataaaaatgaacctaaattca

SEQ ID NO: 17893 - DNA, 586 bp, Homo sapiens
agctcggtgtgttgtggaagctgaaggaagctgccctgggctctgtttaggggctggatcaggcactgtgtatgttagaacaagagggcaacttaacatgtgactcaggaagcacagccgctccctgtccacccccaccatcacagggctggttaggaggaggtgctgagatgctgtcttggagttggtataggacatgggtgaagatctggctacggccacttccagccactgtccctggcgaagccatgcagccttcctgggcttttgggttagcatctttgaaatggacgtgactatatcaggcgggcgtgagcgggctgcctcctgtttgactggtgctctcctgacgcacaagagggaagctctcagtggggctcccagtcgttggcactccatggggtgggctttgccagagcatgagaggaagacgccacagttcaaagtggattctcggtcccagtcccaggctcccacgatgtggtcggagatagggatgaggtcagcagagaggtcatgattttcagagttggtgaggcaagcactgagaaactaagttcaacgagaacagtgatggattttaaaa

SEQ ID NO: 17894 - DNA, 434 bp, Homo sapiens
  misc_feature 358: n = A,T,C or G
gtgctaggattacaggcatgagctaccatgtccatccagtaattgactagctatttagaaaataaaccagtttagacactgtctctatactatacaccaaaataacatccaaagaaatttttcaaattaaaccataataaagttcaaataaaatagaggtaaaagtgtatttgatcaccagataggtagtgaccatttaagcgatgacggaaatgtaccttcactaccattctcataggtagtatttattgaacattttctgtgtgctaggtaatgtgtaaagtgatttctttatatgctattctcattgggttctcaaagcaagaacgtgatgtagatactcttagtgactccattntagcaatgtggaagttgaggcacagggagttttagtaacttgcgaaaggtcacacagccagaaagtggaagaatta

SEQ ID NO: 17895 - DNA, 568 bp, Homo sapiens
tagctttgttttgaaagaaggtctgatggtgaaattaaataacaagttaggatcaaggagaccatttgagagagaaaaggatctaaattctagttctagaatggaatcccagacataacatataactgaccccaattattctttagctaaaaggtatccttttctacaacaggattgcagtcattcttttccaattgactcagcaatatataacctctttttattatttaactttattttcatagctctgacataagctaaactccatttaatccaaaaggatttttaaagtgtctatactggaaaagactacaatggaaaaggactgactttgtacctagagcaggccaggatgaaaacataccctaggaccagaacagcaaggagggatgggtttcaatggatggtgctctgaaaacagcctcttgaaatttagatgctggcccttgaactaattgtatgggtggagcacgttagctgcttcagaataaaaaccaattatattaacaaccaccctcattatgcaggacataatcaccatgaccatgtcaatatgtgtgtggaatat

SEQ ID NO: 17896 - DNA, 559 bp, Homo sapiens
ttctttccaactctcattccatagctttccctttttctgcaaactttctctgtaacaaatctggtatgagttattttgtagcatcctcaccgttactgaaggccactttgtctctggcctataataagcataggcttcaaccagaaatggcaagagtgagacctaccattcactaggtgtctactccaaataggtagtagtgcttagtgtgctgagtgctttacatgcagtatctgccactccacattgttttgaagtgtccagtgatttttgtgcactatcatgcatcccattcatccaggggaagcgaaatatatcatcagtactttagagatgatggatctgtatctctcattctgtttaagaatcccaaatcactaattaagattcccagactacttatgcccctctaggctctttcagaatgaggtgtctttagatcaggatgtatgttcattcaaatgcttaacctacccattcaccccttgggcttggttggagttggagcagcctttcaggctttcttattaagaaatttctttttcatggctcacgcctg

SEQ ID NO: 17897 - DNA, 567 bp, Homo sapiens
gaggggatgcaaaagatgagtccgtgctggtcccatttcaaagaactcaaaatatggtggagacaagcacgtatacaaaaccagaacacagtataatgaataccacaggagtatacccgcaaaagttatatgggtgaagaaagaaggattaattagttctgccagagaaggactaattcagggaaggctttggagaacagggcacacatgatcggagactttactggttcagtcagctatataagtgataaggataacatgaagagaggtgccaagggcaagaaagtataagatatgtgtagaggctgggtgcagtggctcatgcctgtaatcccagcactttgggaggctgaggcgggcggatcacgtgaggtcaggggttcaagaccagcctggccaacataatgaaaccccatctctactaaaaatacaaaaattaggcgggcatggtggcgggcacctttagtcccagctacttgggaggctgaggcaggagaattgcttgaacccaggaggtggaggttgcagtgagccaagattgcaccactgcactccagcctggttgac

SEQ ID NO: 17898 - DNA, 537 bp, Homo sapiens
gtgggccggaggtcaccgagatctctcctcactgggggacggaataggcctctccctgcttgctgctgttctttggccttgtcccctgcctcctttcctggaccacctacaaggacctagagggaacagtactgggggcaggagctgggaaaggcctgctgtggttcactgctagtaagaaatagagactcagagaaatttcctgaaacacagcagactcttggcgcagccctttgagcagatgaaggaggacaagaagaagaacatccctcagctccagctgcatgccagaaacttcactcacattatctcatttcatctgcacagcagctcagcccagagtggagaggagtaaattggcccagaaagatcaagtaacttccttggagcttgtcagcgttgagtggaaacttggactctgatgtcgaactccaaaccccatgcttattctgtaaagcctgaaaagtgtcttggaattgctttagaagtaggagaagaggggaaccctgtgacattacactgtcttccagcataaca

SEQ ID NO: 17899 - DNA, 506 bp, Homo sapiens
gaaggtaaaagtagttgcatgggcatctacttttttaaaaaagttcagtgtggcttccaaaacacactgaataagcacacatgccttagttgtaggaaataaaaactaactctggcaatcttattttaaaaatttaaaaagtgattttatttaaaagatattagagatcatataatgtgtgagagccctgcgagtatacagaaaaggattctgtaaggtctgaagggtcagacaacagaaaccgtagcaagtatattacagaacaataacaagaagttttgtgtgtgacttatagcggtcatgcatctgacctctaactatttccaagatttgcgtcccatcttttggaataaaagtctcctaatctttgagaggctgaagggggtggatcatttgaggtcaggagtttaagacgagcctggcgaacatggtgaaaacctgtctctactaaaaatacaaaaaaatgagctgggcgtggtggtgcactcctgtaaacccagctactc

SEQ ID NO: 17900 - DNA, 594 bp, Homo sapiens
ttctatgcagagttttccccattctctggaaattctcattttaggaaccttacttctgttccctgggaaccccagtcccatccctttaagcaatatgaaacaccctgtctgtggatcaaattccagggagacttctgggcaaaaattcttttgccccatgacctgatatctttggtcatgcctcctggaggcacaagtccccaccacagggccgcctaccacatgtatctgatggctgaaattaagggcagcagggcagaaagcggatctgctgacaccacagttagacaagcttgcaccaaggctgtaaaacacccttggcagagcacaccagtaagttgtcctactaattagtttattatttcatttgagagatcaaatacataaataaaattaataaaccctgcaaaatacgtgcagcactggaaataaaagtacttctcaggtcattgcattaaacacagatattacatgctagaataatgttaacgcaaggaaagcaaatcatgctgccttataggccggaacgtaccaggagcagctggggtttgtggagtggttgacaagctttgggataggtcaggaaacatgaat

SEQ ID NO: 17901 - DNA, 588 bp, Homo sapiens
gcaatatactatagtaagagtcaatatgccagatgatataaaaattatgtatgtttgcctgaccagtatgagttaaaatatgtaactaaaaagcaagaggcaaatttataatcccaatgggggcctttaacttcttgcttttaataagcagaaaaaaacagaacaataatcaaaaaggatatagaggatctaaacaaaaccatataaattgttgttctaatttttatgtatagaacattgcaaacaacattagaaaagatgtatttttatcaaatgaccatatatgctgagatattaaagcaagcttcaatatcaattttttaaaaactgaatgtgttcatagggtgttttgacaacagtggaattaagttaggcatcaaaacaaagtagaaaaggtaacaagaaacactcccacctccccatgcgcacacaccaccccccccccaaacacacacactacacataaatcatttagaaataagctatgggccaaaaaactgaaagatcacaagaattagaaatattgagacctgaatgttaatatacatagtatctatcaaaatttttggaatgcaactaaaacagtgc

SEQ ID NO: 17902 - DNA, 557 bp, Homo sapiens
atcctagaaagtcaaggagattacacatgaggaaagacttaaatagtgaaagagagctagccatgcaaaggggaagcacatgcaaaagccgttaattgagaaagaactcggtatgtttgaagcagaaaggacagtggaatgaggtaaacagaactatgaaaagcagatgagagctatactgagattaaatcatacagaatctaaagctacaataagtagcttggattgcaatatgacagcaatacacagcaactgaagggattttaagctggagtagggtgtgaggggaacacagtgttaagcaaaatgctacataatcaatcaaaaatagttggcattccctttccacagccaaattccagatctcaggctcaggcaagaaaccaaacaatacctttctggagaaattaaatgttcccagagaaagactctttagacactgacatgtgaaggtatctaaagaaaaagccatctggccacctgacatcccaacagtaaatccaactcacgcagaataggtataggtatgcgttgagtccaagacaactgttcacact

SEQ ID NO: 17903 - DNA, 577 bp, Homo sapiens
caggggatccaggatcatcaccaaggtcattttcccagacagatgtgctgaggctgtagaaagtgctttttatttggttgggagcttgtgcataaatgcgagaggggctgcacatctgacggactagaggtgactcatggctgaaccggaacaggacatcggggagaagccagcagtcagaattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtagtcccagcactttgggaggccaaggtgggcagatcaacctgggtcaggagttct

SEQ ID NO: 17904 - DNA, 596 bp, Homo sapiens
tggattgctgatttaaagaggcagcctccaagaggcagagaatgagagcaacacttatcacatttgattgacatcaaatccttttatcaggtaatatctcaaagaactagtgcctcggagaaattctagtttagaaaatgctgtgcactcaaacattctcaattcctggtatgaaccaaaatttaggtgcaacatagcaaatggttaaaagcaaggatgctggagcccactatgctggatccacaacttactcttctgtgaccttcagcaacttgcttaacctctctatgcccaagtttcctcatttgcagaacggcaagagggaaaatgacaagagcagttacctcatagggtcatactgaagattaaaatgaatgatgcagtggctcatgcctataatcccagcactttgggaggccaagagggatggatcacctgagatcaggagtttgagaccagcctgaccaacatggtgaagccccacctctactaaaaatacaaaaattagccaggcatggtggtgcatgcctgtaatcccagctacttcggaggctgaggcaggaaaatcgcttgaacctgggaggtgaggttgcagt

SEQ ID NO: 17905 - DNA, 472 bp, Homo sapiens
ccaacctatatatgtacttgacatatagtgttatgagtatttgtttacttatttattttaaggcttcctccaattactccagcatatatagcttttcttccaaatctacgaaccctgacatatcattagtaacatttatttgatacttaatccaacgcagggtacttttatacttacaaatttaagaattaagtgaggctgggtgcagtggtacacgcctgtaatcccagcattttgggaggccaagatgggaggatcatgatgtcaggagatcgagaccatcctggctaacacggtgaaaccccgtctctaccaaaaatacaaaaattagctgggcatggtggcacattcttatagccccagctacttgggaggctgaggcaggagaatcatttgaacccgggaagcagaggttgcagtgagccgagatcatgccactgcactccagcctgggctacagaggggaaaaaaa

SEQ ID NO: 17906 - DNA, 636 bp, Homo sapiens
tgaacctctgatcattcctattggcccctgggtgagaggcgggaggcatggggggactgaagtttccagttggccagtgagcgaagaaggcgttggctgtaggccactatgatttgctaggagaaatttgaatgggtatgccagggcaattttcacttgcgagcaaataaccagggctctatccgctcctgcagagaagcgttggaggtctcttttctttcttgattgtccctaggagcaatctactgatatccttgcccagaaaaacagatgttttccgattcaaaatcagaaattgagtgcctgctgtctaccctacctcgtgccaactcaatgaaagtagagaagtaaaatcttaccgatttcaaacatacgcagtcttaactgatttcattatggaacctcataggaatacagatttattgtagcagcataaacttttcaataggcttctgtgggtgcgcctttgttcaaaaagagcccttgtgtgtatttgtgtatatatacacgtttacaaacaccaatcacaggaggaatgtaaatattccactcaacactttacgaacagactaaggtacttttaaaaaattacaatgttaggctgggcactgtggctcacgcctgtaatcctagcat

SEQ ID NO: 17907 - DNA, 563 bp, Homo sapiens
tatatgaacaaggttttaggcaggggtctaggatacaaatcatggattagctcttgttaaaaaatgtatttcctttgggagtcattaagtgtttttgttacgtgtgaaaaatgcaagcagccactgttacctcgtgctcttagccaccattatacaaagaaaagagacaaaatgacaaaaaatgacaaacccactttagctgtcttttgcacctattacgtttcttgttccaagaatattttgtgaatacacagtaattgaacttaaattacattgtggttgatcattgtgttggcttttcttgacaatagtttcactttaacttaagaaaagggcatctcatttatttggcatggggttatgcatcatggtaaagttctttagtataacttaagcaattgtgtgtagatacataggtcatagatatggaaagtttacctgaggatcctggtatatgaaatttagctttgtaatatgtgaaaccaactaaattttacttaggggagtttggatgagaaagatgataatgagttctttgggcatagttttctaaagtaagacta

SEQ ID NO: 17908 - DNA, 578 bp, Homo sapiens
gtgtctccgggtgcgtctacacttgtgacccgggcacgcctctccagcagcctgtgccaggcacatcttccagtctttgtttctctcttctgtgaatctgtggctctgaggtcatgacttggtagctcggaggggtcccccatcgccccccacatctgcccacactcgggactcaggaggggtgccggtttctcagcccctctcacattagcacctacttggcagagggaaaactgaggccgtaggtgtcccaaggctgcccaaggtcaggtgggtctccctggctccttgttcagcctctcccctaccccaccagtgcttccctccctattgatcagggcccatatttaattaagaacttgattccacccagcgccagctctcccgggtaagccgggctacctgcccggctcagcctccctcctaacagctgctcaggactttcccacctcccagcctttgtccctgctggtcccaccggccagaagtcccctcccacatccacgcaggaggccagggtcaggcactgtaggccaccacaggaaaccacatttatattttagggctctggggagcca

SEQ ID NO: 17909 - DNA, 613 bp, Homo sapiens
tctgaattagaaatgaatttaagaagagttagatagacatggggttattttccatgatcagttatgaaaggaaggaagggatgatcagagtatattttttattatttaagaatagacacaaagttcttctattaaatagttcagccaataccaaattattttaattcaggatggaatttcctgcatcttataaatgagatgttgttgaaaagtaatttttaagatgatgttttattcttttccccttctgtgcatttaggtatcttatgttattcaggctgaaggaaaagagcatattattcacttggaaaggaacaagtaagacatttaatttattttggcttttcagtaatgtttttccaatagtatattggttttctttctagtttgatatggtttagtggatcctgaaccctgggattaagcagatttagctcttcatattggtgctgcacagtggcagctggctgggcaggcagtgacttctaaacaggaaagaaggcagagactggaaccaagtacctccagtttattcttttcaaatgcatcactaagggagcaaaggctacacatatgtgggggagttggggagaaggggagcctgcagtgactg

SEQ ID NO: 17910 - DNA, 607 bp, Homo sapiens
gtttcgctatttaacagatgaatgatgttgggaaagctaatcaagtcctctaagcttgatttctctcatctgtaataatgttgatgggaccttgctgataaggttgtttggcagattaataaagacaatacatggaaagtgctcaataactgttggttattatggtacattcaatattacacatattattatatgtgtaggtttatttatatattccattttataatttcttctatcactcacaatatccaaataaacttcttagaggtcaccacaagttcgctggagaaacggggaaacaaagatgccagtggaaatcttccatttagttttagcctttatttgttaacattcttctgtcacaaggtcttctcacccttgccaattatagaaagccattaatttgaaacccattaaaagccaccttatgatcaagaaaggatcaagctgaattaaattttccagcccaggaatattgatataactgaaacacaagatggaaaatctggacttgaagatcccaactagcctgcgtgttctcaaagccatgtgctgagaaaagaccccaccctgttcattttaagccttgtacttgtactttcctttg

SEQ ID NO: 17911 - DNA, 648 bp, Homo sapiens
gttttgggaaaagagtcaccaacagtctacttatcatacaagaaaagtatgcctggtttaaaaatcactggcgccaactcacttctatctttttttaatttttttttaagagatggggtttcgccatatcacccaggctggtctcaaactcctgagctcaagttacccacccacctctgcctcccaaagtgctgggattacaggtgttagccaccatacctgtcctacttctaactgatatacatgcatctggggacctctgagaaactctgaacagcgaacaattgaaaaaagaaatttctaaaaaagaataatttttcagcacctaaaacttctgtatgtgaaactataacaacaacctaaaatgcttctaatacggtaatggccctatttctctgcaaataaggattgctcatgattcttacactgcctttcaattaggattatacagctccattcctcattcaagcttcccatacgtgcacctaagtatcattttacaatgggatatacttaggtaaactgagacggtcagatgactcagcgagaagtcacccgaagaattttagaacaaagattaataactccaatataccctctcaaccaagaatttgaagaaactaaaaggttaaacacaaaatttctgga

SEQ ID NO: 17912 - DNA, 536 bp, Homo sapiens
ctgattgattagatgaatacaagctaagggaacagggcaatatgctaacagggagtccaaaaggaaagagcatttttgtgagtctgccaactgctctgaagatgaaatcacccccagaccactgtccctctcaacacgctgatgccagttttcctcccccacctcaaaaatcacagctgctcagagctggaagggtcttcagagtccctctgagccatagctatgtgttaggaccccctagggaattgtagaaagatccagaaatgcagcccactcccagagattcctaaattggtctcagatggagtctgacccatctctttttatacgttcccccaaatgattctaaattgtggctagaaaagagaaccactggccgggcgcggtggcttacgctcgtagatcacgaggtcaggagatcgagaccacggtgaaaccccgtctctactaaaaatacaaaacattagccgggcatggtggcgggcatctgtagtcccagctactcgtgaggctgaggcaggagaatggcgtgaatc

SEQ ID NO: 17913 - DNA, 622 bp, Homo sapiens
caggaagaagaaaacttcattaatagtctcaaagacatgagagaagttatctttttctttcatggacacaatgacacaaagtgtttatgaaaccaaaaaaatagcttttagaaattaaaaacggagcagaaatgaaaatttcaatagaatgataggaagaaaacttgaaatattctagaaagtagagcaaaaatccagagagaaggaaaatagaagaagaaagacgcaagtaatagagcacccatttagaaggtctgacatccaactaacgggttctacagagaacagagaatataaaaggaaggaaatcatcagtgacatagaatttaagaaaacttctcagaaccagagggtacaagtttctaaatggaaaggaccaccaagtgcccacacagtggctgagaaagaggaccgtctgtaagctttcagaagaagaaggatcaacagttggaacgacttcagacttcttgggagcaacgctgggaggtgaaaaataaggcagtgaaaaggctttcagtgtcttttagaaattatttataatctagaatactttgctcagccaaactttcagtgaagtgtgaatgttgaataatagctctcaaaagtttatttcccaacacac

SEQ ID NO: 17914 - DNA, 631 bp, Homo sapiens
tacttctgtgggaagtatcgcctcccactgatgcactacttgtgttcaccagaatgttcttccccttgcagttctgcctctcacagctccacttcccagagtgaatctgactcagaagatgaagctagtgttgctgcacgcagaatgcagaaagttcttcttggttgaacaggagtgcacagtgttgtgaaatacttaaaaaactgagcaaaatggttagacaagaaaatagagcttgaagttcactagaaatcttatcttcatcttaagtgttcatcaaagagtctgggatgatataaaacattttgtgtttcatctacccattcagcaagaatgagtccagtcccatgtttagattattttaacataatttgtgaatgatagtttcacatttggctgatggtttgcagttttcactcaagttttgcatgaatcacaaagcagaatggtaccttttgaagagcagttctgcaataagtcatgagtagtataacttttggacattgagatggagaaagtgagaaattatcaaagctataattgccagagttgcccttgggtttaggtagaacactgtataccatatatactatataccatatatactatatataccatatatattatatgc

SEQ ID NO: 17915 - DNA, 519 bp, Homo sapiens
atctgactttaaaattcttgtggtcaagtttctttaacttctgaaggactgtattggctctatattggaattaagtcctattcagttttaatcatcaaatttcaagctagaaaaaacaatcagtccagtcttctcattttatatatgaagaattgaactcagattagtgcttatcaaagaattccaatctgctgctatatcttactggccaatatttttagcatagtttatttatttattataaaccttttggggtcactgcagggaaattaaaaagcacatgtcagcagagatttccccctgaacattccattaagaagatatagactgccgcagggtctctttcctctttgatccctagtcaactacaggcatactttaaaataagtgaacagaccaaaaatacctcaccacagtttagcaatactttacgtggtgcatgtgtcatttattctgccacagaatcactgcacatcaggtggtctgtagtcctggatcttctcagagcaatatcacctc

SEQ ID NO: 17916 - DNA, 617 bp, Homo sapiens
aacttggtctctttgttcattatctccaagatctcaggctggctgctaagccactgcagcagcctccttacctgatgtcccacttatacccccaaactcaacacaacttctctaggatattctgtccattgcaccattttaccccaaattcttaggtgtactaaagttttgttccagcttggattgtgcacagtaactccaatactatcttcaccactattcccatgcctcacccccactaaacctgctgggctgggcctgtactgaatctccgcaccaccctcacccactccaccctacctcaccatctttgttggatcactgctcacttgcagaaagtcaagtgtaaaccctgctggtcatttccactctttttggcctttaatcactcatgatagccctttaatgtgtcccttagactctatgatatttgatagtaaaagaggtatcgaaagcatattttctggtcctcctgctttcagattcttccttctgtccctacttctgagatggagactgagtagggagtcaccaaaccgatctggagaagatgaactagatatgctcagattatggaccctggcctcagtggggagaaactggaattctaacccacc

SEQ ID NO: 17917 - DNA, 622 bp, Homo sapiens
tcaagtgattagtgtggccaggcgtggtggctcatgcctctctaatcccagcactttgggaggctgaggtgggtggatcacctgaggccaggagtttgagaccagtctggctaacaaggcaaaaccctgtctgtacaaaaaatacaaaaattagccacgcgtggtggcacacacgtgtagtcccagtcactcgggaggctgaggcacgaaaatcccttgaacccaagaggcagaggttgcagtgagctgagattgtgctactgcactccagcctgggcaacagagtgagattctgtctccaaaaaaatttaaaaataaaaaaagattgagtgaagaaaaaaaaatttgcagattccatcagtcaaagccattttcatatatctcctttgaatttccatttctgtgtataagggttttaaaaaatagttatcatattaagtagacagttgtttaattttcacattacgcgagcatttccatttcattacctgattttcataaccatcactctctgatgactatgtaacattactctcagtgcatgtttctcttactaccccctattgttggatgtctaaattgcgtctgattttttctctgttccataaaattgaaataaata

SEQ ID NO: 17918 - DNA, 629 bp, Homo sapiens
ggtcataagaaaaaatacttgctaaatatttgaaagaacagctacaatatctctcagtgggaaaaatagaggcagaaagctagtggcaaaatctctgagtgactgtttcccattcttaacccagtatcaaatatgctatggaatcagcactacagagaagctgatataatgggaggcagaatgccattacaccctttttttcccctcaggatcttagaatcagtcaccggtggttttgcaaaaactactactaacaacaacaacattttaaaaaagaaacctcatcttcagagaaagcactggctaaccggtctccattttcagttgctgggataaagaacctatgtgggccaggcgcagtggctcatgcctgtaatcccagcactttgggaggctgaggcaggcagatcacttgaggccaggagttcgagaccagcctggccaacatggcgaaaccctgttgctactgaaaatacaaaattttagccaggcatggtggcatgcgcctgtagtccctactgctcaggaggctgaggcatgagaattgcttgaacttgggaggagaaggttgcagtgagccgagattgcaccactgcactccagcctgggtcggacagagcaagactctg

SEQ ID NO: 17919 - DNA, 564 bp, Homo sapiens
tctgtattgtggaatttctgaaagaaagtgtaaatggcaatgtgtggaactaaagggtaggcaggtagattaagcagtagattaagccagcagtaactgttctgtttgcttccgaaaagcatgctattttacccacaggccacagtttctccattcccagttgtccaggatattttctcctagagttgttccataattgcctatgtctctgatactaaggattcttaatatatgtcattcctccaacacacaggcatacacacatccatataaagttctattatattggtttttcagcaactatattaaaaatctacattgggccggacgcggtggatcacgaggtcatgagatcgagaccatcctggctaacacggtgaaaccctgtctctactaaaaataataataaaaaaaaattagccgggtgcagtggtgggcgcctgcagtcccagctactcgggagactgaggcaggagaatggcgtgaacgtgggaggcggagcttgcagtgagccgagatagcgccactgcagtcaggcctgggcgaaagagcgagactctgtct

SEQ ID NO: 17920 - DNA, 649 bp, Homo sapiens
ggcactcaccgccgctgggggaccttgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatagagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagattgcttggcccatcttggagaaaaagtgtcccaggaactgaaagagcctctccataaagcattgcaaatgctcctgagccaattttggtgcctctggttttgctacgacaaatgcttttggaattgacaagacgtggtcaagaacctttgagcgcactgctgcagtttggcgtgacatacctggaggactattcggcagagtacatca

SEQ ID NO: 17921 - DNA, 564 bp, Homo sapiens
agtcaacaggtagaagctatagttttaagtgtagtgacactcctgctctgtaccttagtaaaaagaagtgtcccccttccagtaaccaaatttaaaaccacaaagcttatagttgcagggacaggaagcacaatttccccaaaacacatgaccatgaggtccactggttctgatatgtattgtactttctaaaggtaccagtccaatagtgtttgatacccgtgtcaatagtcacagtaatttgaagacgaaaacactggatcagtaaaagggatttcaaaggggcatcaatctcatctactacagtcttagttctattataattctagccccattttatccccttttatagtggaaatgaatattgcaattttcctgccccaaacttctcattgtgtattgagagtatagtggacagataaattgtctctttaattcacaggtcttcagaatgagagaagatatgccaaagactttttatctatacctgttcctgttatgatgatgaaatcctggactactagactgaatctgataccaaaattggaagagtttttgggtatc

SEQ ID NO: 17922 - DNA, 646 bp, Homo sapiens
ttcagtgcctctggccatttttaaaaggtaataaatacatggagttgatggctatagtgacttatttattcttttctctttgctttgaagtcaagaaatatttgtgctccctttttcacatgactcccctctgcccaccctgtttccacatagtctgttattaaaacaagttggaatcacaaaataaaaacctcaacagttgtctctcgactttcaactccatgattaaaaggagactgaaattatagtttagaggagtatccaaagtatgtacacgtgacatagttagttcagatgttgtgcagagtgcagcaaagtgtagctccaaagaagacagaataagtaaatgttaagtaaattagtttaatccaagcagataagaaaaagacatgtacttaatttatattgaagaaacagtcacttggtaggaggggaaaagggggtttagagtataactatagaagattggtttctgggcacggtggctcacgcttgtaatcccagcactttgggaggctgaggtgcatggatcaccttaggtcaggagttcgagaccaacttggtcaacacggtgaaaccttatctctactaaaaatacaaaaattagctgggcatggtggcaggtgcctgtaatcccagctgcttg

SEQ ID NO: 17923 - DNA, 549 bp, Homo sapiens
ttaacaactggagaaatgtaagttaaaagtgcttttggacatgaggacacatcaagtttgaccttgaacatttgaacagaaagtactggacaagccaataaccaggaaaatatttcaagttctggccagagagtctaaccctggtttttacttcccctccatctaacactggcctgtaaacatctgtcccccacctcctgagtgttcaattccgttgaagtgctttcaaatatcctccaagttatacccaaaaactatgaatctgaatgttcccaaatgtttctttccagctgcaccagagttgtgctgagttccacctaggcaggtcccagtggtctgcagtactcttgatttcttcaatcagatagtaggcatctccagacccaggaatgactcagcttcactttgaatttgagattttatactctgcatcactcctaaatcatttaagaaggctgaaatagcttttccgttttcccaactccccagaccaaatatagtgctgattatacccaacaggtattaaataggggggtgattgcagttaac

SEQ ID NO: 17924 - DNA, 631 bp, Homo sapiens
tcacaggtccgtgtgccagatacgacacacacacatacacacaaagaaagacacgcacacacacacgcacacgcacacatgagcacgcacacggacgcgcgcgcgcacacacacacacacacacacacaccattaagtaaacttggttcttaggcgttaccgacagtgagggatagagagagaaatagaaagacctaagccgcaaggcaaaacccagcaagggcagcagaagagatcaaagtcctgtgcccttggctgtcagcagagtgggtgctgggaagcttctggaagcaggcacctgagtggatgccggtgcacgtgaaaagaggccttcaagcctgaagaacacgtaaggagccagaacagggtgccacagagatactacccttaaggaagacagaaaagcattcgttccggggaaggggacattatccaatcagcgaccctgtgaaactcagacatgtccgggcacggtgactcacgcctctattcccatcgctttgggaggtcgaggccggcggaccccctgacgtctggagttgcagaccagcctgaccaacatgaggaaatcccgtctcttctaaaaagacgaaactcggttgggcttgctggcgagcgcctgtaatcccag

SEQ ID NO: 17925 - DNA, 629 bp, Homo sapiens
gagtggtcagagctgaggcccagaaggcaggcagcacagcacaggcagagagaggcagagatttgcagcaaatgctaaggatgtgggacttcatcatgtattcctaacactcactgcagtgtgaggaatggattggagggacacttgcagtagttcttgggagattatggtccctggaagattgtgggtggtcaggggaggggaaagtgtgtgcttttgtgagacacgtggtaggtaagagtaataggcatcacttattcctgcagagtgatggtggtggccagggaaagggagatttgaggtgatttccaggttttcagacctactcaagtgtatggaaagtgataaccttattgaaatagagaacacttagagaagaaccattagcaggagaactgtgtcagtctgttttaggacatagcaaggtgcatttgagacatgcagaacaggtattaatagtaagacatacagatccgaggccaggcacagtggctcatgcctgtgatcccagcactttgggaggccgaggtgggtggatcacatgaggtcagcagctcgagaccagcctggccaacatggcaaaatcccatctctactaaaaatacaaaaattagctgggcatagtggta

SEQ ID NO: 17926 - DNA, 437 bp, Homo sapiens
aagcactttgatatccaggacttcgggaaaaaataaatcactgtttgcttatagacatagacttacccctttgactcttaaagagacaaacaagggaggttgtgtctggggcagaagaaaattttgtgggtataatgagattttggggccgggcgcgatggctcacgcctgtaatcccagctctttgggagtccaagtcaggcagatcatgaggtcaggatattgagaccatcctggctaatacagtgaaaccccatctctactaaacatacaaaaaaagaaaaaaaaattagccaggaatggtggcacatgcctgtagtctcagctactcaagaggctaaggcaagagaatcactagaacccaggaggcagaggttgaatgagccaagatcatgccactgcactccagcctgggcaacagagtgagactctgtccc

SEQ ID NO: 17927 - DNA, 648 bp, Homo sapiens
cactacaaaaggcaaacgaggactacaattaattttgagaatgaagtttcccatctttcattacatattcttccgtagtcatatgttcataaagggtagagtgcatgcacaaaacacctgcacttttaaaattctttctctcctcttttgttaagtatatttatttgaacttgcttaagttaaatacatgcatgagacaatatcaacatatgctaaaattatttatcacagctaaagacatctcgccgaattccactcatctgatttaactgtttatgctatcttaaagtttcctgtatttctcgttctgttactttgctaatttcgtatactcaaccctgatttggaacatagacatctacttttaaaattcaattaagatttttggtaacttcttaagttttttttaactgtggtaaaatatacataaaatgtaaccatgaccacgtgcggtggctcacgcctatagtcccagcactttgggaggctgaggcaggaagatcacttgaggtcaggagtttgagaccagcctggccaacatggtgaaaccccatctctgctaaaaatacaaaaattagctgggcgtggtggtgggtgcctataatcccagctactcaggaggctaaggcaggagaactgcttgaatct

SEQ ID NO: 17928 - DNA, 619 bp, Homo sapiens
gagtcacacagtcttagacatttcaagtacattttttttctttctgaccaatctatgaaagcaaatatggcaggtgaagaatgaagtatgactgagttaatgcttcagtaataaactagcccatcagcgtctttagtccaagaggcaaacagaatttttaaccctctcaagaattgttagtgatatttgaaatttgttacgtaaaattttgtatgtaaccttttaaataaatctgaattcaatacacaatttgggaagaaatgttaatgttgtcaaggtcagaaatagcagcaggtgaaattacaaaattctttagaataatgcttttcttttacattatcttgagagtaggacactggatcttacactttaatagtctcttctgaagtggtttaatataatttactagcacctacaactataaagagtcacagctaacattaagggtatccttttcaggctaattattcactttttttttaatcttgcttctcatcttaatgtataattatgataattttactcagagtggggccagcctctatacaaattcagattttgagcagggtcaacaattacatttccttttctcagtttagtttattctattagttcctga

SEQ ID NO: 17929 - DNA, 495 bp, Homo sapiens
cggctcactgcaagctccgcctcccgggttcacgccattctcccgcctcagcctctcaagtagctgggattacacgcgcctgccaccacgcccggctaattttatttttgtgtttttagtagcccaaagtgctgggattacaggcttgagccactgtacctggcctgtgtgatgtattttagaggcagtgtagtagcatcctattgatgctgatgcattcttagacctttgattctcaggttcttagacctttgattctcaggttcttagacctttgattaaatgcattctaaaacattttaaatagtatgatcaaagtacaaatagacaattaggcatctctgaaagctgcgtttctgtgtattcaaattattggaaaaagaactaaacattcttggacaatttttctgtcgttttaaaatccgtgggatacatccattaccttaactatcctttcatactcagtaataatattacatcctgaatttaactccg

SEQ ID NO: 17930 - DNA, 584 bp, Homo sapiens
tatagaaatgctactggctgttcctgagttttagttttaaattactgtcaatcattcctcagtggtcccatgcacagtccccatgctgcagggaggccagctcctctgggcctcgtggagtaacggtgttgcttagcccatatcctcctggacaagtgctttggttcttccctttaccggtaaagtgttgcaaacgtagtctatcgagtttgttctatttcatctgttctgtttacgaaactgtaacttcatataggactgccttagggctgaagtaaataaactgtcaacctaaataaaacataaaacaggccgggcgcggtggctcacgcctggatcacgaggtcaggagatcgagaccatcccggctaaaacggtgaaaccccgtctctactaaaagtacaaaaaattagccgggcgtagcggcgggcgcctgtagtcccagctacttgggaggctgaggcaggagaatggcgtgaacccgggaggcagagcttgcagtgagccaagatcccgccactgcattccagcctgggcgacagagcgagactccgtcccaaaaaaaaaaaaaaaaaaaaaaaaat

SEQ ID NO: 17931 - DNA, 656 bp, Homo sapiens
tgctctgtttctctattctaaatgactttgtggacatataaacataatgacttgtacttgaaagcgagagagaggggaatatgttggatgtagagagaagataccatgagaccataactgttagtatggtgcccacacttcatgtcccttttgtctctatcctcaggtcagctgcatggttcctgccccatttttcccattgaaaacaggatgtaaaagtgaggtttgtaggacctcaggctccaattcatttgagcctgccattcccttctgtagacacccaaagggttttgccctaaatcagacttagggattggaaaaactaatctagtgtgacctcatgctttatcaagtcaagtatactgcccctcttataaaagcccagtgttgggctgggcgtggcggctcacacctataatcccagtactttgggaggctgaggcgggcggatcatgaggtcgagagttcaagaccagcctggccaatgtggtaaaccctgtctctactaaaaatacaaaaattagctgggcgtggtggcgggcgcctgtaatctcacctattcaggaggctgaggcaggagaatcatttgaaccgaggaggtggagtttgcagtgagccaaggttgcgccattgcactccagcctggatgacacagc

SEQ ID NO: 17932 - DNA, 637 bp, Homo sapiens
cccaagagctattagaatagataatttgagtacataaaaattaaaacttctatataacacaagcaatgttagagtcaaggaacgtatgaaaggaaagtcttctcataatattaatatccgcactggataaagtatttcaaaatcaactagaaaactgagcaaaactctgagcaggaaatttgctgaaattttaatttgctgaagttataaatagccactaatcaaacaaaaatatgcccaatcagggaactgtaaacgaaaagattgtggtataacttttcacacatcagattttttaagtaaattaagtacatgcagtgttggcaaggctgaggggaaataagcactcttagtgagaaaataaatgctgctgcctggactggaaaattaggaatgccttttagaaggatcaatttagtggcatttatccatttttaaatgcatttcatttgccacaataatttcaattacaggtgtctattctatagaaataattgagcttgtttatgttaaaagatattcattgcagtacttctcaaaatagaaaacacatactgtaatctaatatttacatgtatattatcaatagtggaaattctaaattatggtcccttcacacaatgatattctgtatagt

SEQ ID NO: 17933 - DNA, 595 bp, Homo sapiens
gagagtctagtccctgtcttgggcttcacccagaggcacttctccaagccaggcctcctttctgatgaccaaggagaggagctttatttcaccaaagcatcaaaaggtcatgtgattcatgcattgctctaagacatacagtgctcagacaagaagagggaaattactgacagtaattctgtgcattgacgaaaataacaccacgggcaagctctttactttggtggcatcacatcaggggaagaagactttggggcagtgctaaagactggatgtggagcagggccagtgtgatcaggtttaccagctggtcacttactcaatccgtggtcagaagatgaaggttctcatcttggctgtgtagtctgtcaaacagggggctggaatgtataatttgggacctaatcagcttgaaatttctgttttctacttaccaaatttacacttgacattgaatctttagaagcaaggtggaaaattggatttgttcccagcccttccagatgaatgagtgatatgaagtataatgtagtgaattagcatttcctattggaaggattgctcatttacatatcccaagaggtaacatataaat

SEQ ID NO: 17934 - DNA, 580 bp, Homo sapiens
aaatgatcaagggaaacatttcatagtccttaatctttctagtataaaacatcaaacaaatttcatgtagaatatctcttggtagctattaatattgtgaaattgtctttgttttaaacacattcacacattatgattaatgtattttaagcatatttatgtgagccatctttacaaattcaataattccttttctagtaaacactaaaacctattaaatcaataacattgatttatgtatatatatattgattcataacctaaatatatttatattttatacacatttatttgcatgctgtaaaatataaaatttagatatatttttctgtaacttaataggtatcttggcaattcagaaaacaaatttccgctccagagctgctctgactcaggcatctgtttcctttaggtgtctggttgagaaagtactcagagggtagaggatacttgagcagggtagagacccattagacaattttgtgtggaggtcaatacaggaggtaaattgtctactttggttagaaggtgcctggtttattcactgagacttgattacaacaaaagatagagtcacaca

SEQ ID NO: 17935 - DNA, 629 bp, Homo sapiens
caggaaagatattggcatatttccaaaataaactgcattcctgaatttaggaacacaccaggaagcttgctttactttagcaagagacaaattttagggttcaggagccaacagttctagagattgtatcattagttcccaaaagagggctggaaactgctcatggatacaatgatctctctaacaatgccctgaccactactcccaacccccaacacacacacacagcccaatttgagaacatattcctatgtgtaccattttatcagtagactctgatgagtggctctagctttatgggagtatctgacattatccatagcatactagttatttcagttttcagaagtatttttcttcagtgatgggagatctctccaccagatcccagaaataagccatcaattatcctcaaagggatgtatctagctgtggtgttgggtaccttgcaagtcttctattacagcgtcacttttgtggaacatcattagactttccattggcatcagtctctgagtttacaaagcaggtacctgcaaactactgagataaaagttaagattgtttgcatcagtgatggaagaacgtattgagtttagtcagtagggggagccatattttcaacttat

SEQ ID NO: 17936 - DNA, 642 bp, Homo sapiens
gacaggagtgaaaccctgtctcaaaaattaaaaatcaatagataaattcacctagaactaagcatttttagcgtttagtatgtggagtttcagtatttgtagtatgtggtgtttgtcatttatagtaacacacatgagaactacgagatgagacagtaaagggagctatgttgtggtaaaatttctacatttaacttgaagtggtagaaaaaaactctgattgtgaaaagtatgtattttgtaatccccatagtaagggttagtaaaccatattccacaggccaaatccagcccactgcctgtttttgtaaatacaattttgttggactgtagttacacctcattcattgcatatcatgtatggttgcttttgcactacagcatcagatttgggtgttgcaacacacattgtatggctgacaaagctcatcatatttattgtatctggccctttacagaaaaagtttgccggcccagtgtagtgactcttgcctataatcccagcactttgggaggccgaggcgggtggatcacgaggtcaggagttcaagaacagattggccaaaatggtgaaagtccacctccaccaaaactacaaaaattagccaggcgaggtggcaggcgcctgtaatcccagctttt

SEQ ID NO: 17937 - DNA, 624 bp, Homo sapiens
tttatggagccagtcacataggaaccctctacctggcacttatcaggattccagactcctacaaagaaagcaggggtttagcataaaccgcatcacttgtacagaaagtgtatgagccacgcatgtagggaagttttaatatccgtagggaactttaccaactgcaggcctaccttgccagcaggcctttctcaggaagcagcctcagatctattcattcttttctgcacacactatgcttttagataggccagtggctttcaagctgcaaatccaggccagacccaggtcggtttcacctgccactctctattccaatttgaagtctcatcggcaccgtaagcataacacagccctgaccctggactccatccctgccttccccatcgtgcccacagctgacccctcccgagttgtagccacgaccacctggacctctgtgaccacttcctcatgggtttcaggtcctcacctctgtgtttcaaactattttcagagtgtccttacgaaactgaaatcagtgtcacctccttgcttaaagctctccccaggggcttggggtgtgtggcttatgcctataatcccagtgccttgagaggcagaggcaggggaatagcttgatgc

SEQ ID NO: 17938 - DNA, 638 bp, Homo sapiens
aaagagctcatagttcacaaagagcaagtcaaaggatgtctggaatatttgaacatacaactgcctttggcatgaggtggcctacatacattctcaggggcaggataggctggagagctgatcaagctgccgggaagctgaagcaaaggcagggtggtggaatcaaatgtctcttcaactgaagactttaaaacttgggctttagctgggcgcagtagctcacacctgtaatcccagcactttgggaggtcaagtcgggtagatcacttgaggtcaggagttcgagaccagcctgaccaacatggggaaaccccatctctactaaaagtacaaaaattagccaggcatggtggcacatgcctgtaatcccagctactcaggaggctgaggctggagaatcgcttgaacgcgggaggcggaggttgcagtgagccgagatcacgccattgcactccagcctgggcaacagaaaaaagaaaaaaacaccaaaatgcaaaaaacaaaaaaacttgggcttcagctgggtgcagtggctcatgcttataatcctagccctttgggaggctgaggcaggaggattgcttgaggccaggatttagaaaccagcctgggcacacagggagaccctgtctttacct

SEQ ID NO: 17939 - DNA, 651 bp, Homo sapiens
gtcatcttttaggtcttgggaagaagcacttttccaaatcattctttaagcaaaggtattgaccacattttactctgggagggtattcctgctcatttgagaagcccacaaaatgcctcggcttcaacaacatatccacggttctttgtgttcctctcatctcatccttgcatgacactcggcaagcagggtgacagtaactaacccctatcattcaagttcaagattacagtcttgctgcctccccacatacctaccagacattgccttaatctttgggcaaagattttgatttgacaaaaagcaaataatctcaagagtattgtattttatcatttttcttaactttgaaagggatcttgtagataacaggagtaagaatttggagagggggccgggcaaggtggctcatgcctgtaatcccagcactttgggaggccaaggtgggcagatcacgaggtcaagagatcaagaccatcctggccaacgtgataaaaccctgtctctactaaaaatacaaaaattagctgggtgtggtggcgcacgcctgtagttccagctactcaggaggctgaggcaggagaatcacttgaacctgggaggtggaggttgcagtgagccgagatcatgccactgcattccagcctggag

SEQ ID NO: 17940 - DNA, 611 bp, Homo sapiens
atgttttatctcttacccattcatagagggtaaaagagagcaggccctaaacagagcctccttttaaactgatttttaaaaaactacctctgtggccgggcgcggtggctcacgcctgtaatcccagcactttgggaggccaaggtgggtggatcacctgaggtcaggagtttgagaccagcctggccaacatagcgaaaccccatttctactaaaaatacaaaaattagctgggtgtgatggtgtgcacttgtagtcccagctacttgggaggctgaggcaggagcttgaacctgggaggtggaggttgcagtgagccaagatcgtgccactgcactctagcctgagtgacagagtgagactccgcctcaaaacaacaataacgacaaaaaactacctctgtttctaacttctaattggctatagattataatgtctaatactgcattatcaacattttaaataccattttacactattagtatgaaaaacatagtaatcattaaaattgcatctgctagaatatttaatctgtcagaaaactgggtttaggaaacaatttaggcatgtaggctatcaaatatggcaaaaatgaaaagactatggagcat

SEQ ID NO: 17941 - DNA, 611 bp, Homo sapiens
caggccatgaatagtaatagatttatagttgatttaagaaatttttgtaactcaataaatactgaactaaagcattcaaattatctgctttgaaactgtaaatttttgttctaatcctaactctcttctttttggatactgaaaaacaatgaaggtgatgcattctcccagcctgattgcctctctgcaatgtcgaagtattggcagtgatttctaaaatagcaatattttatacactttttaaaatgagcttaatattaaaatgaattatacatttctctgagcagatggaacaatgttttattcaattttactatagtttattttcagaaatttgatataaaaacatcaggaataaaaacctgctctctcctgaaaatatggttcatgtagaaaagtggcttagagattaatagaaacttaatttagagactgatatcaactgcacagttactagtaaatgtcatttcatatagtctgttctaaagatcatattagctcatccactaaaaaatcaagcttattactcatgataagagttgatatcagatctagctcagataaacttattgtactatgttgacaagataaagctagctagtcaagaacac

SEQ ID NO: 17942 - DNA, 643 bp, Homo sapiens
tatttggctcatggagcagattgtattcacatgtagacagtcacttaggtgatgcgattccaggagcccctagaagtccatgaatctccactctcttcctctattatctgtaccattgtgggctattctgtcattgacgtttattctttgtgttgagtcttcacctgttaatgctctgtcttggtcacactcacacaaattaatcaacagaacatgatcttatattaactactaatttctggaatgcttttgaatgctgattacagtatacatctataatttgtcaatttaaagaaacacacagtgctgatccgcactcccagagttcccgatgcattagatctggggcagggcctaagaatttgcattcccaggtggtgctgatgagcctggtcagggaatgcactttgagaaccactgctctaggctatatctggaccttaccatatacaaaaataaaatcatttaagacacaattatagttttcacaaagtacaaatactaaagcagtaattctctgaaacatattaactcactcaatatgtattttgaacaggttgagttatctgctttcctatacacataaaatgaaagcttcaaatctgaagcaaagttaatgctctggtggaaacattcttttaca

SEQ ID NO: 17943 - DNA, 640 bp, Homo sapiens
gttttcttttctcatagcctatgtggatggctcctctctggccctgctttctgcaaccttacattttgggtgtagggtcctccactctgttaataccttctatgtctcctgattaaatttcttaaggcatagaatctccttagtgtttgactcaaattggctggccctgggtcagtttccttcctggtttcaatcagtagttgccagagttggaaggtggaattggatgccagaactgtctttttcaggtactgcagtcagcaaaccctggttaaaaggcaaaagatcaatctagaagtacaaagaaatgaacaatgcagtagtaagtgctcatttatttattaaaagcagttcaggccatgcacggtggctgcctgtaatcccagcactttgggaggctgaagcgaggggattgcttgagctcaggagtttgagaccactctcggcaatacggccaaacattgtccccacaaaaatacaaaaattagcagggcatggtggcatgtgtttgaagtcccacctacttggaaggctgaggtaggaggatcacttgagcctgggaggatgaacctcaagtaagtcatgtttgtgctacggcactccagcttaatgacaggtgagaccctgtctcgaacaaaac

SEQ ID NO: 17944 - DNA, 593 bp, Homo sapiens
ctacagaggcattaaatattgtagtcatattatagaaagtacaatgaattgttatggttttggtggacaaataattcttaattttcaatttaattgcaacagtaactataacatacaagaattaaaagtacagtggtatccttgagggatattttgcttaggactagaatatacaaccagagataaaaattgtgttagtaatataaaaattcaataatatgactgggctattactagatttggtgagaagtaggatatcaaaggcatttgctgggaggcatgagcagagaaaacgggacttaagagaattgttggccaggtggggtggctcacgcctgtactcccaacactttgggaagccaaagtgggcagatcatgaggtcaggagttcgagaccagcctggtcaatatggtgaaactccatctctactaaaaatacaaaaattagccagggctggtgtcatgcacctataatcccagctacttgggaggctgaggcagaagaatcacttgaatccgggaggcagagcttgcagtgagccgagatggcaccattgcactccagcctgggtgacagagtgagactccgtctc

SEQ ID NO: 17945 - DNA, 637 bp, Homo sapiens
tgggccgtggtgagagtgtttacaccatggaatgggcaaatgatcgaaatcagagcttttttttcctcaggagagccaacatttgccagttcactactcatcgtatctattggtatttaccatatttgatatttaaaaactaagaatttttaaaagtgcaagagtacacaggacacttttccttagccacgggagtgatgatgccatttcacatcatgtagcttgaggaaactactatgcttggaagaatgagacaaatgacctttttattttactatagttttaacatcccagatgccctacaaggatcttggggacacccaggagtctctggaccaccctttgaaaactgctgcctatagagaaagtaacttccagtaagcagggaggggtgtgaattaataaggaaaatgagagaaatagggctcctgagttacctcctagaatctcaaaaacttcagcctctcctttcgaagtgttcaccaacctctgcaatcacctgctaatttgctgtgctatccgttatttcaagtgttccatagttccacctgacaaatactgtgaaagacttgtttgaattcagggaaagctcatttgaaagtatgtaaatgatggtccagtaagaggacagtattct

SEQ ID NO: 17946 - DNA, 489 bp, Homo sapiens
tcacggcaacctctacctcccaggttcaagcaattctctgcctcagccttctgagtagctgagattacaggctactaccaccatatctggctaatttttgtatttttagtagagacggggtttcaccatgttggccaggctagtcttgaactcctgacgtcgtgatccacccacctcagctccccaaagtgctgggattacaggcttaagccaccgcacctggcctaaagataggctatcatccagaaaaatatactgtgatctaatgttaaaaataagttaaaactacctcaagctagtagtttgcacagtgtctgacaaatgttactgtgttttcctcaaaaatttaaaacatcagacagtcctcgtgtgaattcactgcagcatactgggtgccttggtgcacagtttggaaattgaggcacaagaattaacgtttcttgatgtcatgaaatataccatgtccaggccaggcgcagtggctcacac

SEQ ID NO: 17947 - DNA, 649 bp, Homo sapiens
gtttccatatatacatagtgattgttcatatatagggaattacactattcattcagaaagtattgaccgcctagtatgtgtctggcactgttttagtcactaggaatgtaatggtaaatgagacagtgttagctgggcgcagtggctcacacctgtaatcccagcactttggtaggccaaggcaggcagatcgcttaagcccgggagttcaaggccagtgagggcaacatggtggaaccccttctctacaaaaatacaaaaaattatctgggcctgatggtgtgcacctgtggccccagctactcaggaggctgaggtgggaggattgcttgagcctaggaggtggaggctgcagtgagctgtgattgtgctgctgcactccagcatgggtgacagagtgagactctgtctcaaaaaagagtgtgtacacagccagagccatataaaatacaggcacagatcactctgcacctgtcatctaaaaagacacatctggctgggcgcaggggctcaccagcactttgggaggcccaggtgggctgatcacctgaggtcaggagtttgagaccaggctggctaacatggtgagaccctgtctctattaaaaatacaaaaaattagccgggcatggtggcgcatgcctgtaatc

SEQ ID NO: 17948 - DNA, 613 bp, Homo sapiens
gtatagatacattacaatttatccaatttacttttgatacatatttagtttttttccagcgtttgttcttgattttataaatgtatttctattgaatggaatagcttggtcatagggaatacctgtattcaattatagcagagtttaagctccttgtcaacttttggcattttcagacttttcattttagtcaatctgttgggtatgtggtggtatcttactgtggttttaatgcatattgccttaactactaacatgattgtgtatcttttattcatagtttaatggccatttttataacctcttttgtgaagtgccttttaaaatatctttcccatttttaaattgtggtatttatctttttcatagtactttgtaggagttttccctatatttgggatataagtcctttattgggatctatctacccatctatctattctcactctgtgccttgactttttattttttaaatattgtctttgaattgacatgttttaattttaacttagtcaaatttgccaactttatcctgtataatttctttgtatcgaaggggcttaacaaaatcatctttgccaatgtcattaagatattttctacgtttttctct

SEQ ID NO: 17949 - DNA, 533 bp, Homo sapiens
gtaccagcagctttaaggagccagtatagtggctggcagcaaggacccccgggccagccaagtaggagcttgtgtctagggccctggccaagctgggctatgagcggacctgtcccagtgctgggaggcatcaagctggttggatgcccagaactgaatgctatgctccagctgtggcctcaccagtgctgaatagagaggaagagccaccttcatagcttacatgtaattcttctgcttatacaacccagtaccggatttacttactttgaccatttgcacgtgttacaatcgggtgaaagaacatggtgttgcgaaaagaaagagcagttacacagtagaacagttggaacaggtgtttgctcaggcaggatgggatgctcagccctgccagactgtacttcttaacagcagtagcttgtaccaggagctggagtcagatggcggcaccatggaggactattcattcacaggagtactgggaacccaaagtcaggatctccatggctggaaaaaaaaaaaaaaaaaaaaaa

SEQ ID NO: 17950 - DNA, 582 bp, Homo sapiens
acacattgtatgcctgtatcaaactatctcatctactccataaacataaacacctacaatttactcattaaaattaaaaacaaaaaaataaagaaacacacacagtgtgctaatcagaacatctgattggcttaatataataagtgtaacaaaattgaccagaaccaataaaagttaaaacaaaacaaatgttacaaaataaaacatttcattagctaaaagccataattttaattgacttttaaagcaaaacaaatattttacagtatcaaaattgatctctttaattcgctaaaaactattgaaattccaaattggaaacttcagagtatcaaaatgtaaaagtagaaacatctgaataaaaccttatatttttaggccaggcatggtggttcacacctgtaatcccagcactttgggagggcgaggcgggaggatcacctgaggtcgagagctcaagaccagcctgaccaacatggagaaagcctgtctctactaaaaatacaaaattagccgggcatggtggggcatacctgtaatcccagctactcgggaggctgaggcaagagaattgcttgaacc

SEQ ID NO: 17951 - DNA, 576 bp, Homo sapiens
tgctgggttctccatctccattctttcagctgggctcggcttcacagtcacctgccttccttgggctttggtctatagcatgtccatctactgtgagagctcagctgtctgaaggaacagggcccagcccatctgggacccccacgggcctccgttagggcatggggagctggaagcacaacatggggtgaggaagaaaagggagagagaaagaggaaggaaggagagcaccagaaggggagagatgggagaaagatgctagaagagaagggctgtgggggtagaggcaggagtggggacacagacggaggtctggggagatcggggctcgaatgtgcccttgaatggcaaacactttggcaggagtctagctggtgaagatggaagatagtaactgcctgctctcttagcattttggactaagttcttctactctcttatcttcttaatttcgcagcaaacaatggactattgactaagctttcagagctgtgggtgttctcagagggaggccagccagaacaccagcatctccggcttttcttccaactcccaagttggagctccatctatcag

SEQ ID NO: 17952 - DNA, 375 bp, Homo sapiens
ggtgtgactatggggacttcattcacctatccgggccttggtttcttgtctgtaaagtgggtttgagggtggcttgttctgcacagactgttgttcggaggggcgaggtcctctgggtaagcttctgcgtggtgtgcctcatgcaagttagggcggacccgatgaaatggaggtttgaccatttttcacaagaatggctgtttcccatgcccaagttagagtaagtgctaatgcatgttggaattcaggtgtctcaggccttgttctaggcactggggacatagcagggatggaggcgggcctagccctgcccttggggagcccagatccaacagggacacaggtgattgtgggcgtgaggtggctggtggcttg

SEQ ID NO: 17953 - DNA, 342 bp, Homo sapiens
  misc_feature 1, 2, 4: n = A,T,C or G
nngntatagttggaattacagatgggaagagaataggaaagttggaagtttttggccaagtttcatctattatgggcagattctgcagtaattttgtgttggctttctggactggttgctgtagaggttgtaggacaaagtgttatatatggtttggccactgtccctttgtgtatccagactctcaaatctagtttaatataacttagacaagtatggtactcaggtatctttccttgaaaatgtacttaaatataccctctgactattaaaaaggtattcaaataatgaatttaagaaaagataggccaggcgcagtggctcacgcctgtaatcccagca

SEQ ID NO: 17954 - DNA, 579 bp, Homo sapiens
accaatatggtcaccaccacatttcctgatcactctgtgacagtggtcaaaatgttgagattagtgaaaaataattggaaacaatctgaaaggtgaaagtcttctttttcttttgagatagagtctcactctgtcacccatgatcacagctcactgcagcctcaacctcctgggctcaagaggtcctcccgcctcagcctcccaagtagctgggaccacaggcacacattaccactcctagctaatttttaaattattttgtagagagggagtctcactatgttgctcaaacttgtctaaaactcctgggctcaagagatcctcccacctcaacctcacaaaatgttgggattacaggcatgagccactgtgcctggcccaaggtgaaagtcttttcatagaagaaaagataaacttgttgtatattcccatagttttaaaaatactcaggtatcaataagtatcaaatataatgttgattacacaaagccaagttacaaaaatatatgtgctagtatttttgtaaaacactgaaacacaaacaaagctaagtattctttatgaatttatatacacata

SEQ ID NO: 17955 - DNA, 615 bp, Homo sapiens
gatctacaaataattctgttgggatttggataagaattacattagacttacagatttgggaagtactgacacctttactatgaagataaacacagtatgtttgtccgtttattttgttactctttgatttatttcatttatattttgtagttttcactaaacagaatctgagaaggcttttttagaatatatattttagctatgtcctttttgggttttttagtaactataaatgtcaggcctctgagcccaagccaagccatcgcatcccctgtgacctgcacgtatacgcccagatggcctgaagtaagtaaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaacacccccactgagcaccttgggacccctactcctgcctgccagagaacaaaccccctttgactgtaattttcctttacctacccaaatcctataaaacggccccacccctatctcccttcgctgactctcttttcggactcagctcgcctgcaccca

SEQ ID NO: 17956 - DNA, 647 bp, Homo sapiens
agaggcccaagggaaatggggaggaacttctccctgaacctggtggagagtaaagatctgtgtggcacaaggggtagactgtgatgttaacactatagttgtagtatattttagacagttcaaattatgactctttttttaatttttatttttttgagacagtctcgctctgtcacccaggctggagtacggtggcatgaactcagctcattgcaaacaccacctcctaggttcatgtgattcttgtgcctcaccctaccaagtagctgggactacaggcatacaccaccacacctggctaatttttgtaattttggcagagatggggtctcaccatgttggccagcctcttttcgaactcctggcctcaagtgatctacctgccttggcctcccaaagtgctgggattacaggcatgagccaccacgttagaccattttagccctgaattttccttgatatgatttgtccattagtatttgttgttgttgttgttgttgttcttgttgttgtttttgagacagggtctcgctctgttgcccaggctggagtacagtggtgcaatcatggttcactgcaacctcaacctcctgggctcaattgatcctcctgcctcaacctcccaagaagctgggacaacaggtgca

SEQ ID NO: 17957 - DNA, 484 bp, Homo sapiens
tttaacacactggtggtgtaattagttgtctgttttaggacaaatctctttattcttaatttcctcatatgtaaaaggagggggcaaatacggatggtttctaaaattccttccagctccaaaattatatttgatccttggtttagttcacaagccaaactaaactacttgtatgaagaatagttgtaggctgaatgccgtggcctgtaatcctagcacttcgggaggctgaggtgggtggatcacgtgaggtcacggagttcgagatcaacctggccaacatggtgaaaccttgtctctactaaaaatacaaatattagctgggcgtggtggccagcgcctgtaatcccagctacttgggaggctaaggcaggggaatctcttgaacttgggaggctgaggtaggagaatcgcttgaacatgggaggcagagattgcagtgagccaatattgtgctactgcactccagcctgggcaatagagc

SEQ ID NO: 17958 - DNA, 560 bp, Homo sapiens
caactagttaccttccaagtaaggtaaaaatgtcaggcctttcgcaattcttgccactctctcaatatatttttgtgaaaatatactctcgtttttaatttatctctctgactgctcctccctcctccttctttcagctgatcatcttctcagccatctctgaaaaattgatgctactcagggctctgtccacggtcctgctttactttcgtttaatatgctcaccttgacaatcttccttttatctatcatttttattctaatatttgtacccaaatgtttttaagcatatattccagcaaattaatctctttcttgagcttcagacttcttttttcaacttcttaatatatacttttagtataacatgctctagacctatcaaacttaatttcatttaatgtaatctcaattaactcatgttcttaagtggaaaatattgtagtcatcctcaaactccctgagtattttatcaatcacacagctaaatatcttaagcctcatattttctttcacagccattccactctcacctgacatgatgtgtgataatattaact

SEQ ID NO: 17959 - DNA, 188 bp, Homo sapiens
gatttgagagatgcttgacttctttgctcaattattttatagaatgcagggtttttgcattttcccactttgtttcagtgctttccatggttaatgttggtttccttctcaggtcaaaataagagatcgcatctagaaatgataatcctcctccagtcgaggcagattttcttagaagcttcctagta

SEQ ID NO: 17960 - DNA, 624 bp, Homo sapiens
agcgtgtcgtgaaccaaggtcgtcattattctagcacaccgaaggtacacccatttcaaaccatgtgagctgtgagtaggcacagggttgggtcgctggggtgggaaaggctgcatgcgcttgtgcctaaggatgtttaacatgagagagctggaatccataataatggttcgcatccacccttgtatgatcatcaggatctcagccttcctcattttactctgtccatttcatttttgcttttattttttatgttaattgtaggcaaattaacaccttgtttaaaaaataaactggtgggcatggtgcctcacacctgtaatccctgcactttgggaagctaaggtgggagggttgcttgagtccaggagtttgagaccagcctggacaacatagtgagaccctgtctctacaaaaataaaaaatattagctgagcatggtggcatgcacctgtagttctagctactagggaggctggggcaggaggattgcttgagaccaggaggtcagggctgcggtgagccacaatcatgccactgcaccgtagcttgggtggcagagaaagactgtctcttaaaacaaaacaaggctgggcacggtggctcacacctgtaatcccagca

SEQ ID NO: 17961 - DNA, 629 bp, Homo sapiens
atcaaatttcgatttaagaaactccaaaaataacaaaaattggaaacagcctataacattttaggaaatcaagaaatatatttaattgtaacacccactttcatattccacaagagaaaaataaagcaaagcctgatcaagacgtgcctttaacacaactcaatcacctttgagccttcattctttaccagtctctctattctctgtgcctattttctactctccctgagcagaaatttaagtgtcacattttgccaaggcctccattacatgagtaatgagtgcttacatatattgatatcccctgattttctgttggtgaagtttccaggaacattcattctcttgggaggagtagagactcaggtaaaagtcatgtctcttcatcttccacccttcagagattactggtggccagaacacctatgtgggagagtgggtatgggaagtggggtgtgtggataaagaaactctgttcgggagaggctcccagggatctgtgagtcagaggagtcacctatctttagggttgcacaaatctagcaccttctatgaaaactgcattcacccagaatgtgaaaagaaaaaagggatggctgagaacttttaaaattcagcaacagacacct

SEQ ID NO: 17962 - DNA, 263 bp, Homo sapiens
aagataaaatttgaaatctggttaggctggtgttagggttctttgtttttggggtttggcagagatgtgtttaagtgctgtggccagaagcggggggaggggggggggtttggtgaaaattttttgttatgatgtctgtgtggaaagcggctgtgcagacattcaattgttattattatgtaaaaaaaaaaaaaaaaaaaaaaaaaaaaaaaaagggggggcctttttttcggtaaccccaacctgaaaaaaacctttggggg

SEQ ID NO: 17963 - DNA, 105 bp, Homo sapiens
aatacacaaaactcacttgcttcacttgaatccaaaattagaggttagaagttcaaatgttactacagcattgtgcataatggtaaaatactgaaaatagtctga

SEQ ID NO: 17964 - DNA, 657 bp, Homo sapiens
cggctgcgagtaagacgccagaagggcctcacccctaaccaggttgtgaatttagatgaaataaaatttatatttttatttgacgatggccctttcctcatcaggcgctatttactgcatcctacagatgagaatatcaaggcttcaatacatgaaaatccctgccaatgagtcaaagcccccatgtgaacccagatccaggtcttctgaagagttctctccaaagagttctgtatcatttctcctcataagaaatgagggcaaatgtgttggttcaaaggctcaggggatgctgaggctggtggccacagatttgtctctgaacagggtgaaagtagaaggaggtgtaaaaattctttcctccttgtggtatctcctttctagtggtagacatttaacccaccagttagaagggtttctataagcctttattttactgagatatcataaaacaaattcaaaagaacctcctagaagcattagcatttttgatccccaatatattcacactctggatttatttatttttttaattcttaagagaatgaagttttggaatgcaataatagtgtgagtgataagtctgcttcgcaaatgatttttttttccttctgtaaacataaattcaatgattttggattttgattactttcccta

SEQ ID NO: 17965 - DNA, 592 bp, Homo sapiens
caggcggcaggcagtatttggcccctgggccgactgtggtttaccaacccctggcctgggcttaggaggggtggcaacaatctattatgcaatttctgcagtgggaggagaacacaattactgctattctagttcttccgcttcctggtggctggtgatcccaggctatgattccagaaggcccaagcttctgcacacctgtgtgcaggaaggcagatggtgtgtggccagggaggacccaacaggcagtgagcggagtctccactgacaactctcagtagcacctttaagacccaggacaggccaggtgtggtagctcatgcctgtaatcctagcactttggagaacgtgccttgggcggccaaggcaggaggatcacttgaggtcaggagttcaagaccagcctggccaatatggtgaaacaccatctctactaaaaatacaaaaattagccgggcgtggtggtggacgtctgtagccccagctactcaggaggctgaagcaggagaacagcttgaacctgggaggcggaggttacagtgagcagagatggcgccactgcactccagcctatgtgacagagcaagactct

SEQ ID NO: 17966 - DNA, 601 bp, Homo sapiens
aaatcttttaattagttattttatcaagacttgagacactttctagctactgctctctagtttaagaataagcttcgtaaaccagaagaattaaacatttaaacataaaattaatgccattttaataattcatatccgaatcatttgtatttttaaaagtattttaaagcaggccaaataaagacatgaatcattaacattatttgaatttacattaaggaaagtatattttgagacatggttgatgtgttttcaccaagaagtaatttatggtcgtggaaaagaatttaataatcttcttgtatagtctcataacatcaaatcaggatctgattagtatttttttcttttgataagggaagaatcaatgtctgccctgataagttacaactgacttactttgtaagtactcatcccaatagatgtcataggccaacagattaaaaaccagagaatccagatgtcaactatgaattcaaaaaataactgaccactcctaactgaaaattttcaatattaaattacaataggtaggccaggcgtggtggcttatgcctgtaattccagcactttgggaggccgaggcaggtggatcacttga

SEQ ID NO: 17967 - DNA, 584 bp, Homo sapiens
attatctactggatttttactttcatgaaaataaaggacaccttcaataaatgagtttttactgcgttttggtttttagaaatacggtcttactgtgttgccctggctaaattcaaactcctgggctcaaataatcctcctgcctcagcctcccaagtagctggggctccaggctcgtgccactgcacccagctagttttcacttctttaaggtgcataatgtaaacgtgaagatgatagagaaagcctgtgttagacatttgcatttcatgggattgagccaaatctgggctgtttgctttctctcatgccaggcagggcagccaggggaggaggtgtcagcatggcatctggcaaaggggagaagaggacactcagcagggaggagccattacttaatgcagccaatcaaaagtgcatagctgcattcagctgagcccttgatctgaagtggctctactctggtcaagggggctcaaactccttggctaggacttgaggcatcaaagatgacaccttttcctttgggaagtactaatgagcctactcaattctctagatgtttcctaacactagtggtaaac

SEQ ID NO: 17968 - DNA, 578 bp, Homo sapiens
tgctggtcccactacaataattacacccacggctagaacatggagcaaagcaacaaatttcaacatcacagggtggagagggcagggagaatcacaaagctgttgaaactgaagttctcaatgcgtgcgatttatggctgagcagctatctcagtctgtagcatcaaagccttaggtgagagcagaggtgacagggacacccaatgcctcggtggccagttcctgctcaatttgaggtcacaggtcacatgagatctatctgttgacttggaaactcttcaaatctgggcacaactccctgttcccacagataactccattcttctcacacgcttttgggtatctcgagtggtgattgagaatagctcctgctcctctccttctctgccagctgctagaggaaatgtctccactatgaatagtaggaattgtgtttaatatttgcgagatttgcttcaaaatcatgtggataggccgggcgcggtggctcatgatcacaaggtcaggagatcgagaccatcctggctaacatggggaaaccctgtatctattaaatatacaaaaaattagacaggcgt

SEQ ID NO: 17969 - DNA, 628 bp, Homo sapiens
ctgatagggtaggtatcattattatctttacaggtgaggatattgaggtacagagaagttaatcacctgctcaaggccatacctactaagtggtttggcaggaaggcaaacccaagcagtcaggccctataacctgaaagtagacacttagccacaacactacactgtcagtcagttaaagtccagtcagacaattgccagtgatcgccaagtgtggtagcagatgccttagtggatgagcagggtacatcacttgaaaaaatcaggcagatgggaaaggaagatgttagcttggtgttatgcaaactctccagtgctaatagagtcctaaatacatagttcctaagtagtggcagacaaccctaaagcaagtctcagtttggtatggaactgtacgcagactgggtaataagatttctgaagcaaaatgagttctgtaaactagactcacattgagcatgaacttgcaatgccaatgccaatgccaatgcgaaactatggaacagggagccagagatgcttcagctcatttagtccacagttatactaaagagaaaaatcaatcaattgtaactgacccaaaaatgacacagatgatagaattactggatgggacattaaagcagct

SEQ ID NO: 17970 - DNA, 649 bp, Homo sapiens
actatctcggctcactgcaagctccgcctcctgggttcaggccattctcctgcctcagcctcctgagtagctgggactacaggcgcccgccaccgcgcccagctaatttgttgtatttttagtagagatggggtttcaccgtgttagccaggatggtctcgatctcctgacctcgtgatccacccgcctcggcctcccaaagtgttgggactacaggcgtgagccaccgcgcccggccaacaatcttaaggctgatttcctctctccccttcccttacttctgctgggctgcaagcaagattgcccacccttggctaaaggcatatgtactcttggattagaagaagggcagattcctagctagctactgatgaccaaaaagaataggaagcactgctggtagaagaccattactgacaaatctttcctggcggtacattcaaaccttgccccacaagggcattctgacagtatttaacaacatttgtattgcaaataactccttttgacttagtgacttcacttctaggtatgtatcctaatagtaatgctcacacatattctttcagaaagatgaatctgacaagattgcagcacctctaaataaagaaaaattagaagccagctaaatgtccaccagagaaaagct

SEQ ID NO: 17971 - DNA, 506 bp, Homo sapiens
gtgccttctgtgtccctctctcctgccatccagacaccaatgtgtccaccaaagattccggtctgggaggcacgtctttcccaccacactggggtgaaatacaagtccagctgtctctgccttatggtccagggcaagtttccccctgtaatatacacagacagactgtaaaaattatagattatttaatgtctgcgaggaaaaaatacaacgagcacatcaaagaatatcggcgctccatttaaagccgtgataaaagtttcctttaaaaataagcacatttagatgaaacggagttgatttgatgaagaaaatttaagcactagttttttatttcactgaatctcagatgccattcactgtaagattcatcattattttatgaagtgctcagaaagaaaaaatgctcccaataaaccagagcccaatacttttgtatcatcaattctgagctgcatcccaaatcggagatgtgaaaatcccgaaaaaaaaaaaaaaaaaaaaaa

SEQ ID NO: 17972 - DNA, 588 bp, Homo sapiens
tcacaggtccgtgtgccagatacgacacacacacatacacacaaagaaagacacgcacacacacacgcacacgcacacatgagcacgcacacggacgcgcgcgcgcacacacacacacacacacacacaccattaagtaaacttggttcttaggcgttaccgacagtgagggatagagagagaaatagaaagacctaagccgcaaggcaaaacccagcaagggcagcagaagagatcaaagtcctgtgcccttggctgtcagcagagtgggtgctgggaagcttctggaagcaggcacctgagtggatgccggtgcacgtgaaaagaggccttcaagcctgaagaacacgtaaggagccagaacagggtgccacagagatactacccttaaggaagacagaaaagcattcgttccggggaaggggacattatccaatcagcgaccctgtgaaactcagacatgtccgggcacggtgactcacgcctctattcccatcgctttgggaggtcgaggccggcggaccccctgacgtctggagttgcagaccagcctgaccaacatgaggaaatcccgtctcttctaaaaag

SEQ ID NO: 17973 - DNA, 612 bp, Homo sapiens
ttgcattaactttctgaaaacccccaaatcccagtacaaactctgttgtctaatatgttatggaaagaggcactcatttgagaaaatttaagattttgttcaattgttttactgaaagatgtgtgaccttaggccacttcactcctcaaagcctggggtggttattcggtcaatggggatgatgctcgtgtccacgttgcctcttgtagaacgtgtttagaaggaatgacatggctgttagtggctttgtaagtgcatagtactatacagagattagacaaccacttaactacttaagtggtttcatcacttctgtacctgaaaggtgtggcagagaatagcgatcattctggccctggattggccaaagtaattatgccaaagtcactggatatttttgctagggaagtggtccaagagaagtggtaccaaattgttgaaggcctctggctcataactttagaagagacatctgtgtgtgttcttaaatgacgtcatgaggtgtgttgtttgtttgttttaaactgaatgctaagacagtacaattaatagagactgaataccctgacttagagataattcatttcaggatgagaaatggcacatttaact

SEQ ID NO: 17974 - DNA, 606 bp, Homo sapiens
caggccatgaatagtaatagatttatagttgatttaagaaatttttgtaactcaataaatactgaactaaagcattcaaattatctgctttgaaactgtaaatttttgttctaatcctaactctcttctttttggatactgaaaaacaatgaaggtgatgcattctcccagcctgattgcctctctgcaatgtcgaagtattggcagtgatttctaaaatagcaatattttatacactttttaaaatgagcttaatattaaaatgaattatacatttctctgagcagatggaacaatgttttattcaattttactatagtttattttcagaaatttgatataaaaacatcaggaataaaaacctgctctctcctgaaaatatggttcatgtagaaaagtggcttagagattaatagaaacttaatttagagactgatatcaactgcacagttactagtaaatgtcatttcatatagtctgttctaaagatcatattagctcatccactaaaaaatcaagcttattactcatgataagagttgatatcagatctagctcagataaacttattgtactatgttgacaagataaagctagctagtcaag

SEQ ID NO: 17975 - DNA, 583 bp, Homo sapiens
agtagagacggggtttcaccatgttggccaggctggtctcgaactcctgacctcaagtgatccatctgccttggcctcccaaaatgctggtattacagacatgagccactacacctggccttaatttttattttttgtagagatgggatcttgctgttaccaaggctggtctctaactcctgggctcaagggatcctcctgcctgagcctcccaaagtgctgggattagagacctaaaccactgccccggtccaggtctgaaactttttaaaggagagtaccacttgttgacccctttccttttgatactgggaagggagtgcttaagtgggggatgcctcctttctcaatgcaaagaggagactcttactagtatatttaggggtaatggttgccttttgccaaatgaaagtttgtgtctaccgtctggggagacataaacacagccaccaataagcactgtggttacagccagaaaggcctggtcctgaggctaattacactggagaagtctgaatgtgccccagggactggagaagtcccaccttcttcttgactacttctgccagatgtctgtggggtc

SEQ ID NO: 17976 - DNA, 648 bp, Homo sapiens
cactataatgtaaaaaaacaattaggcaaggatagatatatgtaaaataggtgaagggtggggatcaatccgaggaaggtgtgccaaacgggaagacagcttcacaatccagtctgttgatttacctaggacttgtagctagggtttaaactgtttttgccttgaaggtggtatttcactgggtgtgtgccctgatctgcctaggagttgtctgccttctaccactctcaataacaaaaattgaaattgcacaaatctttcaattacggatgatgacaaaaacactattaaacattaatggagctttgccatttttagaggttggagttaaaggctgaccatgataatccctttaaagtagccactacaattaactgctacctcttatcccacaaattataaagtatcttcctattagagacatctcaaagcactttgggaggccaaggttggaggatcacttgagttcaggaattcaagaccagcctgaccaacatggtgaaactccgtctctactaaaaatacaaaaattagccagacattgtggcatgcacctgtaatcccagctacttgggaggctgaggcaggagaatcacttgaacctgggagatgaaggttgcagtgagcctagatcacgccactgcactc

SEQ ID NO: 17977 - DNA, 640 bp, Homo sapiens
tagcagggaaacctaagtccagaagtcaccccatcatgggtcccaaaatattccataggctacttatatggctgtgtgtgtgtgctgtgtgtatgtgtgctatgagtgcatgagtacgtatgttctgtgaatgagcgtgttgtatgtgactgtgtgtttgtgtgtgtgttgggcacatgatcacgttatctctgttcagagttagggatggacggtgagagcaatgtcaacatcaaaacacaggagtcccaagttgatttttcccgtagatccctgtatcatatcctcttctgggtagcttctctctttccatagtgaatctgggaagatattccattaccacagcaatctaacgtgtccacagtttggaaagaagaaactaaaagggttctgagaaaagcatcctctctttccacccctacccccatcaccaaaagatgaaagatggtaaataggatctatttttaaaagacaaaagaagctgaaattattaaatccagaaggcaacaaaaggctaaaaagggtgaatttatcattgcatgtgtgtacacaaagtatttttataaaaagggtgagtcgagatcgcgccactgcactccagcctgggcgacagggcgaaactccgtcccaaaaaaaaaaa

SEQ ID NO: 17978 - DNA, 564 bp, Homo sapiens
atgacctttccccgctttcaccagactcagtgaaggacttctctgaggtattgacagaggcctcagatggccaaggggccagatcctctttctcctgcactccacactggattgtgacacaagcaaaagatcatcctttatttatgttacttatgttaaatgactgagatctggaccttgtttgttagcttatcctgactaatgcatacaggaattttaccattatgagaaagacagtaaaaatattagacaaataccaacttaaaaattctaatatgatctaggctgggtgcagtggctcacgcctgtaatcccaggactttgggaggccaaggcgggtggatcacgaggtcaggagttcgagaccagcctggccaacatgctgaaagcccgtttctactaaaaatacaaaaaattagccgggcatggtagcacgcacctgtactcccagctaatcgggaggctaaggcaggagaatcacttgaacccaggaggcggaggttgcagtgagccaagatcgcaccactgcactccagcctgggtgacagagcaagactctgtctc

SEQ ID NO: 17979 - DNA, 607 bp, Homo sapiens
gacagaaggggttcttgattttaagaatcctagagaatcgtattttttaatactgaaaaatgattgtttactagcaattgttcagtatgaagtacaactagtttttttaaatgttatattgaaaaatgtttgatcttgtatatttggttttcaaatctgcttcctatacaataattttatattctaaatgtggaaaaatttgtattattttaaaagtagttgaaaatggtataatacaaaggcagtttaccaaatattctaggccacatacatttctatgaagtgtcgtatgcaacctttgaaatgtctgtggagagaacgtcatatggatgatattaatgctttgattaatgtagagcctttctgtgaaaacctatggccagttcaagtacccaagcctttctccttatcactaccactttttgaaattagaggtggaatgcttgaattctaataccggagtattcagatgcataaaaatggtggtaagaacataaggaatcttctcaaacaaactagctcaagttcatctgagcctatgagccttttcctagtcaggtaaaataattaatttctcctaatcagtaatactgtataagagctatac

SEQ ID NO: 17980 - DNA, 593 bp, Homo sapiens
actttcccccttaggtgttgagttcaagggaattcccagtaaacttgctgcacaaactctatttcccagaaaaccaaatctaacacactcactcaagaatatgaaaggatattccagcatttttaataaaaaactctctaacatgaaagacagtccaaatcaatgcatggagaataaaggaacttgaaagagacacatagtgtagagaatattaacattaattgtttaaagaggtaaaaattctgtattcataaaataaaaagcaggatgttataagaacagaactttcagaagacaaaaaagaggcccttggaattcaaactacagtaatgaaaatgaaaactctgatagactgattaaaagacacatttgtggcactctccaaaacatagaacaaaatgaaaagaaagagaatatgaaaaacaatatgagaaaattagaagattgagaaagtacaacatttgactaataggaattctagaaagagaacaaaaaaacaaaacagaagggcaaaatttgctttcaaaaaaattaataaagaagatgaaagggccgggctggtgactcacgcctgtaatcccagcactttggga

SEQ ID NO: 17981 - DNA, 582 bp, Homo sapiens
gtgaggtcaggagtttgagaccacccgggccaaactggtaaaaccccgtctctactaaaaatacaaaaattagacgggcatggtggcgggcacctgtattcccagctactcaataggctgaggcaggagaatcgcttgaacccaggaggcagaggttgtagtaagctgagatcgcaccactgcactccagcctgggcaacagagtgagactccgtctcaaaaagaaaagaaaaaaagaaaaaagaataatcctcaactttctccagtttaccagggataccgatacttttctctcaagcaattaaattgatggtagctcattccaactgaacgttaataacaagctgtttctcaaagcaacacacaaagaagttaattatataaatctatcacaatgggcagcatcagaacagtctgaggactataacaaatctacaatatctcatttacactataaacattccaatcaactcaattttccagttagaaaatctttttgttggccaggcgcagtggttcaagcctgtaatcccagcactttgggaggccgaggtgggtggatcacgaggtcaggagttcgag

SEQ ID NO: 17982 - DNA, 628 bp, Homo sapiens
tagtaggacttaaaaactagtgataaatgagaacaacaaaactatttaaatcctgctggaagcctgctctccaagataagtgtatccagtgtaagtcccctgagattctcctatcagggccgggtgatttacgagttgtatgatttatcaggctccatgtaccaggtgtcacctctgcattcagcttcactgatcaagaaaatgaattcgatcctggatctctgtccttccaatagcagcttgccaggagaagtcgttaatgtgatacattatcttgccggctgttaatatcatgtacccgtcttgtttcccttcttttagttcagctgagcatcaatttgtgccatgatatttacatgaatatcttcatttcatcagtaccattgtccatctgtttggctgagggctgaattacagagctgtggccaggaatggaggcattaggcagtctaaatgctaacttctcccaagagagaagggcagtcccgttttcagttttcctgcccctgcttgctgctgaaatgcagcctagcagacatagagcaggaattagaaaaatcatcctttaacagaaagttagaaaatgatgaggggccgggtgcagtggctcacgcctataatcccagca

SEQ ID NO: 17983 - DNA, 621 bp, Homo sapiens
cggtgagtgtaaatttggcactgaagtgtggatgcagactcccacgcccctttaaagtttttctagagcttccatcccaagcagagccctgcctggccatcttctttgaaggactcagcacttctgctttcataaggcttggtgggtgtttctagaccttcctaggcattgaacctatgaccacacaggacacccctttctctgccctttcagtctcctatctgcccctctgggtcagtggttctcttgtcttcatccaagcctggtcaaatgtgcaagccaccctaggtctgaaggaagaaggaaggtgggtcccagtcttggaaggtactgaacccacgtggtttccttgtttgctcaaaaacagccaaaataagggccctcattccctcgctcaggttagttagaaataggacaaatgagtaaaaaaaaatatacaaggaaatgtttttggccgggcacagtggctcaagcctgtaatctcagcaccttgagaggcaggaggatcacttgagcccaggagtttgagaccagcctggacaacatggcaaaaccctgtctctgaagaaaaatagaaaatgtgcctgacatggtggctcatgcctgtggtcacagctactc

SEQ ID NO: 17984 - DNA, 638 bp, Homo sapiens
ctgaattagaaatgaatttaagaagagttagatagacatggggttattttccatgatcagttatgaaaggaaggaagggatgatcagagtatattttttattatttaagaatagacacaaagttcttctattaaatagttcagccaataccaaattattttaattcaggatggaatttcctgcatcttataaatgagatgttgttgaaaagtaatttttaagatgatgttttattcttttccccttctgtgcatttaggtatcttatgttattcaggctgaaggaaaagagcatattattcacttggaaaggaacaagtaagacatttaatttattttggcttttcagtaatgtttttccaatagtatattggttttctttctagtttgatatggtttagtggatcctgaaccctgggattaagcagatttagctcttcatattggtgctgcacagtggcagctggctgggcaggcagtgacttctaaacaggaaagaaggcagagactggaaccaagtacctccagtttattcttttcaaatgcatcactaagggagcaaaggctacacatatgtgggggagttggggagaaggggagcctgcagtgactgaatagggtccaattactggaaagact

SEQ ID NO: 17985 - DNA, 559 bp, Homo sapiens
tggtgacagagcaagaccttgtctcaaaataaataaataataataataataaaccaacacagtgcctggaatatagtaggtacttcataaatgctagttttcttcccctcaagaaacacttgctaaatgagctgattgtcaacaattaatcccaaaccagaacgatttttagggttaaacatgcaggccgggtgcggtggctcgggcctgtaatcccagcactttgggaggccgaggtgggcagatcacaaggtcaggagatagagaccatcctggccaacatggtgaaaccccgtctctactaaaatacaaaaaaattagccgggtgtggttgtgggcgcttgtaatcccagttactcgggaggctgaggcaggacaattgcttgaacctgggaggcaaaggttgcagtgagccgagatcgcgccattgcactccggcctggtgacagagcgagactccgtctcaaaaaaaaggttaaacatgcaaatagggttacaggctatttcagaatatgagccatcacatgcttattgagttacacgaagaagtcaggaaaca

SEQ ID NO: 17986 - DNA, 538 bp, Homo sapiens
tcatgcttctcagaccatgaggatctggagttggttacaatttgtgcagggaaaaactcaagctgtgaagcaggcaaccacggcaaacttgtcttcagttctatgtaccaatcatcaagtcttccttaataggcagattcccttgtacctaagatattgcagtgcatttcataaaacacagacataccaaccataagatgaaaaacactcttgtgtaagtaataaagaataatgaaatggccatcaagctatagtctaaaactttggtcactggaccataaatggggatgccaaattgtattatgattgggattttgaagtcttctccaatagggacagaagttatgcatgtgtgtaaacattcccctccaagcaaagatgacgactagaagtcactgccacaccagctaacagaataaactaccaccagtttgatgcaaaatcctgacccaagcttttgatcctccagttgagatgcagctgccacatggcaatcttgctcacaagcaaacagaaacctacatgcctgctagtgtct

SEQ ID NO: 17987 - DNA, 518 bp, Homo sapiens
agcaagaagtcaaactgatggcctttaagtcagagaagcagcaatggagcaacataatcaaagttgaccatctttgttttcaagacagtcacattatgaaatattctgacatgctaggctaggaaatggctataactggttcacttgagactggagaaatcagctttgctaacaggtaatactttgtcaagtagtgagaaatattatatactaggtataattagttgtccccaaaatctaaataaacttgttctaatatatggaaaagggcagcaagatagagaaggtaagtttgaaattctacaatatctggatctttgtcacctgagtttatgtactttaaaccaaatatactattttactatgtagtatagcaaagattgaaatattcttggtaaatgaagccttttggatctaagccatatttttcaggaatttttgaaaaggtaacttttttttgcttcagttaaatacagtctaatgactgaaaaaaaaaaaaaaaaaaaaaaaaaaaaaaa

SEQ ID NO: 17988 - DNA, 593 bp, Homo sapiens
tttctaataaactgatatcacaagctcatcatgtagaatgacatcttactgagagtcagtctaactgcagggttactctacggatgctgccgttctgacatattccatggatcctgtacttagctcccgtcatgtgagtaaatacaacattatcaatcaattcagagatgtggaagaatatactgtgttggcaaaaataaccatgaatttttgtttcctttgaccatcctttgctttgactgaaagagtagtttcatggtgcagagttagtgcccagctttgtttaaagccaggaaaacctaaggccaattctcagctctagtatcactgctgtatgtctgaggtaggggaaatgtgcctattattttataaacaagttccttcatttataaaatgagggaagtaacaatacctaagttaaacagttgtagtaagatgaagacaaacggaagagtgcctaacaatggaacaagacgaattcattgctaggtttttttttcctatttgctcctgtctacacgtcactgctatatgaaggaaaacataagaagaaattataaaagaagccagtcattagttctaattagatgaga

SEQ ID NO: 17989 - DNA, 277 bp, Homo sapiens
aggactttccagaataacttctgttacatacaacatgcttagctttagttttataatccttaattttattgaatttgaatttccatttgacatttaattttgaaaatgttttacaacagtaccctaaatgtacttgttggaataatatacaacagtttaattatttacatgtatattcagtttctaggatggcatcccccaaactcaaaataaaatgtattgacacagttaaatatggcatgtacttaaaataattatttcagtggtagtgatagac

SEQ ID NO: 17990 - DNA, 629 bp, Homo sapiens
agtgcctaaagatggtgaagctctgccggaactgaggttagcagatccatctaaggttttttccctagactggggaggagtgatgcctacccaaggcacccagagatggggtcataaactcaggactcaggactagcccaagattctcaagtcaccagcatggcacagccgccacggaacctctccttggaaacagtgtgccacagatgccctattgggtagacgaagtgtcacctcccactctcttgcttggggttgggtaagaccctgggatgttggtgcatccctgggagggcagcaacagcaataagcactgagaggtatttgagcccatggtcagatgggcactgggaatcagacaatttgatttaaatagaaaaaaccatttcttgctcatctgagattaggaactagattcatcttccaacatttataaggttcaccttgatgcttttgtgaatttcaagaagggttaaaaaattgtagtgacgtaaacacagttgtctttgatggcagagtctgggctgtcttctcctgtatttcctctccctctcagcaatgcagaagcatagagaagcaatcagagctccctcactcactttgggatattcatggaggacaatgcacat

SEQ ID NO: 17991 - DNA, 515 bp, Homo sapiens
tagagcctctgatacagcataagcctaaatgctttttctacatcttccttttctcttttttctttaaaagaatcttctcatattactctctttctttttatcttatttctcttttatatattttatcgcccctcttggtccaatatacattttataaagaagtttctgttatccaacttatttgactctatgtccttcctcttcaccaacgtcatttttatttccttccacctccttctccccgtcatcatcaacaatctttaaaactaccatcaattcatatgttttaaattagtataattccatctgcttctctgaaatggaaaggagagaaagtactcacgtttactttgaggtctttctagccccattgtctaattagtctcttgttcaatggtcaggacggcaagaatttgttctattttttttcccccagagtatatttctgtggataggggaatatattcagaaatacttgagatcgaacaccaatgttacatattgtagtgagatta

SEQ ID NO: 17992 - DNA, 637 bp, Homo sapiens
tccaaacacagagcttctgttatcctcaggacgtattacccttctagaattgacacatgacagagtattaccaaccaaggaacgtcaatcaatctttgaagtttcaatcaaggcttcattacataagcatgatcgattaattacctgtttgattcatcacagctttgaagttgggagagaaagctccctaaatcatctagttggtcaaactggcataactgtccctcaagctggattatcaggtgtagtcagcctcactttaaaataacacttttattgggtatgacaagattatctccttaaggctgagggcaaaagcctgacctcctttgggtaaggtcaaattctttaccacacaactataaatcatcttaatttttttaattgaatatttttacaaatagtgctgatagatctctcatattatgaattaataacatgttgataaagccaaaatggtatttttcatgtagaaaacagtgtcattgggagataaggaagaaaataacttacagtacaatcagaaaatgtgtcgtggaagttttgtaaagccagtgcagagagagagagagtcttttaaaagaaaattacaaaacaattaaataatactgtaggggctgggtgcagtggctcacgc

SEQ ID NO: 17993 - DNA, 635 bp, Homo sapiens
caagaagctagaaaagctcccctgactcaaccctcttctccaaaaattcccaattcacttaaaaaaattagtaacagaaaaggatcatttgaatatccaagatcaaagaccaaatcacttataagaggaaaaaacgagattctcatcagacttttctacagcaatgctttatgccaaaacacatggaataacatatttaagatactcaagaaaaaaaatatgagctgtggattttatattaagccaaagagatctctaagcacaaaggccacaggcaaactttttatttttttaatagagatggtggttagggatagggtgtctcgccatgttgcccaggctggtcttgaactcctgggctcaagcaatccgcacgcctcagtctcccaaagtgctgggattacaggcatgaaccacagcacctggcccacagacaaacttttaataacatgcaagaattcaagaatatgtttgccataatcccttcctgaggaatgaactagaaaattagtttcaggaaacaaaaaatgactgcaaggttacctgtgtaagtactgatgatagacattaagtatgcacttgcctatacaaataagaccaaatagcaattaaaagtgagacaggatagcatgtga

SEQ ID NO: 17994 - DNA, 584 bp, Homo sapiens
attaagaaaaaagttttttttaaaaattgagccaaatattaagataatcttcatggtgaagcattactaaattaatttaacggcagtcttaatgtaatgtaattttggtttactgatatgtaatcagttaatcttgaagatttcataagttctggcatttgttctttcctcttgtttctctcttataaattggtcaattctccaaaatatgcaaattaaatttaatgttaacctatgtgtaagtcaaggcatgtgaatcccatgaccaaataaatattacaaagcaggtgtctctacactgatgctgaatacctaccatttagagaagacacctctcttccccagggtctcaaggcatctcattcccctggctttcccccttttcccttgaggactctgcatcctcctttgctgcatcctcctcagctttccaaagtcttagcatggacatttcccaagcttagtccttgcagtcttctgtcctccttctgcgtatctcttacacctcatctaatcacaagacttcaaagtctatatgccattgtttgtcaagtctctaccgatctggatctctcacctgatac

SEQ ID NO: 17995 - DNA, 609 bp, Homo sapiens
tgatcccacaggtctttcatgcaagaaatcaaaaggatttacaccattatactacagacattcatcatgctctttaacttgccccataactgagaaggtacacaattacaatgacacttcagttgaatgtacacttcacgtctcttcagtggaagtgtcctaaattgatcaccttggatatctgtttgctgaaactgagtagataatatttattattcctcacacccacgtggtgtaataatttgcctaagtttcttgtatccactcgtttagccttccaaaatttcttcatccattcatggcaccaaaggataatatattagcctcaataaaaatatcatcaattatcaattttgacatacttctacaaagtaaaactgctacaagcgttagatattaatatgttttacattcacaaatcactccaatattcattgaaaatgaccactttaggagttaattagaattccacatactttttgtttctataatagtcttgttgggagtatcatgctattctctaaagaagtttcatccaatagctattttacccaagagttagctccttgaacaatgaagccaatgtattcatattcaagtttatctcat

SEQ ID NO: 17996 - DNA, 552 bp, Homo sapiens
aacacatatggtatatgatatatgtattatgggactgtattcttactaaaaagtaagctagagaataaaaaatttattgagaaaatcataaggaagagaaatatatttactattcattaagcagaagtgaatcagcataaaggtcttcattctcgtcatcctcaggttaagtaagccgaggaggaggaggaagagaaggggtttgtcttgctgtctcaggggtggcagatgatggaagaaaagccacatataagtagattcgagcagctcaaacctgagttattcaagggtcaattgtgatttgatttcctctagcctttaagtacatccaatttactaacctctttatggctgccttacctactatgccagaaagcctgcttttctcatctaaatccttttaaattatagtcacatcattgagatgcacccatatttcattctcatcacagaaagatagcaaaacttatttttaagatcagccaggccaggtcgggcacagtggctcacacctgtaatcccagcactttgggagactgaggcgggtggact

SEQ ID NO: 17997 - DNA, 627 bp, Homo sapiens
tgggtgaaagtaaactttagagagaaggaaatgcataccataagatggtgaaaataaattcatacatataaataattacaattgatgttgaaggaatagattgtcagattatataaaggaaataaaaatccagtgctattttttttcataagagacaacacagaaaaatttaaactaaatcttggaaatagttatatcaagtaactatagacccaaagaaatgcagtatacctgtattaatacttgtcaaaacagatttttgactattttaaataagaggaactaagctatttaatagaaacctttaacacacaattcttagcaattgattgtacagaaaaatatcagtaagaatattgaagatgtttaaacataatgaacaagtttgatctaaaaaccatacacatatctgtaagtggcagtatacacatttctttcaaacataagtgaaacacttataaaaactgatcatctattagatgacatagtatgtctcaacaaattccagagaaatactatcctagagaccacatttattaaacacaataaaattaaattggagccagtcatggtggttcatgcctgtaatcccagcactttggggacccgaggagggcggatcacttg

SEQ ID NO: 17998 - DNA, 500 bp, Homo sapiens
gtgcatggagacaggaatgaagccagaacgcaggtggggtgagccgcatggcaggatgatggagctcagtccggctgagaagtgtgttcgttagcatcctgcaggagtcctcaaggtcattcgacaattggtgcttcattcatcggctcaataaatatacatgagcacttacacagttcctggtacaatgaacataaaagctaaaatccgtagcctgggccgggcgcggtggagctcacgcctgtaatcccagcactttgggaagccaaggcgggcggattacctgaggtcaggggttcgagacaagcctggccaacacagtgaaaccccatctctactgaaaatacaaaaactagctgggcatggtggtgcatgcctgtaatcccagctactcgggaggctgaggcacgagaatcgcttaaccccgggaggcagaggttgcggtgagctgagattgcaccactgcactccacctggacgacagagtgagactccgtctc

SEQ ID NO: 17999 - DNA, 644 bp, Homo sapiens
gcaagcccatctaaaatccacaaatatacttgaatttgattcagcatctgatcatatttgactcaaatatgattcaacttttttttacattgggaattttaatgtctaaggagtatttttattaagttttcttcagtaagaaactcttcccttcttgtttagagaacacaggtagtgattttcctaatcatatatctgaatctctgctgagccttctcccagcttttctccaaaaattactttgccactgtatagtatgtatttttaataaagaaattattataaaaacattctactattatttgattcactatttcatttattcattccaacatctattaagattttacaatgtgcaaatcagactttccactcattaggaatatattatttttacaaagatcaattgctttgtaaatattaatatagcagggtttattatataagaactgcattaaaaagtacagtgaaggccgggcgcggtggctcacgcttgtattcccagcactttgggaggctcaggcaggcggatcacgagatcaggagattgagaccatcctggctaacacagtgaaaccccgtgtctgctaaaaatacaaaaaattagctgggctggtggcgggcacctgtactcccagctactc

SEQ ID NO: 18000 - DNA, 604 bp, Homo sapiens
acaagctgttaaattctttacctgcagctgaacgacagttaataaggtgtgaaattttttcttttctttgaaaacatcacagagttcaattgttttccctaatctttttcttatatcttgaagtccatagaaagaaccaaaagaaaaagagaaaagatgattgagattcaaaaggttatgattttttaatcttttgggataagatatctacttgactactgtccctcagttttcaggtctgtacaatgggatgtgaacaaaaatacctcccttgctaaagactgtgaggaataattattcagcgttcgtaatgctctttgaagttggagaaaatgattcatgtgctaagtgtcataatcaccaatctaagcccaggcagaaataccaggaaaattaaagccagctttgaaggaagaaaaaaaaattattcttgatgcacatagttttatattagagttagcaaagttataaagagaaaacttttcatgcaactcaattgtatgtcccttctgatcccgaactaaacatcatacaagcaatctggtcttgaaataaaagagtatttctcagatgatattcatcatttcttactcatcagcataga

SEQ ID NO: 18001 - DNA, 450 bp, Homo sapiens
tgtgggtttatattgtgctagctcacttcagtccagacaccatctagatgccacaacccctttctagtgttgtgctaaggggtggttcacaacactagtacaagacacgttttgcatttaatacaacccccactgcagcactctcagtttgcattcttcactacaaaggatgtcttagaaaaaagcagtggtaattaaaattaggttttaatgttagtggttttaaagtatgttctaaaacaatttacactcaatagtaaatgacaaataggtcatttcccaagataatcccaagcccacgcaactaagtaaggaaaaatctaggtgcttttaatatagacacaatactatgtgtgatgaattctaatatgtcaatctggctaggtactgccatgaagggatttttcaggtgtaatgtccccaagtcagttgaggggagatggtcttggg

SEQ ID NO: 18002 - DNA, 538 bp, Homo sapiens
ctgaggccatcttaaagtaaacctcagccaatcaaccgccagatccttgatcagcgcaatcacctagatgatccacaaaactgagtacagatgcacaagtgagcttagctgagctgcaggctagtgagcagtaataaatccttaccattttaagtcagtgagttttgaggtggtttctcatacaatagctaatacagggattcggtttttttccattttttacagaaaaagttagagtcttcaagtttgcaccaagagtaagcagaggggctaatatcccactgatacactgactccaaaatatatttttttatagtatgcactactgttttccaaaatctagtgtgttattttgtttctgtaggcatactaaataacctccctaaactcaacttataaaattattagatgcaattacaagtgaatattctgaataagtactgatatgttttcataatcagcccaaaagcatcctcatcatatactacttttctaagatggaatcaaatatgctacatagtaaaaattattaagtatt

SEQ ID NO: 18003 - DNA, 261 bp, Homo sapiens
tgagcaccagtatgtcactcgaaggaaatcctcactggagtatttcggatttcggattttttggattagggatgctcaattataagtataatgcaaataggcaaaacaaacaaatccaaactctgaaatatttctggtccctggcattttaaataagggatattcaatccgtatagatattctacatagtcaaactttaatggacttactcagttgcagttaaaataggtagatctcattttaataaatatagcaatgttc

SEQ ID NO: 18004 - DNA, 467 bp, Homo sapiens
tatccttgacaaaatcaagaaaaacacaaaaactgaaaatgtgttgccttataataccctctgcagaatcacactctggtcttctgtctgtaagcctgaaaccttagggtgttactagagagccaacaagactcaggttgttgtattatgtatactatatataatcacttcagctcagtaccaacaggttagcactgacctgagattttaatggttattgtactcaaactgacaattccacaaagccctcatgtcctgaaaagttatttatttttgtagactcagggacttaacttccttttccagtttgctatcacgagatgtagttaaatgtcatggccacattatcatccctttattcaaatagcctagcttgtattcagttaaagtatataccaagggctgggcatggtggctcacgcctataatctcaatactttggaagactgaggcaggcagatcacttg

SEQ ID NO: 18005 - DNA, 563 bp, Homo sapiens
tgtattgtcctgataaaatgtcctgaattctaataagtaaatgcttaagtcagtctttgctctggagaaacaaccctggtcccagcagtgtgctaaggccaacttgtaataagcttgcaaaattgattttaaaattttcaaataattttaaacttcccacttttttgacatcatgttgataacttgaaattggttatagtgggactatttacactatggaaatcagcagcctccactaattaggcccctcaaccactaggaaccagctgtgaaacactgaccaggacaccactgcctggctcacctattttctcagttaggattgcatactttgcatgttatttatcattagtaatctctatagagaatttaaataaaggaaaattgaacagtttgttcttaaaattttacttttgtaaacgtacttaaactattcacatccaattggaaattgagtctccaaagtatgtgtgcgtggtagttttcatttggtgttaaagaaattttgaagataatgaaaatgccactggagtggaagtcaaggaacttggatttgtcactga

SEQ ID NO: 18006 - DNA, 638 bp, Homo sapiens
caagaatatagaaccagaaataccatttgacccagcaatctcattacagggtatatacccaaaagattataaatcattctactataatgatacacacatacatatgtttattgcaacactattcacaatagcaaagacttggaaccaacccaaatgcccatcaataatagactggataaagaaaatatggcacatatacaccatggaatactatgcagccataaaaaagaatgagttcatgtcctttgcagggacatggatgaagttagaaaccatcatcctcagcaaactaacacgggaacagaaaaccaaactctcatgttctcactcataagtgggagttgaacaatgagaatacatggacacagggagggaaacaccacacaccggggcctgttttgttattttctaaatttaagagcatctactggccaaagaaaacttcagcacggtttgccaattagcagccacacaaagaggggatgaagtccatgaactttgtcaaaagtcaaacctggacaatcagtcttactatttttttttcttctgagaaataagtggataatttccgattaacacatgcatcaactatgaaaacaataaatggttgacagtgctcacaaagcttgccctatctc

SEQ ID NO: 18007 - DNA, 583 bp, Homo sapiens
aaatatagaaagactatcaaatatcttgacaaaaatagagaggatgtttttcttatataaagctcatgaccaagtcttcagcaccaaatttgtatgtaaattctttgaattttttggaagaaaaatattgactagccttttatttgatttgatctttcagaacattacccactgagtaaatccatattccactctaagttttaataaaatctgtgacggagatgggtatttctgtcaatactcatttctggggatatgtgtgtgtgtgtgtgtgtgtgtgtgtgtgtgtgtgttgtatgtttcatgcctttatacaggttgagtatctcttgtgtgaaatgcttaagaccaaaagtgtttcagatttcagatttttaaaatatttttgaatatttgcactattcttactgtgtgaagatccctcatctaaaaatagaaaactcaaggtgccatggctcatgcctgtaatcccaatattttgagaggctgaggcaggtggatcacttgaggtcaggagttcaataccagcctggccaacatgatgaaaacttgtttctactaaaaatacaaacattatctggac

SEQ ID NO: 18008 - DNA, 601 bp, Homo sapiens
tatttgggaaatcacaattagctttcagatacttcaaaactcaattatagtaaataataagaatgagattgaaatgagatatttcagatcctaaatggtttcaaatgcctttttattattttattttatttttcaaagaaaatgtgaacttaacttctaggtcactgattctaaatcttctatgacacttatttcactcatcattttatcatccaaccatgaacaaataaaagcctgctttttttttcaaaaggaaattgatattttctgactttattttatttttaattgttgctaggctacagaggcattaaatattgcagtcatattatagaaagtacaatgaattgttatggttttggtagacaaataattcttaattttcaatttaattgcaacagtaactataacatacaagaattaaaagtacagtggtatccttgagggatattttgcttaggactaaaatatacaaccagaaataaaaattgtgttagtaatataaaaattcaataatatgactgggttattactaggtttgatgagaagtaggatatcaaaggcatttgctgggaggcatgagcagagaaaacgggactta

SEQ ID NO: 18009 - DNA, 570 bp, Homo sapiens
tatatgtacttataacctgcctttatagaatttgcagtcatatggatgacagctaaatattataaccattttaaatgttgaaactattttgcaatttataacatccatgtccctcacgccagaatttgctcaaattaacagggagaaaagttgcattaagaataggaaaacatgtatgtccctaatactgttcccaagaacttctcagacaaaattccaacattaggaactaaagagatgtggcagtgctgcttttaaaagaaaaaggcaggaaacaattcaaatatccattaatagagaatggttaagtaaattgtggtacaaccaaacaatgaaatactatgtagctataaaaaataagaataaagaagctgtttatgtactgacaaaatgattgccaagatacaaattaaaaagcaagatgtggtacaatgcatataaagtatattgccatttgtgtaaaaacagagggacaaagagtatgtgtgtattcgcttgtgcatacatgaaatattaccaggatacacaagacacagatattactaactacctctagaatggggaactttt

SEQ ID NO: 18010 - DNA, 531 bp, Homo sapiens
tctgtggccactaaaaggataaaaagaaatatgaaaaactatatgcattattgcaactacctacatgaaatggattaattccttgaaaaccgcacactaccaagattcaactatatgaactgaattatctgaatagccttataattactaaagaaattcaatctataattagggaatggggtattaggttaacatattttcagaactaaaaggagacatgagaagaaatcaaagctagacactgccatttaatcaagacttttctaccaatcgttttattgctatacaaaattagtagaaaaataacagaccatagaaatctatgtttttacattgtgtgtatcataattttacttatttaaaaattattcttgaagagcagatttaatcatgaatatactaaggaccaaagcaatttaacatgagtttgtgagataaaatatggaatgtctagtttgatgtaaatttcggagaaacaatgaataatatttttagaatgaatatattccatgagacatttgtaacacatac

SEQ ID NO: 18011 - DNA, 533 bp, Homo sapiens
tggtgaccaccagacctttccattttaaagatgccattttttcttttcattgtataacaatctgtggggtcatattatgtctccctgagaaagttctgttccaacaatcattccctattttaagttttagcattcattaattatccttgcctaaaataattattttattgggaattgtaaaatagtgatttttctaattctgttcattttctcaatttgttacttgacattattctatgaaaaagagcttttctttcattaactagagctcaattacagtttctccataaaggcagaatatatgtttaatctgttccctttaatgaccaatttgtggttatctcctctgtaggcaaaggagaaatatagcatttccattatttataaatatgtatgtatgtgtgtatatatatatgtgtgtgtatataaatatgcatgtatacacatactttatatatgtatataaaatggaaatgctatatttgaaaactacagtattagaaatgaagaattcattagatgggcttaacagc

SEQ ID NO: 18012 - DNA, 618 bp, Homo sapiens
aaaactggacttcctaacacaggcctatgtgccacatcaccaaaggcttccaatgcaggggtccagatggcccactcttcaccatgacgaagcccgaggccatggaagacatcatcaaaccactgcccacgtgtgcccatcaggtctcactccagatgcctcgcacctaaaagcagggatgccactgtgctctggccagagttgatgctgggggagaagagctagtaccagcctaaggagggaggccaaggttctcaggagtgcagtgctctgaggagggctgggtgccaggcaccacctctgcttgtaccttattacctgctttctcacctgcaataagagtggcccatacaccctaaaaggttttcatttcggccgggcgcggtggctcacgccgatcacgaggtcaggagatcgagaccatcctgactaacacagtgaaactacgtctctactaaaaatataaaaaattagccaggcgtgttggcagacgcctgtagtcccagctacttgggaggctgaggcaggagaatggcgtgaacccgggaggcagagcttgcagtgagcaagatcgtgccactgcactccagcctgggcaacatagtgagactctgtctc

SEQ ID NO: 18013 - DNA, 405 bp, Homo sapiens
ctatgcagcctgaagattttgccgtgtattttgcaaattagtgcaaaagcagaagagtttagactgcgactacacagagacccattgtcctggctaaaacccaggggcttgagtcaggagcagtggctcacgcctgtaatcccagaactttgggaggctgtggtgggcagattgcttgagctcaagagttcgagcccagcctgggcaacattgagaaaccctctctttacaaaaaatataaaaagttagccgggtgtggtggcacgcacctgtagctccagctactcaagagggtgagacagaaggatcacttgagacttgagcccaggaggtcaaggctacagtgagctgtgatcgcatcactgcactctagcctgagcaatagagtgagaccctgtccaaaaa

SEQ ID NO: 18014 - DNA, 160 bp, Homo sapiens
gagaatgcatttgctgaaagaaagtcaccatgtctttggttgccatccaccaattgtttatctgtacttgcagccctgtcagattcatagatgagtggttaaagggtccatacctgagatccaccaagccataagagaatgttgattttgttgggaaact

SEQ ID NO: 18015 - DNA, 308 bp, Homo sapiens
aggaggcatctggactaaaagaatcaaccacaaatgtttagctgtcatctctagtataattcctggttccatactcaaactcaacatggaaataaaacaaccataaaggattagaatgcttaatagaagatacttttgatgtctgttgtttgtaaaatgtaaaactattagccaactacactagcctctccctcaacaacttctatacagttagctggtccaattgtcttcaactatttaccaactgcaaactgccacatctaccttctgtcttggctgagctcctaagcacataggaaaaaaaaaaa

SEQ ID NO: 18016 - DNA, 623 bp, Homo sapiens
tggaattttattctgttgtgtttattttatgtggtatcatatatttctacataaaattttatcaagcttactttagtggtttagttttattttgatactctaacttatatacatgttattggaagagaaatagttcttactaacctgagtgtattggaacattaaggaatctgcatctatattaaggcagctatttgaatattaacttgaatacctagaaagcatctgaccaggatcatttatctgtgcataccaggtgatgagtgaatataattctatatgaataaccatatagcttttttcttttgccggcttaggcttccatactttcctctgtacaaatttgtagataaggtctctatttttattttcattagaagctggcaaaatttgtttctatatttccaaatgcatttactatgtctagtagaaaagtgcatatctttgtctatatctacatgtgtgtgtataatatatatgtaattgtcaacacacatatagatgagtttgagtgtcatgagcctaatgacattcatttgtaagaaaagaactctggctattaaaattgcacagatattaaagctctgctttttcttttgtttaaaaataatacacaatgcata

SEQ ID NO: 18017 - DNA, 597 bp, Homo sapiens
tttatgcaaactgaaaattacttgcccgccaaaataaccatttatgaagatttaagaaaatgtagaaaatgttatgactgtttataggttaaaattagttgcatctaccttgaatccatatatatatttttagcttattgttgctttttaaaaatctatgacatagcaactatatttaaaatagtttatactataatgggcatatttattatggttatagttaataaccatatataatgagatagacttaaatcatgtgttggaaacttaagttattccagttatactgtcataataaacatttatttttcctccatgtcttctatatatcattcatctgtttctgttttctgggctaggcttagaatgagagccaacaaaacctgggactcagtctgtcttctcaataaaattattggtaccactggtggtcatacgtgtcttcattggttcttgatatactcttctttggcaatgattatactttagttttggggcatatgtgactaactagcggcatttaataacaaaaagataacatctcataatgttacattacaatcagtccttccactaatttaaattcagattcatttc

SEQ ID NO: 18018 - DNA, 486 bp, Homo sapiens
aattaaactggtcgtaatgtatgcatttatattgtctatgtctccctcctatctactcagacttaactgggagaaaccacagcacatagtgcagtagcagagaattctgactgtccccaccatgtgcactgtgctcaaaaaagcaacagcagtttgcgcaggaaaactgttgggtccaatatggcaggacaaaaagttagtgaagtggagatatgaagaatcttctaaacccatgaaaaatcaggggtagaaagaagttttgcagaagtctagaatttctctttgggatggtaagagcaagagcaagaatgatttaaaattgtacatttatatcatctaatctttatgtatgctttcattatcattttttgcccacaagaactctgaattttgatagtgtccattggactttaaaatcatctacctctttgcttggctgtgattaatttcctcttctttactcctatagaagaaagttgacattag

SEQ ID NO: 18019 - DNA, 613 bp, Homo sapiens
acatctgtgaagagtccatctttagacatcctcagcaggaaaatcacctgctgaaatggatctggctgaaatttttctgccctgggcaaaggaggtctcaagcgttcttattattatagaataatctgacctatttagagaggtgtgggcaccaaaggggattaagtctaaaagactccaatcaagaggacattatttctccactccattcaatttaacaaatattgatggcactttgactttgtaccaggcactgtgcacgtcttgttgaagatggaaatatgtatgaaatatggtctctgcccttaagaaatttacaattaagaaacaatgtaattggctgggcacggtggctcatgcctgtaatacctgcactttgggaggctgaggcaggcggatcacctgaggtcaagagttcaagacgagcctggccaacatggcaaaaccctgtctctactaaaaatacaaaaattagcagggcatggtggcaggcacctgtaatcccagctacttgggaggctgaggcaggagaatagcttgaacctgggaggcggaggatgtagtgagccgagatcgcgtcactgcactccagcctgacagaatgagactccgt

SEQ ID NO: 18020 - DNA, 149 bp, Homo sapiens
ggatggcccctcctcaacaagaaggatgtgaagataggaagtaagataatatgttgtgtgttcattcagtgccacatttgttacatggtggctgtttagtcaaccccagcattatttccctttcagctttgtcccagcatattattcat

SEQ ID NO: 18021 - DNA, 637 bp, Homo sapiens
actttggaggagcctctaatcgttcatgaggactccagattatctcttttacaccttattatgggaaaacacagtattcttgttggcttcccattttaaatattatatagccgagagagagactgccaaagtcaggaagaaagccatgttgagattttagatcatttattaataaaagttgacagtggccagctcttcttttcctgctctaaagaccctaataaaggcagtgctgggcataggctcagatgctggaaggatgtgggagaagaggaagacaatctgatgagcttacctttattcctgtcacctggttctggcttcgtgagtatctccaaccccaacttgcttgcctctccccatctcaactcttctcattcccatgcctgtctccagagtgggcatgtagtgctcctatgtgtggctccatgagtcctctggcaaagcttccttaccaatcatcattcccatgaaggtatattcatactaacagctgatggtgttggatatttaaggcagacttgcatcccaatagcagtaaaaacctgaaatacagagtgggttattctggccagggagcttctaggtaaccagttggtcaaattttattttaaaggaattatgtcttttaagagct

SEQ ID NO: 18022 - DNA, 645 bp, Homo sapiens
ggcctaaaaaaagttatttaaaaaacgcaaatctagtgttgaaagtgtctgtcaaatggtttgatatttgtgagtaaaaggtcctccttttggcattttctagttattctggggctgcctgctttcaccgttggtctttattgttggtccaaacttgctgttctttaaatagatggttctcaaacatattagctttttgacctgtaagaacagataaattttcccattacaaattattccttttacagtcataacaatttttttgttgtgtttctcatctgttgcttctatatcaatcactttattttaccttttgggagaatgcatttgctgaaagaaagtcaccatgtctttggttgccatccaccaattgtttatctgtacttgcagccctgtcagattcatagatgagtggttaaagggtccatacctgagatccaccaagccataagagaatgttgattttgttgggaaactcaacaattctcggagaggcactgttgataatttctggaaaacaattggtgactacagctttccaggcacccaaaatttcctgatggcatactcactgttttcagattcaccacagaagtaaaaccctacagtcagtaaaaccagtccttttgataggtcacacaacat

SEQ ID NO: 18023 - DNA, 600 bp, Homo sapiens
gggggccttcactccctggaggtccaaccgcagccatccttgtccccacaacttctgcagtgtcccagggcttgcctcactctaactcagcccactcacacttatcacgtgacttcatcctaaacaacaataaccttgaaatctggaatctgtcttggtcatgttcttacaaactcatgctgaaataaatgacagcagcccaggctggctgcagaggctcacacctgtaatcccagcactttgagaggccaaggcaggaggagttcaagaacaccctaggcgagatcccatctctacaaaaataaaaaattagctggggccgggcgcagtggctcaggcctgtaatcccaagcactttgggaggccaaggcgggcggatcatgaggtcaggagatcgagaccatcctggctaacacagtgaaaccccgtctctattaaaaatacaaaaaaattagccgggcgtggtggcgggcgcctgtagtcccagctactcgagaggctgaggcaagagaatggcgtgaacccaggaggcggagcttgcagtgagccgacatcatgccactgaactccagcctgggcaacagagtgagactccgtctc

SEQ ID NO: 18024 - DNA, 587 bp, Homo sapiens
tcctatccctggcttatgtaagagccaactagaccacagagcatataaaatcaagtgctgcttcacaaatgaaataaagtgttccttgattcattactaatgcgactatccacatacatggaaaaccacaactcagatattccccttttatttttctctagaaacatgaataaattgcttttggcacacttaattggtgtttgggacatacttttcacaattgaagtccttagtaaattactcaggagagagactctcctctttcagtacgttatttaatacttaggcttgttagtgtgtgtcatttacacataaatattttgttgtgtgaatgatgatgcctagatcctctcatctgaggcctggctaatagctagtatgcttcttgttaagactggttcagtcaaaaataagtgttaattatttttacgtgtgacaatggtattatgcctatcaaaataccaatgacattcttcacagaaatagaaaaacaatctcaaaacttgtatgaaaccacaaaaggttccaaataaccaaagcaattttgagtaaaaagaataaagctggaggtatcatactacctcact

SEQ ID NO: 18025 - DNA, 615 bp, Homo sapiens
gtcatacagggctgggtgtgcgttaggcacagtaaaggggagatctaagcaaatgatatgaacggtcaggtcaagaattggccacacaattgaacgaagtacatttttagcatgttggtagatatcccattgaaaatgcttggcatggaagcatgggaattgaggaaactggttagagatccccctacggagtgaagttggaggataatttacagctgcatcagagcaacatatctatgattttatgagttttggtttctatcttaatgatctgcatgcatttgacatggttgtcatggaatgtcagatgtttcacaatgtatgtggatgatttcatgttttttgacaatttatagcagttaaataaaactgccctaaaaagttttgtccctctgggaatttggggagcacatgctgtgttcctcttcctgtccctccttaccctggcagtctacctgattattttcttctgcctcttctcccctttttataaaatattttaataaaatatttggataagcaacacaaactcatctaaatttccagttgttttaatacctcagtaacctgtaggaaaatagtgcctgtgagtctaattgaatttttcatctagct

SEQ ID NO: 18026 - DNA, 507 bp, Homo sapiens
tatggtcagattctggcgggggtcccttttctgatttgcaaatggccttctttttgttgtattctcacacagtggggaacagagagaggggggaagctctcctgtttcttcttgtgacagcactaatcccattcataaggcctccatcctcgtgatgtactcaccttccaaaggccccacctcctaattccatcacattgtgggtgatttccacatatttcaacatacaagtttaagagaaacacaaacattcagtccataacataatctgtctgtggctatactgctctaaataataagtaaacaatgtagctagtttaacttgtcccaaaactggttattccattggatgagtttgtttggaccccttatgtgggaagtggacaagggttaagtttgcaattatgatcttaacatcatcttccttcttttaacttctgttaagattaagtatgaaaatacattcaaaaccaggatatctacactgaatagcattttttatgtagt

SEQ ID NO: 18027 - DNA, 524 bp, Homo sapiens
catgagagctctatcatgactgacaattagtcaataatcaagagtttatatgttctttaagcccttttatggtctagctggatgtagagttttacctgagagtacaaagttgggtgattatgttggagaggttaaggagagcaggcatggagaagtgaatgaagatggaaagtgccctactaatgtctatgggccaaaatgggaaatttgggattggagacaatggtttccataaagatcccattacagtaaagcgaaggatggagtcttagtagaatcttcagtttcaagttaactttctgtttccatcaattccaaattaatgctacgtgactattctggtaatagctctctttaattatctgctgttgtcttaattctattcagattttaaaaattagtgcatagtatgaaatatctgagactattcttagcttctttctatagttgcaggcaaataaatgctacatgttgggaaatgttggaatggaactccgcctgggaattattatagattatgagta

SEQ ID NO: 18028 - DNA, 593 bp, Homo sapiens
ttgtccagttcctttgctgggaagagacctactccaaaaactccaagtacagattgcttttgggccacaaggaagtatgactttgagcctaactgagctgaaggccatgatgttaacccttactgtcccacagactgaggactggagactatatgcaaaaaagactccagaaccaggagtaaatgaaatgtatcggttacttactaaaattcctggagtataggctgaagataactcaccagggctggctgtaaatcaggcactggtagtagtagggtcagaaccaggaggcccccttcattgctgtggagatatagtagataaggtgttctcaagccagagagattttacagaccaacccctcagggccccagatgttgaatactttacagatagaagcagttttgtactggaagggatctgacaagccgggtatgcagtagtaacattaaactcagcagcagaggtacagtctctgcccaccggaacatcagcccaaaaggcagaactaatagccctgacaagagcccttttgctagcaaaagacaaaaaaagtcaatgtctggccagtcacggtggctcacgcctgtaat

SEQ ID NO: 18029 - DNA, 387 bp, Homo sapiens
catctaagagaaggttcctataggaaattggccctttaactcatacacagattaccctcggcactttcagaaaacaacacagtgaccagtatattctgtctttttgatacagccagaagcaccctgaaagctgagacctaactgtgcttttggaaaataagcgtttaggagttgaatgaccttgtctacttcttttagtcagaataatgttggcatgtctattttaggttaaaaaaaaatacaaattctaaaaagtgactttaaaggcccactttgaaagccttagcatttaaactaacattagatttaaaagaagggcttttctcccccattataggaagctgtgtaaaatcatgtgtgaggttgtgagggtcaaatggaagtcta

SEQ ID NO: 18030 - DNA, 415 bp, Homo sapiens
ataccgctgctatacgactacctgcaattaaagcctgataaataccatggggggtttttttacttgaacacttacagtgcattttcctttaggaattgggcatcccctgctagctagtgtttcaacctaactatcaaagcttattgaattcaaaatgtagctgatctataaattacaaaaactctattctacagtcctacaagagagtctacagaaaacaatgccttcttaatcctaaatttgaaagttaagcctgggtacagtggttcacacctgtaatctcagcactttgggaggttgagacaggcagatcatgaggtcaggagatccagaccatcctgtccaacatggtgaaaccctgtctctactaaaaatacaaacattagctgggcatggtggcacgtgcctgtaaacc

SEQ ID NO: 18031 - DNA, 621 bp, Homo sapiens
acaacaaaacaaaaccaggtgtagtgtggctctaaaggaacatctgaccaggttcctggggaaccagggccatgggaggaagaagggactcttctcccatgagaagggcctggagatgcagggactgtcaagtcactttggccaactttttttgctcccctagaatgaactctgcactaaaagtggagaatcacttctatgagagaaagacataaaaagaaaagatataaggtaatgttacagtaagttgggcaaatctatcaaaatttaaaaacatgtatactctttgagtaattctattttttcagaattcattctgccattatagctatatatatataaggatagtattcacctgtatttgcctgtaatcccagcactctgggaggccgaggagggtggatcacttgaatccaggagtttgcgaccaacctgggcaacatagtgaaacttcatctccacaaaaaatacaaaaaactagctgggcgtgatgacatgcacctgtagtcccagctactcaggaggctgaggtgggaggatcgcttgagcctggaaggcagaggcagaggttgcagtgagccgtgattgcaccactgcactccagcctgggtgacagaatga

SEQ ID NO: 18032 - DNA, 630 bp, Homo sapiens
ctatttccaaaataggtttcattcataaacttccctccatccacactactcttagtcaaactgtcaatatttcctgcattctagaagatcatcttgactatatccctggcacctctattcttttgtgaatgcacattggctcacggtggtcccctagagcccaaatacatgcaatggttttccattgtaattaggacaaaacacaaagtaagtcctcacgattgcctaaaatttctgcatgaactagtcccaaagagccctacaattccatttcctaccgctgatggctactacccagccatgctggcttgctttcttttgtatgaatatgccaagctctttcatttctcaggggcttggcacttgctattctttctgccctagggccctatctccaatctttgcaagaccttaattgtgattcagatcccacttgcaatggactgcatgactgtaccccctacccccaaatccatatgttgaaatcctaaccccaagtgtgatgattttaggaagtggggcctttggaaggtaatttaggtcataagagaagtcctcatgaatgggatgagtgcccttatgaaagagaccccagcctgggtgcggtggctcatgtttataatctcagca

SEQ ID NO: 18033 - DNA, 549 bp, Homo sapiens
tcttctgacctcgtgatccacccacctcggcctcccaaagtgctgggattacaggcgtgagccactgtgcccagcctaggcttcatttttgacccctccatacccattcacacaaatgtggttccattattttgatggatcaatttgttccgccaggacaactgtaatatgtctggcagtgctttcactttgatcatctaattagatttgctcctctcacccaccctgagagataggtaaggacatggattctccctaaattaactggctggcaacaagataattagtcacaatgtttgaactggcttattaccgcctgctcaggcattcacaatggaggcaattttcttaagtacatgttcaaggcaaacaagggtcacctggtatggatgtagctgttgagcgttagctgagcctcatcttgaagggctgcaatggcggcagcattccggaaacttctcagttcagaaccactatgtgtaggaactagaaatgaagaccaggaaactgtgatagacagcatagaaattgcatctgggagccgagcgc

SEQ ID NO: 18034 - DNA, 607 bp, Homo sapiens
tttatagattaaaatatacaggcgcatctacttcatttccagtagggccacttccaccatcagcaaaaatatttttactgaccaggtttttatataaatctaagtttgtgctttggaagataatgtaagaacgtaaagtagaatagatatttaccagtatttcttgaaatcatttaagtagaaacttgcatggaaaaatggcctaatggattacaagaaaatgaccacaaagctctgtttctgaaaatctgaaattctccacagagatttctcatctaacaattcatctgttaaccttcatgtttttaatccatttaaatctgcttgagactctagtgctgaatttacataagccaaaaatactctgaactgcttacgattttagttttatgtgagaatttttatatataaattagagtttccctatgagtttttgacaaattgaaaatagttctatgattaatcaaattttggaacataacctatttcaatcctttgattatccatctttcaaagcaacggccacatttagccagttgcctgttttgctctttccttccctcttttggtgacaggaaaagcaaaaacaacattctaaaaagttagt

SEQ ID NO: 18035 - DNA, 473 bp, Homo sapiens
ttatcatggtgcttggcatattgtaaatactcaataattatttttttctaaaaaggttgaatgaatttctactgcaggttttgggcttttaagattttctgaattcagtttcttaaccaagctaactctagataatagttccagtcaagtacactaccttcactaattttctcccagcaatttaaaaactgccaagcagatgaagtttgaagtaagttttgtaattttcaagaattatacaggccaggtgtggtggctcacccctgtaatcccagcactttggaaggccgaggtgggcggatcacaaggtcaagagatcgagaccatcctggccaacatgttgaaaccccgtctctaataaaaatacaaaaatgagctgggtgtggtggcgtgcacctgtagtcccagctactatggaggctgaggcaggagaattgcttgaatccgggaggcggagattgcagtgagctgag

SEQ ID NO: 18036 - DNA, 491 bp, Homo sapiens
aatgatttaactccctctatccctgtttacctgttattattctttaaggctcagtttaaatatcatcacttctgggtaatctttgtgctgttttctccttctcccaagtctaacttaggtctctcctgtgtgcttccattttactgtgtgcacatccatcatatgacatatatatatttctttgacatgaacacaaagttttaaaagacatagacattgttccattttatattctttgcatttggctcaacacctatgcatagtatacctcaataaaatttgataaatgattgacttatttctcctgagattgatttgtcaagatcacacagattaattattgaaatgagccatacgtttttggtatattgttaccctctccccagtttccctcaaaacagcttgagacactaaaggactgacttagagtctgatctatttcgctttttcaacctgtgatatgtgtgtgtgtgtgtgtgtgtagggggatg

SEQ ID NO: 18037 - DNA, 589 bp, Homo sapiens
agcctgttcactataacctttgtttcgagaggagtttcactcttgttgcccaggctggagtgtaatagcgtgatctcagctcattgcaacctctgcctcctggttcaagctgttctccctgcctcagcctcccaagtagctgggattacagttgtccaccaccatgcccagctaatttctgtatttttagtagagatggggtttcaccatattggtcaggctggtctcttaactcctgacctcaaatgatccactgcacccagctcattgtaacttattaatgtggctactaggaagttttaagttgcatatgtggttctcattatatttctattagcactgctttggaatattattttgaataacatccaaatttcagtattagccaaatgattatcaaccaatattgttcagtctggacttagttctatttgattaaatcaactaagtaccctctggtttgttaataatttctagagtgattatgaaacaaaataaagctctgaactagaagttgtagaagaagacaaggagggcactgccaaaatcataaaatacaatcctctttctttaaaaagcttacaatcga

SEQ ID NO: 18038 - DNA, 409 bp, Homo sapiens
atgtcctctccacatgaagaatcaatctgaattcttcaccactgatgttttccatctctaacttgaagttacaaactaactttagcaggaatacttatggcttacttcggagcatctgttacaaggcaagaactatcatgtatgtttgctacatttatttttattttttatttttttttgagctggactctcgctctgtcgtccaggctggagtgcagtggcgcgacctcgcctcactgcaagctccgcctcctgggttcacgccattctcttgcctcagcctccccagtagctgggactacaggcgtccgccaccacgccctgcaaagtttttgtattttttagcagagacggggtttcaccgtgttagccaggatggtctcgatctcctgacctcatgatccgccgg

SEQ ID NO: 18039 - DNA, 545 bp, Homo sapiens
tcaggttcacagaactgcagcatttcctctgaggttctgttgtttttatcaataaaaagctaagggcattacactgcattaaaatgtcaaatagcaaggatatttcctcaggttttcacggacaaacatattctataaagttagtttgatgtcttaactgttgcacctatctgaaaggatacttgagacaaaacaaaaatttttttttttgcctgtcacatctgatgttatagacaactttgaatgcaatcttagtgtatgggatgacaatatttaatattgctcgtttgatttaaatgatttgcgagtaaaattcttcaaaattaagagaaaaaaatcagccaacaccaacattttggtgctttgtctttgtcaatattctcatcaaattctttaacttcactgtattattctcttgagaagaatctatggtcagactagttttcaaatatggttctacttctcatttttgaacttgggactttagctaccacctctgacactcagtgttcttacacattaaatgagatttatactagtaagac

SEQ ID NO: 18040 - DNA, 509 bp, Homo sapiens
ggagtttgagtcataagctgaatcacatttcagcagattgggccatcaacacagcccagtggccctggacacacactatgccagagttatgcagaaaaaggaaatgttcaacatgttgcaaatggaagaaactagaggaaacgatgttctccattccacccaatactacctcccttagtactatttgtgggaataatggatgtggcactgtcagagccagatggatgcgtccctaaaggacgtgcaagcttggctgtgggtccgcaaatccctcactgttgagaactacccagggcatacgttgctttgaggaatcactgcaaatggaatgttatggactattacgataatcaattaataatcaattagtttagtaatcttctcttgtagaaaacctgcttaaacaatgatgaatcatgcaaactcactcagggctgaaagatgatagagtggaggaaaaagtagctttgcggtttacacacacacacacacacacacacacacacaaa

SEQ ID NO: 18041 - DNA, 574 bp, Homo sapiens
cttaaggtttgagatatgaattttctccagcagtcctcagcaaccagcaggtaggagtaaataactgaatgattccaggatggaaggtggagccccagtaatgaggaggtcctagatgtgagcctcacgcttaaatagaatgacacagtcaagtaactgagctatatgtattatctgacaaaacatttatagcttattttgtacaatttttatgtgatgaaaagttaatttgagagaaaagacctaattagctggaattagtgtaatacagaaactcttttcaactcccaaaatgatgggcaatatcactaaatggtttagtggttttatcaatgaataatttttcattatcagtgagacctggaaacaaattggcaaagcctctccttaaatgacaatttgataatctttgtcaagatataaaatgtgcatattattagggaggatgaggcaggcagatcacaaggtcaggagtttgagaccagcctggccaacatagtgaaaccccgtctctactaaaaatacaaaaaattagccaggcgtggcggcgggtgcctgtaagcccagctactcg

SEQ ID NO: 18042 - DNA, 509 bp, Homo sapiens
aaaacagactcttaaaaaataataatgcaaaaactcctatatttgaaaccatagtttaaaattataaagaaaataagagtctcaaatgatttacaagtgggttctaccaaattttcatggaatagaccattgtaatctactagaaactcctctggacaattgaaaaatagactatatctcaaacctttaaaataataatacaacacgtacacaaaaacaattataggctttccttatgaatgtctctctctctctctcatatcatgtaaaacagatcacatacgaccagataggtttatcccagcaatggaactatgtaaggatgggtcaatattaggataggttaacatttcatatataaatgccattcttcattgatcatctcaatagaaagagaaaaagaataaaagtctatacaaaaaatttgataaaatgtagcacaaattcttgataaaaattattagtagctaggtgcagtggttcacgcctgtaatcccagcactttggga

SEQ ID NO: 18043 - DNA, 587 bp, Homo sapiens
aaaataacattacttataatattgtcaacagaaaaagaaattactttgagcagatgccagtatttcttctcaatgagatttcaaagaataagaaagctaaacacagtattatcaagaattaaatgtgagcattctgcctactttctgcaagtggcctacattcaacctttggaggtatgcttatacgtttaacgactaaagtaacataacataatacttaacagtgccactcaggggttttagctgtgaaaaagcagtggatcctaagaacagtgggcactgaagttgcctgtctctatgtcaggttacagctcaagctttgtatatgctgcagacgcccaagctgaatttaagagaatccgctctaaaacattacttgctatttagacacatgcttaaagttatttccttttaaaccttaggcagattgtgaaatattcccgatgtattgtctcacaatgcataacaaagcttttcacatattttcagatatttgggaatgtttccatatgtctggcatgcctgtaatccagcactttgagaggtggaagcaggagaatcacttaagcccaggagttcaaaatcag

SEQ ID NO: 18044 - DNA, 594 bp, Homo sapiens
tctgtatgtgtgtgtgttgtgtgtgtgtgtgttcgatgaaaaggatgtgcacatttaaacatgtttgcattgactgaattttaaaaaattcataataaaagagtcaattccaatgcctgtcaatgcataatagttctcactttagagtccttgatatttctcttcctgattagtgtcaccacatcattcctttaaacattttgataaaagagatatcaattaatggtgccctggtaaactgtaatcagaatagattcccaagatgaagttggttcttttacttggtcacaagaagcatttttctttctatttggttgtacctgtccctttaacaaccagctatttaggcgatcaatgtcagaaaactagaacaaatagaaacacattttccagtagagagacattcagttgactccattttggttttctttctcggtttaacttttgatttacccaagaaagaccaggaaatcagtgattgcctagagtgaaaactgctagaagaagagattatatacaaagaaggataaggaatattttggatatgatgaaaatagtctgccctggttgtggtggtggtttcataggcatata

SEQ ID NO: 18045 - DNA, 311 bp, Homo sapiens
gggtgaggctgttctgtttcaaacttgacactcaaaaactaacttctgtgttttctattttaaggcttactacaggtagactacttcagccatcaattaaaataagcttttcttaaaaatgagatgataattagtgacagcattagaatccctaatagtgcgtgtatgtgtgtgcatgcacgtggatgcagtatgatagtggctgcagcgacagaaaaccaaagtaatgtggcttaaccataataggcatttatttctctctcatgtaaaagcccgaaaagtggtctatatttatcagacttttttgagac

SEQ ID NO: 18046 - DNA, 521 bp, Homo sapiens
atccattctttctcttgtgcctacaatgccttctcccctttctttgcctggctaactcctacctttaagactcagctcagtcttaaagtctgcctctaccagaatatcttcctaacatcacaggcataacatttaaacatttgtgccttcttctgtaccaccatagtactttgtacatatcttttccaaagtacttatattatagttaaatgctcatttatatgtctgtttacacttacaacttaagttcctagaaggcagcagctgtgtttcaccgctcttccattcatagtgcctaattagcaagacttaaacaaatgatatttgtttttatgtgattggttgtcaactgattttatatcctgtaagtacagatgactcctgggaaatcttcagggatgatattggagttaaattaggtgttgaaaggtaataattataatgaaatttgcatactgagtacttatgtgccaggtgcccacttggtacttatcttgtataatctcatgttatacccaact

SEQ ID NO: 18047 - DNA, 655 bp, Homo sapiens
atatttaccttttaaagaatattgtgagcaaatatatatctagcataaacagctgtgttactacacacacacagcaaatgtcacaatactgttttagagttgcattccagagagaaatatttcaaggacaccatggcagttgacgcaggtgaaaaaggaatggtggctactacgtgaagagaatttttaaatccaaatatgcgcacaatgttcaaataccatagcagcacagagcagctgctcagggaagtcttggagggttcttactttaagtttattcggcccttccttttctatctttctaaggtgttggtttaaaacttctgactttagacctttcttattttctaatgtaagcattgagatctctttagtttctcttgataatagtttctgtatacaatttttgctaatattttatttgattttctcttaggcagttggaacattttttaatgttactctaaatattatctttcaacatcatattttgaacgtttaaacggaatgagctggagaaacagctttcaattagattacataccccagtattttgttaatactaaaattctagaaagaatcttctaacaaatattcataagtgatgatgaaatttaaagaaaacaaaatacttcccccccaaaaaaaaaaaaaa

SEQ ID NO: 18048 - DNA, 519 bp, Homo sapiens
tggggtacacacacaggagtgaggtagtggagcaccggctaggcgcatttttagcgttaatcgatattgccaattcatttccccagtttacgtgcccaccagcgttgtagacaagttccagtttctccacatcctgaccaacgcttattagaataaacttttgaactgtttttgcttttagttcttccgttggtgacctccccacttgcagatcagcagatcaaatccccatgctgttgacaacacgctgggagcaaagagccaggtggagcttctaacgaagtcagatcttctgatattttaaaagctgagataaaattcacaggccataaaattaacccttggtcgggcgtggtggctacgcctgtaatcctagcacttcaggaggccaaggtgggcagatcacttgaggccaggagttcaagaccagcctggacaacatgacgaaactctatctctattaaaaatacaaaaattagccggggcgtggtggcacatgcctgtaatcccagctactca

SEQ ID NO: 18049 - DNA, 540 bp, Homo sapiens
caactcagaacaccagtagatgctgcataaatgctaattcctgtctccgactctagtctcatagcatgggggatggctatcatgtcttcctatgaaacattctatggtgtcaacaggaaaggaaaaaaaacccaagaggaaataattttgctagaatttaagtttcatggagtgtcaggaattagtctgttttgttcaccaatattctaaactgttagaacagtgcttggcacagattaggcaagataaatatgcgtagaataaataaatgaccaaattatatttttacttccattttgaccctttttgaccacctaaagtctgtcaagcaacttctacattaaaataagttttatgaattcacaaaatatagaattataaacagcctccaaatctgcctacttttttatcattgttgcttttctcaggcaagaaaaatgactcctttagaacaaactacataaaacaagctcctgaatatcaactcactgagacagaatcccaatcaatattagtttaaattacctgtctcccacacct

SEQ ID NO: 18050 - DNA, 505 bp, Homo sapiens
gtattaaaagaaattgtattgtccagtgaagttttaagaaacagaaaccataaggtgattattatttttcaagccccaaaggagaattcattagatgacatacttttaaagttcatggatcagggtcgggtgcggtggctcatgcctgtaatcccagcactttgggaggccaaggtgggcagatcacctgaggtcaggagttggagaccagcctggccaacatggtgaagctccatctctactaaaagtacaaaaaattagccaggcgtggtggcacatgcctgaaatcccggctatccgggaggccgaggttgcagtgagctgagatcgcgccactgtaccctagctcgggtgacagagtgagactctgtcttagaaaataaagtccatgggctggtcgcagtggctcacgcctgtaatcccagcactttgggaggccaaggcaggtggatcatgaggtccggaaatcgagaccaccctggctaacaggtgaaaccccaaaatt

SEQ ID NO: 18051 - DNA, 240 bp, Homo sapiens
aaatgtgttattaaattaagaaaacaagctaggaatggccactggctttgttaaaagagtatcacatctaactgatctaagcctcccttttgataaggtgaaaactgaaaaaggagcattagttaaaatctacctcaagagtaatgagcccatctttatgacatactcaggacagagggagaaaagtgatctaacttgaccacagtgaactgtctggaaaggtaattgagctgacaggat

SEQ ID NO: 18052 - DNA, 465 bp, Homo sapiens
agagggccttctccctccccagcctgcttctagtctgacccctactctccttttagactcagccccttctcctccaccctgagtccacaggccccggagcgctaagcacatggtgttatagttaactatttacttttctatcttttcctggaagacagacacgatggtagatggtaattatgcgtttaatgtctgtctcctgggacggtaaacccctgtgagtgtgggctgtgactgtcttattcaccactgtgtttttggcacggggcccagagtaataaacatgggtaacacttccacagcgctaactgtgaaccggccagaagtgtcctgagagccttacatgagtttacaactttaacccttaccaccactcagtgaggtactgtgatattatgagatatgtatttggtcttcctctgggttcctggcatacaacttctaaaatccttggaatctccaaag

SEQ ID NO: 18053 - DNA, 501 bp, Homo sapiens
taaatatcagtacaataaagaaagctagaaacataagtctaataatattggttggaagctattttaatgactatttaaatattttaaaggtgaatagtcaatgaaccaaacacttttgtaaggccactaagatgcatgtgtaatgtgtaatgcctccttttataaggagtcaatctgtaacatcacctgggctatttgacagcttcaaagtgaacgtgagaaggagagaaacagtgagagagatatatataaaaccagtaaaataaacataaagaatgaaggaaatatccaggcgccatggttcacacctgtaatcccagcactttgagaggccgaggcaggtggatcacctgaggtcaggagttcgagaaccagcctgtccaacatggtgaaacccactctctactaaatatacaaaaattagcctggcatggtggcatgcacttgtaatcccagctactcgggaggctgaggtgggagaattgcttgaacgtgggggct

SEQ ID NO: 18054 - DNA, 125 bp, Homo sapiens
atagctgccattatattctcataggcatctatgactgacccctcccaacatttgagaaccattagtcttaatctgtgctgaattctcttttgttaattctttcatgacctgaagttaaaaaaaaa

SEQ ID NO: 18055 - DNA, 597 bp, Homo sapiens
aaaacagactcttaaaaaataataatgcaaaaactcctatatttgaaaccatagtttaaaattataaagaaaataagagtctcaaatgatttacaagtgggttctaccaaattttcatggaatagaccattgtaatctactagaaactcctctggacaattgaaaaatagactatatctcaaacctttaaaataataatacaacacgtacacaaaaacaattataggctttccttatgaatgtctctctctctctctcatatcatgtaaaacagatcacatacgaccagataggtttatcccagcaatggaactatgtaaggatgggtcaatattaggataggttaacatttcatatataaatgccattcttcattgatcatctcaatagaaagagaaaaagaataaaagtctatacaaaaaatttgataaaatgtagcacaaattcttgataaaaattattagtagctaggtgcagtggttcacgcctgtaatcccagcactttgggaggctgaggtgggcagatcatgaggtcaggagatcgagaccatcctggctaacatagtgaaaccctgtctctactaaaattacaaaaca

SEQ ID NO: 18056 - DNA, 589 bp, Homo sapiens
tacttgatgtgaggatgggctggcgtcccagatgtcaaccctttaaggtcatggtcccccaggccctcctcgtttacctgaagaatccattggggtaaatccgaccctatgagttctaaaccttgtgaggaaagagctgcataaaattgctttgaaatggtcatggtggaagctcctccaaagcagctcattctggagggtgggattcctgagggcgtttgtttctacatcacatgtttctttaatgatttctccctcccttaacttcttccccccaaaaaaattacctttgtattaagagtaacaaagccagccgggcatggtggctcacgcctgtaatcccagcacttttgggaggccaaggcgggcagatcacaaggtcaggagtttgagaccagcctgaccatggtgaaaccccgtctctactaaaaatacaaaaattagccaggtgtggtggctcacgcctgtaattgcagccatatgggaggctgagtcaggagaatcacttgagcctgggaggcagaggttgcagtgagccgagatcgtgcattgcgccactgcactccagcctgcgtgacagagcgacact

SEQ ID NO: 18057 - DNA, 591 bp, Homo sapiens
accacagctagaccagtgggtgccacaatcactgtgtcaactatggaaagggcagctgagatcacatcaaagattccggaaagaattggcacaggatcattcgggatccatctgtcccttgcccctgttcctggctttccttacagctctcgacttcctcaaaggagtcatcaattcggggtttggcttccattcctattgaggaagctggaaagcgtttcaaaaatgctcctccgatgtgcctgtggttaagacctctgagctctgttgaaaacttttggaagctgggagcggtggctcacacgtgtaatcccagccctttgggaggctgaggcaggcaaatcacaaggtcaggtgttcgagaccagcctggccaacatggtgaaaccccgtctctcctaaaaagagaaaaaaatgagcctggcgtagtggcgggcgcctgtaatctcagctactcagcaggctgaggcaagagaacagctggaacctgggatgcggaggttgcagtgagccgagatcactccactgcactccagtctgggcaacagaatgagactccgtctgaaaaaaaaaaaaaaaaaaaaaaaaaaa

SEQ ID NO: 18058 - DNA, 501 bp, Homo sapiens
  misc_feature 312: n = A,T,C or G
ctgtcagcaacatattactattacaaactctgtaaacatgcttctgaacaaaatggtgtattcacaaaaaattttaattacttaagtcataaaaaatcagtctagcatcaactcttctgaaagtttggttctatattaaaacataaaaattagctgaagagacatcttgctaagcttctcagtcactgaagagcaagtcaagaagtccacaatattcttaccaatatataaacactggaaaatgttccttctaagcatgataaggatgtgaacaacagcacctctctaatgactaaaacttctgttcctcanaaaatacatcattagccaacaactttctggcagaagttgcctttaattggcatttgtacataaccaagtgttagtctgtatttacaccgtaagttaatttggacaaaattaaaagctaattgatcacatatctcaacctcagtcataaatagtgtgggcccaaatatcagtctccccatggatttatgc

SEQ ID NO: 18059 - DNA, 454 bp, Homo sapiens
gtgggggcgggtggtgtgggtgtgtgtgtgtatggttgtcactagaacaaattgtgcagctgtgtaccttggtatgtcaaggttaccatgatttataggttgtatgtccaagttcacaacaccaagagaggagggagaactgcaggaggaagtcttagcgacagggctttaagaatgtgtttcatgtttaatgcttttaacatgggtgccttgttcttgcttctagaaagcactatagaagatataaccccaatccagattgctgtctgtagctggccaaacccatgtgagggtgaaggtggggtttgtgtgtgtgaatgttgttatggttgtttatagttgttgtgttatatctgagctgtaggagagtattttacaacaagaggtatgagttctgtaatcccagcacttgggaggccgaggcaggtgcagcacttgaggtcagtagttcaag

SEQ ID NO: 18060 - DNA, 546 bp, Homo sapiens
aaatacatgtgaaaatcaagatctaaatacacatttgaactttagaagaacttaacttacatattgtaagatgaaaggtttagtttctaattaaagcaaatttggttttgtaagagtagtatgtaaaacactgccctggccctgtgcggtgactcacgcctgtaattgcaacactttaggaggccaaggtgggcagatcccttggggtcaggagttcgagacaagcctggccaacatggtgaaattctttccgtattaaaaatacaggccaggcgcggtggctcacgcctgtaatcccagcactttgggaggccaaggcgggcggatcacctgaggtccagagttcgacaccagcctgaccaacatggagaaacccgtctctactaaaaatacaaaattagccgggcatggtggtgcatgcctgtaatcccagctactccggaggctgaggcaggagaatggcttgaacctgggaggcggaggttgctgtgagccgagatcgcgccattgcactccagtctgggcaacaagagtgaaactccgtct

SEQ ID NO: 18061 - DNA, 608 bp, Homo sapiens
tatcacagtaagaaaaatgggagtctgtagtgttttgttctggaagcgacttctgcaattcttctccctagtacagaagttctactaggttgggacaggcagagcagactagtagagcaagaagactttactggaagcaaagcaagaaaaattattatatacccagaattgtcaaagattatagcagtaccaatgtcaatcaggaaagaccaactttacaattagccattacaccagttcagtcaaaaagtacaattgcagaaaagtcaaatatttagaatgtaaatgaaaggaaagagacaaagattgtcttaacattctacttatcccagccttctataaaacctgtggacacacaaagctaataaccttaagagagaccagaagggacctttgtaatctactcttccatggataaacatgtacccttttgaacaaagaaagtaatatgtgtgaaacacttctaaagtctgagtttttaataaattctccaacctagtcataattcaattggccgatgatgaaagccattgttgactaggcagtgtttaagctccaagtgttaaagcacaacttataactaatcataggctaaaaaataagctatg

SEQ ID NO: 18062 - DNA, 528 bp, Homo sapiens
gatcaataggcggagggaaattgtttctatatgcacttattaaataatttttgttaacaaccctgccctgggataaaagtgaatggaagtacatgactgagtaacagtaattaattctttgccctgatcgtttatttggggactgtatatgctttcttgactgacaatagaatgttgtattagttttcattgtgtctttatttgcagttcacagcacttttgttttgcatatgctacaaactaaaagtttagcaattacgttatattccaattctggagtccagattgtacaaattagatgaaattctaattcgtcattttaggaagaaatcaattacctaaaattactggctcttttcaacataccctttagtatgtaaaaaaataagcttcaaatgcgtgggttaaagttaactatcaatcccagtttaagaatgatatttctgtaagaaaactgctttattttccaagtcgtagtatttaacataggctgagtcacaaataagttttttaattgtatcttaatgc

SEQ ID NO: 18063 - DNA, 609 bp, Homo sapiens
aaatacaaaacgaaattagccaggcgtggtggcgggcacctgtagtcccagctacgctggaggcttaggcaggagaatgcgtgaacccgggaggcagagcttgcagtgagccgagatcacaccactgcattccagcctggacgacagagtgagactccgtctcagaaaaaaaatagataaataaataaaataaaaataaataaataaataaagagagagtgagaaactggagataattataaaataaaacaagcagaattttattttctaaattcagtcattcagttgaagagcaggtgtcctctccccacatgcacaatcaatgctatttcttcactctaaatgtttcagtctcttacctgaaacatgtaatattactctaatagaaacagttttctcggctggccgggtgcagtggctcacgcctgtaatcccagcactttgagaagccgaggcaggcggatcatgaggtcaggagatcgagaccattctggctaacacggtgaaaccccatctctactaaaaatacaaaaaattagccaggcatggcggcacacgcctgtagtcccagctactcgtgaggctgaggtagaagaatcgcttgaaccc

SEQ ID NO: 18064 - DNA, 166 bp, Homo sapiens
gatggaagaccaaccaagagatcaagctatctctgcgaatcaggacctcaggctcatgctacagacccgggtatattttcttctcctgtttacacaaatatgcaacagaacttgctgcaaaattgcttgcaagaaaaagtaacttctgaagaactgaatattataa

SEQ ID NO: 18065 - DNA, 409 bp, Homo sapiens
attattaaagctagttctgctactctagaatggcacttttacatgatggcttttccaatatttgcaactgtggtaatcttaacttttctcttctccagatgaaattttgtctgttccattcagagcttcctctcgtgttttaattccaggcttcttccacattctggtcacctccttgtgaaaacattctgattcagtttatccttccagaactgaaaacacactactaattctgtagcccgagctaagtataaagggacacagcaagggtttcctcactttgcgtaatagtggaggactgaaaaatgactgtgaaacctgaaataatgcaaagtgatcctagtgggaaaaatgatgatcattctgagacctttataaactgctttttttttttttttttttgaaaagg

SEQ ID NO: 18066 - DNA, 542 bp, Homo sapiens
gcagcgtgatcatgggaataccgcttaacctcaaatccttggctttctctgtaaagtaaatgtaataagatctccacagggtttgctgtgagggttgaacgagctcagtgcacatgaaaatgccctatacactcgaaaccagctataaatattggttattattgttaggatgctgacgttcaaatataaattgccaaaatcatttgggaagcattgcatactccattcccacatggagagttgcagggcatgtgattatctgtttgttcatttagtcacaatattgatcaatatagaacaaagcagtatattttaaaaatcaaccaggagcagccattctttgaagtgttatgcaaccattaaaaattaggtttggccaggcgcggtggctcaagcctgtaatcccagcactttgggaggccgaggcaggcagatcacctgaggtcaggagttcgggactagcctggccaacatagtgaagccttgtccttactaaaaatataaaaatcaggcgtggtggcaggtgcctgtagtcccagcta

SEQ ID NO: 18067 - DNA, 616 bp, Homo sapiens
catgtattaaaacttagatatcgcctcaccgtgaatgcatcagacactgtactgttctcaccactagggtgggccctctgcagccacaaatagaggagacagttggggataaaatcataactgatgaatagagagactgagtgcactagcaaacctgtagaaattctaggctcacaggaatagcaaaagacagcccactaaataaagagactgtcaagaagcatttcacacctaacatgagcaataaatggattcccatccaccaacaacgtttttcatgattttcctcatccacaggttcaatgagaagctttgtaaatttattttgtttaactgcagacaataatcactctcagggctgggcatggtggctcatgcctgtaataccagcactttgggaggctgaggcgggcggatcacctgaggtcaggagttcaagaccagcctggccaacatggtgaaaccctgtctctactaaaaatacaaaaatcagctgggcgtggtggtgggcgcctgtagtcccagctactcggaaggctgaggaaggagaatggcttgaacatgggaggcagaggttgcagtgagctgaaaatgcgccacatcactccagcctggg

SEQ ID NO: 18068 - DNA, 610 bp, Homo sapiens
ttaggtaaatggaaaggaataatagcctcaattcttatttccctcgcagccgttataggtgtacttattcttgtcgggtgctgtgtcataccatgtatccgtaagttggtgcagaggctcataaaaatggcacttactaaaaccttccttaactgtcctccaccttatccagagaagcttcttcttttagaaaatcaagcaaaataactaagctatgtttaaaaagtttgaaaagaaagctgtaaggaaatacaagaggaggggttgttagatatgaattctaaatttcttttcaaagaattaatatgtcattatgttcaattctttgccttctacttttaaacttaacttcctcgtaaagcaatcttttttgattacctactccaccctgactcattctgattacctgctccaccctgactcattccaatcacctgctccaccctaactcattccgattacctgctacctgctctgccctgactcccgccaaagcactcacctcgtcattctctttaaattagccaatcggaattagtttagcctgtgcagtctaaccctagccaatagggaaacaacacagcagcaggagccacatgcgtcagggata

SEQ ID NO: 18069 - DNA, 561 bp, Homo sapiens
tccttacccttcgagcagactgtgcaactttccagtcattcttactttccaacattaaaaaatctaagctagtcatatgttcttccaatttaaatcttctttctcccaactcagacctgatctcgtttcaagattctccggaggagaagggaaacaaggactattcttttagtatttatctcctccaacaacctgagatttaggcagttctcttgaggtttctttactgggcttgaggtaagggaaggagtttcagtctcttttcctgataattcttgccatttggatgatacagtaaagatttcagaatcagtttgcatccactttggcaattctttcataggtaatctaaaacctctttttggaataaagaaaaattatcacctattgttattagttttaggacattaactcagaccagaaaaatgtcctatttaataatttgttatacatattttaaattttaacagatattaataaatagtagtagtttaacaaattttcacttccactaaaattatatcaaacacaatttatcctcatccaaattttgaatctttg

SEQ ID NO: 18070 - DNA, 380 bp, Homo sapiens
ctgtattaaaaaatagaattggcaatggcttttgctcccgcttgagcttgccaaaaaaggttggaaatgagcatgcctcttcctgtctctcttggctctgctccctattaggatttgatagagacagaatctttctcttcctcaactttccctggagctgtaagtgggctaaggggtggagtttgggagaagggcaccacctttcacaatccagaagttagggatgtagaaatatcaggtgctggcgacaacattttggagcttctgagcaagttcccatgctgttgtttaatccttaatcatctctcttggcatacttcccattgctactgcttgcataaaattggaaggagctgattgcctcaatctgtattttctat

SEQ ID NO: 18071 - DNA, 142 bp, Homo sapiens
aattgtatttaatactaacgatctcttgaagagttcagatgagaggctaaactagctgtgtaatctaagctaaatcttgagagatgactgagattttcatgtttcaaaaaaggggacagacctgggagcagtaccaacactc

SEQ ID NO: 18072 - DNA, 559 bp, Homo sapiens
gaaagaataaaaataaatgtgaaacattcaatctaagaaatcaggagaagaacaataaaataaacacaagaacaaaaagagaaaagatggaatgggaattacttctggtcaagatactgaaaccatccagtggttccagacagcgacctttgaggaaacccctggaaagggggaggggtgctcttacacgcacacacaccccacacgtgcacacaccccacacgcgcacacaccccacacgcacacacacgtgtcagggagcacgtctgacatgccccgtaagatctccagaagagattagacagaaatggaagaaagcagtgtttgaaaaccaatgactgagaattttaaagaatagaaaaacaaccagccaaccaacctaaaatttggtcctaaaatttaaaaaacatactgattcctgagcaggattcagggaaacaaatccacacttagacacaacaatggtaaaacaggagcacctaacagattgggagaaaagtctaaaaacagcttccccaggccgggcgcagtggctcacacctgtaatcccagaacttca

SEQ ID NO: 18073 - DNA, 596 bp, Homo sapiens
agtattagagtaacaaataatgaataaacatagtggttactctatagactgatatcttcaattactgttcctgctttttgtaagcttttaaatggttcccattcactgaacacttatgtatccagtaaagtagataacataggtgctttatatacttcatatttgttagtccttaaatctgttgcagatattaatagtcctcttttttcagatgtgtaaaactgagtttcagtgtaaactgaatctctgagagattaagtcattttctcaaggttcagaacagtaagtggcagagtaagtgcaggattgaggctagggtctttctactccaaagcctaaccctgtccgtcccagagtgatacaatattataacctacgccctgatatttaacaaaattaaagcattcttgggaatacttctagttttcatagaaagatcctcaatcaagatcattctggaatgtgcagaagataaaaagaaatgggatggcaaaacgcagagaaagcaaggcaaatgaaagctacaaacctctcccttagataaatgtacacatgagccgggagcggtggctcacacctgtaaccccagcacttcg

SEQ ID NO: 18074 - DNA, 532 bp, Homo sapiens
tcctctttttttgtgaaatgttttaacatgacttctaagacctaaatttatgtaacaactacctgttttcccaatccttcattgtgttaatcattcacatgtgctcattcttttttatagaggcttccatgggtgatctcctgaacacttcatccttaccccttgcctttttgaactcatggtatgctctaggcctggattccctgcccatctcccttcaccaataaacattaaacctaagctcctatccctcatctttgtcttttatgaggcctactcttgtaataacttcacggggtaatctcacagccaatgcctttgtcattcattctttcagctatttccccccttcgattattatgtaagtatttctccctgagtatcttctaaactaaaaccttcccagcatttctatgtatcttgtactcaaatcatccagcaaaatgctggggttgtggaagaaatgtatgcttagacgcataagcatagatgcattgatagatgaaaatgtttgataatgagatactctaat

SEQ ID NO: 18075 - DNA, 644 bp, Homo sapiens
tagtgcttaattgtctcattcaactataaaattttaacccatgttgggagttaaatatctgggagtgatagaacccatctgataaagcactggagaggtgtggccagtgaaacaggaggggacccatcagggaagaggggcagcttggtcagtggaaagcacagggcgccacggcaaactgcccgccaaatccagacaaaggcttggcaagcaggaggggaaactcagataaagcccaggtgcatttcattcaaagcgtgggcagacgataacaatgacaaatgcagggcaggcggaccacacttgaaaatgtaaagcatgtaggccaggcatggtggctcacacctgtaatcccagcactttgggaggcagacgtgggtggatcacttaaagtcaggagtttgagaccagcctggccaacatggcgaaacctggtctttactaaaaatacaaaaattagccgggcttggtggtacacacctataatcccagctacttgggaggctgaggcaggagaatcacttgaagctgggaggcggaggttacagtgagccgagattgtgccactgaattcgaacctggccagcagagtgagactcgatctcaacaacaacaacaaaaaaaaaaaaaaaaaaaaaaaaaaa

SEQ ID NO: 18076 - DNA, 508 bp, Homo sapiens
caaatgattgctaaaggatgaattaagatatccttctcattagcccaagtccattttttcagtctattaacttgcatatatgaaagttctagcaatataaaaccacattttgtcacatgctcataattttggaattagggaattttggctccaaaagccatgaggctgacagatagctgtagtaattccaacaaatctatatttatgtgtttctcagaagaacatcgagcatttacattttctaccacacactccctatctggttgatgaagtgaaagtcaaatttggagggatgaagtacaaaatttacaggacatctttaggattccaaaaattatgaagagcaacttcaggtcatataaaagctattttataatgaactattttaatatgaaaaagagcttcagaatatcttctatctacttaaactggtcaaacacatagtttagttaaagaacacaaagatgtgtgctgttcagaacaaaattagtaataagaatgtgctatg

SEQ ID NO: 18077 - DNA, 586 bp, Homo sapiens
tcagggaagttagaaaaacaacgcccaagtagatgtgtctggctgacctacctcctggactatccaggtggaggagaagcatacatctcagatatctgcaccaatactttcagcatgtaaactgatggaagacatcaaacaatgcatcaaagacatatacccctctcatgaagaagagagctggctgctctagataccacagccatctcttctagcaatctctgccagctcatttccagagcatctgaacacaaccatctacttcctaaatcacaacatggcagtgactagagctgccaccatccctttctacctgtcagatgcagaaggatgcacagccaacagtaacaggaccacagagctgtttctctaatatcacaaaagctttcaatactgttaatgaaatggctctagcagccaccaaagaaatctgctactggactttgttgtccaagaaatatgaccttatggtactgaggtcagagaacaggacactcctcagcactattcagtcaacaaatattagtgaaacacagcactgtcaggtactataaacaacagaaaagacaagactcaacctttatgt

SEQ ID NO: 18078 - DNA, 567 bp, Homo sapiens
attgagacagagtcttgctctgtcgcccaggctggactaaagtggcacaagctcagctcactgcaacctctgcttctcaggttcaagtgattctcctgccttagcctccaaagtagctgggattacaggtgcccgccaccacacctggctaatttttatatttttagtagagatggggtttcaccatgttggccaggctggtctcgaactcctgacctcaggtgatccgcctgcctgagccttccaaaatgctgggactacaggcgtgagccgctgagcccagcccaaccctagaatttaatagtgaggggaaactgaggccgcagatatggaagagacaagcttgtcccagaacgtttctcatccttctcatgcagagccttttctcccaggtcatgttctttattgaagcatcacttctacaggctgcaagacacagaagatcagggaccaattgataggagcaggagcaaaggaagtaatattattttgtggcttccaaaaccacaaggaatgagagttgcaaaatgtgttcattcaatccattcaacaattatttattgagta

SEQ ID NO: 18079 - DNA, 487 bp, Homo sapiens
aagaataaaaattaaaagtagttaaaataattgttaagacgagactacagttgcctgaggaaaactagggatacacattaactcaatgatggtaggtatcacctggactgttgtctcttgctgtcatctgcataagaagtgccatctgttttcgctcagagagtggataaccaaaaagaatgctaactggtgtggatttcttatttccagcttccttttttgtcttcttcttttctggaccttctttctctggaattattaacaaatatgtaagaatttgaaacaaatccaagtactcaaaagcaagtttaagatgaattttttgatagatgctgtacatatatatgagaaatgtgtacaatatatgaactagtagtagccagacaaaagcacaatgggttttatattatataaacaattttcttcctgactgctttgaaaaaaatatattcttaattccactgttttcagaaaattagtaatactt

SEQ ID NO: 18080 - DNA, 587 bp, Homo sapiens
aaggatgctgaaatctcaggaaatctggaggattgaggaccagtttcagggatgccaagaagcagaggtggttaattgtggattagggcacaacagactgtgttgaggactgttgtgagctatgccacaagtcattgataactagacaaaaatcatttacctgattacaataaattacaggtattcaaggttatgcctataaaaagagttatctcactcttgtgcattcagtttgctttctaaacaggcacggaaatgggtggaacagcagctagctccctggatgtttctgtatttgggaaacaactatccctgctgctggaagtacacgcatgcccacaactgcacacacaggcaagcacgcacagaacattccacagcccaggccaagctcctttgagacaatgaagtgcaaggtagccacctgaagagaataaagccttaattaaaggaggaggaagagaaagaaaaggtctcaatggtgtgatttaataaaggccaagggacccactgccttcactgcactatcaggtgggaagtacacagcctcatttctaaaattctaataagcaataagcagtcttagc

SEQ ID NO: 18081 - DNA, 392 bp, Homo sapiens
tggatacattaattcacttgagtgtggtgatcatttcacaatatacacatatatcacaccatcaagaagtacaacttgaatatgcacaatttctattgttgagtatgttgcaaaagaaagcatgagggaaggaaatataactttatcttgctttaccaaagagatgttcttggaaacatgtatgcaaatcacatttattaccaatcaaattacaaataaatactactatttcactttaccactgaaatttatttatttactttgcagaagtgattgaggaaacatacatgaagtgcccactttgagctaggtagtagacagtagagataaacctggctaaaacatgatccctctgcacaaattgatatctgaaccaatgtgatcattcagct

SEQ ID NO: 18082 - DNA, 501 bp, Homo sapiens
ttgttcatgggacagagggaagtttagaggcaactgaccatttggagctttaggacaattgatggaagagggcttggcatctggatgagaagtggggtaattttccttgcattttaaactcagaccacatatcacatcagaatcacctaagggagacattttcaatgcatattcctgggtttcttctcttggaaatttttatttcttaaatcttgagttgtgctgatttatccatatttatcataagaattttggataattcttactttgggaggcccaggcagtggatcacttgaggtcaggaattcaaaaccagcctgaccaacatggtgaaacttcatctctactaaaaatacaaaaattagccaggcatggtggcacacacctgtagtcccagctacttgggaggctgaggcaggagaatcacttgaatcagggaggcagagatgacagtgagctgagattatgccactgcactccagcctgggcaacagtaagact

SEQ ID NO: 18083 - DNA, 655 bp, Homo sapiens
gacatttctgagttctgttaaattattatgttctttcaagatagaaattacttccagaatttttcccctttgcctgaaatactcttcgccctcattatcttactgtctttctctagcaaatttcctttcctgaaggaggtctcccctgacaagaattacacaagggtttccctccccttacattgttttatttttttcatcacagtatatctatcacaaataataacactctttttttgttcagttttgtctccttcactagaaattaaacttccagaggtcatggtgtttgtctttttccttggtatgttcccaatattttacaatcagccaagcctgagtaaataattaatgaatgaacaaaattatatccttaagtattttatagtgtaaattttaataattcctaaaataaaaacctagtggaataactggcaagatggcaaaatagaagtttgcagctcttatcttcccaacaaacatcaatttcgacaactatacaaggatgagagtatttttgagggagaataggaggccagtagagagatgccagcaccctataggtgtctattctaatctatgaatagacacattgaagagggtaagagaacagtttcactatatcctcatcacccctccaccaaagcagcacagc

SEQ ID NO: 18084 - DNA, 485 bp, Homo sapiens
tgtttactcagcacatttcatcctcagctaccaaaggtaagttattgttttaggtcgttttccagtttctatttagcctaagaactccacccaagttagaaaagaataaaaatgaggtaaaaataaagcagcattatgaaacttaaaaaagggaaaggtcacacactaatgcttttccatcctgggcactggggactggggtgaaggctggggggtccattttcattattatctttgcatttacaaacacagcctccgacgtttagtatttgctttgaatgaggaaccgagaaataatgtccaagatgagttcaaaaagaggtgaatctagtacttggtagctaaagtaataatccagttgggctatattactctgggtattaagaaacaatagctaataagaagtagtttcagccaggcagatctcctgaggtcaggagtttgagaccagcctggccggcatggtgaaaccctgtctctactaa

SEQ ID NO: 18085 - DNA, 473 bp, Homo sapiens
cattctaaacataaatagaaaaagtatccataaactgatcactaataaaatagtgtacacacatataagacacatgaacaatcaagattttttccatccgaaaatggagatataatgattcctcattgccagtagtcataatgcctactgcatttgtaactcagacccatattttttccttttggctcttccaaaatacattctgcacctaggccataagcatgcatttgtagattcatagcttcaaattttggcaatttgcaaaaccacatggccagatttgggccacttctacttagttgggaattccatcatagaaatgccagtcagggtgccgaatgaacctactgttcttttcttgccaacacagtggttgagagccggtatgtgctatctgtctcggttttatagtctggtacaataatgtcatgtttgtctatgtgattaagacattgctgcagtgtacagcacca

SEQ ID NO: 18086 - DNA, 304 bp, Homo sapiens
atatttaccttttaaagaatattgtgagcaaatatatatctagcataaacagctgtgttactacacacacacagcaaatgtcacaatactgttttagagttgcattccagagagaaatatttcaaggacaccatggcagttgacgcaggtgaaaaaggaatggtggctactacgtgaagagaatttttaaatccaaatatgcgcacaatgttcaaataccatagcagcacagagcagctgctcagggaagtcttggagggttcttactttaagtttattcggcccttccttttctatctttcta

SEQ ID NO: 18087 - DNA, 353 bp, Homo sapiens
  misc_feature 8: n = A,T,C or G
tacggctnggagcagtgtccccctccaaatctgcatgtctgaaagcattcatgcaggttcattgcatgggtctttgcattttacttagacttagcaaaaatcaggtatagtctttcctgaaaacaaaagtgaccattgtttttaatcaactgcagggtgtttggagttgtgaaatatttagggtcccgagtccattccagattcaacattgggaaagaatgagaaagctgaagcctggggcaggctctgtctgcagaaaccatgggctatcaccccctctccttagcagcattgtaaacaaacgtcatttgtaaggagcatgtcccaactgagcttgtaattataggggcaag

SEQ ID NO: 18088 - DNA, 631 bp, Homo sapiens
gaattgagaatataaaagtgggtacatgttgttccaaattagtgggaaatttatattgtaggctctaggtgcattttgctttagaatgagactcatcaataatatagaagacattccatagtataagagaacaagtactgtgacagattctcctaataacataaatttgattttttactgattttaaaattaaatacattaatatatcactaaaatagctagagatatgtaatttctaaaagtaaagcatactattattaatataaatattgaatatgtataattgttgtctggtaaaaattaaaaatacagtaataagtacataatacatataaaaataaattctatggccgggcgtggtggctcatgcctgtaatcccagcattttgggtggccaaggtgggcagatcacctgaggtcaggagtgcgagaccaacctgactaacatggtgaaaccccgtttctactaaaaatacaaaaaattagccaggcatggtggcacatgcctgtaataccatctacttgggaggctgaggtacgagaatcgcttgaacctgggaggcggaggttgcagtgagctgagatcacgccattgcactccagcttgggcaacaagagtgaaactctatct

SEQ ID NO: 18089 - DNA, 642 bp, Homo sapiens
agatcaatttttatttttattgggcaatttgaaaaatgatctgtatcatagtaagaatgatttcttttacagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacacgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatcta

SEQ ID NO: 18090 - DNA, 511 bp, Homo sapiens
tccttctctgaaatgcagctgagaactggtcagcctcactcccttgctgagaccaatagcaatccctgatgatctcgccacaggtccagcaggtgccccatccacactttgtccccagcccctaccaggaagctccaaacacctacctgaggggccaactgtgattcccaaggaggtgacacctcctgccccttgttgatagaacattgataaggaaataggactgagttttaagcttctttccatgtcaaatatttaaaggcaatataatgttcacgtttaaataatatttcatgtgtaattaaacaatcccttattgttaaatagatgggttccaattttgaactgctataatctgtgtatgtgtccttgattaatccttaagagaaatccctagaaacattatcttagggtcaaatggcttggatattctgtaaactgctgataattatgggaaattgccttccaggaaggttataacaatttgcctgatccccagcagcaacagact

SEQ ID NO: 18091 - DNA, 400 bp, Homo sapiens
ccgaaatatataaggaactcctacagggagtgcaacttgtagtagcaggctaacccttgcagtagtaggttaaccaagatcacacaactaactaaaggcagagctgggacttcaacagagtctattgacaccaaaatctttgcgcccttaaaaccttctcaaaacttttgggaagggctaacttttgaggtaggcataggaagaggaactagtgaaaagtggccaaggcagagtttcaaggaggtaggaaacctcggaattactgataatgaaggaagaggacatcccaagtggtggtacagaaggggctgttcagggctgtctcaaggagagaacaaaagagtgagtgtcgcctgtaatcccagcactttggcaggctgaggtgggcggatcacctgag

SEQ ID NO: 18092 - DNA, 564 bp, Homo sapiens
gcatctagaaaggaaggagggatgcaccctcatcccaggcagaggaaggaggaaaggacaggagggaattgtaagagggaaagaaccatagctatttctaagtgaccagagcaaaaggtgggcagtgacaatagcaacagagaagactgagagctagaaggacccagtgtccggttttgttttgttttttaaattaaaaaaaaaaagtttttgggggccaagtgcggtggctcacgactgtaatcccagcactttgggaggccaaggcaggcagatcacctgaggttaggagttcaagaacagcctggccaacatggtgaaaccccatctctactataaatacaaaaattggctgggtgcagtggctcacacttgtaattccagcactttgggaggccgaggcgggtggatcacctgaggtcaggagtttgagaccagcctgaccaacatggagaaaccccatctctactaaaaatacaaaattagcttgggcgtggtggcacatgcctgtaatcccagctacttgggaggctgaggcaggagaatcacttgaacccaggaagc

SEQ ID NO: 18093 - DNA, 553 bp, Homo sapiens
aacacattaaaagccagagttcagggatatcagagctagagaaaaactgtcaaaaagcaaatgcagagagccttgaggttatgtgtggaatacccacgaggaggaagtccttaatcagttatcttgcaaagactcagcagaacctgggcataaacccagacttgagcaaacactaagacaatggctcctgcaagaactgtctcctctcaatatttggagtatgtcagatacagcagtgcctttcagaatgtgcctaacatccctaaagaatttgaatatgccactctttttttctgatttaaaattttcttactgttgcaaattaagaaattaaaaagatgtttaagattttccataaaaataccaccccccaggaaaaactatagctaatatttggtacaaaattagggtcatatgctgtgcatttattacagtacatcatctgcatctttccatgtcaaatttatatatctattttttaaattttctttatcaaggtatctaacaattacagttttgagaaaagcaattaaaatttcttcctatctgctag

SEQ ID NO: 18094 - DNA, 536 bp, Homo sapiens
gaactatccttatagtttctttttctgtttccttgtgtatttactcttgcatctgtcatctgtattttcctcatgttctgattcttctttatttaccctcttgcctgcctaaagagtttcatactaattggattgttattattattttcaatgaagctatttgttgaagaatcacttggggagaaatagaaatagtaaaatgagccagtcagcatcttcttggaattgctgttgcaagtatcctcaataagtttattttcctttgtcctgggggcaactttcctgtccttgttattgttgttaatgtaagaggtttattgaagacagttttttggtcacagctttctgggttactatcactttgtacttttcttccttgatcctctaagacaatgaacttacaactttgtgaccagctcagtttccccttcagctccacgttcatttgtattttgtgatctcagacaaggttttaccagggtcttatccattctctcagggtcttatccatatctatgtgatatagatatactcct

SEQ ID NO: 18095 - DNA, 537 bp, Homo sapiens
tgagccactgtgcacagccctattaatttatgattaaagatatgtggctggttcatgacccaaccagtcatctactcttagtgagtccagctaggggcaggttgattcagtagtataaaatcagaacggatggaatcagatgttcctaagaaatatttccagcaaaatatttatgggcagactacgttcagttgtgaggcagagaaaaacctcatatactaatgatgtcaagaagacagaaattagttttgtaaacgaggtccagagataagcagttcaggcctggtaaggtggcttcacattcatcaggaatctaggctccttctaacttgttgctccatcgtcactggcacagagtgccttctcctttatggtccaacagtgacaaattccagtcatggaattctagtcagcggggtgaagcctacattctagtcaggagggtgaaggaaggagatgggctcactcctttttaaggataagtcctataagttactcaggtcccactggctaaaatttagttagtgggttacacct

SEQ ID NO: 18096 - DNA, 572 bp, Homo sapiens
tagtcattttctatgttgctctaaaattattctaaactcctctaataaaaacttacaaagaaaccagacaaatgtgcatatggatatgactatgaactaggaaacatccagatgccttggaaaaccctaagagaagaaggaataactcacgatatgtggaaatgcaagtgagataggtgagctggaaaatatatcatcagtataagccttagatttattttgcataattgaataaaattctttaaaaataaaaaggtgagtgttttaattaaacttgacaagtgacaattaagttaaacataatcttttgtttacaatcactttgattggagacagaaggaaattagaaattaaagtttgttggctgggcacggtggctcacgtctgtaatcccagcactttgggaggccaaggtgggcggatcatgaggtcaagagatcgagaccatcctggccaatgtggtgaaaccccgtctctactaagaatacaaaaaattagccgggtgcagtggcatgcacctgtaatcccagttactcaggaggctgaggcaggagaatcatttgaacctggga

SEQ ID NO: 18097 - DNA, 561 bp, Homo sapiens
tccaccctggggaacagagtcagactctgaaaaaaaaaatcctatgagattttgtagagtctattgatgaagatttaccctgggtgtggatgaccaccacccacttatgcctagtgttccattattggaacgctaagcatgtgggaattacttatatcctagtgctcaaggtcatcaccaaggtctaattgcaaaaattcaaaaaattgcaacctcagacataaatgggttaagggaagaaatcacaagataaaagacctcttctgccttatcctcaattgccaccaccatggcctttgctcgtatacaacttagttttactcatgagcaccttttacttctttatgccccatacatactgctttgccctataataattttcattcttgccttgactagcttcaaaattttgtttaatgagcatcaccttttgagtaattttcctgatgttttaataacatcatagcaatcttaacagtattctataatcaattatttaattgaattgatgttttgcactatatcctaaactcaaggacagtgatcatgtgttctttttct

SEQ ID NO: 18098 - DNA, 556 bp, Homo sapiens
ttccctatgttcctcacaacgtagctagaatttgtggtggctttatttctatgaaagctattccatactttcaagttgtaccctttctgattatgtttacttcagtcaagtctaaattatatggagtttatttgtgcacctacttaccacttattcgaaaagcatttacaacaaaacaatgcctagggagggttcccattagacccatttttaattacctagttgtattacttttgtggaacagatactgaaattgggaaagtgattggtgagtacttaaagcctttgaataggagatgagttatctcaaaatcactcagaatagttcaaaatacatggctccaaattggtagtatgaatcaaagatcaattataattatcataataaaataacattatttttaatttccttaaacaacagagaaaatgaagtatagaaatggccgtgataacagaaatcaaatcatgtgatagttacaagaattagtacaggagtgaaattgaagggtcttggtgactctttgagcagatagtgatgtaagaatcaggataaaaa

SEQ ID NO: 18099 - DNA, 603 bp, Homo sapiens
gctcattcaccacatttcaaccatgcttgccttttctctgttctctgactgtgctgtagggctcatgcccatgctgttccctgtacccccaaatcactgtaatgctgtctctttcttgttgctcatatcctagttcaaacctcctcactggccttccctcaacaacccaatttatttttttattttttgtttttttgagactgggtctcattctgttgcccagaccagagtgcccaatcatagctcactgcagccttgacctcctaggctcaagccatcctcccactatagcctcccaagcagataagactctaggcacacatcagtccattattttttgtaaagatggtgtcttactttgttgcccaggctgatctcaaactcctgggctcaggtgatcctcccacctcagcctcccaaaatgctgggattacaggtgtgagctacaactcctgtggcctgaccacccaatttaaatcagttcctcttcctgttttcttctttcacatcattctttgatatctcaccacatgcctgtttgcctgctatctttcaccactagaatgtaagtgccataagagcaaagactcctttggtcactct

SEQ ID NO: 18100 - DNA, 614 bp, Homo sapiens
acactggcattgcagatgtaagatttctgtagtcaattcttattttctttaaaattgcttattgggttttcaaataataaaaaatacaaagcaaggtagattatagaaaataactaaagaaatagggccatttagcatctatcactagctgagtgacttttaacaagttctttagccttcctgtggctttatttcttttgctgtaaaaggttccacttgtgagatgatgcatataagacatgtaatacaatgcctagcacacagtaagaactcaatagacttaaattttaagtaaattaagccccataccagatgtgtgaaatacaaagaaatcatgactacattctatactgaatatagagaaaacttaaagcaataagatttttttgtaggtttaatggagagttatcaatagtattgctttctactttatatgaaaaataatacatgttgaaactcctgcaatcttcggttgaagtaagataaatatgacataaaggaagatcagctggctgctgacatggcacctcatgaggtggaaatttattagtggggtcactgggctctggttttgtaagtgaagaaatttgattttatgcagatcagaataattc

SEQ ID NO: 18101 - DNA, 617 bp, Homo sapiens
aatagagagggcaatccatgcagattgtgccacaagaactagggcatgttgatgagggaaggatgtggtatccacagagctgtgcagaaactgcttgagagagaaggtctgagtggacagtgtgcaaaataccttgcaagataacacctatttttatttctttgagtgagtttatctatttggacaaatccagtgggactgctaaggagtggcatgtaatggaaagacaaaggaagggagacagaaaaggctctaaaaataatagaataacagcaaatacttgctgaaaactacatgctaggcactgtagtaagcactttttccattgaattctttcagcagaccatgaggtattatcacatctccattttaaaatggggaaactgaggcacaaagaagatgtccaaggtggcctatttaataagtgccagagctaatattttaacttgaacccccaggctgtctgactagagcctgcattcttaacctacctctcctggctctgcagacatggtctctgccttggggcagccaagggccagcgtggtagtagggggaaggggaaggggccagctatggccaaatggggccacaggagaacacagaagtcaaatcat

SEQ ID NO: 18102 - DNA, 516 bp, Homo sapiens
aggctaggagttttgagaccagcctgcacaatgtaccaagatcccatctttgctaaaataaaaaaattaggtaggcatgataggcagctctatagtcccaactactcgggaggctgaggtgtgacaattgtttgagccaaggagttccaggtggtggaagtgaagtgacattctgagacttgtgaggttaggccattagaactcttgcagtttctgcctggccctgctgaacatgctctctaggagccctgaggccaggtgaggagtccaagcactctgcaggtgctcggcctaagcctcagctaagcctcaccctctggcatccacttcaagtcaccagacatggaagtcaacagccactcaaatactctaaaccaacccattcacagctgaatataattaagtgacttctgttcaggacgcctgaaacagaagaatcaccccgccagtccctgctcaactgcctggctcacaaaatcatctgtcagtatgagttcatgatgcatttgatctcaa

SEQ ID NO: 18103 - DNA, 563 bp, Homo sapiens
gagatcacgtgtgtgaaatgtctctgaggactgaaaagtgttaaatgtagcagtaagaactgattatcttggcaagagcaggtttaggggagtatggaaggtggaagccaactgcaggtgaggaagccgagtttatgttttattagttgatgggaaggagggagggaacaggctgggagattgtctgtcctttgtagttaggatccagcagctcagggcaagaggtgtggagggtccttcctcttggtggtcactgaagtcccctttggtggagaagaccaacccaggagagtctacatagtgataagggaagacactgatgatgaccccaaggggtaccaggcttaaaatctggattgagagagagagagccctgaaaaaggaatagaaagaatcctcagagcaggaacaccggctgagtgtggcctcccggaaatcagagagacagactgaaggaggagatcacgtgtgtgaaatgtctctgaggactgaaaagtgttaaatgtagcagtaagaactgattatcttggcaagaacaggtttaggggagtatggaaggtgga

SEQ ID NO: 18104 - DNA, 538 bp, Homo sapiens
atatatcattaatatttaactaaaaaaaaatcaaccatgagatatagaaaggggtgcagtggtttaatatgagagactagaaaagcagacaatctaccttaaaatctaatgaacatatttattttaatgcattagtacaatgtatgaatggtatcttaaaatgacttttatttaaagcttccataaaggaatatattaagagtctggaatatacccatgattatctggaaacagctggttccgtttcaccatcgtttcaagtgaagccccagttttgtgcttttctgccagaaataacgtcagcccagaagccctgaatcccaacagcactgaactgccggagttccacccagtgtgggcacataagtggcttcctcaacccacagaaagatgtgttgctaagaccgtaaggtgaccttttaacttcttcagagatagtttcagtcatgcatatctttaaactgctacatctcacccttgtttaagccattttttagaaaattatgagatctaatgttgtcacctagtctgaaatact

SEQ ID NO: 18105 - DNA, 532 bp, Homo sapiens
tgtaatcccagctactccagaggctgaggcacgagaattgcttgaacttgagaggcagaggttgcagccaagattgtgccattgcactccagcctgggtgacaagagcgaaactccatctcaaaaagaaaagaatagcaagcccgtaaatgctgaaaacagagctgatgattcaagttgcataaattaattgtataagtgagagaaaggtcagggacctggtgacagcatgtggccctgggctgaaagacggcctgctcatcccaggagggcccggggagctgggaagatgtgggtaacggcacgcccctgccatgctcctgggccttgtccccagccaagccaccccactgaggctgccagatccacaatgtgaggagacacaacttcacatggagttttcacaccttgtggctggaaaaagttctggatgcaaatacattctccccagagctctggtggattcgagcaggcactgatgtgagaggacgggaaatggaggaaactaaataggtcacagccttgatctcgtc

SEQ ID NO: 18106 - DNA, 618 bp, Homo sapiens
ggttgttttctaaatctgtatagtattcactttttttgtgccctgttttattttataatttataaattcacagcaaacaactctaactctattggaagctcaccgtaacaagtgctgtgataggcactttcatatgcatatctcatttaatcaacaagatatgtacactgtcacactttgccaccattggcttacatattggatatctcagcatacaaatcttaaattataagttgtatgttccatgaaataaagtgctgtttcctactcattataagttttaagttccatatctttaatttgattaaagtgctttctgaatgtctaaagtgtttattgagtgttttaaaatatatatggaatgtgaaaattattcaactaaatccatgatctatttgtttgaaatgtgaattttagcattacaatggagagaatcctgaaacctcataagatcttttgtttatgatcatatttatagatcagatacatgatatctttgaggaagaagaaatgtacattttatttacaaccacaaaccagaaattcctaattccttggaagaaaacaattttaactaagactcaatattatttgagggatgtgaaaaataagttatgt

SEQ ID NO: 18107 - DNA, 641 bp, Homo sapiens
tggcctcctgagctcaggcaatcctcccacctcagcctccagagtggctgggaccacaggtgcacaccaccacacccagctaatttttgtactttttgtagagatggggtttagctatgttgcccaggctgctctcaaactactgggctcaagcaatctgcccacctcaacctcccaaagtgttgggattacaggcatgagccactgcacccggcccatctggtcttattaaatacttcattctctgcaaatgcagatgttttctcagctctgattattttttctaaagtaatgaccctccacctggctagacaaatgcttctagcaaaggaaaagaccagggtgtgaaaactgtactgcaatagaacataaagcccgtccaacccccacctcccatcagacctggggtggtggcagcagcaggcatcggggctctcaggcctgcccattagtcatccctaaggcctgttagcacacaggttaggaggagcacacactctggaatcagaaagcccaggattgagcccagccctgctttcagttaaggctttgtcagtcactatcactcccttgacctaggacctcacaaaaccttgtcatctgtaaaactggggataataagttctaccttgagtgttatt

SEQ ID NO: 18108 - DNA, 580 bp, Homo sapiens
acatagatccagatgattgaaaaattcatttctctcctactggagaaatggttaaaggatatgaacacacaggaagaaatgtgaagagccaattaacaagtgcaaagaggctcaaccctgtgaatgatctgggatgtgcacacttaagtaggagagataaaacatttcacacccatcagatatgtatacatttaaaagtttaaaattactcagtgatgctgataatgtgccacagctttcaaacactgctgatgggcatttctgtcagcacagggtctctacagagccatctcccagttgccagtgtagttgagaatggactgtccaagaatccactgggctagtgtataccactgagaagctagcatgtatgtgcccagtgaaacaagtatagtacacacatgttacagtttcgttttaatgtgaaaatttacaaaactcttaagtgtctaccaacagtgaaatagataagtaaaaagtggtatagtcagaatactttatagcaatgaaaattaatgatctacagctgctgtgtccttgcaaaatagttcatttgtatgtgtgctattaaaaaaaaaag

SEQ ID NO: 18109 - DNA, 617 bp, Homo sapiens
atggtattaaactgcgttgcgcctcaatttggctcctaaaaaatggacatactagtgcatttcacataagtttgctgacagaatgaaatgagatactatatacaaagcacttatattgcttgagatctcacccgtttacaggtagttattatatcatgctacctcaggaagaggtgagactttaaggagtgagaaacacaaaaaatttattatcaggtttccaacttgagaaacaggtggttcaatttcccaacatttaaagtatatgttcctatagtatataaatatgtcatttccctcctgctattatccctttctcacccttgaggaggaaatgctataaatcaagtgacattccattgccccccacaaaaacaaatggatggacactcaatagaactggattggcaagtaactagaaatttgagattgagacagaaagtgtgactaagcattgctgtgggtatggtaggtgttaggccatgtaaactagggccttacatcattttttcttgacaatatactgtctctcaaataaaccgagcaagacaactgtcgtggagagtagcaggagagtaaaacagaaatgcagagttaagctgaaaggacagaacatg

SEQ ID NO: 18110 - DNA, 575 bp, Homo sapiens
aataatttcttggttaaatgtaaggtaagtagtcaacacttaaacgatgctacaggccaggcgcagcggttcacgcctgtaatcccagcactttggatcacgaggtcaggagatcgagaccatcctggctaacacggtgaaacccctgtctctactaaaaatacaaaaaattagccgggcgtggtggcaggcacctgtagtcccagctactcgggaggctgaggcaggagaatggcatgaacccgggaggcggagattgcagtgagccgagatcgcaccattgcactccagcctgggggacagagcgagagtccatctcaaaaaaaaataaagaaagaaagaaaaataaaaagctacaactgacttgaatttcttaactgaaatgactgactcttccctggccatggctacatgaagaaggaaaaaatactggagaaactactaagggaactagtcacatatacatttatctattaggaaacagagtttcgatcctagaatatattctatctcacttttgattatataataaaatacatgctttaggaaaaaattactagcaattcttaaccttt

SEQ ID NO: 18111 - DNA, 577 bp, Homo sapiens
gaacccagcatctaggaaaactcagcaggcttttagtgacttttccattcagcctcaatgcagaagaaaggcagtcttttgctcagaggcacaagaaagtgaagcatcaaggaaggaattctgaagaagtttttacaactttacatgcagctgggttttgtcagataaagaaggaagagaacactgcaggtgtaaagacaagatgaagaaagcaagaaggcgtggcgaacctatctggtacgaagtaagtagggcagtttaattaaagtgccagggaaaggtgcagaaaaagaaatccctattctggggcaagatttctcagtaggtcactcacatctcagttcatccagaacagtctcattttgtctctatcaacctggcacaatgattaatatctcctctttccgctcttgaaagtaactgggtttgggcaatatagtcattccactcaataggcaattcgagcatacagttagggcattaaaaaaatgcactcttggctgggcgtggtggctcacacctgtaatcccagcactttgggaggccgaagcaggcggatcacaaggtcaggagttca

SEQ ID NO: 18112 - DNA, 610 bp, Homo sapiens
accaccacgcttcaattcaatctaaatcaattcaacaaatctgtgctgaaagtataacatttagttttcttagacaccaaatgaacaatacaaaatccctcaagggacttagaacattcaagttttctatatctgtggttctaagtctgttaccaacttccaggactctgcttctttccctctgcccattaacaatgcggtgttaaaagtgacttcctaccactatgtttcttacagctgattcaaccactcatctcatagccaggcatgaaagaaaggagcatacccctaaccgagaactattttttagatggtagtcatatatttatttcatatttagtaagtattatttcaggtcttattaattaaaggaaaaaacttctctggctataagatgcaaggatgatatgtgaattcatgaattgttccatgtttttcacccagatacaagaaattcagagaacacttgagagatgctatgcaagatgaacatcaccaaggcacacagtcatcaaggtctatcctaaatatacatgcacgcaacatcagagcacccggattcataaaaaaactactactaaacctaagaacctgagcaatacactagtgg

SEQ ID NO: 18113 - DNA, 613 bp, Homo sapiens
tgtggtattatactgtgagaaaatccaaaatagagtctctataaatgtcaagattacctttaataaaatatgtgattaagtgacacattcagtatattatattttaatacttgtagagaactaattttttataaccttacacagaactgaatatcattttcagctttattactgaattcataatcaaattgtaccatttttctcctgattgtgtaggttctcacccttagtttaccctttgaattatgatttatcatctattttattatatgtagaaatattcattaattgactatatcatgattatatgtatgaagtaaaactagttgtgacagtgttgcaattagtagttttttcttggaagtatttcacagcgtttaatacttgtttgaaatggtttatatgaattaaatctgtacaaccatggggtaaaatgtaaacaactgcactattaggaagatattaaagtagaggctatatttacagtgtcgtctttcaaatctagctatgctgtaaactgatgtttgctgtatgctcctcctgatttgaaatagatgaaagaaaatgaacctattatcaccatggttcacacaatgattgagaactcggcgct

SEQ ID NO: 18114 - DNA, 614 bp, Homo sapiens
ttcccacaacctctgcctcccacgttcaagcaattatcctgcctcagactcctaagtagctgagattatgggcgcccaccaccagtcctagctaatttttatatttttagtagagacgggatttcgccatgttggccaggctggtctcgaactcctgacctcaggtgatccgcctgcgttggcctcccaaagtgctgggattacaggcatgagtcaaagcatccagcccaaggctacttcttcttagatgacgcacttcactctcccaaaatgattactatttctttggattatactttgagaatactttgagaaatgctgaactcttgaaatgagcattggtctgagagtcaggagacttggcctctagtcctggttgtatacaagtaatgttacctctctagacctcagtgtcttttccaaaatgggagggttaggccagagtctctcctccaacatctttttggatctaactatctacaattctatggcttctgcaaagtatactggaatcagtgtgctgctttgggagagaggtgggccagaggacctccaaatttctaaataattcttcagaatatccatcttttaagctacagatcttaaaacagaaa

SEQ ID NO: 18115 - DNA, 411 bp, Homo sapiens
tcagcgactggtgtgcaattctctttcaccccgtcagggtgagggcacatgtcaacaactctggcagggtgaggggaccagctgcgacctggatcatctatagggtggtggctcagcctctctaagcctcagtttcctcatctgtcaaatgggcagcaacaactatgtcagagagttgatgggacaaatgaatcaaccgcccgggtgtggtggttcatgcctgtaatcccagcactgtggggggccgaggcgggtggatcatgagatcaggagttcgagaccagcctggttaacatagtgaaaccccatctctactaaaaaatacgaaaattagccgggcgtggtggcaggcgcctgtaatcccagctacttgggaggctgaggcaggagaattgcttgaacctggtaggc

SEQ ID NO: 18116 - DNA, 517 bp, Homo sapiens
caagattgcttcccgccagatggcatgtggaggtgggaggcacatggaggccaaagcaggcgcacctggttcgggtgtaggggtaggcattccaagactcctccaccacccgcagggctgccttgggcaggatggagcggaaccagctgggaatgtgcatgcccacatgatacaccttgtgtgtgtactgcccagagccgcctgggccatctgtgtacggccggttctccaggatctccacgccgctgccttcgccatatgtctcgttacggctcttcttctgtggggacaaaagcacctgcaatgtgtgtggggccagagcactcttcaggagggaaggggcacaggagactgggcccaggggtgtggaaagggaggaggggctttggtcaacgaggctggctcctcctgtgtcacttccagggccccaaatctatatgccagggcttgtgcaagaggctgaaggggccacagactccctctcccagacctagtgctgcacacacaagtcctatat

SEQ ID NO: 18117 - DNA, 568 bp, Homo sapiens
tcctcacagtcctgacttgctgctcaccaatacaaacaaacagaaaaagattagtgagggtcctaagatagcatccttcaaggctttggacatgaaatgaagggggataataaaaaaagactcaaaaaaagacatgaaaacccacctaaacccacctttcttttctcccctacaaaacaaatgccttcaagtactggtggagggtcaagaaagatgtgcacccttagggcactagtgaaaatcaactgaagctaggagaaaagaaaaggaaagaaaactccctatatctcggggaagagcagtggaaaatcaacagaagctagggaaaaagaaaaggaaaaaaatctctctacatcttggagaaaagcaggaatacaactaggagtggcgtaggagcactgagaaactcataaccctaagaaatgagtcttagggcacagtatctgcctaaaacagatgcttaattagaactataataaaaatcaccccaaccctcaccacgaggatagcaggcatcaagtaacaatggtatactgcagggagattaagcaaaaaaggggagagaaat

SEQ ID NO: 18118 - DNA, 637 bp, Homo sapiens
atattaagtaaagttaaaatgctgaaaaagatcatcaaatttccaacatgaattgttctgtaaagcaaaatagaagataattaaaaattggcagggtgtcaccatttaatttcatccactgaatttaaataaccagtattttggccaggtgtggtggctccacctgtaatcctaacactgggaggctgaggcgggaggatcactcaggctcaggagttcaaggcaagcctgggcaaatagtgagaccttgtttttattttaaataataataaaaaataaccagtattttcaaattcatgtaatatggttaatactgtgctaagacataaagaggtacaggcaacccataggacatggcttcattctaaatggctttactatctagttaggagataatgctaacaaccaactaaggttgccaggaagtttatcaaatgtcatattgtgtgacgcagactttacagattatagatatctggaaatggggctagagaatcaatacttacttcattcattgaatattggttgagaacctattatgattctctgtgaataagagcgtatgttcggagtttgcaatctaatagagggagacaagggaaataactaatacagaataatttaagtggacaggtat

SEQ ID NO: 18119 - DNA, 244 bp, Homo sapiens
gcaatgatggtggagttaggatttagatgctactgtctctaaagattgatgttttctttgtttggaacagagtggggtgtgtgtgtgtgtgtgtgtgtgtgtgtgtgtgtgtgtgtgtgatactctttaaaacgcagggaagacacaggggtttatgtgcagggtgtacttgtcaggctctcactcttgcgggtctggcacccatctgactctttgtcaaagccatcactctctttgttaatga

SEQ ID NO: 18120 - DNA, 609 bp, Homo sapiens
ggatgacgtcgtggttgcggtgctctactatgcacaacaccgtggctacattaaaataaaagaagttttaagccctactccccgcacgaagcagaggaagggtgagcagggaggagatcctcctgtcgtgtccattctgagccttaagtatatttctgtttttcaaggcaaatagattctggtccacttttagaaaccttaatctcggtcttcgttgtgtctggtgaatacatgagtgaccagcaggtggtgccagagacagttggtagccagggaatgccctaactgtcctcggctgggatagctgaggtcactcactggctggagttgagcatctggggctcacatgcagacgtgatgggaaactggatccttttaatatgaaaaatgggtaactgtagagctaattcttattgtatattaatagatatttatcaggctgggtgtggtggctcatgcctgtaatcccagcactttgggaggctgaggcgggcagatcacctgaggtcaggagtttgagaccagcctttccaacatggcgaagccctgtctctactgaaaatacaaaagttaggtgggtgtggtggtgtgcacctgtaatcgcagcta

SEQ ID NO: 18121 - DNA, 652 bp, Homo sapiens
atagcattggtgtcatcatttatgcttatatctggcacttgttgctacaaaggtcctttgggatcgcatgctaaatgcaaagatagtaacatggtacataattgctacaattttgtttttagaaaatcatttactgtatttacttaacctaacattttaaataccccaatccagtatcaaaacaagattaaaccagcagttgcatgatttattaagctagtattgcagaagaactctccatgtaatctgaaaaatcaaatgtagtaggaaaaaaaataacttaggcaaacgtaaatgataatgttaaataaaagaatacaaaaaagctctccttccaacctgcacctgcattttaggtggactttagaagactgtggtgtttctgtaactgttaataagcattcataagaccccagaacagagcttcacagccaagcagaaatacataattgctacaattttgtttttagaaaatcatttactgtatttacttaacctaacattttaaataccccaatccagtatcaaaacaagattaaaccagcagttgcatgatttattaagctagtattgcagaagaactctccatgtaatctgaaaaatcaaatgtagtaggaaaaaaaataacttagacaaaaaaaaaaaaaaaaaa

SEQ ID NO: 18122 - DNA, 261 bp, Homo sapiens
gatcatacaatctagtagcctgttagaatatggagtatgacagacagattctggaagtcacattattagtatcaacctttaaagaagtacaaaaacataacccataatcaaaagagaataagatcaatagaagaatattttgaaataatcaaaccaaacatttaaaataactatgcaaaatattagataaatgatctattagaaagttacatggataaacagatgacaatttttaacacataaaatgaagatataaaaagc

SEQ ID NO: 18123 - DNA, 561 bp, Homo sapiens
gagctagaatgcctgccatttatcacccaagataaaactctcagcaatcccctcatgcaaatggaaccctgtttgcggaaaggattaatccaaattgttccgcgttgttcaaagtgtctctgtggagttcgttctgtctcgtctgccccaaacaagcaataaattatccacacgtgagccaatttcccaaccaaaaagagacaatgtgggcagaagcggacttttgatgcccactccccgcaaggggctgccccacctgggctcaaaatagcaagcaggtcacggagggcagccctgggcacataggacaggagtaaacacagccaggagattatgctgcagctggttaaccacaaggataaacaagcggacaaagtagggagaaacccaaagcactccacttcagtatttttaaatgacactgaaagcaatttcatggcttccatttaaaaagaagctgctgagacacagaacatccccaatttacaaagattccaggaaacagcctgagcttgtgattggagggggttacggcggtgaacagactacatggaaatgctt

SEQ ID NO: 18124 - DNA, 537 bp, Homo sapiens
caagcagtacttagttactgcaagtgctacttctaccaatatttttcttcctttctgcccctttaaagagaggttgtccctttttaatagatatatgacagctctgcttcctttcttaagtctaagatcaaagaaatgttgtaataaaggggagtcactccctcccattccttctctctttttgtggatgttgttctgttttttaagagcgatcaggtcttgacattagtggatgcagctgttgggctcccaagctctgcctttcatctctgggtcaccactgcagacagcatccttcatctctgtcatggtgtaaagacaccactgtgggggaacagtgcgttgcaggttaagtacatgaagtatttctagagatcctagccacctttgccgttcattgttgtttggatgcacttttctttgaaatgacatggaatgtttggcagagatgtcaatcaatagaagagtttctctgctttagaggtacctaaacctcaccaacttcttgtaaattggaagactagctccaaaaaagta

SEQ ID NO: 18125 - DNA, 575 bp, Homo sapiens
aaaactttcaagagagtattgcattatggaagggaagaagagagaacattttaaatgatacgcaatgctcaataatggtatccgctttggagaggccaagtaagattcctaagtacccattggatcaaggtccttaatcttacaaaaacttatacaaatcaataataaagagatgataacccgataatcaaaaatagacaaggcatataagaagaaaatgaattaaaaatattcaaagcattcaacatatacaaatgcgctcaatctgatatataatgaaagaaaagtaaattaaaacaacaatgggcatgactaaataacagtatgagggagcctgaggagaaggagcatttgaaatttcagtacagaagagaaaaggggtgacttatagaaaaaggagacagaaaccatagaacatgtttggaggataagactcaaacaggtagtggggacccttttctagagtaggatgaaaacaggtaatgtgtgtggatgcaaatatgaggtaggatgtaatgggaagttgagcgaattcatatttagtcattcattcaaaaatacttaattgagttact

SEQ ID NO: 18126 - DNA, 654 bp, Homo sapiens
tggcaaaccaaaagcattccaccatttattttaaaacttgtagtcaacacacatcagacttttatattgcctcaaataaaaattctctaaagaatcaaatctaaagctgtgctataaatttccctggggaagttaatcctaaagttcttagacatcaatatatgctcctgaccaaaggttggatttcagaggtcatgatgacatagattgataaaatcctgctgcgtaatccagccacgaattacgtgttgacattgataagcaacatttttcattgcctattaaataaaggtcatattcttcagcctggcattaaagatgaccccagtttgaatttcgaactttatttccctcgactctagccaagtggaacaaattgtgttctgtgcatgtcctttaatttattgtctttatggttttgcttacagctcctttcacttgtaattctctttctttctatatctgtggatcccaaacttatccagtaattaaggaccagtgcaaatgacatctccattgggcatccaaatacccaaagagctgaaaatgtactctttcaattatctcctagacacctgacaaacttcatctcatgttatatttatttatgtatgtttaatgcaattcactagaggtaaaccttcctgacggaaa

SEQ ID NO: 18127 - DNA, 606 bp, Homo sapiens
aggcaagagctcatgacaccagcttccatagactgcagctccaattgtttgtttgtttgtttttttgagatggagtcttgctctgttacccaggctggagtgcagtgacacggtcttggctcactgcaacctccacctcccaggttcaagcgattctcctgcctcagcctccagagtagctgggattacaggtgtgtgccaccatggctggctaatttttgtatttttagtagagacagggtttcaccttgttggccaggctggtctcaaactcctgacctcaggtgatccgcccgcctcagcctcccaaagtgctgggattataggcgtgagccaccgcgcccggcctgtagctccaattgttaaggaacagtttgtcattaaatcccctccctggaaagagcgttgagaggtgattctaatatgtccctgtgccttatatttaggatcatttccagaaaaaaaaatatgtcttttatcttaagtcagtaagcttaaagaaaaggaaaacccacaaaaacaaacagaaactcctgatgattatgctagcagaaaagtggacaaatacacaagcaggcagtttatatgaaaagaagtataagtggt

SEQ ID NO: 18128 - DNA, 584 bp, Homo sapiens
accatggggtgtaggtgtgagaagatgtactggcgtatggggcaatggaaatttcaataattctggctgttaacaattgtcatagaactctgaaggaagaaaattctagtctcggttttgataactattaacttagggcgcattttaaaaccaagtaagcctcagtaacactgtttaaaaagatttcatcaacacctgaaagacagatgttgctggatatcaaatacaaggtttaattaccagggttttggagttgggatgaaggctgaattcagagctccaacaagtcttctacagtaaagtgaggttcatgataagaagaaaaaactctaggccaggagcagtggctcacgcctgtaatcccagcattttgggagtccgaggtgggcagatcacgaggtcaggagatggctaacacggtgaaaccccatctctactaaaaatacaaaaagttagctaggtgtggtggcgggtgtctgtagtcccagctactcgggaggctgaggcaggagaactgtgtgaaccaggaggtggagcttgcagtgagccgagactgcgccactgcactccagcctgggcgacag

SEQ ID NO: 18129 - DNA, 628 bp, Homo sapiens
caagcagtacttagttactgcaagtgctacttctaccaatatttttcttcctttctgcccctttaaagagaggttgtccctttttaatagatatatgacagctctgcttcctttcttaagtctaagatcaaagaaatgttgtaataaaggggagtcactccctcccattccttctctctttttgtggatgttgttctgttttttaagagcgatcaggtcttgacattagtggatgcagctgttgggctcccaagctctgcctttcatctctgggtcaccactgcagacagcatccttcatctctgtcatggtgtaaagacaccactgtgggggaacagtgcgttgcaggttaagtacatgaagtatttctagagatcctagccacctttgccgttcattgttgtttggatgcacttttctttgaaatgacatggaatgtttggcagagatgtcaatcaatagaagagtttctctgctttagaggtacctaaacctcaccaacttcttgtaaattggaagactagctccaaaaaagtaaaaggggttggggggaagaacaaaacttttactggcaggtttttttctagacataaacacagttgaatggaaaggataatagggatcgaag

SEQ ID NO: 18130 - DNA, 122 bp, Homo sapiens
tatctgtgtggtttttaagtttttaagttagatacttaccttgtttttggacttttatatgtatctatgcattgaagccataaaattcctaagttgagcttatgctatattccatggcactc

SEQ ID NO: 18131 - DNA, 541 bp, Homo sapiens
ccccaaaccatttctgcatggcctccgtgggaccaggggctccccagctccacaatggggagagccccccagggtagagccttaaaggcccatgtgactcccaccagtcctcaccctgcaccacatggctctgggacctctcctgggtgcaacctctcttgttccctgccacacttctgcctcagtgcctttgatgaattctgccctctgcttggaatactcaccacgtccagacacccacctggcttacctcctcacatcctttcagtctttgctcaatgatcacctttcccgaggtctacaagacccctgtgtttaaaagagcaacttagcacacttcccttcctctgctttgtttttctttgtagtaattaccagcttctagcatcctctgtcacttacttatggatcatgttgattgtccgccccttcctcttcgaatgcaagctccccaggggcaagacttggttggtttttctcactgccacattcctggaatgttcaaagcataccaataggtatgtgttgaatgattgaaggg

SEQ ID NO: 18132 - DNA, 603 bp, Homo sapiens
actatcactagaacagcaccaaaaaacctgcccccgtgattcagttaccttccatcaggtacctcccatgacacatgggaattatgggagctacagttaagatgagatttggctggggacagagccaaaccatatcatggaacaagataaaggggcctttgcatgtcagaaatagttccagataccagcaagacagacagtttcttgagttggacttattttcagctttcttagcatctgttatatggtaaatagtgggcgcatccccattgaaaacaatgtgaaaggagaaagggaaaaaatagtgaagaaggcagcagcacgctgaagactggtgcatgctggtgcgtgtaaagttcagatggaatctgctgtgctttctagaatctcctactttctcactgtgttcagcaggagagaccctttttatcttggcaatcatatttcccatagttagtcctctccctaaccctgtgcaggcaaggcttagctgctcactccttcacactgttgccttctttgtcctctctgagtcagagttctgagcctgtcgcagatccagtataaaactccaccttctccacatcagttcacgttgagccc

SEQ ID NO: 18133 - DNA, 551 bp, Homo sapiens
gtttgaagtaaaatacagcaaccttacatagagctttataataagcttcatgtgttcaaatataattggtacttttataaccgatgctgtttgtgttatactcagaaagttatttcttatcgtaagattaccaatatagtcaccaaaatttttttttatagtttgaattaattttctacatttaaataaaacaagcgctgctgctgttgttactattcccttttaacatctccccaaattagtgttttattctgtacactttatgagatgccagcttaacaatacccttaatatggcccaaggattttacaaaaggaaatgctggtgtgtttgtcaaaagtgttttctggctgggcatggtggctgaagcctgtaatcccagcactttgggaggctgaggcaggtggaccacgaggtcaggagttcaagaccagcctagccaatatggtaaaaccctgtctctactaaaaatacaaaaattagctgggcatggtggtgcatgcctgtagtcccagctactcgggaggctgaggcagaaggatcacttgaat

SEQ ID NO: 18134 - DNA, 351 bp, Homo sapiens
tcactttgtggacttgggcacctgcagagtgcctggcatggtgagcaggagttggggcatggcgtgatctaggcagggtttggaaggttctttgaatagccaagggggacagtctggagggtgccctccagacacctgagaatgcattgaagctagggtgactactgcagcatcagaggcctggtgacacatttaaggcctcaaggggcccatgtgactagaagtccaggatgtggctgaggtgggccagactggatggccagcggccacctaaggacaattggctgtgcgtttgggaagcatgggtggtccccacctcacagcagtcgcacaggcagacagtgggcagat

SEQ ID NO: 18135 - DNA, 579 bp, Homo sapiens
atgtctgtatgaaataataattattatatcccttatatggaaacagatccagagaggaagatacactagcatgtgtaaatagaggattcaagaattaaacatccatctgtccaactgactacaagctctttcataaaatgctaatttctctcctgcttctaattttcttatcaaaaattgtcatctattgttatttttgggtctatgggtgggtagtgactccttggtttccattttgttctagcggattactgtctttatttttgttctagtgtttattgagagtcctaattaattaacctggctgctctgacttccatcagctcaccattgtctcttcttccagctcataatttctgtaacagagctctaggctatgctaaagttctgctatatgctgccagtctctctagatccaagtgcctcttgtcggccaagtttatatgcacgtgtttaaaatcttcttattgactctatatacaaagtcttcacatgccttcctccttaaaataatagcattgtgagaagaaaaaaaatcatcattctttttaaaactaattcaggatgtctatgtaatac

SEQ ID NO: 18136 - DNA, 367 bp, Homo sapiens
cagttatgaactagtctgttttgaagaaaatggtgatggaaagctaaaagtaatattttcactttattcaacaaatcttattgaggtcttattatgaatcaggggctctcctaggtacgggcatacaaaattgattaagaccatgcttgcgtgcagaaaacaaacagaaaagcatctctataataaaaaggaaaaagaggaatcccctttgtaggtttcatagtttatactgatatttctgatgtcgctcagagaattagtcacaattataggaactcagaaggcattccgtggagatgaaatagagactaaactagcagagattacttagtgaaatattgtgataccatttatttcaattagaaaa

SEQ ID NO: 18137 - DNA, 468 bp, Homo sapiens
cagggctatcatagtgggctttaattttcctgtatgtctaagtaatattgcaacgaaaaggagacacattgaagtttgacaacaatagaagtgtcttttcagcaatataattttaactatacttctataagcttaaataagttcccctcaagctacagtaacctctcataatctttgttatatggtgttaaagaagctagagtgaaaagacatttgccatctgttaagtgacctcaaagctacctgaattatttggaatccatgagatcatggggcgatcactgagactacagacataaaacactgtactaactagataatgttccaaacctaagaggctgggggcacatgaaatcagacacctgaatttgttgttttgtttttacaatgattttacagccgggcacagtggctcacgcctgtaatcccaacactttgggaaccaaatacaggtgaatcacctgagat

SEQ ID NO: 18138 - DNA, 360 bp, Homo sapiens
gcatttctacttgtaaggtatgagaataactttttccaagaacagtctatattgaggatccctcttcccatctttctcctcccatctactcctcaactgcttataatttgggttttgctccagctactctattcatattcttctccaaaggccactaattatgtgctattgctacattaattgttcttttaaaaatattctgtttgcgttttgcaacatttgaagctcctggagactggttttgtatattacttctcctgacttccttaagaatataccctaaccaccatttcctgattcttttgcctcatcttcatctgcttgctgcttggatgtaggtgcttcactagattccattct

SEQ ID NO: 18139 - DNA, 528 bp, Homo sapiens
atcttgcatatgttactctttttctaaaataaaaaataaattcaacattggttgtcaagtgtcttcattaatcatgaatgccccaatgcagtgtaatatagaaagcatggttttcttttttttaagaatgaaatgtaatctttaggggtgacatttaaaatatgtttctttttagcaaaagtcttatgatctttctttgacatattctcacctggataaatttaattttaaattaggaatggtaaaaattgaaaatctttttatttaatatgtaatatcttaatcatgaagataaagtttaataggactgcatgtttatgtttgtattaatggtaggacatggagatgtatcaatcaaaccaataaaactccagtacacataatataaatgtcatcttgctttggtgggtgagtagcattgtgaacaggatttcttgtcaagttggtgctgttattgaggatatgagaagcaaagttcttgagtaggtaatattcatgcaaaattttctgtttctaaatatcttctaa

SEQ ID NO: 18140 - DNA, 333 bp, Homo sapiens
ctctctgcctttaccataatcaaaatttctgggcactcaaaattggaatctgataaggctaagaaaacaacttgactgatcacacagcagaagtagctgtcttgaactttttctcatgtacttattgtccacatgtatgtcttcttttgaaaaatgtttatattctttgcccactttttaatggggttgtttgtttgtttcttatatatttgttgaagttccaaataggaagagaggaagtcaaactatccctatttgcagatgatacaattctatatttagaaaacctcatagtcttggccccaaagctccttaagctgataaacaacttct

SEQ ID NO: 18141 - DNA, 397 bp, Homo sapiens
atgagttgctataatatgagctgtcatcacattttaacatgcatatgtattttttgatacctgaattacattattagaataagtatccatatacattttcactccaaaaacacaagcttaaaaactttaaagtacatctagggcaaatggtggctgaaagtgaataatattcaaattactgttgcttgtactgtataaggaaaactgcttttttaaattgggtatttgctaatttataattactatttatacttttcaacatttttaataactttttttattgttggctataacagaaggattcagatatctaaatatcatttagaacatagaacacattggtctaattcatcgaaagcttagttatgagcattaatacaaccatgtagtagagcaa

SEQ ID NO: 18142 - DNA, 483 bp, Homo sapiens
gccataacctccaccatagtagattgtatccaaatatgctctgctgaacttaaggagtggcctttgttgtctaagtttctttgtaggtgaaagagaggttatatttgaaaggagttatgataaatgatctctggggaccatatgggtactgtgtgcactttaaaccttattcaatagggaggcaattcattaagggaaatgaaagatctctcattatcaaaaacaaaacagaggttttctttctatttagaaacattatttagtattttcccactgtaaacttgcatattaacttgagcccaattttgtatctttttctagcctgttagtattcaatatagaagcacatgaaacagggagtagtaatttacagaaacattttccagtaaacataaaccctgttgacattgtgattaacataaaatctcccattagtagttttccgtggagatgactgtacttgttgaatgatgatgcatttgc

SEQ ID NO: 18143 - DNA, 316 bp, Homo sapiens
cagtggagtaaatttcataaagatcagagtacaagcaaaccacagaaatggacccaaacagagagtcatgttgccctgctaatggaagcactcaggtcttacgggggtagggagtgcgggtgtgttaagaatcaggccacctggagagtgatatttgctgtcttggattagtaaaataaaaatgcccattagtcttccacagctaccaaaagccagtgtgagtccaccttggccagttaggtagggccagtgaccaagcacacctgcagcaggggttcagggccaaaggagacattgtgacgctcatggatgagtc

SEQ ID NO: 18144 - DNA, 627 bp, Homo sapiens
  misc_feature 192, 193, 194: n = A,T,C or G
ctgtttttcagatgggaaaactgaggcccagaaaagttaaataaatcatccatggtcacttgtttaataagtgacagagaaaagttttcaacatagactatttgcttctgaagtctgtgtttttaatcacttttaatcattatgctacactgctggggagaaagtttggcttgcatttgagatccttatagnnncacatctaattgtaaatttccaaaaggcaattggaaatatgataataatggaacccaaatgtcagagctgaagatgtggatttcttcagcgtatgaatgttcattggagttgtagacactgtccaacaaataatgtataattttattggcccaaatgagagtaatagggacttcaagacagcttgatgccatcaagagtctacttctagaccccttttatagcgttaatacaaagcaacaactactgtattatttcataaatatatttggtttcatggttgtttatatattcaaaacaattatttgactgtggtacttgcaaattcatagaactcttttgcacctaactacattaataccagatactaaaagttaacttaagaaaataaaggaatcctaatcaacatttatctattattaaatttggatttga

SEQ ID NO: 18145 - DNA, 550 bp, Homo sapiens
gaggagactttaaaagtttcctcactgcaaaaaacaatggtaaatatgtgagataataaatatgttaaatttgttagcttgatatggtcattccacagtgcatcaatttattgaagcatcacatgccacaccgtaaataagtaaaaccattttttgttaattaaaagtaaattgcttaaaatgtgaaaactggggcttgaccctttaatgctttgcagcctacattgtagaaataatctaaggtattactgataggtgttatctaactggtgtatatattttactgtaagagaaagacatttacccatagaaaaaaacaacactgaacttgggaagacttcaacctcttcactctccaacctccactcccttcagaggtagaatttttctgaaaggatcaggaaaatgtatttctctgcacaattttctctccaagaaaagcatactaagaatgtttgcttcttatactccacatagccatcatctaccacagtcattcatctggacttcaagtctgccctgctgggaagtaggtcaccacctctacact

SEQ ID NO: 18146 - DNA, 343 bp, Homo sapiens
ctttatttcgtgaataagaatgttttgattttgatcatacaaataacttttgtagatttttgtttacttttgggggggttcccttagaagacattaaaaaaaaatactgccttggtctgtgcaggctgctgtaatgaaatactatgaacttggcagcttataaacaacagaaatttatttctcgctgttctcaatggtgggaagtccaagattaagggatcaacaaattaggcctctggatcatacatggcattttctagctgtgtccttatacataaaaggaaaaaggtagctctctcgagtctctttaataaagatactaattctcatgactgaatcaccc

SEQ ID NO: 18147 - DNA, 93 bp, Homo sapiens
tacagaagagagtatttgaaccttggagaaaatataacttctcatattgcagatttagtaattggaactgctgtgcaacaggcttttggagca

SEQ ID NO: 18148 - DNA, 311 bp, Homo sapiens
cttcctcaacctgctatgaatatggctattaaattaagaacttaatagatctcttgctcctttttgatctcaaagtgtcttttggagctaaatttgcaaagaaaaggccctcattaaaaaaactaagtaaatttaaggccaggcacagtggctcacgcctgtagtcccaacactttgggaggccaaggcgggcagatcacttgaggcgaagggtttgagaccagcctggtcaacatggagaaatcctgtctctactaaaagtacaataattagccagacatcgtggtgtgtgcctgtagccccaactactc

SEQ ID NO: 18149 - DNA, 202 bp, Homo sapiens
gcaggaataaacatacatgataatgtaaattggaaagaacttttgctttttttgttcacctgttctatgatatgcttgctgtagtctggagttaatttccacacttgcttttaatgtaaacattgtttttctatttgtaggaaagattttcccttttgatctctcacatattatcttctgaattaaagttctctagagaact

SEQ ID NO: 18150 - DNA, 579 bp, Homo sapiens
ggtgataaaaagctaagagttttaaaattaagcagatttcatttgacaactgagctaaaattttgagtcagccctaaactccaatctgctgtgtccttttcacttttggtgaccttttactatgctttaactttagtgccttaacttggtaaaattgaaagaagaacaaaataaatgttgtgagagaaacttgccatttctctatattataatttgattgtaaaataatcacattaatgattctaagtcccttaataattgcttactagcagatatattatcaagcaaacactagttaatgttactttgtcagatataattacaatgcaaattaaacatacacaatgcatgccctcaaggaatttatataccacgacagacataatcacaaagatacacataaatgtatatacatcatatgaccaaatttatatttttgtgttgaaattattggtaatataataaatatacaaatcaagtattatttctataatgtataaggttattaattttaactagcatagtacccatgttatttttattttgagacacatgtatcatatattactgaagtataac

SEQ ID NO: 18151 - DNA, 235 bp, Homo sapiens
tcataaactccagtcattacagatgtcaacatgtgcaagaaacagtacagtcaaattataacagcaaatttatatcaactcttttgtttgctttttttgagatggcactctgtctctcccaggttggagtgcagtggcatgatcttggctcactgctgcctcccgtattcaagtgattctcctgtctcagcctccccagtagctgggactataggtgtgcaccaccatacccagc

SEQ ID NO: 18152 - DNA, 448 bp, Homo sapiens
ataaaatgagtatcatcatagtaatcactgagacggcaaaaactattagctcatacccctccttctacttctaatgtaggcttggtccccatagcctactgtattttggagtacttcagtccagtctgactttaaatggatcacgtaatgacttcttccagagtctttgaaagactatttcagtctaatggttctccctattaagaacttgttgtgatattcagcttaattttctcctgattatattttatcttgttacttaattcctattataaaccttctggactagttcatcctcttgtctgattcagattcttcatccaacatttctctaggacttataaaatacaaaagcttcacacagttacaggagagaatacaaagatggcaattctatgtccagacatctttgctaaatgtttaagacattttttgcacacttatatat

SEQ ID NO: 18153 - DNA, 178 bp, Homo sapiens
gtttcaggctggtctcgaactcctgacctcaagtgatccacccacctcagcctcccaaagggttgggattacaggtgtgagccaccgcacttggccttcagcctatgttttcatttgagcacttttctttataatttcacgttgtcatcctcatctaaaacccaatttcctttaggga

SEQ ID NO: 18154 - DNA, 534 bp, Homo sapiens
cagaagggaaaccaataacaaagaaactatcttcaaagcagccagagagggaagaggacataatacatagagaaatgaatgaagataggaattattactgatttctaatataaacaatgcaagtcaaaagataataaagtttttttaatgctaaaaggaaaggaaaaaaataactttatatctgtaaataaagctgtattcaattcaacatttagacctatctaaatctgtattctattctgttctataggtataactattctattttattcacatctggctaaaatatccttcaaaaataaagacaaaatgaaaacatttttagaaaaggaagaattgaaataatttgtagaactgcaccataagaaatgttaaagaaagtgctttaggttgaagaaaaacaatactagaaggaaatttaggtccacatgaagaaatgaacagcattagaaatggtaatgatttttacgctttacatgaaacaatagaatactatttattaacctataataacattattaacttatatataat

SEQ ID NO: 18155 - DNA, 341 bp, Homo sapiens
aaaaaattttatccaatgccgtgaatgagcaaaacatattatccaaagccttaagaatgagataactaaaaatatactgtaacactattaaattatatacattaattgcatacagaaataaattatatacaaggaaacatgtaaactaacacacacatgttcatattcaagggaacataaagaacaaaacacatacataaaaaacaaacagtcacatatgcaatacacataaaaagaagaatagtcaaaagatagcagaaaaagagaattgtagaaaactcttaacacgaaagtcaaaaattacctccaaaccaatatttctgtcttagtaatatagatac

SEQ ID NO: 18156 - DNA, 429 bp, Homo sapiens
tatagagttgatggatatgttaattcacttgaggtgatggattcattaattcacttgagtgtggtgatcatttcacaatatacacatatatcacaccatcaagaagtacaacttgaatatgcacaatttctattgttgagtatgttgcaaaagaaagcatgagggaaggaaatataactttatcttgctttaccaaagagatgttcttggaaacatgtatgcaaatcacatttattaccaatccaattacaaataaatactactatttcactttaccactgaaatttatttatttactttgcagaagtgattgaggaaacatacatgaagtgcccactttgagctaggtagtagacagtagagataaacctggctaaaacatggtccctctgcacaaattgatatctgaaccaatgtgatcattcagct

SEQ ID NO: 18157 - DNA, 561 bp, Homo sapiens
taaatacaaatgttgtccaggagtgacagaagctggagaattggactacttgatggaggctttgtacaagctttgaacaataataacaacaaaattgaaatgccaaaaatattgtttaattagcagttaaccaccaataaaaggaagccagccatttcacacagaggattttgttaattgattgcatgaattttcaaggaaataatattattaggtgtgtattagtccttattgcattgctataaagaaatacctgagattgggtaatttataaagaaaagaggtttaactgactcacagttctgcatgctgtacagaaagaatgttgcatctgctgggcatgtggggaggcctcatgaaatgtataaccatggtgggaaaatgaagagggagccggtgcttcatatagctgggagcaggaagaaaagtgagaggtgaggaggtgctacacccttttaacaaccagatttcataataactcactcactcactatcataagaatagcaccaaggaaatggtattaaaccattaaaaagaaaccactccacaatccaataacc

SEQ ID NO: 18158 - DNA, 316 bp, Homo sapiens
tgcgcagggccgtcaggctggggacggacatttgaattcagttgactgatggaggagcagtgagcctgtgagccagcctctggggtcaaggctcccagacagtggctgctctgttactccatgtgttccctaccagctcccccacggtggctgcggggactgagcacacagaccctgcaccttctggggcatctcccctgcctctcacaaagtcctgctgcttcctctgctgtattcatcacacgcttcacaatagtcatgtcaccgatttctcaagaatgtgtaggaatcatgccttgccccatgccctcagcat

SEQ ID NO: 18159 - DNA, 82 bp, Homo sapiens
tgacaccatctgactgtagagcctcagggcattcagtgaacataggtagtagccagggagtagttacatcaggccttgggtg

SEQ ID NO: 18160 - DNA, 431 bp, Homo sapiens
atattgttggcagattaaactcccttgtgtaaataagtcttataatactgattgatgattatatgtattgtgaaattgagttgaagcctcctcaggatataatacctatggaaagtgactggcttgaggaggaactggatctcactatcagctgatttccatcctgaatagttctgcacaaggtacaaataacagtagatcaagggaaaagaaagctggtacaagatgataaagatgtttctaatggcttctgtcaacctaaaggaagaaactaaggtacaaaatacaattttaaagaatttatttgcaccataatgaggacagctgcccagcagactcagatccaagtggatttgagctccatttggcccttgttacaaacaggtttttaaaggccaaaaattcgggacaggatgtgggctgatacaaag

SEQ ID NO: 18161 - DNA, 368 bp, Homo sapiens
tgggtggagaaacactttaaaataagaagccttcataaaacatggaaagtaattttgatgtgttctctactagttttagaaactgctaagaatatgaagaatccaagggattagttggtcctaaggtctgttcaacctgaaataagacagagttcctcatgtcagcattattgacattttgagccagataattcattgtgatgggggctgtcctgtgcaatgtaggatgcttaacagcatctctgatttctacccactagatgacattagcatctctgccaccaattgtgacaatcaaacatgcttgcagacttagtcaaatgtctcctagggaacaaaattgcccctgattgaaaacctctgatcta

SEQ ID NO: 18162 - DNA, 567 bp, Homo sapiens
aagccacaaagtcatctctgccaaacaagaagtcaaacagtttgtctctagttaagagtttatgtgccatggtaatggcagagaaagctgaaaaaacagaagactggccataaatgaatacccaaaagatcccagaattgaagccttcatctccattaggaatagagctttttaataagaggactgtaagtttaagaaatgtgaaggactaccttccctttactgtggtatttttatagtacattatccagctcttggttcactctacaagtgaaagagaaatcagatgataattacaaagaattaggattatgcgtccagagttctaaacacaagggtgaattgaatggtgtatataaaaaatgtttttattaatatggtgaatgaggccaaatgcggtggctcacatctgtaatctcagcactttgggaggccgaggcaggtggatcacctgaggtcgggagtacgagaccagcctgaccaacatggagaaaccctgactctactaaaaatacaaaattagctgggcatggtggcgcatgcctgtagtcccagctccagctactc

SEQ ID NO: 18163 - DNA, 528 bp, Homo sapiens
gaattgttcccaccaagaaatcagtccgcccggagctggccccaactgtcagaaagcagcccagaatagaggtacattgtgaatcacaggccacgggccacatcgggagggagaaagctgccggcagacggactagaacgtgtcctccacctgccccaccacccctggccagatccctgttcctaccccagaccttggtggagccccccaggtgctctgagccctgggaaagctttggctgtgtggcttctgccaggacaagttggcttctaagcctgactgtcccctgagcatcagttcaagtgcagcctggggcctgtgggcatgggagggcccgagtgcctggaggaaaatgttttcatgatgccagtctatctgaatctactgactgacagggctgcagggtgcacactattgtttctgggtgagcaggacctcactttctattctttgggactttcagtatctgaatttttccacctcatttcttgggctcctccctcccaagggaggatgaggtgggacgtg

SEQ ID NO: 18164 - DNA, 464 bp, Homo sapiens
ttttagtagaggtggggtttcaccaggctggtctcaaactcctgacctcgagtgatcctcccacctcagcctcccgaagtgctgggatgacaggtgtgagccacctcgcccggcctggactcaatttggattgcaatgccccacaatggtgacctccctcttctctgttaatgcatcctcttccctcttgcttaaaaatttccccagtgccgtggcatcttacctcctgctgaagtgtgtgctgatgctttgctgggggctggaccccgtcccttggagcctggcccaggccctgcctcccagtgaaaccctagccgcctttccaacctcagaggctctatctcctcccaaaccctgtagcccttccagttgctggtcactgacttccattaattggcccggtggccttgcctgccagggggaccatgaggtgaggggccgtgtcctccgagtggtctctttct

SEQ ID NO: 18165 - DNA, 583 bp, Homo sapiens
aaggcaacatttttttctcttaatttcaatctaaaaaatattgtagccatgctctttgacacagaactttgatgtctaacttactcatcatcttgaattcagaactacctcaaactgacctgttggtcacaaggtatacctgagcccacctctatatggaggtgaactggctttcatatatttcattgttgagctactcagtgatcctaaaaaggaagccagttgtaatgccatctcattagagttgatcattacagcaatttgctgcacactttaaatagttacacttaaaacacttggtaaaatatgtaaccttgaactcactactccttaatacttatcaaaagcttgaatgagataaaaaaaatatttttggagaattgcctgttggataagtagcctacccatttctctccatgttaaagaatctatccctataaaaagacagatggtcagaaaagttattacttaagctctaatatatggcttacctgcctcatccgatttgtttattcaacatatatctacttcaggcacggtgcttggtgctagggatgtagcaataaagaaaatacaaactcct

SEQ ID NO: 18166 - DNA, 459 bp, Homo sapiens
tagatgtaatcaataattttcttcaactattatttcatttttattgtgactgatgcagaactagtgggtgaggttaaaatataaggcaaagggcaagagtattatgacttttttctttgacgttttgaataataggcataattgtgagctcccatgttagtaattaactccagaaaactgttaatgaaaattactagcactaagattttctggccaaataataaataaataaataatgcacacatagaaacacacatattacacacacacgcacacacacacacaaaatatgtctctaaatatgcaaagtatttcctatgctgggatttcttacttatttataggtctcatatatgactgcattggtaaaaaccatgtaaagttaggattcaaaatgacattgccctttggacacaatttaagctctctcactcaccgtcttctctagagataaataat

SEQ ID NO: 18167 - DNA, 564 bp, Homo sapiens
aaggtgacccataagtcctacaaggtgtctacctctggcccctgggccttcagcagccactcctacacaagctggcctggtgccagcatcagctccttgagcttctctcgagtgggcagcagcagcagcttccaaggtggcctgggcaccagtatgggtctgggtggaggctatggcgggaccagtggtatggagggcatcacagccatcacagtcaactagagcctgctgagcccccttaagctggaggtggaccccaacatccaggccatgtgcacccaggagaaggagcagatcaagaccatcaacaacaagtttacctcctttatcaacaaggtatggttcctggagcagcagaacaaggtgctggagaccaactggagcctcctgcagcagcagaagacagtttggatgaatgtggactgcatgttcaagagctacatcaacctatggcagcagctggacatgctgggccaggaaaagctgaagctggaggccgagtttggcaacacaccagggctggtggaggacttcaagaacaagtacaaggacaagatcaataat

SEQ ID NO: 18168 - DNA, 476 bp, Homo sapiens
agtgattgtggaggcagccaggacagaagctgggaggcatattgtacagtgacaaagaacaaagacgttggagtcccacggcttcaggttcgaatccagactccacttcttagcagatggatgatcatgggaagtcattgagtctccctgtgtgccagtgtcctcatctgtatactgggataggacagcacctcccacaggggttctgaagtgatgtaaatgcaatgcttggcctgtagtgattgccccatccatggttgataccataaggggttagtgaaatgcactgttttttgcagctgtggtgccatgcaaataaaagttattctcaggactgcatatcgctttcaccctgtcataggtttcacattttattttgcttatttcctgtctcccattcggaatagaatctccatgagggcaaggatttaagactattttgttcactggtatgtcctcaagtgtctacaagactc

SEQ ID NO: 18169 - DNA, 650 bp, Homo sapiens
cacctgtagtcccagctacttgcgaggcagaggcaggagaatcacttgaacccaggaggtagaagttgcagtaagctgagatggcttactgcatccaacctggatgacacagtgtgactccatctcaaaaaaagaaaaggacaaagtatattggtccaaaaaagaagaaagaatgaaaaaaaggacaaagtatactggttagtatcgtaacagtgagatagtccccctttgagattagaaaataacagtatactcaaagtaacatcaataagaaccaacataaaatagacaagattcactatctacaaaagtaatctgcaccaagtagcaatgtatgagcatgtggtggagaatattgtctataatatgtgtactagaaggaagagacctcaagaaaaaggtcagagctggaaatgtagattagggaatctaggtcaaagttttgagatttcaggagtcctgagagaatttaaaaagcgaaatagccgccgggcgtggtggccacacccgtaatcccagcactttgggaggccaaggcaggcagatcatgaggtcaggagttcaagaccagtctgaccaacatagtgaaaccccgtctctactaagaatacaaaaaattaagctgggtgtggtagcacatgcctgtaatc

SEQ ID NO: 18170 - DNA, 575 bp, Homo sapiens
taaaatatcctaatttggcaaaccagactagttttaattacccatacaattctaaggtttatgacctctgaagtaatattccacaactgttttgtaatcaatctgtaattatttttgtgatgtcacagagtagctgatccccctccaaaaaataaacagctttcaaaacatttgttattatttatcattgtctatgcatgtattcattttgtgctgctattatggaatacctgagactatgtaaattataaaccacataaatttatttctcaccattctagagaccaggaaatccaaggtgaaagggctggtaaaactttcaagggccttcttgatacataatgccatggcagaaagcaaaagggtgaagaaagctgggtgcggtggctcaccctgtaatcctagcactttgtgaggctgaggtgggtggatcacaatgtcaggagatcgagaccatcctggccaaaatggtgaatccctgtctcttctaaaaatagaaaaattaactgggtgtggtgtcgcgtgcctgtaatcccagaaacttgggaggctgaggcaggagaatcacttgaacc

SEQ ID NO: 18171 - DNA, 606 bp, Homo sapiens
ctccagcctgggtgacagagcaagactctgtctcaaaaactaaaactaaaaataaaataaaataacgaagagtataagtggattgtttgtgacacaaaaaataaatgcttgaggggatgaataccccattcaccttgatgtgataattatgcattgcatgcctgtaccaaaacatctcatgtaacccagaaatatatacacctactaggttcacccacaaagctttaaaaatatacatataaagaaagaaaaaccccagcccagatagttctaggtgtgggaacctccatgaacctctctgtgttcaggtgaggtgaaagtgactatcccataggttgtcatcaggagtgaatgagaaaatgcaaatggagcccacacctcgaatataattaatgtacaaaaagcattaactaatctagctggtccagatgaggcccttgttgcaccacaagcttaagacccagaatcctacagggagactcttccccaggtgcactcctctcgttctggggctctgtctttaccccattctctccagctgggggcctgtagacctcatccccaccctgtgtccagcttcgaagtcaaaaagcttgtaagtaggcg

SEQ ID NO: 18172 - DNA, 632 bp, Homo sapiens
aatatcttaatatattgcccatgtgaagctcctggtgttacaaaaaaggcagtttatattcaacatacttcaagtttagaatagcagagcattttgtaatttagaacaaaggcatgttccctctagtagtttctgatatcaactgcaacttataaatttgccttgagacatgtttgcaataaaaattacaggttttctgattcagcatgttccatcatagcacactaagatagcaccaaagatgacaaaaataaaacgactgaagcaaaatgaagtgaacacaaatagcttattaccaaatgaaaaggccatttcaggagcccaaaatagaaagggagtaactattacaagcggtcactttgtatttttcatactaagaagagtttagaacaagattagcagaaatgctgtagcctatattatgagcctttaaaggaaatatagtaggtcattcaacaaatggtaatcttcaaaaacttgtatctgaaggtcaaaatctgagtgtataatatttagacatgcctaatcattgttttaaaatgtaaaacaatcatagaatcattaataggcatctaatatatacattaatataccatgtcaaatacagacatttcttttttaacaatagacat

SEQ ID NO: 18173 - DNA, 334 bp, Homo sapiens
tgccagctcactttccatttggatcagttatcttttcatttatcgtcccatagattcctttttgaaaaacaactttccagatacctttatacagcctcctgtgtcctgtggctagtcattcccctgaagtgcaccactgccaagcttctggaaaggcattggcctccttgtacttttgcaggatgtttcaccacctctaggttgtgcttcttacctgtttctgctcttccaacttcttttcctcattttcttttggtctattcattttgaatcatgagagctctatcatgacttacaattagtcaataatcaagagtttatatgttctttaagc

SEQ ID NO: 18174 - DNA, 555 bp, Homo sapiens
ctacaccccgtctgcatatttatgataaccctgtcacaaaagaaaattctagtccaccctgacgtgttcctagtgacttgtggagctccaggtgactccactctgttttctaaatactcccaaacaatctttttcacaatccatgtagggatcttgcccaggtctaatgtcaagatcacgagtctgtccgaagtctctttccatttgaaaactaaacctctagtcttctggtccttcttttgttttatcacaattcctcaaagactttgacaattgttcagcaacttcatacacaaattcactcttgaaagaagttgcattggatacgtactaaagttggcagagaagataaaacctgaattgtatcttgaggctatgtattggctttgactaagctgagaagggtgaggaccaagaaaataatgagattaaaatgacttgacccaagcaagctatagataaatgtgaaggcagcaggcaacaaagagcacagtcaagagcactgggtcagaaaacagtgttattcatgtaactacagggcatcattcagctgct

SEQ ID NO: 18175 - DNA, 535 bp, Homo sapiens
accacagcagagttactgaaactgagaacagatttttgccaaagacagagcacagatgcagactggcccctacatctgtgggagaatgcagcagacaccacggcactatcaggcacagaaacgcattgcatccctacacgagcaggaaactgtcatgagctattataaaactaccaaaccataaaccattagaaccacaaatcagccaaggctggatgtggtggctcacgcctgtaatttcagtactttgggaggctgaggcaggtggatcacctgaggtcatgagtttgaaaccagcctggccaacatgatgaaactccgtctctactaaaaatacaaaattagctggatgtggtggcacacgcctgtagtcccagctactcgggaggctgagacaggagaatcgcttgaacccagggggtggaggttgcagtgagccgagatcgcaccattgcactccagcctgggcaagaaagagtgagactccaggccaggtgtggtggctcacgcctgtaatcccaccagcattttggga

SEQ ID NO: 18176 - DNA, 557 bp, Homo sapiens
agtggatctttatcaaggtctttccaatgatcttgtggccctctacagcctgccctttgaccatctaattgctaataaatctggaatggatcaggagaaaaggaagaaacaagtcaatccattgtgcttcccaatcagatttgtggtaaagattttggaggaggccacataattagagtcagatatttaggattatcgatggattacagtactccatgaaacacatttcctccattaccatggttaattatgagtagaccgtaaaagcattcctctagaaaggctattaaaaaacataatgtaatgtcatgtgcaatagagaatgacacatatcatgacttaagaaaataaagaccatttattccctgtgagtttgaagtatggtgggtatgcccaagtacaaaattttttagaatgctagagatggctttaaaaattgtttatgtcttctcaggctttgcaacttttctctaattctgtagaagttggcagtgataacagacatgactagaagtcagaaaattattttagtcattgactactcattaatctgtatc

SEQ ID NO: 18177 - DNA, 589 bp, Homo sapiens
gcaattactcagtagttttattaacaacttgtaaatattcttttgattcttggaaacacctttatatgggagacaaaataaatatattgtttccagtaacaaaagtacatccccatggaatgacatattttacagagttcatcctatacctttttgttggtttgttttttgttaacagttgtttaatacatttagtgagccaggtattgtgtgagtcactgagaaacacaaaaaagaaatgagaatggatggcaagcctcagagctcagtgaagtggttttaaaattctatgaaaataactctgtgaggccaggtgtggtgacccatgcctgtaatcccagcatttttgggaggctgaggtgggtggatcacctgaggtcaggaattcgagaccagtcccaccaacatggtgaaaccccgtctctactaaaaataaaaaattagccgggtgtgatggtggacacctgtaatcccagctactcaggaggctgaggcaggagaatcacttgaaaatgggaggcggaggttgcagtgagctgagatcacaccattatactccagcctgggcaatggagcaagactccatctc

SEQ ID NO: 18178 - DNA, 640 bp, Homo sapiens
aaacataaaaatgaagttgtttttccattccccagtctattccaaatcctcatctagaaaccctgtactaatttgtatgagtgggttacttgaatctctttgataaatgtacgaaagaccattacttacgtttttttgcttttgtaattgggttctttcctccttggtactgtcccagggaaaataacccagaagaaatttccatgcttgctttctcaatgcatgactaagtccctgaagaaagcatacatattaaatacatgaatgaaaaagaatgtaacactgtaagttcacaaaacttgcatataaaaaggaaaactaatctttaagaggtagtttcatatatgtaaatagttcaattcagtgaatatcatcttgttttttttacttctagatccaaaagatgtaagcagctgccagaaagtttaaacagtgcacagaatacagtagactacagcagacagacagtgtgactggtgagtctaagcccaatcttacagaataaggcaaatgccactggaatgcaggcctccttcacaaaacccacagaacttcaagtacggaagaattcttcccccagagttaagggtctacccaacccccaggaacatcataagcacctcactctgtcctactcaat

SEQ ID NO: 18179 - DNA, 572 bp, Homo sapiens
gatcatgaggtcaggagagcgagaccatcctggctaacacggtaaaaccccgtctctactaaaaatatatttaaaaaaaaattagctgggtgtggtggcgtgtgcctgtagtcccagctgcttgggaggctgaggcaggagaatggcatgaacccaggaggcagagcttgcagtagccgagatcgtgccactgcactccagcctgggcgacagagcaagactccgtctctaaataaataaataaaagttgcttttgtttatcaacagtgtatcaaacagtgtatcagagagaacaccatttgtcagtgtatttggaagtacatgcttcattcttatctgcaggatagcatctcctggtatggatgttaccgaaattaactcttactctgtttataggcatctttctccatttttttgccagcttaccacaagtgactctatagaaaacatccagctacttgggaggctgaggcaggagaattgcttgaacccggaaggcagaggttgcagtgagccgagatcatgccactgcactctagccctggcgacaatgtgagactccatctcataaa

SEQ ID NO: 18180 - DNA, 631 bp, Homo sapiens
gattggcagatcaatcaatagatattttaactagatagatatggatcaatagacaggcaaataagtattattacatgattttaccaaatttcctcgtttccaaaatgtggaagtcatgatcaagataattctatgagttgaaaagctatgcctgaataatgtttgcatggtccatgtactggtaaatgggaaaagcaaaatgattgaaagctttaggaattatttctaacatccggatttggacaattagtatttgttcttgaggctataaattggtactttttcacattattaaaaagtctagtgactactggagtttagggagatcattttccctaaaagttaaaaaataaattgttgaaagtatttcttctcccagatggcacatgatggcatctttataaaagcatcaatatttgagacactcaatgtccaatgtttcattcatgttctgggattgtgtttttattagtatgtatgatatgaaaatgtagattatatttctaaatttaaaattatattcaagttataaatttaataattaatttcctgaaacttttatgaaaataaacccataaaatcataaacattttaccctaaatatttatgcaatattttatgtatttatata

SEQ ID NO: 18181 - DNA, 455 bp, Homo sapiens
cattccagaaacatttagagacgacccaccatgagatgaccttgaccaggcgtggctgaacatcttcattatagctacagcagaaacatcatgtggtattcttaagacaaatttcagggcccaaagaagctattcaggatccttttttccacttgcttcaatatatttaagctccttgaactatgacatcctcccaaataggttcgctgacttccttcactaaggcacccaccaaatatttgttgagcgcttaccatgggtcaggaactgttcaaggcactgggcatagggtgttgaacaagaaagaaagacatgatccttgctgtcatgaagcattcatttcagagtcatacttcttatgttcacacacaagtgaagtggtattggtatttcagagtgaatgtgttttataaccaatattgatatttttcttctctagaggctccctttatttc

SEQ ID NO: 18182 - DNA, 642 bp, Homo sapiens
cagcacagcactaattagagccaaagtactgtgggtccccaatactgaagtctacttcctgaggaaaggatggtgcagcacacccaaaaggtagcccagggacaaaggaacccaaaggttgcactttttccagagctaagaagcaaccatgcccctagtagtggcacaaattctgtgtttggtctcctgagaagaaagtgagacctcctacaaatactgcttcagcagttgctgccactggtgagcctgacaacagactgtcaggttgggtagagtgaccccatccccaccagtggagcaacctctgtgctcaggctcacataaagatcatagagcacaagacacctttcccccatctgcacagtgctgcagctgtagccactgctgctgccaccaggggctggggcaggtgagcagaaggctgccagtctggggctgtcagtaacaaccttgtctcctctgtcagcatgatctccaacctcaggctcaagtgtgaagggcaagatccctccctcccttgcatggtgctgttgcactactgccactaagggctggtaagtctaaatgctgcctagggttctctggggccgtgggtagtgatcccacatcacagccactgccaacaccagcacacactgctga

SEQ ID NO: 18183 - DNA, 84 bp, Homo sapiens
tgtctgtttcattaaatcaaactaaccttatcctttgatgtacattatttcttagaaatctgagaagtcttggcaaattcatgc

SEQ ID NO: 18184 - DNA, 635 bp, Homo sapiens
agaaagaagtaatttgttttatgtcgtgctttctcctttcctgtggagagtgatcatcagcctgaagggttaattgaagggactgaatgagagcttagggcagacaggatttaattgctcaatattgtggataattgtggtacagtagtagcatacactgatgtttataagtatgatggggacaaaataatttaaaagtttaagttaaaagtgcactggcaaattcactaaaaaactgttggaactactaaacgagttcagcaatgtggcaagatacaagatcaatatacaaaaataaatcttatttctatatactagcaatgaacagtctggaaaagagattaagaaaataatcttatttataatagcagccaaaaaataaaatatctaagaataaacttaacagaagtataagatgtgaaaactagaaagtagttgaaagatattaaagaataaataaatggaaagatatgccatgttattggatcagaaaacttaacatttttaagattgcaatactggccaaaatgatctatgtatttaatggaatccctttaaaaatcccagctgtttttttatttttttccccagaaagtgacaagctgatcctaaattgcatgtggaactgcaaatat

SEQ ID NO: 18185 - DNA, 481 bp, Homo sapiens
tgtcaggacttaaatagtagctgggattacaggcacccaccaccatgcccggctaatttttgtatttttagtaaagacggggtttcaccgtgttgcccaggctggtcacgaactcccgacctcaagtgatccgcccgcctcagcctctcaaagtgctgggattacaggcatgagtcaccacgcctggccaggaagcagtcttaagggcgaaagacgctgtactgaaacagagctaggcttcgtctcccttcctcctttcaggtctgtggctagtatatagttaatgtgccaggacttaaatgctgagtcacctaaaaagctgagcctcaatcctcaataaccaggaagactcatataggctgcaactcccttccagaggagactgcccgtgttgccttttgctttcatctaatgtctctttactttacaaagaataatatgatctaaaatctgtctctgttgtaagcagtcactgaatatt

SEQ ID NO: 18186 - DNA, 562 bp, Homo sapiens
tgtattcttcaccagacttgtctcagagcagctgctcacccaggagctccatggccacagggatgcccaggacagggacgactgcttgcccactgccgtgctctggggctctgggcagtccctcggcctcacccactgctcagattttctgcaggaaaaatgggagagccaccctttcaaagagtgacccgggcccggttcctcctcaaagcctttcggaatgaatctcccagttccccactgactggacatagaacctctgctctttccttctctaaggctgtgctagtccattattcattaaaagacaaaatgaggccgggtgcagtggatcacgcctgtaatcccagcactttgggaggccaaggcgggcggatcatgaggtcaggagatcaagaccatcctggctaacacggtgaaaccccatctctactaaaaatacaaaaacaaaattagccggctgtggtggcgggtgcctgtagtcccagctactcaggaggctgaggcaggagaatggcgtgaacccgggaggtggagcttgcagtgagccgagatcgtgcca

SEQ ID NO: 18187 - DNA, 599 bp, Homo sapiens
gagagcagggatgaggccccacattgtcaagcccaagaacactggtattcagtcctaactcccatcaccactggtgctctccagactggcagacttagctagagatagtggctgctaaaagaggaaattactaagacagtggcattcaggggtccctgcaacttccgggcttggctcctgttgtattactctccaatgaagcctacctagacaatgaaggcatcagcacaaaatataaaaagaaacagtataatatcctaagggagatattatattactacaaccataaaataagaacagcatgttattaaaaataataaacaatgagctcagaaaagactcactgtaaattaagaatgatacacaggccaggcgtgatatggctgacatcagtaatcccagcactttgggaggctgaggtgggcggatcacttgaggttaggagttcaagaccagcctgggtaacatggtgaatccccatctctactaaaaatataaaaaaattagccaggcatgatgacgcatgcctgtaatcccagctactctggaggctgaagcaggagaatcacttgaacccaggaggtggaggctgcagtgag

SEQ ID NO: 18188 - DNA, 76 bp, Homo sapiens
tcctctgatatttaacttcatttactacttcctggtgacagctgtttacataacaagtcaggtaccctctcaatac

SEQ ID NO: 18189 - DNA, 391 bp, Homo sapiens
gggagagcatcaggaagaatagctaatgggtgacagacttaatacctaggggatgggttgatctgtgcagccaacaaacatgacacacatttacctatgtaacaaacctgcatatcctgcatatgtaccctgggacataaaataaaagttgatggaaaaaaaaataaaagaaattctataatgtttctatggtgtatggttaaggaaggcaagtaagactcaaattacaagaattaaatggaaagaatacaacataaacacccttttatcaagtgagcatctacatattatttatgagcttaaggctggacgtggtggctcacgcctgtaatcccagcactttgggaggccaaggcaggcagatcacctgaggtcaggagttcaggaccag

SEQ ID NO: 18190 - DNA, 163 bp, Homo sapiens
aaacaatctagagcccttaaagcagtgcctgacatacaatacacgctcattatcagttattcatatgtgactctattaataaaaatgtaacaattttaatacaaatgaagttggtggtgccttagacagcatagaaaattaagtaaaaacctcagctgctggc

SEQ ID NO: 18191 - DNA, 579 bp, Homo sapiens
ccacccacctcggcctcccaaagtgctaggattacaggcgtgagccaccgcgcctggccctaagtgtgtactcttggggcgctcgtttagctttgtgggctagggattatggtgcattatctgataaattagaggaaaattttactttatctgagaaacatatttgcagccagtctcagacacactaagtcacagaagaaagaagaatcaaaataaagagaattctgctgtcagctgtttcccctcttgctttacctaaaaaaagcagccatctgtgccctgaggcagacatggcagaatgtgcttactcaacccctgacccccgactcctgacccctcaaaacacacactgggagcttagagcctgcccccaggctgcctctccccaccctttactcctcaaaatacatactgagagggaaggggatgcctgcagctggtccaaactgcttctcttggactaagatatatttacccgggggtgtcaacagcgtgggagtggagagagcaggcaaaggggagcagggaggtcctatggccttgcagaggacaaaaccacaaatccctggcaagtgacct

SEQ ID NO: 18192 - DNA, 586 bp, Homo sapiens
gtatctaatttacttcaggcataacatttaaattctgacatatgtgtcaatctaaaattaattctgacatatgtgtcaatctaaaattacagacaaatttgaaatagaaaatagaaaaatgaatagagtgacattagtttgacggaaaaataaaaggtgacctattttcttaacccgacagcaagaaaatttgtcaggaattcctgacaaaaatgcctttatgagagagccaagcatcatgtctcacacctgtaatgacagctatatggtacactgaggttggagaatttcttcaggccaaaatttcaagaccagcttggggtatatagcaagtcctcatctccaaaataagtgcctttaagagagctttaaaggccgagtgtggtggctcacgcctgtaattccagcactttgggaggctgagacaggtgggtcacctgaggtcaggagttcgagaccagcctggccaacatggtgaaacactttccctactaaaaatacaaaaattagccaggcgtggtggcgcatgcctgtaatcccagctactcgggaggctgagacagcagaattgatcgaacccagctgg

SEQ ID NO: 18193 - DNA, 592 bp, Homo sapiens
gccaaataggttgtaagcagttcagcaccttttgtcttttttagtaactaaaatctgcatttgatacagaatttccttcagtgtggtttctgcccttcacactttggtaatgagttttcctgagagccattctaggcaggcaaatgtctggttttaatagacagggtctttcagtcctttctgcaacttactagctgtgtgctcttcagcaagttgcataacttttcgaactcttaattttcttgtctgaaggaatgaagacgatgataatgatgtccatgtcataggtttgtcagggttaaagaaacaacgggccgggcgcagtggctcacgcctataatcccagcactttgggaagccgaggtgggtggatcacctgaggtcaggagttcaagaccagcctggccaacatggtgaaaccctgcctctactaaaaatacaaaaactcaccgggcatggtgtcaggtgcctgtaatcccagctactcaggagactgaggcaggagaattgcttgaacctgggaggcagaagtcacagggagctgagatcaagccattgcactccagcctgggtgacgagcgaaactttgtct

SEQ ID NO: 18194 - DNA, 563 bp, Homo sapiens
gtgtgaggattcaggggtgaggtggatgcattctggggagaagaatggcatgagaagcaacaggaatgtgtgaaatgtgttcagggactagtggagagatacgcctgactggagaagaatgttctctaaaaaggaacaatgagagattatgttggaaaaggtggggccagttcatgaagggcagagtggggaaaggaaaggaaaccaaccattataaaggccctgcggtatacctgtgctttcccattcagtccttcagaaaagctcagaaggttgtacagcttagagcttaagagcctggactctggaatcagagtgtctgggttcaaatcccagctctgccagtcattggctgtataataattttgggaaagttatttaaactctctgtgcctcagtctcttccatctgcaaaatgagggtagtaatgctaactacttaacaggattgatgtaaggattaaatgagttaatagctatgaagtactgagaatagtacctggcagatatgttataaatgtttatattatgattatcacctgcagtttacagatacattggaat

SEQ ID NO: 18195 - DNA, 600 bp, Homo sapiens
aatgtacaaccctatcagacttcaatgggtgcataaaatactctaaatttgagttattttctcatattttatgtactagcttgtcttaatcaaattcatttattttctggaccatgtacacctttgggttctcctcaaacctagagttgtgtctagaaaatattaaggtattatcattaagcccacataagcagatgggaaagctttatcataggatggcatctatctatcattaattggtcttctgctatgaggctggtgctgtactgagtgctttacacttagatagtaagaatataaagcacttagtacttaggctttatagtagccctttgatgtagggactattacacccatttcacagatgaagtaacagagaaataagtaactcacctaatctattatgtgaagtcaggggtgaaaacccaggtccctttgaccccagagaccaaattattaacaaccaaatgatatgtgctctgttgggccaagaatcaatgcatattgcatgtctctcatggccattttgatcatgataacctggacaccgattggtttttctgaagcaacttgagacttaatagaagcctcacctctcat

SEQ ID NO: 18196 - DNA, 633 bp, Homo sapiens
tggctctgggagaggtgatggcttgtgacgggaaattgaattcaatttgcttcaccaaacttgtcctggagaggggggtgaagcagttcaaaagaaatacaatgaaactactggtgagcacattagtgtcagaatttacagtagatacatgtgtcactcctgaaggtatccacagagacactgaacaataagagagacggggccatggcaggacagagcagcatgctccggacccatagggcgagatggaaagatgctctgggctctacatcactacatgatgctgcgtactctgggtcctagtcctcccatcagcaaattaagaatatgcaatcctccattcatcttatgaagatatcatgagcagatatttgatgcttattagcattttgagtttttaaagttcttaaaggaaatccatgtcaggtgggtgcggtggcttacgcctataatcccagccgtttgggaggccaaggtgggtggatcatctgagctcaggagttcgagaccagcctggccaacatggtgaaacccctgtctctactaaaaataccaaaattagccagggtgtggtggcacacatctgtaatcccagctactcaggaggctgaggcaggagaatcacttgaacct

SEQ ID NO: 18197 - DNA, 612 bp, Homo sapiens
gtgtatataattacatatcccagagccagagaggattagaagtgctacagaagtgaatgtcaggcaatatgatattccacaggtgtgaaagtagcgtttctacagagttggccaacactctctaaatcaaaaatatctgctgccgaatggggggagaaagaaagtgaagtgaatcataaactagagtcaaatgggataggagagacagtacagagtagtcagcccagcagatcatacaaacctgactgcccacaccttgctccaaaggttgagtcctttatcaaagggacgtgtgatttaaattgaaataatacgtttaaaaaaaatgattttaggcccggcgtggtggctcacgcctgtaatcccaacactttgggaggctgacgcgggcagatcacaaggtcaggagatggagaccatcctggctaacacggttaaactccgtctctaccaaaaaatacaaaaaaaaatagcagggcgtggtggcaggcacctgtagtcccagctactcgggaggctgaggcaggaggatggcgtgaacctgggaggcggagcttgcactgagccgagatcacaccactgcactccagcctgagtgacagagcgagactc

SEQ ID NO: 18198 - DNA, 506 bp, Homo sapiens
gagtggaagaaaaggcaaatctgtattggatagacatcagtactatctgccacacgtataactgtgctgtgttaaaactgctaatattttttccaaagccagtttaaagaaatgcagttttttagatgttttgaacaattgatttaataatatgcaacgatagatggaattttatatttaccataaaaatcttggaattctggccgggtgtggtggctcatgcctggaatcccagcactttggtaggccgaggcaggtggatcacctgaggtcaggagttcgagaccagcctggccaacacggtgaaaccccatctctaataaaaatacacaaattagccgggcatggtggtgagcacctgtaaccccagctactcgggaggctgaggcaggagaattacttgaacctgggaggcagaggttgcagtcagccaagatcatgacactgcactccagcctgggcaacagagcaagactccatctcaaaaaaaaaaaaaaaaaaaaaaa

SEQ ID NO: 18199 - DNA, 629 bp, Homo sapiens; identical to SEQ ID NO: 17935

SEQ ID NO: 18200 - DNA, 645 bp, Homo sapiens
actaggcagcacaacagagataaataaaatacacggtaaagagagaaaataataaaatactgtaatttggcctcccagcatgaaggagggaagctgagactagaagaatggattagaattcatgagtcatttgttcagcttggaattgaaggaggcctggctgtctggagaggctggagcaagttggttgttcttccttccaaccctgagatcccagtacaatggacctgcactctcactctttctccttcgaggttaaccgttttttaagcaaaaatcttgggcttggcactgtgcctttcatcttcacaaagccctgcaaggaatatataaggaaactggagctcagagatgtgtcgcgacctgctctgaggtcactcagctggtacagaggccacagctaatcccaatctttgtggctgttactggtgctcctcttcctgcagtctagtgcttctggtgtcctttgacatttgacaaatgacctctgtttgagaggcaaagcgaaagtctcaccaaagtgagcaccagggaaccaaacagtctagaaatatccctttccatggacaaaaggcagagacatgcttttaattacctacttctgaggctgccttgagtcagagtctgctatacgaatgatttgag

SEQ ID NO: 18201 - DNA, 578 bp, Homo sapiens
tgtgtatatatatatatatacacacccatatatacacatatatatacacatatatatacacacacatatatatggagattatctgattaaataagctctaattttatttttaaaatgaaagatttctgaaactttaagtttacagttcaacttattgttttgtaaaacaatgtagcagagactatattaaaatccatatgagaatgtgtatttgatagtttagtgaaaagctgttagcctaggatataggtgcaagtaatggaaacattttcacattaggtgaagagctcaaaagaaaaaggattagtggccaggtgcggcggctcatgcctataatcccagcactttgggaggctgaggcgggcggatcacgaggtcaggagatcgagaccatcctggctaacacagtgaaatcccgtctctactaaaaatacaaaaacttagctgggcgtggtggcgtcgcctgtagtcccagctactcaggaggctgatgcaggagaatcacgtgaacccgggaggtggaggttgcagtgagctgagatcacaccatggcactccagcctgggcaacagagtgag

SEQ ID NO: 18202 - DNA, 78 bp, Homo sapiens
acatatacagtcagtgtgtacccataaaaatttaaaaaggaaaagataaacaacctgatattacaactctagtaacta

SEQ ID NO: 18203 - DNA, 571 bp, Homo sapiens
taggcacacaagactgcccgatgagtgtcaattgccatccttgttaactggacgcctattactaggccaggtccaggcttaggtgtatcccacacgaagccaaaccggtgaccaccgcccacatggagaaagcaagtgattggctgcgggtcttctgtgtgttcctcctcccacaggaagctactttcgcctaaacaaggacacttgccatccctggctgaccatttctgaagacggacttacggctgtacgaagtgaaaggagaacccccgccagggagctgtcacccagcgacactcacttcaccaggtactttgtcaaccgctcacaagggcgttctgtgaacttcccgaaggtgcactgttattcaggtcaaatccgaatatggcacggaggcagcctcgagggaaaaggaatcctacaaatgagtgaggagggaggagcctaatggggaggggacccagaggagtgtgggcaagaggggtcaggcaggtgcaggcagaagagccccctgggacggtgaggtcaggagagggcgcggtcccctgggagggcatggtccctgggtcct

SEQ ID NO: 18204 - DNA, 421 bp, Homo sapiens
cgcagtgggtgggtgctagggcagtggtgacttagtagattggggtgttcctgcaccccggattttccagcacctccaacaactaaataatggattaactgattcattgcattttcctctcccttgcgtggggaacacttttctctgccccgaagttcccaatttggcccataaataggaagtgatgtcaccctctgcctcaccagggaagtgctggccaccttcctgcaacacctcagccgtttgcagggaggactgagtgggagtttcccttcctctttcctcccctggggaaaagggtatcttgagaggtccaggccatgggctggggtctctcttgggccaggttaataggacagaatcgctgctcctccatggcccctcttgttttatccctttctttggatcagcagtggctcgc

SEQ ID NO: 18205 - DNA, 612 bp, Homo sapiens
tattaataatgctaaacacttaccagctttgtaactttagctatctatcaccattgagttgtttcctaatctataaaatggtggtaatccctcatacgactgtggaactgatgaaataatatggcatatgtaaacatttggttcaagacctgctacattggatgaggaatgtcaacagtaaagtaaaattttgatctttgagtgtgtagtgagcttgttatgtcactttctgtggattctatttgacactcataaagaaaaactctaggtttaaaaatggaactaggccaggcgcagtggctcacacctataaccccagcactttgggaggctgaggcaggcagatggcttgagcccaggagttcaagaccaacctgggaaacatggtgaatctccatccctacaaaaaatacaaaaattagccgggagtggtggcacacacctgtagtcccagctattcaggaggctgtggcaggaggattgtttgagcccagaaggttgaggctacagtgagctgtgattgcaccattgcactccagcctgagagacaaagcaaaaccctgtctcaaaaaaatttttctgggctgagtgtggtggctcacacctgtaatc

SEQ ID NO: 18206 - DNA, 612 bp, Homo sapiens
gagctaccaaagaagcacctgacaatgagaaaatgctgatgagatgagaatttaagatataaacatctcctgggagtatttgcattataagaggagattatagaaggcccacctttcagaagatacacaaagaagtctgtggccactctccccagcaaaacagcaatttagtaacaatcataaaaacattttaagtctctgagaattgtcctaaggggataatgacaaatagagaaacagtcatccaagaaaatctaccaaatcttggcaagaaccatgagagtctgtggcatctggtccctgacctgttccatgaccaacccctactagctctgccttacaggagctttactctggggcagtgcagtcaggaaggctgggctctccatccccccaggtcccatcaagaaagtgaaaaagagcctacagaaagagagaaccaccgggcatggtggttcacacctgtaatcccagcactttgggaggcccaggcaggcagatcacctgatgtcaggagattgaaaccagtctggccaacatggtgtaacctcaactctactaaaaatacaaaattagctgggcatggtagcacatgcctgtaatctcagctac

SEQ ID NO: 18207 - DNA, 602 bp, Homo sapiens
agttagcaatgattgcatacataagagaatagaaaaatatagaaaaagaataatgaatttctctatgcagtttgcacggcttagttggcttctgctgacctaaatgaagtctaaatggaagaagcttatatgttccaaactctgacgtaaattcaaattcagaaaatgtaataaggactataaatccctttattcgtcattgtgagtcactaaatatgaactttatttatagctgtgtataattatatagtctttggcttgccataagcaattttgacaggagtaaatatcattagagtagaaaatctttcacctacacagatctatgcttcccagttaatattcgtgactaatatattgtgtagcactatggatgttaggaagcttttctccacgtacacagcaatggttcttgtattatagatattttattggctgataaagtatttttactggtatttatgtagtcttatttcccacatcacaacttccgacttaaatgagtgaagacagtttatttttttcttcagaactaattgaatgaattctgaagacttgctgtttaaattatgcaaacataatattttctcacatttatggct

SEQ ID NO: 18208 - DNA, 494 bp, Homo sapiens
tggcgttttgtatagattttccaaaagcatcagaaaaacgaagtgatgaaagagtgtctagcaagcgggttctcgcacccctcagagcacaggtcattatcaacctaggggaaaactgcaactgagttttccttcattttcttttcctattcaggaagaagcaactagaaaaacaaatgtaatttttgtttctttttagctgtaattgctggagttaatcttcattttcactactagaaaataaaggggccaggtgcagtggctcatgcctgtaatcccagccttttgggaggccgaggtgggtggatcatgaggtcaggagtttgagaccagcctggccaatatggcgaaaactagtctctactaaaaatacaaaaattagccaggtgtggtgtcgcgtgcctgtagtcccagacacctgggaggctgggacaggagaattgcttgaaacccggagcggaagtttcagtgagctgagactgcgccactgcact

SEQ ID NO: 18209 - DNA, 615 bp, Homo sapiens
cctgacctcttatctctcatatgacctggtctcggtccccagaaatggcaatctgaccttcaactatgtgtgctaatgtttcctgctctgattttcaatttgaccatagtgggtttcttctaatcatgtgtctatgttgatttttaaagctttaattattgcaggagaattataatacctcttccaagtatttatgatttctcaactgaatctcttttttcaagattcagtatttgaaaaacctccaaatttcccaagaaataatgtgaagaaactcccacatggaaacattatccacggaccatggtatgaataaccaggatccagggtttagaaagatcttttctttttcacttttcagagtaagtgtctcacttatgttgcgcaggctggccttgaactcctgggctcaaatcttcccacctcagtctcccatgtagctgctgggtctacagttgtgcatcaccacagctggctatatgggagaacttttctaacataaacaacatagattggttagtccagagaaagcaaggtaacaaaagtcattgcgaagattgcaaaaagtctgcagagccccgctaaaacacacacacacacacacacacacacaca

SEQ ID NO: 18210 - DNA, 597 bp, Homo sapiens
ccactgcttcctactgcagttgcagtaagttagacccttcccagtggtccaccctgtctttctctcatctcatttcatcccagtccccctgattctctggctttctctgggttccttgaacacatcaaacacacttctaccttaggacactccctggtgttcctccctggaccactctacccagaaatttgcattcttggacctttctttttatttaaatcttctcaaatttcattcatatcacctctgcagccttccctgagccccaccccccaatccaaattagcaccatctccagtcatttgttcccacaccccttgtcttactttcctctgtgaccctctccctatctgtatttgcttcctggtctgttgtctgtctctctccctaaactatagatctgtgagatcacaaacctgtcctatccaccactctatcccgaacagctagaatagcacctggcatggactatatggttagcatatatttgttgaatggataaataaatgagtgagtgaatgaaggtgtgaaaaaatgaatatcctgagagtagattagagtgaaccaaaattcaactgccattcattccttgcacag

SEQ ID NO: 18211 - DNA, 486 bp, Homo sapiens
  misc_feature 273: n = A,T,C or G
gacacagaagggattccctaatatatttaatgcctatgctatattctgatctatccttggttctttttaattgtgttactattttataggtcctgtgtgattgaaacagttatagaaacaaaattgccaatacaaaagtccaggaacagagggatccacagcttaatactatcaggcattcatagaagaattgatattaatactactgaaactattccaaaagacagaggaagtgagaatcctccttaaatcattctgttaagccaatatcanccctaataccaaaaccaggaaaggacatcacaaaaaaagaaaactacagaccaatatccctgatgaacatagatgcaaaaatctcaaccaaatactagctaactgaatcaaacagcatatcaaaaagatgataaatcatgatcaagtgggtttcatgccaggaatgcagggttggtttaacttatgcaagtcaataaatgtgatgcaccacat

SEQ ID NO: 18212 - DNA, 474 bp, Homo sapiens
atattcaaagtgctcaaagaataacctatcaatcaagaattctatatccagcaaagccatcctttaataatggaggagaaattaagtattttcacattaaaggaaatctgtcactatcagatatttcgtacaagaaatattaaaaataatcctttgaaaaatgacaaggaattaatataaccagaagatatctaacacaaagcagtttgtgttgaataaaaaggacattatagaagttgaataaaaaggacattatagaagttgaataaaaaggacattatagaatgttaaggctaggcctgatggctcgtatctttaatcccagaactttgggaggctgaggcaggagaatcacttgagcacaggagtttgattgagaccagccaaggaaacataaaaagacctcatctctgctaaaagttaaaaaaaaacttaaccaggcacggtggcacatgcatgtagtcctagctactt

SEQ ID NO: 18213 - DNA, 530 bp, Homo sapiens
cagaaggggattaaccctgcataaaccacgataccttctaaagtttcacactgtctaccactagcagaaagtctgttctctcagcttgttcctactcagcacttcttcagatgttttcccttcttttgcattattcatttcttgaatgataggagtttcgagtataagttgaatatcaggtttctccattttctataaattggataaatttgcacccacttacaggtttggtgatattgggaacttctcatttttgtttctatagttcatgtatagttactatttcaaggtttcaaatctgttttttttttaacttgtatttaagttcaggggtataagtgcaggtttgttacataggtaaacttgtgctgaggggctctgttgtacagattatttcatcacccaaatattaagccttgtacccattagttatttttcctgatcctgtccctactcctaccctccaccctcatgatataatagatttttttcttactttagaagtttttcttgttcattataggaaattt

SEQ ID NO: 18214 - DNA, 473 bp, Homo sapiens
taacaaaattttttttagatacagagacgccttctgttgtccaggctagagtccagtggtgtgttcatggttcactgcagcctcaaattcctgggatcaagtgatccttctgcctcaacctacagagcagctgggatcacaggcgtgtgccactatacccagcttctttaagacacgatcttttaaaatgttccttagttaaggcaatagactcaagtaatgatgcgttacttacatacataagcaacctattaagagtctattagaacatttaatatctcatactatgggataaaggtcccttcctccttttggcttttgcttttcaaaattataatttttagtatcgttcttcctttgcatggctttttccatcaacaccaaacagaaccacagtggaacagagtaacaaagaaaaagcaccaaatcaggcgaggtgcggtggctcacacctgtaatcccagcactctggg

SEQ ID NO: 18215 - DNA, 385 bp, Homo sapiens
ttctttgaatcacttaccacatgggtaagctgccctcagctccctccaagctgtgtctccctcccggcggttcctcttacactccttctccttgtatcccatccctgatcaatattctccagcagttctccactgcctgcacacaggatcaagttcaaactccgagaccttgcattctcagcagctccctaattctgtctctaggtccttcccgtccttgcacacacccaactcataccttactcttgcctgctcccagatatgtgttgtcctcaatggcttccctgcctcttttgtgtgctatttcccttcttagaatgccatcttcacccttagttacagaaacaccccactgaagcccctcatcctccacaaagcctttctg

SEQ ID NO: 18216 - DNA, 410 bp, Homo sapiens
  misc_feature 254: n = A,T,C or G
atcttataactaatcttattctgtgtaactaaacaataggttaggtgtctgtcacagcatttcaactgaaataagactgaacctatcctaaacccctcacttgaaatgcccggtcttctatgtattcaaactctattcaaagtccatttcaagttctatgttttacataacaccatctttgaatttcaagaggatttatacagcatagccctacgtttggtgctatcactacttattttttttgagacagggtnctcagtctgtcacttcaggctggagtgcagtggtgccaccttggctcactacaacctctgcttcccaggttcgagcaattctcccacctcagcctcccaagtagctgggattacaggcatgtgacactacacccagccaacttttatatttttagt

SEQ ID NO: 18217 - DNA, 577 bp, Homo sapiens
tcttctatgctccaataagtacatcctatataacccatcaccactttcttaacactttcctcaatgtactgtaaccatgggtttctttgttcctttttctgctagaattaaaaaattcagaggtcagagattatttatttttgtacattttgactgtcacataaaagctgcccagtaaatatttcttgaatgaaaattgaaagacaaatctaagcatagatacataatagcttgactgggaactggaaatttcagagtgcatttgttttgttcattgaaaaaaagagccatgggcagcaccactttaattaatcagtatagatttattactgtgcatgctctacagagactagcaacaggctaagccccaggtgcagggcaatgagttggctgattttctcctgctccaatgttagcccatcatccttcttatccctaaagggaggctaataaattatgatagtatgacagctacttctgcccactgttaagcatgtcataagttgttacatcatagctatattgaataaaaacctctgtagttttaaaatgttataaaatctgaataaacacacac

SEQ ID NO: 18218 - DNA, 563 bp, Homo sapiens
acttattcatctattcaacattcttcatccattcaacactcataaatatttagtgggcattcacaatattccaagttcaaacttgactttcagtgagttcacagataacggtttccaggtggctaaatttgacacatctgggagtcaggcaacaggaattcaggttaaagaaaacaaagagaaagatcagatacttgggcagatagtgaagccagtgagagaacctgggccctcaggcccctggatccatcctctgcagagaggtgctcaatcctttgcagctttgcagagaggtgctcaatctaaattcaggaaaacaaactctcctatcacagatagggaaattgaggctgatcaaactcttgtacaattttgtttattccatagcccctatgtcaccctatcaccgtattaccacttctatctttgtaagtttctactgaaaccccttatcttagtacaaaaaggcttccaagaatacaaaaattagccaagtgtggtggcaggcgcctgtaatcccagctactcaggaggccgaggaaggagaatcaattgaacctgga

SEQ ID NO: 18219 - DNA, 553 bp, Homo sapiens
cattataagtaaaactataacataacataaatattaaaaagttaacacactgttcatattttggtttattaccctccagtcatttttctatgcatattgtcactagattgaggtaatactatatagagacttttgggtccatgttttgaatatcatattatgagcatttcctctgccattaaaattcttcatggcagacctgatttttaatgctgcataacattccacttttcctatgatccataatcattttcctattgttctgtttttagggtgtttctcatttggttataaataacttaatgaacattctttcatgtgaatgtttttaccatatttcatgttattcttaatataattttttaaaaatagaattactgaattaaagaatataaaaatgtaaggctcttacttttttgtgctgtaaactcaaaatcgaggtaaactatactaatcatgaaagtccatttgctgcacatcaacagtgaatattaccatccaaaaatattaactatcaggcaagatctgttctaaatggatttaaagcataacg

SEQ ID NO: 18220 - DNA, 357 bp, Homo sapiens
ccctgctaatttttggtattttttttagtagagacggggtttcactatgttggccaggctcccaaaatgctgggattacaggggtgagccacccgaccataactgaccatatttttatataaccctaatgttcatctctgcatcgtagaattactggctgtggggaattcatggatttctcacaatccctaatatggctgagtctgtggttccacatttggctgcacactggcattccaggggaccttcagagagtactaatgtggagtcccacctccagagactgtggtttgaatggtctagggttggccaggggcttggaattttcagattttaaggagaactcatgggaaacta

SEQ ID NO: 18221 - DNA, 517 bp, Homo sapiens
aaaagtaatgtcaaaaactgcagttacttttgcaccaacctaatatgatagactaaactataaacatacaaggaagaatgatgtgtaggaagtttaatacataagaattgggatctggctggatgtgttgggtcagggctgagttcagagtgaacagtgatactaaggtttctgcctttatctattcttgagaaaaatggatgatgtttcgggtttttaaaaaagtttcactttagagcagttgagattgagtgtttttagaacatctggctattgagatccagtaagacttgaagaataaaggtttggggtttatgaaagaattctagggccaataatacagatttaggaatcatggtggcattttatggcatgagagttgatgtgatcacaaagggaaactatgggggattaggaaagaaggaaaaggatgaaatcctaagaaactccagcatttagaaagattgtataggtacaaaagccaacaaaggaggatgagatgaaagtaagggaaaac

SEQ ID NO: 18222 - DNA, 493 bp, Homo sapiens
  misc_feature 417: n = A,T,C or G
ccagataaattgcctcttatcccatgcctgaaatgttttgaaacctgatgacagtaaaaaagaattcatttagattcaattgggtattaaatgataaattttctatttgcataagtttggcttctttaactttatacttaacgtgtcagtttttaatgtaattaatccatctgtttgtgcttgtatagtgcttttaaaaagagaacatttcatagtagaatgtacttatctgaattcagaataaaataaagctcacgggaatgagcattttaagcttcacataaggttatatgtggtaatctgtgacttttcagtcatattaaatagaccccggaataatattctcagataaatacagcatttttattaatcagtgtaactgagtgcaaattaaattccattcctccctccttattntataaaaacagaatggtatttgggaaaataaaggatattttaaattgctcaaagagttacatatcttacctgtata

SEQ ID NO: 18223 - DNA, 543 bp, Homo sapiens
ctgcaacctcagcctcccgggttcaagcgattttcctgtctcagcctcctgagtagctgggatcacaggtgcacaccaccacgtccagctaattttgtatttttagtagagatggggtttcaccattttggccaggctggtctcgaactcatgacctcaggtgatccacctgcctcggcctcccaaattgctaggattacaggcctaagccaccgcgcctggcttaattattcacttttaattaagcaagaaaacttattttaattaatgagctcaagcttacagaaagagggtgaagtttttttctacaacttccaatcattcaccagcagattgatatagtctggttttatttctgatctccatggcctagttctacccaagacatacacctgcatctctggaattctaggtctgatttcaggttatttttgtaaatgttgatgaaaatcgaatgtacttgagttgaaaataaaactcatatttttccattcaaaaagtatttattgaactccctactcaatgctatgtactacatgagag

SEQ ID NO: 18224 - DNA, 406 bp, Homo sapiens
tttactggtgctatctgaaatgatactgaaaaatgccgatgccaaaggtcacaatatctaatatgatgagttgttgctaaatttatatgtggtttatatcttttaaccacagtaagcatgttctacttcagagtttatagcttaaatttgtacctaggtaacactgttttatcccttttttttggtttgatttctctctaataattgatcttaaagaatagaataaacagaagagactctggccccaagcagtcaagttataggtggattttattcagtaaaatcaaggcaaaataaagacctattgattcctgggacattttgtcattttatctttcctgagttagacatcctgaccaccctaatagccaaatgaaatggatagcagcagcttgaagtcatttat

SEQ ID NO: 18225 - DNA, 578 bp, Homo sapiens
tagattatttcttcttaattaacagtacaaatagaatatgtcttctgactagagttaataaagacttctgactagagttaataaagacaagatgactcattaaaacaatggtactaaatattaaacacttattttatttctctcaacctccaatcacgagcccccagttaaatgcattaaggaattttatttatttatttatttatttatttatttatttattttgagacggagtctcgctctgtccccaggctggagtgcagtggcgtgatctcggctcatggcaagctccacctcccgggttgatgccattctcctgcctcagtagctgggactacaggcgcctgccaccacgcctggctaattttttgtatttttagtagagacagggtttcaccgtgttagccaggatggtcttgatctcctgacctcatgctccgcctgcctcagcctcccaaagtgctgggattacaggcgtgagcccccgcgcccggcccgttttaaggaattttaagggcatcaaacttatttcaccagggtagataaataagatatatttataatctcaggtatgaaag

SEQ ID NO: 18226 - DNA, 532 bp, Homo sapiens
cttgtgtggtgcactgtgctcctgtctttagggacccgtgaagacaaacttcttccttcatgatagtcatttccatgcgtctgtgtccatactatctctggttaaaacaaatcccaggtacattttaaaacacggatggtggtagatcttgcatggaatggtgatctagtcacatatattttatatactctggaaatgatgcaaaaattggctacaagaaagcttatatctctccttgtaatcttctataacaattttaaactaactttttctacatacagcatgttgtttcctagatgaggcgatgaaattctttatgcagcaagagttttccagtatatttcaaaataccttattgtgaatgtttttgaaatgtgtaattactatctgattaccatatgttaaaaattttaccaaagtaatgtaaaatattggattagatagtaaaatagaataagcactccataagaaatgtttttcctaagaatggaatatgtatgggtttagaagattggatggataggccgggcgc

SEQ ID NO: 18227 - DNA, 515 bp, Homo sapiens
ggccagagtgactgaaagtgcatggctccaggtaggtgacatggtactgtataagttttcttgacccatggttggcttcttgagtcaatggatcagagatagtttcgaggtagacagccacatttctatgccccaagaacactcgagatccctctgcattctctgctgctgtctgatcacgtttttgtttcaagacaagcagctcaaactgtcccacagcttagcaagctatagctcatgggccaaatctcgcctattacttaaaaaaattattatatttttggttttaaatttggggtaaaatgcacataacataaaatttgctatcctaacaatatctaagtggcattaaggacattcacctggttgtgtatccatcactaccatccatctccagaacttttcatcttcccagtctgaagctctgtacccattatgcactagctttcacttccctctgctcccagtccctggcaacctccattctactttctataatttgactccctgggagc

SEQ ID NO: 18228 - DNA, 649 bp, Homo sapiens
aatgtagagaaacttatgattgtcagatttagcaaataaaaatacaaggatgcccagttgaacttgaatttcatacaaactacaagtaatttttaatataagtatgtcccaagtcttaaaagaggactacaaataatttgttagtgtgagtgtgcccgtaagtatttgggacatactcacactaacaaattatttgtcatttatctgagattcaaacttaactgggcattctatacttaacttggcaatttgaggaagggtgaaaaaagagaatacattattacattgcatcatggagatacagaccttaaaaataaaaatgttgtaggctgaggccaagacacagaagcctttgcagcagtgctaattgggcattataagtttatatttattaactcttttcagaaatcataatcttgaaggaaaatatcccaaatcatctcaatacagacaatatccgtacaaggatactacttgacatattcaatcaaaacaatatgaattcttacaaactaagaattggactagaatttagaatgtatgctcattggccttttagctatttatagctggagtcccacagataccaaatgtcatgaatggaaatccacatgcccatcattgacaatctaaacagaacttgtttgat

SEQ ID NO: 18229 - DNA, 605 bp, Homo sapiens
tgtcattacccgagctagggcaaagcaacttcagactttacaaggccatggaggtgaggctaagacagccggtgcctggaatcagtactctctgccacctcatcttctgcaatctaataaacccaatctttctcttttttttgagacagggtctcgctctgtcacccaggctggagtgcagtggcatgatctcagctcagtgaaacatccacctctcgtgctccagcgattctcccacctcagcctcctgagtagctgggaccacaggtgtgtgccaccacacccggaataatttttgttttttttgtagagactggatctcaccatgtcgcccaggctggtctccgactcctgagctcaagtgatcctcctgccatggcctcccaaagtgctgggatcacaggcatgagccaccgtgcctggccaaaacccagcatttctaaggacttcattaacaaagaaataagaacaataccaactctagtaagcgacttctgtatttttatccacaaactaaataatgctaacagtaatttttaaacccatttttttccctgtgaacatacatagcttatgcttttccaataactaacatctctgaaaaa

SEQ ID NO: 18230 - DNA, 280 bp, Homo sapiens
tatgtatacaaaaatatttgagttactctgaatcagctttttgtcttctttttgtgaacagaagttgaacctttggcctcagagcattgctattacatgtaacggccaagagaggactgtacagatgtaccaagggcttagttaatggtcgtggcaaattgtatgatggtttccatgtattagctcccttcctggtaagctggttatacattcccgccagaatgagaagagaaatagaacagagcctccacgggtgatttacgactgctggcatgtaagt

SEQ ID NO: 18231 - DNA, 607 bp, Homo sapiens
agttgcatcacagctagagagcagcacaaagagcagaaagtccagaatttaaaagctaagcttatacttgacaatatttttcatattaatgtaatttcttcctaaatattttaaaatatttcttatgaaacatacttaaggatctctttaactgcccctttgggaagatggggagatggctattgctagctattctgttttgactaccactatttaataaatgaattttaaatgtattatttaattaagaagtattctctgtgcagacccacttactaaaaaataaaagtaataccttttatttttaaaacattattgatatggtttaataagaaagagtttaaaaatagattatacattaaagtatgtctttatattcatttcttctttgcatttttcgaccaattccctataaattacggccacttcatggtaaagaaaccttaattaaaataccaagtgcaaaggaaggacaggatttggatgacatatgtgaatgcaaatgaaaagtactctatagggaaagtgagacttcattgaaggtgacatgcttatggaaaaaaagatgtgctgagcaagcaccttagctgaacaagcaacttggggc

SEQ ID NO: 18232 - DNA, 389 bp, Homo sapiens
gccaggctggtcttgaactcctgacctcgtgatccacccaccctggcctcccaaagtgctgggattacaggtgtgagccaccgcgcctggcctgtaggttctcttttacgaggcaactaattccaataatgagagctccatcctcgtgacctaatcacctcccaaaaagccccaaacccatctcctaatactatcactttgggagttaggatttcaacatatgaattttgggtggacacaaacattcattcaataacagtgactatactatcctatgttaacattctactattttcaaagcttttgttcactttgtatatatgcatttatttatctttgtagcaaatgaaggataaaaatatcttttggagtattatcttgacatactc

SEQ ID NO: 18233 - DNA, 208 bp, Homo sapiens
aaggcttaatcctgacctttcttagatacttgccacacctatttagcattgatgctgttcttattttatggatacaggttagagttcttatcaaaatgatccatactaacgcagagcattttttctgaggcatttataaactaccagagtttactttcaccaatgattacattaacaaatactttccatatgctaaaatagttttgcg

SEQ ID NO: 18234 - DNA, 465 bp, Homo sapiens
accagggaccctctctacaaatgctctaactttcttgccgggaggcatcttccaaccacaggcacgggagggagcccaagtggagcacagccactcgctgagtcgaggagacagagattggagttcagggagtctgaagtgactgaaggctgcagaacagaattccagaggggaaggaaatatgaagaaatacctcagaaggagtgcccaggatcctcatggcgcccccgatgtcctggatgaatactcaggtgtgtgtgagcaggggacattccctgcagctatgtaaagggcgcccgtggtctgtgagctgaagggctcctggacctcacacaggctgagaggagtgcatactccgaccgccagagtggagagtgcccacggatccttcagcacactcagtggagaccccagaggaccacaattgagtgttaagaccaaacctaaacccctcccagtcaaagc

SEQ ID NO: 18235 - DNA, 539 bp, Homo sapiens
agacccagcaaaattgctatatgaataaaatatgtatacaaactaatctttttaaaaaacttttcccaaggctgtatatgaatataaaaacccagatttgaattatacatgcaaactgtaaaagcagagacacatgctccctattaagtctgtgttttaaaatatccagttaccaatcaagaaaccccagtagattccaaagaagcatatgtaagaaaccatgacaaggtaaaagattattatctggcaagtagtgcctagaatcaggtctgagggggccagaagggactatgaatcacaaggtgagaaaagataatttgcagcaaattggtaagatatgtgggaggagctaaagtagttgggtctgccgggtgaggtggctcacacctgtaatcccagcactttgggaggccaaggcaggtgggtcacctgcggtcaggagttctagaccagcctgaccaacatgccaaaaccccgtctctactaaaaatacaaaattagccgggcgtggtggtacatgcctgtaatcccagctactc

SEQ ID NO: 18236 - DNA, 481 bp, Homo sapiens
accctcctttcatcatcctcagcttcagtgaccttcctgaacctctactgggctgctccaacctcaattctgcctctccaaccccttcctctggttgatgtcagttctcagcttggtgtcactgcatcctggaaaaagacagacacaagcccacaaaaagatagatgcacagtgttcatttaaaaagagaatgagttttcccagatctccaggtacttgcagtggtctatgtggccaggcaaatatttatgataatttacacacaaacatatatataggtacacacagacacagacacacacacacacaacacaatatcatttccaggagtgtaaagacatttgatctttagaatgacttaaaacgaaaactagatgagcatatgtgtgaggctgaaagtagttgtgagttgcaggtagatagctgaggttagatcagcagcatatttacatagtttaaaattagtagaggagatactggt

SEQ ID NO: 18237 - DNA, 569 bp, Homo sapiens
cccaggctggagtacagtggcacaatctcaaggtggcgagtccaagcaattctcccacctcaaactctccagtggctgggattacaagtgtgcatcaccacgcctggctagtttttgtatttttagtagaggcagggttttaccatgttggccatgctggtcttgaactcctagcttcaagtgatccacccgcctcggcctccaaagtgctgggattacaggcgtgagccaccgcacccagccgataactacatttcaaattcagttacagtcttgtttaaccccatgataattgtgatctcctttttctctgggcctaattttctatttctagttttctagcctattgtaaagaccctttatgctcttatggacaagagaggagataaaattaacatttggtatgctgattttagaattatttctgcaatttttacaaagataaatgcaaagaatatgtcctatgttatgatatttaaagaatttgtagaggttactccgggcatactgcatgcctatggggtagctctgttccacaaggagcaaaaaaaaaaaaaaaaaaaaaaaaa

SEQ ID NO: 18238 - DNA, 413 bp, Homo sapiens
ctgatgaattgttcccaactaaaaacttgtgattaggttaacttaaaaagtcacaatatggatggtaaattaggaaggtactgtctttattcttagaaaacacagactgaagcatttagggatgaagggtgaggaggtatgatgcttgcaacttatcttctagtggttcataaatgcacctgtgggtgtgaggagcaagtgagaaaaactagtatgtgactcttgtaaaggttatcagatgtgctttatactattcttgcaactttcatcaatttttaaaattatttccaaataaacataaaacgaagagtgaatttattagtctttgttttcccctttccaacacacacacacacacacacacacacacacacacacactatggatttgggtatttttaaatactctatacc

SEQ ID NO: 18239 - DNA, 485 bp, Homo sapiens
ccaagtggaaagagcttggtaacctggcgtttgcccactcattcattcagtaggcttactgagcacatactaagtgccaggtgctgtgctggggattgggtctataaggaaagcagaggggccattctgagagctagccagggtgccgctcaccacgctggggtccaataacctggggctatgttcttcccattgtcctcgctttaccatctgccacactggacctgaagtttccatccttggcccttcaagggctccgtcttcagcaccactcacttgcagtgcctttcccaaaaagggcaaaagccttccttatttggggcacaatgtgggtggagatgtgggccacacccacaggagcttcctggccctggcccctatacttcctcagggatgaaacgggcctttcaacccagtgggcaggtaggggtctcaataatggttctccttttttggcatctggccccataaacatgacagcagac

SEQ ID NO: 18240 - DNA, 328 bp, Homo sapiens
aatgttaataatgtctactacatgctaataatgtctactaaagtacaactgtgaaaaggttgtcaacaaaaattccttatgacccaaggaaaactaaatttgcgtcccaaggctcttaagcaactgtatttaaactctgcacttaaaaattcatattacaaggccgggcacggtggctcacacctttaatcccagcacttgggaggccgaggcaggcgaatcacaaggtcagaagttcaagaccagcctgaccaacatggtgaaaccccatctctaaatacaaaaattagccaggcatggtggcacacacctgtaatcccagctactc

SEQ ID NO: 18241 - DNA, 513 bp, Homo sapiens
  misc_feature 394, 395: n = A,T,C or G
ggaagaccctgcttaccacacagggacaagtgtttaaaagaagtaacagttttaacagaggatgaagggaagtaaagaagggagagtgagagaacatggagctccaaccgcacatgctatttactgaataaatgtgctgttcagggtgattttagtccatcaacaaatattttgtgagccctactataggccaggcaaacagtaatgaaaaagcaggaagcatcctttccctcatggatcttacattctagtagttaaaacagacactgagcacaccattatatgtaattaaataaatcgcaagtggataaatgctgtgaagaatatatacatagaagtgtaggaagataggctgggcgcagtggctcatgcctgtaatcccagcactttgggnngatcacgaggtcaggagatggagaccatcctggctaacacggtgaaaccccatctctactaaaaatacagaaaaattagcttgggcatggtggagggcacctgtagtcccagctactc

SEQ ID NO: 18242 - DNA, 558 bp, Homo sapiens
ggctggagggcaatggcgctatctcagctcactgcaacctccacctcctaggttcaagcgattctcctgtctcagcctcccaagtaggtgggatgacaggcacacgccaccacgctctgctaattttgtgtatttttcattgagatggggtttcactgtgttccccaggctgatctggaactcctgagctcaggtgatgcacccgcctcagcctcaaagtgctaggattacaggtgtgagccatcgcacctggcccacttttcttttacaatatggaattgatgaaatggtttcaggttcaggtacgattatgtgaatacctactgatcatgtaattaactaatactctcactgaaaatttaaattcaactggcaatatactataaagaaattcaggccaggcgcagtggctgacacctataatcccagcactttgggagcccaaggcaggaggatcacttatgccaggaactcaagaccaccctgggcaacatggcgagaccccggtttctacaaaaaaacaaaacaacaacaacaacaaaaacactagctgggcat

SEQ ID NO: 18243 - DNA, 427 bp, Homo sapiens
  misc_feature 260: n = A,T,C or G
gcaaacaaaattaaatagcttattaaaagggttatacaccataagcaattgagatttatttttagcattcaaggatgtttcatcacaagaaaaccaaactatataatacactacattaacagaatgaagggaaagcacacaacgcatgcacacacagacacgtaaatgcacacacacgcaaggccatctcaattatggcagaaaagcatttgataaggtgtagtgctctcttagggggatatggctatgaggaaaagtanggtgagtgtgtacaccattgatgtgttatctagagacacaaatataaacacagtagtaactggaaagaagacagacaacgttggcccagtacatgcaggagatagatgtggtgggagcttatggaagttcccctgtaaggaatagcaagcaattcttcagctgatat

SEQ ID NO: 18244 - DNA, 580 bp, Homo sapiens
cagaagggttattaaaaaaaaagaaaaacagttttgaaaatgataaactaaaggtatagctaacataacttttggagttttcatacacggattaagtatcaacatctcagaagtcaaaaatgacacagtatttaaagtttaaatttggtggatgaataaatgggacaatatttatttataaacactcaaaatttacctagtattaacttcaaaatattaacaggattagaatttttaaaagatgagagccccctagtggaatatagttcttattgcaatatttcaaaatagattaaaaaatgcttaagatctgttcaaaaccaaaaacatccctttagagtaactggactaaaattatgcgacagaaaaaaaaaacattaaactattactttctcagtacttcattttcagatggaactttaagaaaaagaatagtgccaaagggaaaggttagcaatgagcacagggataaaagcaaatgtagcccaaggaagcagtctgctctgccataaatattaaatgttggttttgccatttttttaagctgaatttctgaaagcagaaatagctgaaaagcaac

SEQ ID NO: 18245 - DNA, 561 bp, Homo sapiens
taacctgttacattgcattttgtacttttaaattacacatctgaattgattggttatccttgttaaagtagttccaaaattactgtagtttaaaaactctttaaatattacattgtagttttaatttgtttctgacatcttcaaagtttgaaattttcccttcagcaacaaccatttgttagctacattcacacgaaagcagcttaataaaggacattctacacaaaggtaattataatccattgatgccccttaatgcaagctgctttgtagtcattatctagcagtagatgactaaggaacttgattattcttgtttttcatttttattaaattaagaaggtttttttaaattatgtcattttgcaaatggttcttaggagtaatgcctttcaaggctccataatcactagataattaacctgcaaggattaagtacactcaactttgcctcaggatgcttaactctcaaatacagtcaattatctcatgataataactgctttgtcaagagttaccacttaactccacagtgaaaagtcaaatcacccataccatgca

SEQ ID NO: 18246 - DNA, 514 bp, Homo sapiens
acccctttcctctcccgggacacagctagagtgctgtgagcttgtcggtgtgccgtttagtgtccttctgaggtctcatgtggccttgctctctccccagctacaccgcgagctctttgagagcacggaccaggtctccggtttctctcatacccctaaaggctcggcacagagctctgctctgaagaggggcccagcgagggctgctgtctggccatggcggtcatatttctacctgagtgctggactctggggcccaagaagccccaactcatgttacacaagaagccggttggctataaaatgtggccgggcgcagtggctcacacccgtaatcccagcactttgggaggctgaggcgggtggatcacctgaggtcagcagttcacaaccagcccggccaacatgatgaaaccccgtctctactaaaaatacaaaaaaactagctaggcgtggtggccggcacctgtaatcccagctacttgggaggctgaagcagaagaatcacttgaac

SEQ ID NO: 18247 - DNA, 292 bp, Homo sapiens
ggttaaacactgcagtgctgcattggcaaaacaggtattgcccaaattctggagcccagctccaaccctatgagtttgttgccacttaagacaaatcttctcagatgggaaaagaactttctgtggaggagcgatgccatcacctagggctagaaaaataaacaagaaagagtcagaaaccaagctttgcatactgaagctaaataaatagtaacacctggtcaaacctcaatctttacaagatccgaaatctcatgaccagcctacctgaaatacagggggaagagggaca

SEQ ID NO: 18248 - DNA, 586 bp, Homo sapiens
tgttacttgatactctgccacccccaaacatattttctcttcaaaactgcatgtaaagtcaagggaatcttaaaattttctttcccagataaaatagtcaaagaaatgtcttaccctgttctatgagagttcccatacaaaataaaactaataacatcagagaaatcttgggggtggaatgtattacttggtgctttactcatgtgacttcttaatgctaaagaaatttcttgaatttctgtgtgattgttatcgctgtagacagaaaataaagttgttgttatgcaaaatattttagcttaaaaggttagcacatactgtaagtggattatttacttattaactcactggaggtaaaaatatagtaaaattgagactttcaaatggatacagagatgtgattacaactttagatcctttttttattcacctcagatgggtcatgtgccgacatcataagaggatttgagggaggcatatcaaacatgtgaacataaaaacccaatcattatgcttatctattacaaaaggatcaagtttaggctcttaaaagctcccaaatcaacttgatcaaaaacaataaaag

SEQ ID NO: 18249 - DNA, 256 bp, Homo sapiens
cgtaatttgttcagtttctccccattgtaagatattttgagtgtttccattttttttgttgttgttactgcaattttacattctcacttatgcctatcctctcacatttattcattcatttaataaacactgatttcttgtcatatgccaagcactgtttgagcagtaagaataagactgaaaattcaggtttatcacatcatggaacttatattctagtgagagaagatggatataaaaattgaatatcaattag

SEQ ID NO: 18250 - DNA, 617 bp, Homo sapiens
tagtttgtcattgtgataatagctgaaaacatagcaaatgctaccagagttaagtttatcttccaagatatgagtagattatgaataatattagaaaaagaaaataagcatattttgatagtactaaaacagatttacaaataaaatttactcaaaattcaaaagcgtcattcctacattgtttcattcctccaagggccagtgaaatatgattggcaatgtttttctttgacagactaatattaggatcattaaagataaagaaaaattttaaatgattgtctagtgggtatcaacgaactgattctaaactttatgtagaaatgcaaaagacccagaatagctaacacaatactgaagaacaaagctggaggactgatactacctgactccaaggcttcctataaagccacagtaatcaagacagtgtggtattggctaaagaatagacaaaccaatcaatgcaacagaacagagagcccagaaggagacccacataaatatactcaactcgcttttgacagaagagcaaagggaatacaatggagcaaagagccctttcaaaaatggtgctagacagccacatgcaaaaatgtgaatctagaacagaccttaca

SEQ ID NO: 18251 - DNA, 474 bp, Homo sapiens
taagaaattatataatgggtacaatgtaaactattcaggtagtgattacactaaaagcccagatttcatcactatacaatatactcatgtactcaaactgcacttgtaccccttacatttatacaaataaaaaataaaattttggtacctagaaagatataataaagggatatagtcttttgattaaaaaaaattatctccaccctgatgtggaagcagccatgagaaaagagatttggagaagaccttcttttggatgtcaactacaacaaaattacttattttcacaacatgtaaatatgttcattgcttgatttttttggttgaaaacatagtaagctaaattcataacactggcagtgtttctgtatgtaaacagcttaagactgaaatgactttgcataactaaacacattatataacagctcttcccagttgcctatttgaaagggaaacagccatatgaaccgtttt

SEQ ID NO: 18252 - DNA, 592 bp, Homo sapiens
aagttttattcagacatctgtgttcaggcaataccttagcttaaccagtaaaaactaacattaaaataacattatatatacaaaaaaagaaattccactaagaacatctaatggcataaaataataaatatgtcatagaaagtgaacatatcttcataggccactacatggtaagtaacttgaaaagttaaatagagtatttattttttaacagagttgttgttctaatgttagtaaggaagtgaatggacaaagatataaactcagtatacagaagacatcaaaaatatctggaacagtagtctttggattttaaaacaaattataaagctatagtgatttaaacagtatggaattggcataaagacagacatacagaccaatggaacagaacagaaaccccagaaataaaccctgacatatatggtcaaatgattgacaaggataccaagactacacaatgggaaaaggacagtctcttcaataaatgagctggtgaaactgaatattcacatgcaaaataatgaaattggatccttaccttatagcatatatttaaaaatcaaccccaaatggattaaatacctaaatg

SEQ ID NO: 18253 - DNA, 482 bp, Homo sapiens
cagatttgaggtagactttctgactgatttcttttttagagagcggagcatgcatcttttcaaattcatattattgttgaattaattactaatagaatttatcctcagtgtgtttttccaaacaaatagatcacttgtaattggcattgctttgcaaatccaaaatcagacatccacgttcttaaaagcagtttatcctttttataagattctgtgttttcccctcaagatgactcagattttagattaaatgatagaatgcattctagatacatttctaagtaatcaagcccagacctggaaagtgtttacagggcttgctcttctaaatccttgtgaataatcagagaaactatttgaaaaatggtgttgtgtcagaaacaagttgggatccattcatttctgaaaaatcaaagaatttgcaaaatgagaacactggggccaggcgcggtggctcacgcctgtaatcccagcactttggg

SEQ ID NO: 18254 - DNA, 338 bp, Homo sapiens
ttcctgagctggggtaagagtggaacatgcctcccttctcaggtccagtccaaaaagcatgtggcatatctccctgccacagcttctacccaagaagaccatgtggctcagaaaaactaacaaaagaaatgtgggcacagcaccagctatcagagggagctctctcaagttttacaagcagatctgttgagggaaccgtatcactccatatcactgcagagcatatctgtgaactcaagaagtacaaaaaagccctgtgaccaggtattaacctagctaccagtcattactgttaaacctcattcactggattgccacccaaactacaacacctaaat

SEQ ID NO: 18255 - DNA, 423 bp, Homo sapiens
aatttagtttatctcttttttcatatttgaatcttttctgacgatgaaaatctgaagtcccattattgtctatgtatttacatatttgttcaactactttgcaattaacttttcttccacttgattcccccaggtgctgttggctgggtgggttaccctgtgctagatagaaaccaatcagtcatgctgcctatattacatgagcactagggagaataagaggaagagaggcaatctttctggttcttaatctacaagatagaaataattattgttttaaacagtcacatttgtccacctatttgcccatatatttgttcaaaatttattctggcttttaaaccaaatttctgatgtcatttactttctgtggaaagaatatcctttagattttcatttagtgatggtatgtggtagtaagct

SEQ ID NO: 18256 - DNA, 495 bp, Homo sapiens
attgtcaactgaatttttccaaaagacaaagcttactaacatgcgatggctcttatcactgttgttgccttgaatgcaaagccacagcaggctatgatcttcacaaaggtgcccagccagggaggtgaacggggattgaatcaagtctatgttcaggaaagaagctctgactgcatccaacacaatgaggcctccttttctaaaacctcaaatgcttcatggagggcaaataattttcataattcaatttctctttattatgcataagagttcagaaaagctcaaagaaaaattgatgccccatcgggaggagaagaggagggaagtaagtgtagtaatataaggccaacacaagggattcctgtggtattggaactgttctgtatcttgactgtaggggtcatatacaagtctacacacatgataaaattgcttgaagcttactcaatacacacacatgcacaaatgagtacaaataaaatgagaaatctgagt

SEQ ID NO: 18257 - DNA, 317 bp, Homo sapiens
agccaggatggtcttgatctactgacctcgtgatctgcctgcctcggcctcccaaagtgctgggatcacaggcgtgagccaccctgcctggcctagggttgccatctttaaaaacaatcaacaacttcatttggcctactttaagtcatctttattttattgaactttggagctgaaaaattccttagggctcactgaatccaactctctaattttacaaatgaagacagtgggtcccagagaggcaaagtaatttgctcaaggtcacccatttctttttgtttgccactaacagaacatttcccacttgctgatgc

SEQ ID NO: 18258 - DNA, 340 bp, Homo sapiens
gacagaagggtgtgagctctgggatggtggcttttccttggtctgcatgttcaacattcttccagaagccagagaggtcaggtcttcatagtgactatgtcattcataatgaagtgggtccctaactaataggcaggaacatgccatcatgcctggaatttcctctctgatttctaccagtcagtagccaggctgacaactccagacagaggcaaacatggcggcctcaagtggagaagaaaactctgagcaaagctgtctttgctcccaggcgatgggagatatgggtgaacagcagccgaaactggctggaggcgagaagctttggacttgtttgact

SEQ ID NO: 18259 - DNA, 513 bp, Homo sapiens
gacagaagggatagcattggtgtcatcatttatgcttatatctggcacttgttgctacaaaggtcctttgggatcgcatgctaaatgcaaagatagtaacatggtacataattgctacaattttgtttttagaaaatcatttactgtatttacttaacctaacattttaaataccccaatccagtatcaaaacaagattaaaccagcagttgcatgatttattaagctagtattgcagaagaactctccatgtaatctgaaaaatcaaatgtagtaggaaaaaaaataacttaggcaaacgtaaatgataatgttaaataaaagaatacaaaaaagctctccttccaacctgcacctgcattttaagtggactttagaagactgtggtgtttctgtaactgttaataagcattcataagaccccagaacagagcttcacagccaagcagaaatacataattgctacaattttgtttttagaaaatcatttactgtatttacttaacctaacat

SEQ ID NO: 18260 - DNA, 368 bp, Homo sapiens
gaaggggagccatggaatttttccggtagtccccaactttacccccactgcttctatctttgtggctttgccctcttttatcgcctaataaggctggatagcactttgattcctcaccgtctaacacacggcactttaattttgaggatagagaatggctaacataaagtattcctataatttattaggcttactgtattgtatgctgtggtcacttaaaaagaggactacaatactatatataacacattcagaaatgttgtataaagaccctttttgaattcataaatcttttcttatacagccagattatcataaaatgtatgtgtgggtcgagcgcagtggctcacgcctgtaatcccagcact

SEQ ID NO: 18261 - DNA, 505 bp, Homo sapiens
gacagatgtacatgataatacatatggaggcagttcttatattacaacaataagcaacgcttgctatataaataactgctgctactacatatcgtataactatacaatacccatataacatgcattgcacgatcttccctgaataactcaattatgcacctgctacttactagcggattggaggtataattaaggagacctaagacataatctgtatgttgtaaaatataaacgcataaacagagcagaaaatacgagatcattcatagaaaagtcaatgttttaaatacactcatttaaagaaattattcaaatttgcctttagcttcacagctgtaagtactaaacagacaaatgtgtttcttggagttacaactgtaggagcacagcatcaatctgtgaagctgagagagacaatgagtgaggattcaacaaatacctctagtcttttaacttcttgtgaagcagaatgattgaaaacaactaggctaacttaattctatag

SEQ ID NO: 18262 - DNA, 426 bp, Homo sapiens
ttatacaaatcaataagaaaactgcaaatgagaaaattatatcaagcagcaacgctctaatgaagaaataaaagtagccaacaaaaagttagaaaatggccaggcacggtagctcaagcctgtaatcctagcactatgggaggctgaggcaggaggatctcttgaggtcaggagttcaagaccagcctggccaacgtggtgaaaccccacgaggtgaaaactgtctctacaaaaaaatacaaaaattagtcagacgtggtggcatacgactgtaatcccagctacttgggagtctgaggcaggataatcacttgaaccaaggaggcggaagctgcagcaagccgagatcacgccactgccctccagcctggtgacagagtgagactctgtctgaaagagacagagagagagagagagagaagaaag

SEQ ID NO: 18263 - DNA, 494 bp, Homo sapiens
agaaggggaagttagaaagaatgtggttggttagggcttccaggcttccaaatgcctggaagaaggtgagtttttatatcagctccagcatctgtaggaaagccggagaagaacactagcatccccagcatcccttctgtggagctgaacccctcagcctctccagataggggatccttgttttcatccctggagacccagccctcttgcaaatggctctccatagaggcaatgtctccagagagacttaattggcaatgcttcactgagcacagaaacctgggatatgacagttcctgctctttaaattgtcaaggaaggcaatgtgctctgaactgcagctgctgggagtgcagggggacccatcttagagtctcctccgccttccagcctctgcttctgaatgttctgggaacaagaaacagcaacagagaaatgaacaggtagatggagcacgatgagcaacataagctcaactagcctttttatggtca

SEQ ID NO: 18264 - DNA, 537 bp, Homo sapiens
gacagaagggcttattttgggctggggattactatgatgaagctatatggccctggaaagaaacagataactatttgaaaaacatggtagcattttatcctgtttagcatttttcaaattgtaatatttttatataatattaaaacgtagccttctcaaaagttaatgtaacatactaaaagccattaaaatatcctaatttggcaaaccagactagttttaattacccatacaattctaaggtttatgacctctgaagtaatattccacaactgttttgtaatcaatctgtaattatttttgtgatgtcacagagtagctgatccccctccaaaaaataaacagctttcaaaacatttgttattatttatcattgtctatgcatgtattcattttgtgctgctattatggaatacctgagactatgcaaattataaaccacataaatttatttctcaccattctagagaccaggaagtccaaggtgaaagggctggtaaaactttcaagggccttcttgatacataatgccatggc

SEQ ID NO: 18265 - DNA, 326 bp, Homo sapiens
ccattacccttcatgtgaacttataattgacatttgtctctaaaagcagtcaagcattcatctgtcatttcagttacactaggtaagtatatgtaaataggtgcaaagaaaagtttgatgagtcatatttatagaatatgttctgagcaaatggcagcaactaattacatccaacttatcgttggtgttcaattttgtctttcaacagcaatcaaatctcaaaagtctatatatacaactaagtctgccacaaggctttgccatagctgatacatttatcttttaaaatagtaattgggcctggcacagtggctcacacctgtaat

SEQ ID NO: 18266 - DNA, 120 bp, Homo sapiens
gccattcaggctgcgcaactgttgggaagggcgatcggtgcgggcctcttcgctattacgccagtcgaccgccaattcaatatggcgtatatggactcatgccaattcaatatggtggat

SEQ ID NO: 18267 - DNA, 161 bp, Homo sapiens
aagacaaacaggttattgccaatagaatagtacctataaattacattacatttgctatttcattttcttcttttttaaaatgttgctaaagccttctctattatggagttttgaaagtaaataaactcaataccatcaagctcaacaatgctaaatgtcag

SEQ ID NO: 18268 - DNA, 369 bp, Homo sapiens
gctggagtgcaatggtgcaatctccactcactgcaacctctgccttctgggctctgctccatctcctgcttcagcctcctgagtaactgggactacaggcatgagccaccatgcccggctaattgtttttgtatttttagtagagacggggtttctctatgttggccaggctggtctcaaactcctgcctgaagtggtctgccagccctggcctcccaaagtgctggggttacaggcatgagccaccatgcccagccacattaactttttaaataagacaaatgtgcccataataattacatttattccaaattgtgttagttgtcctagccaatgtaataagaaaggaaaagtaattaggaagcatag

SEQ ID NO: 18269 - DNA, 514 bp, Homo sapiens
gaaagatttactgcttattcatctggaggcaatccttctcttaaaaaaataaacaaagcttgctatataaataactgctacttctacatattgtataagtatacaattcccatataacatgcattcaaagttcttccctcaattcctcaattttgcacctgctacttactagcggtttggaggtataattaaggagacctaagacataatctgtatgttgtaaaatataaacgcataaacagagcagaaaatacgagatcattcatagaaaagtcaatgttttaaatacactcatttaaagaaattattcaaatttgcctttagcttcacagctgtaagtactaaaaagacaaatgtgtttcttggagttacaactgtaggagcacagtatcaatctgtgaagctgagagagacaatgagtgaggattcaacaaatacctctagtcttttaacttcttgtgaagcagaatgattgaaaacaactaggctaacttaattctatagttttaattct

SEQ ID NO: 18270 - DNA, 358 bp, Homo sapiens
aataagtgatcagtttcctttgtaagaacatacaaagtcagtcattcaggaagtttgtgatcttcccctggatgcaagccactggcagtcccaggatcccagtatatccaacacgaaggtcctgtcagagctccagtgttctcccgcacgacctcccacctcctacctcccagtacctcaacaggaaaggacacatctgtgaatcctctggcatgacttcaattccttacagctgtaaaatccactgcatggaaggaaaagaacatttcctagactgggaatccccagacactttcccaaactgaacaagtgaacagggttttcgctctggtgaatgataccccgtcaaggagagtgc

SEQ ID NO: 18271 - DNA, 627 bp, Homo sapiens
tacccaatcagaatgatggcccctgataattttataagaaatagtgtgatgctaagcatgattcctagttaatcattctattcctatgcaacatatcaaaaaagacccttgttgcatgctgaattcttggactaaacgtactttttagttgcacagctgccacaaaccttactattgtatacttgctgattttgtcatttgatttttttttttaatttctaggtttttctaaggatagattcatcatgttatttttcttgtctagagtacagagaaataatattttgattattttagttgtttcaaaattgctctcttttttggaaggagaaacgtaactgccgtgcattttactgtagtcagtagttaaatgtataacatgttagctcaaagattaaaatgtgaatattctagagcacgagtacagagagttgatacaaagggggatgtcagttgctctgaagttaaattccaggattctgtcacatgctgatatagtgccaaagcatatggatctccatatggtgctgcttttggggtttataccacctgtaatctagctgattttcattcacttaaatttgtccaagaggtaagcaaactaaataaggaaatgaaaataatatg

SEQ ID NO: 18272 - DNA, 634 bp, Homo sapiens
acccaatcagaatgatggcccctgataattttataagaaatagtgtgatgctaagcatgattcctagttaatcattctattcctatgcaacatatcaaaaaagacccttgttgcatgctgaattcttggactaaacgtactttttagttgcacagctgccacaaaccttactattgtatacttgctgattttgtcatttgatttttttttttaatttctaggtttttctaaggatagattcatcatgttatttttcttgtctagagtacagagaaataatattttgattattttagttgtttcaaaattgctctcttttttggaaggagaaacgtaactgccgtgcattttactgtagtcagtagttaaatgtataacatgttagctcaaagattaaaatgtgaatattctagagcacgagtacagagagttgatacaaagggggatgtcagttgctctgaagttaaattccaggattctgtcacatgctgatatagtgccaaagcatatggatctccatatggtgctgcttttggggtttataccacctgtaatctagctgattttcattcacttaaatttgtccaagaggtaagcaaactaaataaggaaatgaaaataatatgcctgtgtt

SEQ ID NO: 18273 - DNA, 588 bp, Homo sapiens
acagaagaaacaagaaaccaattttatgtgatttcaaggagtacccctggcctttgactaattagcatggacttgaacccagccctatctctatccaacacatgcaacgcatgctgaccaagcagcaagttaaagggttactgaatttgataaaccaccctctttaatagctgttaccatagtgtttagctgctcgttactgccgcagatgggaattcattgatatgattaaatttgatggtatgataatgtatggtaatcacgattaatcagaaacccactagcaagtggaggatgttgggtattatgtcacgtgcattttaaactgcattctctccttgcaagcctgacaatgtttgacagctggaagggtctcctactatattcgcctgctactacttatagatctgatcagagaaaatgcccatcattccttccatagcttaagtgctggtaattataaggcattgcaagcatgttgtaaaaacagtaggtgttcaaaagcaagacgttctttcctgatgggaataaagtctggattctcatctgcaagggctgtaatagaaagaaatgtgatttgatgcagca

SEQ ID NO: 18274 - DNA, 520 bp, Homo sapiens
ggttgtaagttccctcaaatgctagtcaaagcaaatgcaaattctctccaaattcttaaaaaagaatcttaaacccagactcaaacaattctcccaaataaccttctaaggaaagttgggttatacaaatgtccaagtatacaaggaaacaagatcttatgaatgaaaaccaagaaggcatggcaatatcggacccataaagacatcaagaaaagcaattgtcttaaatcatgaaatagatgctactgacatgtcaaagaaagaagatgggagcctgtaatcccaacactttgggaggctgaggcgggcggatcacaaggtcaggagatcaagaccatcctggctaacatggtgataccccgtctctactaaaaatacaaaaaaagaaaattagcgaggagtggtggcatgcacctgtggtcccagctactcgggaggctgaggcaggagaatcacttgaacgcaggaggcggaggctgcagtgagccgagattgtgccactgcacaccagcctgggtga

SEQ ID NO: 18275 - DNA, 336 bp, Homo sapiens
taaaactctgttttaggataagtcactaatatagagatagctagttcaattgtgtctggcttcctatcacatcactagcacttagtacagaattggggtcctaaaaatatttggcaatgatgacctgtgttgctttcaggaaagtattccaagtgatagggtgcaccataatccatattgctttagctctgttacaagtgacaaaattttctatcaatttccaacttcctagctccaatgtctcaagaatatgccaggcgggtgtaggcacagctccagacagcaaacaactttggggttgtatgcatataactcaggagttaactctattgatct

SEQ ID NO: 18276 - DNA, 599 bp, Homo sapiens
  misc_feature 559: n = A,T,C or G
ttttcaaatgacacctaaggtcttcaatatctaattccctcacaatccaaccagtaacaatagcaccaatgtatttataaaacatgaaagatttggcaacgtttatagatgcttctatattgctgaaatttacgtggatccaactagatgacatcagacaaaggtaacaataattctttaaaaatgtacacagtacatttttaaagcattgggtacagaatgaaattgtaaattttggctaaaactaaagcaaataggtccaaatcacaacacatgtataggagaacctggtgcaccaggataagcacgttcaaaagcctgtaacccttatagaatctgcataggtctgaatactgtctgagaggccaaacctaaatttggagcataaataccaatactttcaaaatataacctaaatgcccttggctccttagaccagctttgaaaacaggtggtaaatctgacaaatggtatagaaagaattctttttgagaaacaccgtatcctaatacctgtatttcatttaagaaactcaaaaaattaattgcttcattagctntcctatatatagagttcatttatacatcagcagcatgcct

SEQ ID NO: 18277 - DNA, 557 bp, Homo sapiens
tactcaaagtgtatatatgttttttttatatgcaagataaactgataatttcaacacaatctgcactactttgaaaaatgtacaccagggcctttcatgacttgtatacagttctggccattctctttatctcaaaccgaagaaagatatgatgcaggcagtagttttttcttagtgcctcatagtatctaatagcagaaagtgagccgcatagcggagcacattagtttttatgtatctacaggacagaagggccacttagctgatggctccaggtttcctttgatataatctaatgttcctatgacctcaaagactgaacacatttccctaagtgctgcacttagcacccaggagcaacttggagtcttcgcagaataaaatccattattttaatgtagattaatacatgggtacttatatctatgcaggtctataatagtttattcctatgtaagctttattaaaagcattggtatgttttacataaaaagttaatgtgaatattagaaaaaaaggacaatattaaagcagtttgtagaatttgttcccccccc

SEQ ID NO: 18278 - DNA, 508 bp, Homo sapiens
taatgccctcattttatgttgtgaattttagaaagaaataacaattaagcatcagtcaattaccttcacttaggagaggagaaagaaagcatagccctcagacagactggggaggcaggagagaattatgcaaaacaggaggtttactaaggtcctatagatacatgcctgggttcttccaaaaataccttcacccaccctcagatattgggcttaggattctaaagtattgagctcagttcttgtggcaacaggacgtaagattctaaacagtcttggtttgaaatggaataagattatgtggaattgctttaacaaggcatgtgaacaagttgttcttcactggcaaccctttccctccacttttgcttcctaagatgtaaagccgtggttggctgaaatgattttttgcataggtgtgcctaaatattgtggaacacaacagcatttgctcgttattaaatgtgtcagattcactatcttctactgtttattttcaatgctacat

SEQ ID NO: 18279 - DNA, 488 bp, Homo sapiens
taatgccctcattttatgtgatgaattttagaaagaaataacaattaagcatcggtcaattaccttcacttaggagaggagaaagaaagcatagccctcagacagactggggaggcaggagagaattatgcaaaacaggaggtttactaaagtcctatagatacatgcctgggttcttccaaaaagaccttcacccaccctcagatattgggcttaggattctaaaggattgagctcagttcttgtggcaacaggacgtaagattctaaacagtcttggtttgaaatggaataagactatgtggaattgctttaacacggcatgtgaacaagttgttcttcactgccaaccctttcggtgcacttttgcttcctaagatgtaaagccgtggctacctgaaatgattgtttgcataggtgcgcctaaatattgaggaacacaacagcatttgctcgttattaaatgtgtcagattcactatcttctact

SEQ ID NO: 18280 - DNA, 535 bp, Homo sapiens
ttggagtcctttgcacattcaactacatagatttctaacttgtggtagattctacctgtggtttctaccgtgtggttctagagagaattatcaacactaggccgggcgcagtggcccatgcctgtaatcccagcactttaggaggccgaggcaggcagatcacgaggacaggagttcgagatcatcatggctaacatggtgaaaccctggctctactaaaaatacacaaaattagccaggtgtgatggtgtaggcctgtaatcccagctgctcaggaggctgaggcaggagaattgcgtgaacccagcagacaaaggttgcagggagccaagatagcaccattgcactccagccctgagcgacagtgtgtgactccatctcaaaaaaacaaaacaaaacaaaaagaaaacaaataaacagtagaaatcatctccataaaaatgattcatttacaaatcttgtgggtggagactcttttcagaataatccttttggggccaggcacagtggctcacacctgtaaacccagcacttt

SEQ ID NO: 18281 - DNA, 639 bp, Homo sapiens
  misc_feature 586: n = A,T,C or G
aagtaattgtagtttttccattacttttatgacaaaaactgtaattacctttgcaccaaactaatatttaaaggacatatggaatggttggtttctaaagatcttagcattgtaaaatatcattaaaaagtcaatattttcttttccttcaagtctctttactcctgccattcctccctgtatttaatatattttcttttagataaaaagagaatgctgatgcacaagcttagagtgtctttcttgatcagttattagggactagaatctgtaatgtttgctggcttttcttttacagaacaattgtaaaacataaatgttgactgatagagttagtataaattatgataggcagacgtcttccctttttggtcctgtcatgacaataagttcatattgtcccactcccaaaacattttcctctatcccctgcctgtctattgcccactatttctttactgcactttacaagaggtgatggctggatgtggtagctcacatctgtaatcccagcactttgggaggccgagtcaggcagatcacttgaggtcaggagttcaatactaacctggccaacatggcgaanaatacaaaaaattatccgggtgtggtagcgggtgcctgtaatcccagctactc

SEQ ID NO: 18282 - DNA, 599 bp, Homo sapiens
cacccttaagtaacaaaatattacaaagcaatcatacaccagatacttcattttaagacagaaatggtgtctgaaaaccagaagaaaaaaatttaccaagttctttcataagcagactattattcttatcctcaaataactaaaaattatctgctaaaaccatcgaagtagtcatttcttgagtatacttctttggagtccaaatatgacaccactaagggaatcctcacaatgggaaacagttgccatgagtgatgagaacaccaagaatgctcagctcagaggcagcattccgtctctgctctgcctaataatagctgctggagctacttccagccacttaggcctctgagtctcagatgcctcatgtataacaccacctactctacagggttgttttgtaaatcagaaatgaaataaaacgatgataaagctttttatcatccgtaaagtaatataactgttgtcaggtgtggtgggtgctggagccatcctcctggtgaaagccagttgataaactttcaagaattttgtgagccacttgttaaaccagaaatagctggaaatcagccacagtgggagatttacactatggaaat

SEQ ID NO: 18283 - DNA, 630 bp, Homo sapiens
aggctggagaatgccaccttctgaaatcaaacctagtaaaagtcaacacattataacaactatggtcataataactacaatttattgatcccttacaatgacaggctctgaagtaagcactttataccctttatcagataatgcttaaaacagctgtgtataatagtcacctatacatctgtatcaaaatatggaagctcctagggttgcaaaggtttcatctggggccaccagcctgtaagtatcataacaaaagttcaaatcaagtttctctactgtctgagctattgtctactaggctacatactaagctttgtctcttttagaggaaaactacagaaaaataaaccatcagataaaatcatttgtaaatatgtcactgatgttgacttgaaaaatatgtacttagaaatctaagagaccagggtataacctcaggtagacatgataggatcacatttgatagatatataacttcatttcaatgccttgggcatgaccaagttgtgcaattagtaaccagcaagaggtggagttgacttgaaagtccttgctggccgggcgcggtggttcacgcctgtaatcccaacactttgggaggctgaggcgggtggatcatgaggtcaggag

SEQ ID NO: 18284 - DNA, 611 bp, Homo sapiens
atatgaggaaactaggcttggaaaaatatagtaatttgcagaaagtcttacaattagttagtgcagctttaattggaaagtttatgcttctttttaccaccatggtatactttccactgtgggcagttgtcttatcagggagggaatgcagttgtttttgctctccttttttaaagcactgaaatgttagaggttactttgataattggattggttagctaattagaatatagagttttttgtttgtttctatttaaagagacagggtctcactttagttgtcccggctgaagtgcattggtgccatcatggctcactgcaccttcagcctcctggcctgaagagctcctcctgcctcagcttcccaaagtgttggcattacaagcatgagccagcgtgcctggcaggaatgtagttctttttttctttttttttcttttttgagatggagttttgctctgtcgcccaggctggagtgcagtggcgtgatctcggctcactgcaaccgctgcctgtagggttcaaataattctactgtctcagcctcccgagtagctggcactgcaggcacccgccaccatgcccggctaatttttgtatttttttttagt

SEQ ID NO: 18285 - DNA, 394 bp, Homo sapiens
ctctcagattaacccagacaaagcaaggcttactgcagtgaatcagacacctcaggcacaggtcagaacacatcacgtggccgggactccctgggactggcaccatcacctgaagtccgccctttagaagaccagcggatgctctgtccatctctcaagagccacatgtctctctcacagggtttccactgctccattctctcatccagctttctcatcttgcatgtgattcagccagctcccagctcagctccacattttaacaaccagcaccggcccggcacggcggcttacacctgtaatcccagcactatgggaggccgaggcaggcagattacttgagcccaggagcttgagaccagcctgggaaacatgatgaaaccccatatgtaca

SEQ ID NO: 18286 - DNA, 590 bp, Homo sapiens
gtatacaaaagtcttttgtgtatttggtttgctaaaatcacctatgctgcatttgatttttgtacttcttacatttcttttaatctagaataatagagtctcattccattgcccaggctggtgtagtggtgcgatcaagcatcatagctcattgtagctttgatctcctggactttagcaatcctcccgcctcagcctcctgagtagctgggactacacacacgagccaccacacccaacctcctcccttttcttcttcatgccattgaggtgttgactaacgtatggtctctattagacaaacttacttatatccactaacttcgaggaatgactaatgggtggggatttcaggacaatcagaagtcagcaagaatgggaagacaaggctgggcatagtggctcatgcctgtaatcccagcactttgggaggctgaggcgggcagatcgcttgacatcaggagtttgagaccagcctggccaacatggtgaaaccccatctctactaaaaatgtaaaaattagctgggcatggtggcgcaggcctatattctcagctacttgggaggctgaggcaagagaattgcttga

SEQ ID NO: 18287 - DNA, 616 bp, Homo sapiens
gcttcatttcatttaaacttccccaaaaccttgtatgagtggagtctggggattcagaagaagacggtggtcatcacagaagttgaaattctctactgtttacttcttcaaaggtcttgttagcggtggccttgaaggtgatgaagaaagacactttcaaggtggacaggtataattattgggtcaccaagaacaaatttgaaaaacaaaatatgccaattgaaattagcatgtagcacctaaatacccagaagcttcttcattgaataatttattcattgaataaattatgtaaactgaattagtaattcctagtgaaatagtggatgaattgagaatagtggtattggtaaaaatggaaaaaaatttttttcttctgagacagaatctcactctgtccctgaggctggagtgcagtggcacgatctgagctcactgcaacctctgcctcccaggttcaagtgagtcttgtgcctcgcttgaggcacaagattagatttagtagagatggggttttgctttgatggccaggctggtctcaaattcctggcctcaagtcatctgcccacctcgacttcccaaagtgctgggattacaggcatgagcgaccgtgcct

SEQ ID NO: 18288 - DNA, 92 bp, Homo sapiens
tttggtttctaggtacaatgtaattttcaatacacttcccagcaagacagctaccaataaattcaagtaattttagtttctgcagcatttct

SEQ ID NO: 18289 - DNA, 608 bp, Homo sapiens
agacaagaaaaatagatgaaagtgcaaaggacatctaggggtgggaaatataaagagagatgatgttagcgccattctcagatatgctctttttcttttccacgacctgttcagaaagacctttacaaccctgaagaagcagaaaataagataaagcgttctgtgagaaaagactctgagaaaaaaagcaagatgctgttcatgtgttccaggaagctatgattcttaactggtgttggtcatgtagccatagtagaagggcacatgtggtggtagcggtggtgtggacaggagtacttaacatttaccaagtgcttgttatcaatcaggtccatgctaagtctgcacagatatgattatctttttttgttgttgtttttagggcaagggttttgctgattgctgggaggagttcaaggtctgaagagtctaactctttcagagacattgagattttaataccacacatctgtcagtgttataaccatgtttttgacttgtgtagtaagtttattggttaaaaacaaggactctttattttttgtggagacggaggtctcacttatattgcccaggctggtcctgaactcacgggctcaaaaaatcct

SEQ ID NO: 18290 - DNA, 584 bp, Homo sapiens
agtataaaaaattcttttattctgaattataaattctgactataaaatacatacgttttgagataaattgtgcatataagcttttagccgaagatgagtgtgttttaaagatgatatgtagctgggtgcagtggttcatgcctataatcccagtgctttgagagtccaaggtgggaggactgcttaaggcccagagttcaacactagtctgggcaacccatctctagtgagacccccatctctactaaaaaataaaaaaatatggtggggcatggtggcatgtacctgtagtcccagctactccagaggctgaggtgggaagatcacttgaactcaagagtttgaggctgcagtgagctatgctcataccactgtactttagcctgggtgacagaacaagactctatctctaaaaaaactcaaaaacatatatatatgcattttatatttacctagttggttgtatgagtctaaaatcttaatcactcaaaaacatattaccgccgggcgtggtggctcacgcctgtaatcccaacactttgggaggccgaggcgggtggatcacttgaggtcaggagtttgag

SEQ ID NO: 18291 - DNA, 575 bp, Homo sapiens
caccatctttgtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcata

SEQ ID NO: 18292 - DNA, 582 bp, Homo sapiens
gatttatcaacttaataaaatatccatagactctgctgtgaaagatgaggatttaactcatttttgttaactttccaatttgattgttgggttattaaaatacacaattaagcagtagaagaagttaaaataatgagagaggaaataaatatattttctccacctaaggatgaggatattagggatatcagtgtccctattcattccactgttctctcctccctgctcctgcttctcacaatcttcttattgtcacaagtttgtcaatatttttactcttaataactaacccttttctgctttatccataggttgattctaaatattcagaaccagtaacaccttttatgtcactttcacagtgtaaatattgttcctagctattcatattctaagattgcatttcttttcatcccgatgagtttcacaagctctggtgcagtcagagaagaatgtttctaagggttgttgggtggataaatgacttaatccatgtaaagggcttagaacaatttctggtagagtaagtcctcaataagcccgtcccagcattattattagtactgtatttcattacatctg

SEQ ID NO: 18293 - DNA, 590 bp, Homo sapiens
agtttttaaaaataattacaacaaaggagagaaatagcgagtgttctctttttttcatttcaaaaaaaattcattacataatatttatagagccctgaaacttgctgaatagaatacatacaattgaaggaactttattttcatctcaccctttccttctcatcttttgtttctctcatctataacctgatgaagtatcattataaaaaataccttactcttttgacttttccattttttttaactttgggatgatggggtgttttgtggtgatggtctaaaaagactgattgctgctattgaataaatgtaaccacacaagtgtttaaaaaagataaggctataggagaataataagaagaatgtagtatggattggcataaaggcctttggatttagcaattgggtttcactgggaaattagtgttttttgttatggtagagaaagttagctgcctgccaaaatcctttctcctcttccaatttcccctgtacttttgcagctatgtgtggccatgcaattcgtccctgtcaatgaaggcttaggaaatgatgtgtgccacttctgggtcaacttctttgctttaaac

SEQ ID NO: 18294 - DNA, 387 bp, Homo sapiens
gctaattagcaatggggatttatggttatttctagcccactccgaacaatgagttatgtaagcaaagcaacatatataaaaatgtaaataggccggtggctcatgcctgtaatctcagaactttgggaggccgaggcaggtggatcacaaggtcaggagttgagaccagcctggccaacatggtgaaaccccatctctactaaaaatacaaaaaattagctgggcttggtggcaggcgcctgtaatcccagctactcaggaggctgaggcaggagaatcacttgtacccaggaggtggaggttgcggtgaactgagattgtgccactcccctccagcctgggcgacagagtgagacttctttccaaaaaaaaaaaaaaaaaaaaaaa

SEQ ID NO: 18295 - DNA, 635 bp, Homo sapiens
tccaagaggtaactaaagtatccaggctgatggaagctccatcatcttgtggctatctcatctagtacccgaggcctttatggatgtcatagcagagtaagagagtgcaggagggttgagcaccagttctctggctcattggtcagagctagtgacatggcctcctcttcctctaagaggattgggaaatccagcaaacagtaattgactctaccacatcttttaagaatagtgttttctgctacatttaaccagagttactgccattgctttcattcaagaactctgactagtaaaggatatgggggtgagaatatttaaagatatatatcttcaatttttttctgcttacaaaagtgatacatacatgttataaaaatttgaacgtgactgggtgcagtggctcatgcctgtaatcccagcactttgggaggccggggcgggtgaaacacgaggtcaggagttcgagaccagcctggcctacatagcaaaaccccgtatctactaaaaatacaaaaattagccagggcgtggtggtgagcacctgtaatgccagctactcgggaggctgaggcaggaaaatcgcttgaacccataaggcaaaatttgcagtgagccaagatcacaccactgca

SEQ ID NO: 18296 - DNA, 119 bp, Homo sapiens
aactgaagttatctctttaagttctcacgttattttgtatattaagattcaaaaccaaaatatcattggtctaaacattgttagaatagaaccagactatgccaatatcactaatatag

SEQ ID NO: 18297 - DNA, 637 bp, Homo sapiens
tacatttattcctttgtaccttctgaggcacaaaatgctcgtaaagattcttctttttgttaacaagagagacacagactatagatggctatggagcagagaagctgggaggaaggccctgtaagccgaatggatgacattagtcctggggggtggacgaaggggtatagacaggaacgagacacttgctcgagacttggctttgcttaccaagaaacagatgcaaatgatcagagacaacggaacagattattctgcaccaatttgaatgaacaagtcatattttcttagttcaggaaacacttttgtcctaacagtaatggtttgatagagaattgaaatggacaattaaaacattggtcatcggctgggtgcggtggctcatgcctataatcctggtactttgggaggccaaagcaggcggatcacctgaggtcgggagttcgagaccagcctgaccaacatggagaaaccccgtctctacgaaaaatacaaaattagggctgggcacggtggctcaagcctgtaatcccagcattttgggaggcagaggcgggaggatcacgaggtcaagagatcgaaaccatcctggctaacacagtgaaaccccgtctctaccaaaaatacaaaaaattag

SEQ ID NO: 18298 - DNA, 560 bp, Homo sapiens
cactatgcctggcctttcaacaatctttttatctattccctctactttgcagatggaaatgaattctatttcctctccctttgtgcttgtatactcttcccctggaagcttgaattcaaacattttgagttaaaaagagtatattaaaaattacctttcctttcaactcttgccaggtcataaacagattgaaaggaagggtttcaaacaggattattcaatgagaatgcgcaagggttaagacattcccaagggactctttactgagtggggcaagggttcagtgtagagggcctcacaaacagaaacgatccattattgacaagggtcactgaatgaacaccagtcactgttctgtcacaatcacaccagcgagcttaagagttaggaaagaatgaggaaagaatgcagcggctcatgcctgtaatcccagcactttgggaggccgaggcgggtggatcacgaggtcaggagttcaagaccagcctggccaacatggtgaaaccctgggaggctgaggcaggagaactgcttgaacccgagaggcagttgcagtgagc

SEQ ID NO: 18299 - DNA, 622 bp, Homo sapiens
aagaaggtgattgtgaagaaaagactggaaagcaaagaggaagtggtttccatacatttacttatttatttctttcaatatacttttgatatactcgttatttttctaactcattaattttctgaaatttagaaggtgaggttagagaggttaagtgactgtttaaagctccatggctgaaaaactgccaaaccatgatggtcttaagtcagaccgtcttcagtatcctggcctcttaccttgttgcttcactacgtgtcaagaagtaggatctattagatgtagtatctcaccataagaaaggtagatacaaagactagaaggaaagaagtaaccttaatctgcacttgcatgtggaaaatgcatatttttaagaggtaagaggtggaaagaaagtagaacaggatttgatggaaaggtaggaggaagtgaaagactggatggagctgagagaagttcacagagatgggacagttaaggagtatgagaaaataatgcatatgttgattgttaaaaactcattactcttcttgaaaagattaccttctaagccaggtggaggaaaaaattagattgaaaagatctgatagacaagactgtaagagataagaaagtacatgcc

SEQ ID NO: 18300 - DNA, 527 bp, Homo sapiens
cagaagggtgaatcagaccttttgctgcatcctcattgtacctgtgtgcacagaccacaactgcaccacctatatactacatacttgaggcatacatttatcatcactcctctgggtttcttccttatgagactgtaataatgtaggggaaaggcagacctggcccctgtctttatacccccagaacctagcacagaggctggtatgagtaaatgataagaaaattatactcaaggacgggtgcggtggctcatgcctataaacctaggactttgggaggccgaggtgggcagatcacctgaggtcgggagttccagaccagactgaccaacatggagaaagcccatctctactaaaaatacaaaattagccaggcatggtggtgcacgcctgtaatcccagctactcgggaggctgaggcaggagaatcgcttgaacctgggaggtggaggttgcggtgagctgagatcatgccatcgcactccagtctgagcaacaagagcgaaattcggtctccaaaaaaaaaa

SEQ ID NO: 18301 - DNA, 616 bp, Homo sapiens
tcaagaacagcctgggcaaaatatcaagaacccatctctaagaaatagtaatatgaaaagcagaatctagatgtgggggcttgtgtttataacttaaatccgctactattataacactccctatccctaattcatataaacaagtacgtaggtattgtagtatgtgaaaatgtcccttaacatttagaatgtatacgataagtctgtaaactattaaatatttgagaagttgaaagagtggttatttatataatcatcttaaaatgtttagagataaatttaaagtgcctaaacagaagaaaataaaacagcttatttagtggatgccaaaatcaaaatataaaataccaaaatgaaaattctcacatttctcattcattaaaaagttttcattgtttgtttattattcaataggagaaagcatttagtgcattttaaagttttattttagttgacaaataataaatatttatatatatgtatggaataggtgttttgatacatgtatacattgtagaatggtcaaacagggtaattagcatatccatcacatcaaatagtttccatttcttttctatgagaacatttaaaattttcctttagctattttgaaata

SEQ ID NO: 18302 - DNA, 549 bp, Homo sapiens
cttggagttcacttcatatcaagtaatagactgtttcattattctttgttatagctttatagtactccatggtggatatatcataggtgagaggcccactccccatgtatggacattaagctttttcaatactttgcaatgatgtacaacgttaaaatgaatagtcttggggtttttttgttttatttatttttttctgagacagagtcttgctctgttgcccagactagagtatgcaacctcagctcactgcaaccttcacctccaggttcaagcaattctcctgcctcagcctcccaaggagctgggattgcaggtacctgccatcatgctcagctaacttttgtatttttagtagagacatggtttcaccatgttgaccaggctggtcttgaactcctgacctcaggtgatccactagccttagcctcacaaagtgctgacattgcaggctgaatatgtatttttatatttttagaagtgtacattcaggacagatactaagaagttatattgcttggtcaaaagctgattttttttttctgatac

SEQ ID NO: 18303 - DNA, 645 bp, Homo sapiens
tatgcaaagtagatttaattgcttgtcactcacactgggaaatgtttcaaacatgggttgttacttaaaacagtttcaagttcatatttttcaaatctccatattcacttcaatataaatgcactgcaaagaataaattcttaaaatcagaaaacatatctagctaagaattaggaaattgaaattctaataagccaagttttctttattttgttttgtttttcataatattttttctctatattggccaaaaatgttcgaagtgactgttgggaaaatatacagcagactaaggacaaattcatataatattatcttaattttggagaattattcagatgcacgtttttcttatagaataacctgtcagacttcagaggaataatctttctaattttgttttcagacatttcctccaaaagattgcagagaaaatcttcccacatatcctggggcatacttcgatgtgccattagagggtagtattgtaactacagagctgttaaccaatattattgatatgcccagaggataccacacccccatcacctataatcatacttcctaggtactttaagcaaatgaacactctaacatacattatagttgattgcatacaactgagtgctgaagacagcactttat

SEQ ID NO: 18304 - DNA, 575 bp, Homo sapiens
aatccagctaatatgtattaaatatgcactatgtgacaggttctgtgagggtgttggggggaagaaagacagggtttctgccgtaacgagccaataatctccttagtaagaaaaaaacttggaatgagaaaccattcattcgtttagccatttactcaactgataatgtatcctgggcctattgtggactgaattgtgtctttccccattccctgcccaaattcatatgttaaagctctaaccccaatgtgactatacttggagatagagccttttgggaggtaattaaggttaaaaaggtcataagagtggggttctttggtaatcccagcactttgggaggccgaggtgggtggatcacgaggtcaggagatcgagaccatcctggctaacacagtgaatccccgtctctactaaaaatacaaaaagttagatgggcgtggtggcgggcacctgtagtcccacctacttgggaggctgaggcaggagaatggtgtgaacctgggagtcggagcttgcagtgagtcgagatcacgccaacgcactccagcctgggcaacagagcgagactccgt

SEQ ID NO: 18305 - DNA, 655 bp, Homo sapiens
agaaacataagtagtttcctctttaagctaaaaatattctgaaaagaaagaaaagttcaaacaagtttgcaaagcaaatggatttgagtggccaatgaaaacatatcaagtcaggctttttagttattggttttgcttgtgagaatgtaacttggaattattaattacaatatcatctattcatttggataaaatgttatctgttgaggaaattataaatgcaacacttatatggcacttatgctattgccacatgtaccatacaccaggcattgttctaagagttttccatatattaattcatttcatcctcacaacattcctccaaaataggtcctttaatactccccgttgtacagatgaagaaactgagtcacagagaagttaaataacctttcaaaggttgcagagctagaatatggaagagccagtgtgcaaacccaggcagcccaaagttcactatatcatgctgtttcttaccatgcaatgaacaactgaatatacaaatacacacacacgcgtacatagacatatctctataaacacacttatatatgcacatacgccttcacatgttacacatccacacacatatacacacaaatgcacacatatacacatacagagagtatatattataaggagcatattttac

SEQ ID NO: 18306 - DNA, 638 bp, Homo sapiens
gacagaagggacctatccaatgctgcagagtgaaccaaaaaaagaactgagaccagaaccaaggtctaaataggctgtgtgctgattagctatgccagaatttgatttctttattttgccactgggaaaacctattaagaggaatgaggcttttattactttacatgtcaaattacgttaggataattcttatattgaaataggatcagaaaattttcattttgtttaaggtatacaaacactggcatttctaaccctgaatcaaatcattccttcaaatcgccacatgtaatttacacaggtgttatatagaaggtaatataaacatagcctctaagcctcagtttcttattctggtaaataagaggacaaataccagcctcacaaaagcgtggatgaaccaaatgtgtatgaagtacccgcactgtgcctggcacattgtaagaagtagtcaataaatggtttcaatgatgtcatgacttgaaaattccatccaggaagggaaggtgatgcttccatgaatatctagactgaggacaagcattgtctagcgatcttccacgacagcaaactatgtggttacttatgatgatggaatcatatcacgtaggtttgctgaatcatgtgttacatataga

SEQ ID NO: 18307 - DNA, 614 bp, Homo sapiens
aatgatatgtaattatatatttcacattaatatattttatgcccatggctatattgatttgggaatatatatggatactaattatgttaggattcatacaattccttgagaggcacaagtgctaaaaattacttgtatgaattatttaatatcattgcaaataagatgttattttaactttttttaagtttctgcaaatatgtttattatgactttttatttttatatgattggaaatacatatactaaaattccgcgttaccagtttcttaaccacagaaacctgaaaaattgccatagttgatttgttacttctaccttggtgcatttacaaaatagtcatatttttattatgaagttaaatattcatttgtttatagctacttcagaaggctcaggttatttttttctttaatagcacagagtcctctcaaggtaagcactgtgcagttagtataaaccattattccccatgtgtacatgattcacagtttgtattgtgttccaagtgaaccatagccctttcagaaatcaagacttatattcattttacttctttgagtactcttgaattttagaaagtccattatgatcctaaggtagcaacaacatag

SEQ ID NO: 18308 - DNA, 610 bp, Homo sapiens
ttattttaagtctcttgattctaaaaatcacttcagagctgtccttagttctccctgcttcccgacttgcttctgcctggcctgggccacagaaacgcggcatggtcagtggggtctttgcccggccctgaagtcctgttagagttctcctggtcccggctctgactctccacagtggcttcttcggcagtttactcactgggcgtttccaatctcgcctgcggcagcattgccctcccctgcagccccctgccttcagcactgtaggaaaacccatcagaagaccaccttgacagtgtggtcagtcaaccaaatgtcttttctccatccttcctctccttctggacataataacatctgttgagtgcattccatttgccagacactgttgcaaatatttgatgcattttatctcatttaatctttgccagaaaccatgaggacaatattatttttatccctaatttttgtggtgaggaaactgaggcacaggaacatgttgattatctttgcctttttgaaactcagcttattttttgctttccataccagttcatttcagtgaacatttatgacctactgtatttccgttataaagatgagcaatgca

SEQ ID NO: 18309 - DNA, 593 bp, Homo sapiens
atgcagccttccttcctgtctttggtgataaaaatatttttttttaagtattataaacactactattgttagcatgttctatactatttgacaaaatgttcttgttttcttcaagtggaggtttttcctagtgagagctatgtttggtcatgttcctctctcaggtgcctcagcaacctgaactcctccttcaagatgcattctatgtggcttggcaaaatagaattagcatagaatttgaaattctcaatttaaatttcacctgtgcaagtttctaactgtgtttaaacatgttatatgcactttgtaaatctgtttcttcatgaataaagtatagataataacaaaaaacaaatctcaagggatagtatctataggatcagatgagataataaattttagaaagtgataagcacggccgggcatggtggctcacgcctgtaatcccagcactttgggaggctgaggcgggcggatcacgaggtcaggagatggagaccatcctggctaacacggtgaaaccctgtctctactaaaaatacaaaaaattagccaggtgcagtggcgggcatctgtagtccctgctactcggg

SEQ ID NO: 18310 - DNA, 643 bp, Homo sapiens
atggctgttcttttctggagggtacaaaagagcttctcacatggcagggaaggctggcgggctggactcagctgggccctcccctctccatataatctcaagacttgtctccgtcatctctgtggcagctatcttacacagtggttgaacatctccagagaccaacaggatttctgccagtcttcttaaaggccagacctgggactgacataacatctcctccagcatactcctttgctcaaagcaatcacaggccagcccaggctcagggaggaggggaagcagaccccacttatcaaagggacaagtagcaaaagtgtgcagctatccttaagccaccatgcctgcaggcccagtggctaagactgagtctatgtcccagaatccccagcaaagctctactgtttactctgactgaactgacttgcagaatgcgtctgcccctgaactaatctctgtgaccaggagcttgggaaatcttgattagagctggaggtggaaacaattttggccaatattatggttaagaaactctgtaggggctgagcgtggtggctcatgcctataatcccagcactttaggaggccgaggcaggcaaatctcttgcgcccaggaattcgagaccagcttgggcaacatggc

SEQ ID NO: 18311 - DNA, 644 bp, Homo sapiens
tgatttgaatataagccagtttttccatgggaaatttatccttagactagtttggggccatagtggggcagcctggtatttcataaatggtcaactgcaatattcagatattggttgtcatccttgtaggcagtggctgtggcaactctgattctacaactttggaagaaaactattaactttgaagttaataatttaattataaactttgaagttttagcatcaacttcaaaggctaggaatggcccccaaaagatcccagtttccttgaataatctttatgtttgggaattatacacttatgctaaatgttccaaatacccctctactcttcaacattgataaactcccttctcaaaaagtggccagctctttcaggtcttctgagtgactttcttaatataaagggcaataacatcgtatcctaaagcttatatgggaggaagctaagtgaatcatggccaatacaagggaagaacgctatcctctgcacataatctcttcagtttatcttttaagacccactttaagttccatcttttccagaaagccttccttaatgacctcaggcataacaacagccaaatagaccatgaaaactcttagaaatggactcagttggccccttattctttactattcta

SEQ ID NO: 18312 - DNA, 653 bp, Homo sapiens
aagttgcctcagaatgagacacactctttgacttcacatgcaacagaaaggcacagttttatttcaaacaaagcagtgttttgctgtaacaccgttaaaaactggaaaggaaaactcaatcaaaccaaaaactagatgcttaggaataaatggtagaattcttacaaaaccaccacgcttcaattcaatctaaatcaattcaacaaatctgtgctgaaagtataacatttagttttcttagacaccaaatgaacaatacaaaatccctcaagggacttagaacattcaagttttctatatctgtggttctaagtctgttaccaacttccaggactctgcttctttccctctgcccattaacaatgcggtgttaaaagtgacttcctaccactatgtttcttacagctgattcaaccactcatctcatagccaggcatgaaagaaaggagcatacccctaaccgagaactattttttagatggtagtcatatatttatttcatatttagtaagtattatttcaggtcttattaattaaaggaaaaaacttctctggctataagatgcaaggatgatatgtgaattcatgaattgttccatgtttttcacccagatacaagaaattcagagaacacttgagagatgctatgcaag

SEQ ID NO: 18313 - DNA, 601 bp, Homo sapiens
tggggcccaggaatctgcattttaaaaacaaatgtcccatggactacacttgatcttagccaaaaggccaagatgtgatcatatgtctcatgtaattctgattttgttgttccttgggtcatactttggcaaacaccaatctgtgggtttttaaagaaaattgtttttttcttacttaagagaactgttaaaagtgtatacggtaaaacaaaagtcagaaagtttaaaagagtagacagtaaaaagcatctctccccatggataaagatgatcatggcagcagttttggtaatagtgaaaaattaaaaacaaaatgtccggccgggcgtggtggctcacacctgtaatcccagcactttgggaggctgaggtgggcggatcatgaggtcaggagattgagaccatcctggctaacatggagaaaccccatctctactaaaaatacaaaaaaattagccgggcgtggtggcaggcacctgtagtcccagctactcaggaggctgaggcaggagaatggcgtgaacccgggaggcagagcttgcagtgagcagagatcgcgccactgcactccagcctgggcgacaaagcgagactccgtctc

SEQ ID NO: 18314 - DNA, 611 bp, Homo sapiens
gcgtgagccaccacacccggcctcagaaactctttttaacaataaaaagttgtttgacggtttggccacatagactatgtaaactttggagaactcatggaagtaagctttattcctgatcttacagacatcttaggggtaggttttggtgtttgaaaggaaaggagaatggcatgagtgctatccataaagtttggattagaagaggccttagagtccaagcctcgtttatgtgagagtcccttccattaccacccccgacagcttctgctttcagcagtggtgagctttataaaattacctgttctggctgggcgcagtggctcacgcctgtaatcccagcactttgggaggctgaggtggtcagatcacttgaggtcaggagttcaagaccagcctagtcaacatggtgaaaccctgtctttattaaaaatacaaaaattagccgggcatgatagtgcatacctgtaatcccagctactagggaggctgaggcacgagaatcgcttgaacccgggggtcgaaggttgcagtaagccgagatcgcaccactgcactctagcccgggtgacagagtaaggctctgtcccaaaaaaaaaaaaaaaaaaaaa

SEQ ID NO: 18315 - DNA, 631 bp, Homo sapiens
accattactgccctaggtcaagcactcatcacctttatctggtgttactaaagtagctttctaaaaacaaagtatggttcctagctggtataagaccctccatagttcttataccataaacttctgcttgaacacttccagagatgaggagcttcctgcctatgatgccatcaatatgattattagacaactcaagtagtttgaaaggtgtcccagtaatttctttctattaggcctagttctacccatcctgtgggcttctccctaccagatcctgaggacctactgctaacttttcaggttccagcctctatttctgtcttccctgtggagttaacttgggtaggttgaactacatttcctggaattgtcttccttgtgtgtttcctcttaatgtgggccacaagagggattcttgtgtgagatttgaaaggcggaagtgaaacaacagccattttgctatccagagtaggtgtttagtaattgacccattatcatggtttctgcactaatcgccattctcatgagtctactggatgtagtcagattagcattgggtacaatagtgaataaagactggtgcagtagagaggcctgatcacttctttggcttggatggtatgcttatctg

SEQ ID NO: 18316 - DNA, 626 bp, Homo sapiens
tacttcttccttctagtctaccctgcacagccctcagagcttgaagaagcactgtgacacctgccgctgtttgcccttaggaaagatgccaagtttagaattggttttcgggtggtttcagcaaaacaatagcccacactgcctcctaagaagaatgactatgccaactacaaagagcactggagaaaaggacaattgttttatgtttccagtattcaaaaacttagcaaatggctgggcatggtggctcacacctgtaatcccagcactttgagaggccaagtaggatggatcacttgatgtcaggagtccgagaccagcctggtcaacatggtgaaaccctgtctctgctaaaaatacaaaaattagccaggcatggtgtaatcccagctactcaggtggccgaggcaggtgaatcgcttgaacctgggagacagagtatgcagtgagccaagatcaagccactgcactccaaatggcagcatagcaggaaggtttagagtatggatcctggggccaggctgctatatttaaatcccagccctggctgggcatggtggcttatgcttgtaatcccagcactttgggaggctgagacggatggatcacaaggtcaagagttcaag

SEQ ID NO: 18317 - DNA, 579 bp, Homo sapiens
tggtggcgcatgcctgtaatcccagctactcaggaggctgagacaggagaatcacttgaacctgggaggcagaggttgcagtgagccgagattgcgccactgcactccagcctgggtgacagagcaaaaactccgcctcaaaacaaaacaaacaatagaaaaaagtaacaaaaccaaactgtggttcccagatcaatgtaattgataaatccctagctagactaacaagagagagagaatacaaattatcagttaataccagcagtgataaagaaaggatatcactagggtgggcatagtggctcacgcctgtaatcccagcactttgggaggccgaggcaggtgaatcacttgagatcaggggttgtagaccagcctggtcaacatggggaaaccccatctctactaaaaatagtaaattagctggacatggtggcgtgtgactataatccctgttacttgggaggctaaggcaggagaatcacttggacctgggagatggaggtggcaataagccaagatcatgccactgcactccagcctggatgacaaagcaagactccattgcaaaaaaaaaaa

SEQ ID NO: 18318 - DNA, 582 bp, Homo sapiens
agattgtgccactgcactccagcctgggtgacagaacgagactccatctcaaaaacaaaacaaaacaaaacaaaaagatgcatttattggccctgtttgcatgttttctggaatccagaacataaacccctaaaaggaccatctccagtcctttgcttcaaagaatcagcaggttagccttgttcatcaaggggcaatcctcctgagttctgtccccaaagagaaaaagcaatgcctaccacatataccttatatttaaccatgagaattgagctggatttctagagaacagcaatggattttgagccaagtgttcactcgagttccagcacagggacacacagtcccgatgggagcatccaaaatggaatctactatgttcaagaatatacactgtctcacacacaaacatcctgcaggatagaccacagggtatgctgtataagctcctcaataaatacagaaatacacaagtatgggtggggcgtggtggctcacaccaataaacccagcacttaaagagggcaaggcaggaggatcacttgagctcaggagttcgagctcaaccagcatgggtaatat

SEQ ID NO: 18319 - DNA, 579 bp, Homo sapiens
atggtaatgctataaaatctctgtttaaaataaagttattaagaaaaatgtgagctgggttaaagaaaagtgttatagtgagacaggttgaagatggttttggccaaagccatgagagtctgggaaactatggcctcaggtctgggaagcattcctctcctgcaagtctcagctttgcccatcaacatgctgggtggccttgggccagggactttccctctctcagtttcatccagtgttaggtgagaggatggaaccagagcagaggtggctgagtccagagagtgcagaggagaggccctgggcaaaggggtgaggaggaaggctctggaaagctggggatggctgggtgcggtggctcacacctgtaaccccagcactttgggaggctgaggtgggtggatcacttgaggtcagaagttcaagaccagcctggccaacatggcaaaaccctatctctactaaaaaaaatacaaaaattagccgagcgtagtggcgtgtgcctgtagtcccagctactcgggaggctgaggcaggagaatcacttgaacctgggaggtggaggttcagtgagttgag

SEQ ID NO: 18320 - DNA, 599 bp, Homo sapiens
ttatggttccagtaggtggtgctataattgctggctttaatgattcattcattcaggaaatcagcaagatgtatccaggtaaataaataagttgcttttcagaaaaagtagctaacaaacaaaaatccatttgtacataggctattgtagtaaatcttaatttccaaagctacccccccaccacagtcttaatgtaacttatccttcttatttcaggaagagcttcagcttcaccttctttagatgtccttattactttattgtcacttggatcaaatggctataagaagctactaaaagaaagaaaggtaagctttccctttaggtgtcgaataacattcttgactagaactgtgctccaaatcattggtgttttctgcctgttggtttcttgcattgggagggagacatctagtatggtccgatagtatttattcagatctggaaccaccataggtggtttcctattactttttgtcagcctgtctatccagatattacgaggaatctgggttaggtgattttgcttttatttatttactttttagaaactcctgcattagggactcttattcaataaaattcaattcatttatcac

SEQ ID NO: 18321 - DNA, 586 bp, Homo sapiens
tggctcaactggagaatcagccatatataaggagtagctgagcaattagagggaactagactaagaagtagattgggatctttgtcctcaactggacaaagattgaaaacagagtccagcccttagataaagtatagatgacagtggaagagaagaatgcgagagggtcagattctaaccaggcaaggaatgtgacttgaatcctcattccacctttggcctgacatttaatcaggtcattcatcggacattcagatccatctcaatgacatcttgttatcacataaggaggccgacaaggagtaggggagtttctcctgatcacctttgtttaatttcagattgaatattttataaacaaactgaaacttatgcctgaagaatgtgtgtgaagcataaaaagataggtttagcagaccaagggcagatatttaacttaagagtaattgatgctttgggctgggcgcggtggctcacgcctgtaatcccagcactttgggaggccgaggcgggtggatcacgaggtcaggagatccagaccatcctggctaacacggtgaaaccccctctctactaaatatacaga

SEQ ID NO: 18322 - DNA, 656 bp, Homo sapiens
tttgagggttagtattatttttaaaaaaagaagaaaaagaaaagggaaaaaattatgaactttttgggacttcatgatcttgcatcagcatgtatttaaaagccattaagcatcttgattagtttggaacatggtataaagactgttacattactggttgctgcagctgaataccggttgcaatatttgtcacagtaaaatgcaccaatcagaaaatgtgggaaaattattatacacttcagtggttgatttggcctaggtattggacataatgagagtcatttaaagaaaagtattcaaagggttagatactatagaagggatagcagttcagctgtggtagacatgaccacaaaataaagtgtggaatttcttaggccacacatagagataattttccttattgaatgatcacactttgcatatgttaatgacttttccttacatctttaggttgagcgatcactcttaatgagttattattattattttttttacaaaaaacgccagccaggcatggtggctcatgcctataatcccagcgctttgggaagctgaggcaggcaaatcaccagagatcgagagttcgagaccagcctcgccaacgtggtgaaaccccatttctactaaaaatacaaaaattaagcaggcatagt

SEQ ID NO: 18323 - DNA, 651 bp, Homo sapiens
ttgccttctagtaaattaagagttcagaaaaattccaattctaaagatgttttgaaataaagattatctttgctcttcagattaaattgcaagtcctgaagattcttttaaccagaaatttaaacatggcttacctatactgagaaagcatattttcctcaaaagaggatatgggagtatatcccctatattgtacataaacctacaaaacatactaatgtggggtgttataaaaattttaataagtaaggctatgtgcagctggaaatccttcgctagcctgaaacatataagcaattcactcaagactcagaagtcttaattttgcaccttttactgagttttcatttttatccacaacagttttattttaaaggaattgctttcctacagtgggttagcactatgatcagaaagaatattttcttttttgcttttttaagcagaattcaaaatctagcagatcaactgaaagacaagaaaaaatgtacaataaccttctcaacatcctccccctccttttctatacagttgcctttacaagaaagtaattaataaacataatcttttgagatcccctaagtcttaaactatgcaaaattctactgacacacaatcttccaatcatcaacagcactgatctttcatgat

SEQ ID NO: 18324 - DNA, 606 bp, Homo sapiens
taccctaaagcacagtttttaatcttgtttgtgtgtgccacaggcccctttgagaatgtgatcattgttattgaccataggcacaaaatacacacaaatacttaacatacacaattttgcataaaatctcagtgagttgactctctaagacatatctagagatctaaggactccagatgaaaagcaactatcctaacataatcccaattatttcaagaaattaaaccaaattctcaaaacaaatttaccttcagtttacttaatttgaaaagtacttgtatgtattacttaaagtcagacagacaacaatattgtgatgcagttataagaaagtggcctgaccttaggtgaaggaactccagaagtaaaaattgatgtctgacaaagatcttcttacgtgtagtaaatgaattctgctctccaaatatgaagtgaaactgcatcaattcaagaaatgcctacaatcccttcagcatggtggttccactgaaaggcccttaagaataacggatattttactcacatgttttgagattagtagaaccgtcgtggctttatgtgtctatttagttactacattcagaaaactgagggtataaaacaaac

SEQ ID NO: 18325 - DNA, 638 bp, Homo sapiens
atagcactaaggcataacctagtacagtttctgctaacagtacttcatagtcaatcagctgtatacaaacaactttgaaaaatagaagagtacattgttttgtgtccctttggaaaaaaaagcttgttaggcagggcaaagaggaaggattttttttttatgtttactgagatgcttcaaattaggtgcttgatatgttcactaaagctcaaaggaataatgtcaagaatagttttagataacataaagataaaaaaaggatagataatatgcctaaaatttatttatgaagcaatgaaaataggaatcaggagacctagtaaatgggaaagctattatcttaggacttttctaaatttaaaattctgtgactctgtgttctctgtgttgtatgaattaccgttagtgtttagaaggaggcaggggtggattgatggaaggatgaataatggatagacagtcttgaaagtaatgactttccagtcacctaaatgacttatggaaaagcagatatttggtttgttttaaataatgttattgttaccatatgtgttagaatcttagaatttcagagctagaagagacattagtaatgaaataatttatgtcccttactttaaacctaaggaaagaagctc

SEQ ID NO: 18326 - DNA, 565 bp, Homo sapiens
tttgattaatacattgactctgggaaatatatcttagagaaggaagggaaaaacagcacagtgctggtgtttaagggctacaggataatgaaaaaagctaatggctctagtttttttgtttggttggttggttagttggtttcagaagctatataatttatttaattaaaaaggatgtggaaacttaaacacaaagtttacacaaataggagaccatgagatggtacccaatgccccacatcctcataaggacaaaacatgctgatgaaaacatctacacagactaaggattctacaagttaaaaaagaagttcatcttttccatatttgtcatggagtttcaatgacttcttgcccagtcctccatctaactgcagctgaccattgggaagactggctaaattcctgcatataccctaggtacagaaaagaaaccccagtacatctctgagttttttggggtttgtttgttttttgttaagttctgggatacatatgcagaatgtgcaggttacataggtatacatgtaccatggtggtttgctgcacctataaacccgtcatc

SEQ ID NO: 18327 - DNA, 614 bp, Homo sapiens
ggactggtacaattgtgcctggactgaaggattattaatattgtgaccagaatgggaaggaattacaaagaatgagaaaacaaaaatacctaccattaaatatcatcaagggctgtaactataatagaaaagagattacaaatctatgcctgatttatacacacactttctttctctctctctctctctgttaataaatttgaaagtctgtatatatttcatgactttctaggctaataaagtgtctcacacttgattcaataattcaaaaaggggtaaaaatatgaatagattaataacctcaaaagtaattgaaagggatttttaaagctcctaaaagagagaacagtcccaacaaatttcatagacaaattcattgtcattaaaggataaatatttaaactgctctaaattagaaatattttagaatgtgctctgtgaaagatgcctaatacatcaggtgaaacctaacaaaaacagcaaaacaaataataatctcacttatgatggtgcagcaaaaaaaatttcttgaagacgtaaattacattcggttatatttttaaagaatacatttgtttaaagaacaatccactacaatgaagcaggtcatattc

SEQ ID NO: 18328 - DNA, 633 bp, Homo sapiens
taaatgggatacacgtcttcttaagtaattcaaagtctagtaggggaagcagaaaggtaacaaacaattaagatacaaaagtaaaacaaaagccctctgtagagtgctccaacatcttttattccttatcatctccccaaattccaatttgctgcccctatatgccctttaaaaaaacccaggccgggcacaacggctcacacctgtaatcccagcactttgggaggctgaggcaggaggatcacttgaggccaagagttggagaccagcctggctaacacggtgaaacttcgtctctactaaaaatacaaaaattagctgggcgtggtggtgcgcgcctgtagtcccagctactcaggaggctgaggcaggagaatcgcttgaacccaagaggcagaggttgcagtgagctgagatagcaccactgcactccagcctgggcaacaaagcaagactccatctcaaaaaaaattccggaactaggcgtggtggctcacacctgtaatcccagagatcacctgaggtgtcaagagctcgagaccagtctgggcaacgcggtgaaaccccatctctactaaaaatacaaaaattagctcggcgtggtggcaagcacctataatcccagctaacttg

SEQ ID NO: 18329 - DNA, 621 bp, Homo sapiens
tggggccaaaatatgtggtggtgttttaattagagattgaattttttagtaggatatttgacttgacattttaaactcagatgtcaagtgaaataaccagttcagttcttccagtagtcgtgtgaaaataatttcttcctcaaattcttccttttggttaggtgcctgtggtgttatgatacataatggttttcgtccatggttcccggttcataactaccattgcccttgttgcagtcttttgttacactgttgggtgtgttaggcctctctggcaggcctctgaccttctcttgcccttcttctactctaatgtttccccgactttctgattaagggtcttaagacccttctctgaaaggctcccaccctatgggcaaaggagtgctgatgtcctgaagcttctctgaaaaaccaagaggacaggattcacagagcttccgaatagcggaatacttggaggttcttggagggtagtgtgcccagggagggcatggaagccctgcatcccttccaccatccctcaccctacacatcttttcatctgtatcctttataataaaccaacaaacatgctacactgagttctgtgagacaatccagtaaagtaatcgaatccta

SEQ ID NO: 18330 - DNA, 537 bp, Homo sapiens
tcggcctcccaaagtactgggattacaggcatgagccaccgctcccggtcagcagtttttattctgttgaccatttcttccttcctgaagctcttctcattaggactatagattaccattcatatattcaacatctgaaataaagatgcttatactaactgagctctgtgtgtgtcagctctgtgacaaattctttacatgtattatttcatcctcccatccatttgatgagataggacaataatcactctaatttaaagaaaccaggcttagtagtttgctgaagatcatgcagtcaaggaaatggtagagaaaggggttcatgtccacatgtgttagttatcaaagcttgtgtccttaaacagtgcatgtaataccacctcctcatgccaggtatcatgttggggcctggaagtaaggaggtgaaaacacctcagatacagaggggaaaacacttagtactcagggaactatgatacagtggaaaaaccaactaagcagatagaatgtgatgatttcaataaagaaggtataatt

SEQ ID NO: 18331 - DNA, 370 bp, Homo sapiens
gacagaaggttggggtttcaccatgtcgggcaggctggtctcgaactcctgacctcaggtgatccgcccgccttggcctcctaaagtgctgagattacaggtgtgagccactgcgcgcccggccgtgggtcaatcattttgagtttgggtcacgtgttcaccactttgcagcccccactggaaccacagtgatgagttttcaggcatcaaccaataggagacaagcatatgtagatcaaaatagtaccattattactggtaaagatgtttgtaaatgtggctttattttctctggtcaaattggctttttaataattcacccttgctgggtgctgtggctcctgcctgtaatcccagcactttgggaggc

SEQ ID NO: 18332 - DNA, 494 bp, Homo sapiens
aacccagcatttgggcatctagaagccttcccaagggctaaggagacacctgaaaaatgagaaagagttacagagccaggcccttaagttggccctgccaaccactctccaaaacccttagatttttgctgcctttgcccttgacactgtcctttccctggagctgaatgtctgggggtagaggaatgactttaaaagtcgaggatcaggcctggcatggtggctcatgcctgtaatcccagcactttgggaggtcaaggcgggtggatcacctgaggtcaggagttcgagaccaggctgaccaacatggtgagaccccgtctctactgaaaatacaaaaattagctgggcgtggtggaagccacctgtaatccaagctactctggaggctgaggcaggagaatcgcttgaacccgggaagcaggggttgtagtgagccaagatcacgccaccacactccagcctgggtgacagggccagactccgagtgttcc

SEQ ID NO: 18333 - DNA, 622 bp, Homo sapiens
ctcccagatctcttggtgtacgtatatttatgatgcttcctcgaagaacttgtaagaagcctgagccacacaaagatgtcccatgtagatcctctggtctaaacccctagctcaactctcatgtgacatccagaattaactgcctaccatcttggatgtctagggcaatcaaacctttggatgacatttgtttgcaatgctgcaagaagccttaagtgaaaactgtccagctgagtcctgtcaattgacagaaatgtaaaagataataaaaagttgtttgccactatgactagggatgatttgttgtatacatagactagtgaaacaacaacaaataatgtattagcataatttaaactttttacatcacagtggtaagacaatattcactgtcaaagtcagctagaacttggataattgagggaggaattatatttgtgtgtatgagatgtcttcattcattcatctatcagtcacttgactaccatgagctggaatttttgttttttaaagacaccgaagactttttataaacaagaggctttaattcctcaatgtatattgatttacaagtatgcattactaccggctgggcatggtggcttatgtctgtaatcccagc

SEQ ID NO: 18334 - DNA, 525 bp, Homo sapiens
tgatactgtagtattacagttaagaggtgatggggtttggatgaagataatgccagtgggaatggagaaacacaaacagaattttatatggactatagatatagaaattaggaaacttaatgtaggggaggacaagaaagaaagggagaaataagaaatggcacacaggtttttaacttgagcaactatatgatttgttttgtaacttagtcaacgagctcaaagtaaaaatggatgaataaataaataaatataattattaatgaaaatgttaataaatttatgaaagtttctctatacctaagaattagggtatatgaataatgccttcacatcacagagccccactcaatattattatttttcttaaattctaccaagatgaaaccttgattctttccagcttctggatgagttacctcaacccccacatccacactaccctctgaagcatacaccaagaggttagcaatatccttgtcctcttccttcattaattaattccgatatcctagcatttattct

SEQ ID NO: 18335 - DNA, 562 bp, Homo sapiens
ttgactcgcttgcttccctagttcttaatcacaggctcaggggactctcagcacctctccttcctccaggtaagtagaagcctgtaccacgtcgtaggtggctccttgggtcgggaagcaggtgctgccagcccgggacgcctcccaggggacattagctaccttgcgggagagcctgcgtgtctggttggtgtgcggagaaacattgtcatctagtggaagaaatagcaacgctctcatctcttttcttagctaatggcgtgtaaccatggattggatgtttacagagccatctcactgttgggctgatcacattgaaactttcctgggaaaagttcttatcatcttcttcctaccttaaattttgtacttcagtaaatttaaagaaatacaatggagattgagaccatcctgcctaacactgtgaaaccccgtctctactaaaaatacaaaaaaattagccgggcgtgctggcgggcgcctgtagtcccagctactgggaaagctgaggcaggagaatggtgtgaacccgggaggcggagcttgcagtgagccgagatcg

SEQ ID NO: 18336 - DNA, 646 bp, Homo sapiens
tgacaactgagctgaaattaattaggaatctatgttgtgtgggtctagtgataataaaagagatcagaaaattcatccaaaggcagcacagacaggcatccaaacagggactgtatctattctcctatcatctacacagaaattgttccataatttactgactgaaaaacaaaaatcattataccaaaagagttggctttttctttaaaacctttgactaaatatttccaaaccagcagaattccaatcaattttgcttttaaatgaaccctgacttactaccccaaatgacttattctaatagttttcaagaaaagtaaaattttcagccaaaaccaaacaaaacaaggggaatgagaggaaagaggttcagactataggatgacccagagacaagaggatgctgtcttttaagacaaaacttttcctccagacactagaaaaacaatgtaacatttccctatttcttgtccagatgcagaacatcatggaagatgtagaatcaaggcacagagctccaagcccaccatctaacacagctaatttcaaaatccccagctcatctttcacctcacccccctcctcctccttggctttaattatgctaatgttggaggagaatgaataaataaagtgaatctttgca

SEQ ID NO: 18337 - DNA, 579 bp, Homo sapiens
cagcctcctgagtagctaggattacaggcacgcaccaccatacccagctaatcgtttgtatttttagtagagacggagtttcaccatgttggccaggctggtctcaaactcctgacctcaggtgatccacccgcctcggcctcccaaagtgctgggattacaggcgtgagccactgcacccagccaatagatgatgaggattctataaatgagtattcatgtaaaatgcctagaataatcttgaacacggtgaagtcattccaaggtgggcggctcggcacgagaatgatgaaagggccgtctgctgggaaagcagggactgttgaatatcagagtgagtttggctggctgagcaggtgcatccttcctggccctggctctaggagctctgccttcccaggtagtacagggttctctagttaggtggtttttgagaagctgcaattctcagctggacaccgtgggcttagagtaggaggtgtaaaaagttaatgcaagctctaggatgtcaagcattgggtgggttgcaggaataatgtgagaggaagctaaaaaaaggtatgtttggggccgggtgtg

SEQ ID NO: 18338 - DNA, 645 bp, Homo sapiens
ggcctaccaggcgaggctagtggaggtgagaagcctcacaatccatgttttttaatgcatccgagttattccaaagcaaagggtatttctttccccttttgctcctctaattgatgcagctgttgcctagcctcatctgcattaagctaaatattatgtttttgtaacgtttttgatctttattaattatagcgcaggaaagctgacaaaagcaacctgtctctttaatataaacaagattaattgcacagttcctgcagaaaatgaactaccagcagtttaacaaaaaatgtttgtctttaagcagccctttggattaaaaaaaaatcaaaactgttacaggaagtgccaaagctgccaaattaccatgcccgtgagcctcaccctcattatcagactaaacgaacgcacaccccctgcactttcatcctcctccaggcccaggagaaagaaaggcgggagagaaaaaaagggcctttatacaaagaagtgtctctgaagtctggaatgcaccctggctgtttgaagacaagatttatacctgacacctttccttaagctcactgttgagactcgcctgttttcaaatcaaccgcagactggctgcttgaggtacttcagctcgtaacgaccacataatctaag

SEQ ID NO: 18339 - DNA, 647 bp, Homo sapiens
ctgggactacaagcacgtgccaccacacccagctaattttgtttgtatttcttgtaaagatggggtttcactgtgtcgcccaggctggtctcaaactcctgagctcaagtgatctgcccacctcgacctcccaaagtgctgggattacaggcatgagccaccaagcctggcctgctataaataatttaattttcattttaaattaataatttgaataacttaattctaaattaaacttgtccaaaactgactctttctgccaaaaacctgcactctattttgattccctgtccctctgactgaccaccttgtcatggttcaggcctgaaatatgcaaatcagactctattctccttttctgttatcaagaaggagtcattccaagagggagtgacatacattataatagacacattatatttctttaaatttttatggattcaaataaatataaacacttttttcacatggaatgtatccctttttgcctataaacatggtggaggtggcagaagccatgggagtgctaaggggaagcctggtgcatcacctgccactgtcattgccatggattgccctccatttaccaataaagtcctgttgggcctgtgttttacgcaagctggtctctgtcacagagtatggct

SEQ ID NO: 18340 - DNA, 613 bp, Homo sapiens
  misc_feature 543: n = A,T,C or G
tgtatttttagtagagatggggtttcaccatgttggccaggctggtctcgatctcttgaccttgtgatccacccgcctcagccccccaaagtgctgggattacaggcatgagccacctcgcccgtcctgacagagcttttaaggatgcatggagttctggggagttgagtctgttttcttgtctcatcagaaacacatcagaaaacacctttgaagtttaaggtgccagcaggtgtccctaagcattctaagtctacacgctgtgccccgtgcaatatcacttaagttaaactaataccttttctgctggtcttcacacagctactaatatgttctgatatataacatttctctgagaggggaatcaagaatgcaattttggctgggtgcagtggcttacaactgtaagcccagcactttgggaggctgaggcgggcagatcacctgaggtcaggagttcaagacatgcatggccaacatggcaaaaccctgtcttctactaaaaagacaaaaattggtcaggcacggtggcaggcgcctganatcccagctacttgggaggctgaggcaggggaatcgcttgaacctgggggcggatgttgcagtgagctga

SEQ ID NO: 18341 - DNA, 644 bp, Homo sapiens
gacaactgagctgaaattaattaggaatctatgttgtgtgggtctagtgataataaaagagatcagaaaattcatccaaaggcagcacagacaggcatccaaacagggactgtatctattctcctatcatctacacagaaattgttccataatttactgactgaaaaacaaaaatcattataccaaaagagttggctttttctttaaaacctttgactaaatatttccaaaccagcagaattccaatcaattttgcttttaaatgaaccctgacttactaccccaaatgacttattctaatagttttcaagaaaagtaaaattttcagccaaaaccaaacaaaacaaggggaatgagaggaaagaggttcagactataggatgacccagagacaagaggatgctgtcttttaagacaaaacttttcctccagacactagaaaaacaatgtaacatttccctatttcttgtccagatgcagaacatcatggaagatgtagaatcaaggcacagagctccaagcccaccatctaacacagctaatttcaaaatccccagctcatctttcacctcacccccctcctcctccttggctttaattatgctaatgttggaggagaatgaataaataaagtgaatctttgc

SEQ ID NO: 18342 - DNA, 634 bp, Homo sapiens
tgacaactgagcttaaactaattaggaatctatgttgtgtgggtctagtgataataaaagagatcagaaaattcatccaaaggcagcacagacaggcatccaaacagggactgtatctattctcctatcatctacacagaaattgttccataatttactgactgaaaaacaaaaatcattataccaaaagagttggctttttctttaaaacctttgactaaatatttccaaaccagcagaattccaatcaattttgcttttaaatgaaccctgacttactaccccaaatgacttattctaatagttttcaagaaaagtaaaattttcagccaaaaccaaacaaaacaaggggaatgagaggaaagaggttcagactataggatgacccagagacaagaggatgctgtcttttaagacaaaacttttcctccagacactagaaaaacaatgtaacatttccctatttcttgtccagatgcagaacatcatggaagatgtagaatcaaggcacagagctccaagcccaccatctaacacagctaatttcaaaatccccagctcatctttcacctcacccccctcctcctccttggctttaattatgctaatgttggaggagaatgaataaataaag

SEQ ID NO: 18343 - DNA, 654 bp, Homo sapiens
tgacaactgagctgaagcgaaggaggaatctatgttgtgtgggtctagtgataataaaagagatcagaaaattcatccaaaggcagcacagacaggcatccaaacagggactgtatctattctcctatcatctacacagaaattgttccataatttactgactgaaaaacaaaaatcattataccaaaagagttggctttttctttaaaacctttgactaaatatttccaaaccagcagaattccaatcaattttgcttttaaatgaaccctgacttactaccccaaatgacttattctaatagttttcaagaaaagtaaaattttcagccaaaaccaaacaaaacaaggggaatgagaggaaagaggttcagactataggatgacccacagacaagaggatgctgtcttttaagacaaaacttttcctccagacactagaaaaacaatgtaacatttccctatttcttgtccagatgcagaacatcatggaagatgtagaatcaaggcacagagctccaagcccaccatctaacacagctaatttcaaaatccccagctcatctttcacctcacccccctcctcctccttggctttaattatgctaatgttggaggagaatgaataaataaagtgaatctttgcaaaaaaaaa

SEQ ID NO: 18344 - DNA, 585 bp, Homo sapiens
ttcatgagatatcttgaggaaggtgctggacttcccacagtatgtggcatggagactggacgtgttttatatagttatccaaaaggttatgccagaaactgggagaagggaagacacctatgtcctccagataatttcaaaatggtttcaagaacactgatagagggaaacagtggggctgtggtacctgcgattagggatttgccatggaaaacagattccatattggagattttctcccaacattttattatgaaaatacatttacagaagagttgaaaaacctgtacagtgaaggctgggtgcattggcttacacctgtaatcccagtactttgggaggccaagggaagaggattgcttgaggccaggagttcaagaccaacctgggcaacatagtgagacaccaactgtacacaaaatttaaagaaaaaattaaccacgcctggtggtgtacgcctgtagtctcagctactctggaagctgagatgggaggctcccttgagcccagaagttcaaggttacagtgaactatgatcatgccactgcactcttgcctggaccacagagcacgaccgtgtgtctc

SEQ ID NO: 18345 - DNA, 603 bp, Homo sapiens
tggctattattcttttaaaagggaatacaaaagttgagatccacctgtaaacttctatgttcaggcaaaggacacaaaaactgaagataaaaagcgtggttggtttaagtgggaaaaatcatcatttttaattgaagaaaataaaatatttaaagtaaatataccaagcaagaattatagaattaatgttatcaaaatgacatgaatggtctcatatactaggcaatacctgtatattaaaaatataaattatataaatatatatgtcaaccaacaaattatgtttttaaatatataaaatatatttaagttatcctaaacaaataacaataatgtttattttaataattgatagcaataaaatatccaagcctttctttctggtgtttgagttttaaaaattaatgataattacaatatttagaaatagtatgagtaaaatgtgttgtgtactaagccaaatatatacaaatttttatgtgaaaaagtgaagacataaaaagtttaaaactatccccactttgcttatatattttcttcttcatatggtgtaatctcaataccttaacctttccattacttttcccagaattcctatttctt

SEQ ID NO: 18346 - DNA, 606 bp, Homo sapiens
gacaactgagctgaagtgaaggaggaatctatgttgtgtgggtctagtgataataaaagagatcagaaaattcatccaaaggcagcacagacaggcatccaaacagggactgtatctattctcctatcatctacacagaaattgttccataatttactgactgaaaaacaaaaatcattataccaaaagagttggctttttctttaaaacctttgactaaatatttccaaaccagcagaattccaatcaattttgcttttaaatgaaccctgacttactaccccaaatgacttattctaatagttttcaagaaaagtaaaattttcagccaaaaccaaacaaaacaaggggaatgagaggaaagaggttcagactataggatgacccacagacaagaggatgctgtcttttaagacaaaacttttcctccagacactagaaaaacaatgtaacatttccctatttcttgtccagatgcagaacatcatggaagatgtagaatcaaggcacagagctccaagcccaccatctaacacagctaatttcaaaatccccagctcatctttcacctcacccccctcctcctgcttggctttaattatgcta

SEQ ID NO: 18347 - DNA, 620 bp, Homo sapiens
tttcctcaaaatctgagccccagccctgcagggcctctcctccatcatctgctgggtagtatgccttccttacagttggagtcccatttctaccagggtttgtctctcctgcttcttggttctgataccctaacctctctttgttctcctagacccagtgggtacaagctgcttcctacagttatcacattacctcaggttcctgtgtgctgtcagccctgtgtgtagcacccacactccttctgatcccttcagcatcttgtgcacacaggcttaccgcgtgctttcacagccagcatctgtgctccctcgtatgtgcccagagagtgagaagtgcctgacaattcttgtccgcccgaggcagccatgaataaatgaccatggaagctttaacaatgtagctcccttgcctctgatcaggatgactctgagagatgtgacctacactgtctccagagctcccctgtggggctgtgccagagtcaccgtccatggattcgcttttctgatcctacaacttcactcccctcccagttttccctggagtgtcttcctaataaactactttcacatggattctcctcttaggctccacctctagagaacccacataagatact

SEQ ID NO: 18348 - DNA, 439 bp, Homo sapiens
  misc_feature 358: n = A,T,C or G
cagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatngttggttgaccataatttgcaacattgtctcattaaaaataaactttcatattcatatttggtagaactgttaatctagaa

SEQ ID NO: 18349 - DNA, 361 bp, Homo sapiens
tggggagagaaaatcgctatctcccatacctgatctggggaaactcactgaggtgacatttaaaaagatgagggagtaggccgggcgcagtggctcatgcctgtaatcccatcactttgggaggccaaggtgggtggatcacctgaggtcagaagttcgagaccaccctgaccaatatggtgaaaccgtacctctactaaaaatacaaaaattagccgggtgcggtggcgtgtgcctgtagtcccagttactagggaggctgagacaggtgaattgcttggaaccaggtggcagaggttgcagtgagctgagattgtgccactgcactccagcctggatgacagagcaagactctgtctca

SEQ ID NO: 18350 - DNA, 475 bp, Homo sapiens
aggatgtgtggcatctcacagaggaaaaatgttttccatgctatacactcataggtcacagacagcagctttgtacagaggccataaatattctgttaccacccagatggccctgactaattaattctttctttcattcgtttatgtttatgatgaactcatagatatttctttgacatcaggcatgatttgcttttttaagacgtttaatgatcatggctaatctaagcaaaatacatagcatatacagtgactgacttctcaaaatctttaatcacaaaacacttccactaccattttccttcaggcaaaaaaatatagcaaatgactgtgaagcaaagaaagcagcaggcctttatcattttgattctaccttaccacttgaaatgtttctcttctggcaaaatgcattattttattccactatttctgacaatgacaaaaaagaaaaacatactccacaggaagtatttgc

SEQ ID NO: 18351 - DNA, 422 bp, Homo sapiens
atagcactaaggcataacctagtacagtttctgctaacagtacttcatagtcaatcagctgtatacaaacaactttgaaaaatagaagagtacattgttttgtgtccctttggaaaaaaaagcttgttaggcagggcaaagaggaaggattttttttttatgtttactgagatgcttcaaattaggtgcttgatatgttcactaaagctcaaaggaataatgtcaagaatagttttagataacataaagataaaaaaaggatagataatatgcctaaaatttatttatgaagcaatgaaaataggaatcaggagacctagtaaatgggaaagctattatcttaggacttttctaaatttaaaattctgtgactctgtgttctctgtgttgtatgaattaccgttagtgtttagaaggaggca

SEQ ID NO: 18352 - DNA, 599 bp, Homo sapiens
gcataataaccaagaaagaaaccaaaaatgttaaaaaatcatgaggaaaagaaaagaaagacaatagaccctcatggtttaggagcaatgtctctctattcatcaaaggtttaattaaagcctatgttatctgtgcaattatagaagacggaaaaattggaatgttctccagttaattttatgaggttaccactaccttaaagttaaaaattaacaagaacataatagatgtgaacaaataaagacaaatattgtttataaatatagttgtaaaaatcctactaaaacattatcacattaaacccaatgctatgtaaaccccaaagatgaatgatttccaagaattcatgaatgagtcaactttaagaaatctatgtatttaattaatcaaccgggttaagtaagaaaagtcatataaatgtcttgataattgccacaatgatatttgatcaaattcaatatccaattcatagggaaaaaaattattagcaagctaaggaataaaaggatacttttgtactctgataaaggttatctattaaaaataaatagtaaatatcagagctaacaggaaaccatgactggcattcctactggag

SEQ ID NO: 18353 - DNA, 94 bp, Homo sapiens
tatttttggcagcagacttaaccatctaatcatgttttgctctagcgaattttaaaattagtttgcatttcctaagcacacatcagctgggtga

SEQ ID NO: 18354 - DNA, 455 bp, Homo sapiens
catgtgctgccacaggaagtgcaaactagaatgaagtctccgaagagaagtttgtcagttcatttccagagccttgaagacattcatattttctgacttaacaactccatttgtaaaaatttctcatgagaacacatcagataggcactcgagattattcactgctgtgctatttaaaaaagaattttaaaactgtcatgcaaataaatgcccaatgatagggggatgactaaataaaattaagaatatgcataaaagacaaattgttgactggggatcacaaggtcaggagatcgagaccatcctggctaacacagtgaaaccccgtctctactaaaaatacaaaaaattagccgggcgaggtggctggagcctgtagtcccagctactcgggaggctgaggcaggagaatggcatgaacccgggaggcggagcttgcagtgagccgagatagt

SEQ ID NO: 18355 - DNA, 617 bp, Homo sapiens
tgatttgaatataagccagtttttccatgggaaatttatccttagactagtttggggccatagtggggcagcctggtatttcataaatggtcaactgcaatattcagatattggttgtcatccttgtaggcagtggctgtggcaactctgattctacaactttggaagaaaactattaactttgaagttaataatttaattataaactttgaagttttagcatcaacttcaaaggctaggaatggcccccaaaagatcccagtttccttgaataatctttatgtttgggaattatacacttatgctaaatgttccaaatacccctctactcttcaacattgataaactcccttctcaaaaagtggccagctctttcaggtcttctgagtgactttcttaatataaagggcaataacatcgtatcctaaagcttatatgggaggaagctaagtgaatcatggccaatacaagggaagaacgctatcctctgcacataatctcttcagtttatcttttaagacccactttaagttccatcttttccagaaagccttccttaatgacctcaggcataacaacagccaaatagaccatgaaaactcttagaaatggactca

SEQ ID NO: 18356 - DNA, 140 bp, Homo sapiens
accagcctgattttctgagacagctggggaactaggagatacaggaatctttcttatttctgaaatactgatctggggcataaaaatatgtgctaaagtaaactgaacccttggatccctgtttcattcagctggcgaac

SEQ ID NO: 18357 - DNA, 510 bp, Homo sapiens
tgaggggacacccacaaacggagtgaccaccagccccacacctcctctccccggggcctggaatctcccaccttgatcctctggggttctaattctggctcaggggcagcggaaagattcctctgcttttcctcctttttaccatctacttatgtctgaatcttacctctgatctttccattgcctctgtgggaaaatggtagaataattcttacatgccaggctcatgtccagtcaggccaatatggacaatgtttagtgtgagtgtgcatgcgcgtatgcagttaagagcaagtgccttggccgggcacagtggctcatgcccgtaatttctgcactttgggagactgaggtgggtggatcacttgacgtcaggagttcgagaccagcctggccaacatggtgaaaccccatctctactaaaaatacaaaaaattagccgggcgtggtggcaggtgcctgtaatcccagctactcaggaggctgaggcaggagaattgcttgaaccca

SEQ ID NO: 18358 - DNA, 370 bp, Homo sapiens
gatgagattatgaaagtggaaccctcgtaaatgggattagtgcccttctgaaagtgacggaagagagctcgccagcaccttccatgtggggagacagggaggatatgacagtctccaacctggaagagggtcctcaccaggccccgatcatgctggcactctcatcgtggacttccggcctccagaactctgatcaacaaatgtgtgttcttaaagaaaaaaaaagtgtggaaagcaatgttaatgttcccaatcactttgagtacattctttccttaactatgtcttaatgcatagttgtgttggatggcctagtttgtaatgttagaatatgcatgttagtgaattaataaatacagcagtaaagaat

SEQ ID NO: 18359 - DNA, 441 bp, Homo sapiens
tagtcccacttgtccccgcagctaagcacccccattggatggatctgttggcagtccttcccaagggattgtgcctttgtgaatttgtgccttgggtaagactgaaggaccaagggtgatgtgcctggagggcagacacaaggggaagaagtgggtgaggtgagctgggctaccaagctgggcccagtcaggaatgcctaagctgcacagagggctttggtcttcattctaagaccaatgtgaaggctttgaagcaggaaaataacccaatcaaacttcaagaatggaggcagggtgatcaggagtgaggcttcctcagtgacctggaggagagatcatggtggcctggactaggatgggtgccaaaaagatggaaggaaatgaacagactggggaaatatttaggaggatcaattaataagacttagtgattgactggct

SEQ ID NO: 18360 - DNA, 437 bp, Homo sapiens
atctcggctcaccgcaatctccacctcccgggttcaagcaattctcctgtcccagcctcctgagtagctgggattacaggcatgcgccaccatgcccagctaattttgtatttttagtagagatggggtttctacatgttggccaggctggtctcgaactcctgaccccaggtgatccgcctggctcggcctcccaaagtgctgggattacaggtgtgagctactgcacccggtctataataacatttttaaaatttataaattattgaaatgttttatatcaatttaaaacattattattcacagtttaccacttcatagtgctgtgttaaagaccatactaccattattttcaaagaataagatctcacatccccaggagtacctgaggagtgctgagacagcatgaaataaacatgggatatttctaaattgct

SEQ ID NO: 18361 - DNA, 367 bp, Homo sapiens
cagagggatctagaatatctgccaaccacgttaccagcttccctcatgaattcaaacatcatctcccgcttctatgccttggtttcagcagaagcagcgctagtgctaactcttataggagagaatcccattccctggcctatagaagtcctttccctcaaagcccagtcaaccaccctcctcatttaaggattctagttttttcaagcattatagtctccagtcacctacataatatccctctgattggatggatctctgaggctgagaccactatattttccacaccatttttgagccccacccacctacctagcaagcaggtgttctagctgagccggagtaggaaaggcatggaagggagaag

SEQ ID NO: 18362 - DNA, 474 bp, Homo sapiens
ttcctaagagaaatagaaaaaaattgaatatgggcaggcaacattattttactatacaaaataaactggtttgaaacaagtattttgatgagaggttttgtggagcaagcaacattatttgctttaaaaaatgcctattcatggtttcatctacttactgcttttagaattgttaatttggcattgtgataagacaagctgtgagattcaccacatttaatattaaatgccaaaaagaaaaagaatgattgtgcggtggatttgaaactgaggaacatgagcattaattacaaaatgttgaaaatatttcattgcacatttcattggctacattgtgcttcttagctgtagaagccataaaaacttacttatgctcttatttctaaaagaattgtaaatataatcatatttaaaaaatttaaacagaattgtgtagtcattattatgtagttttaaagtacatatgattattaa

SEQ ID NO: 18363 - DNA, 201 bp, Homo sapiens
ttctatttctagaatgacatgctttgacatttcattaagaatttttagatgtttcaaatggaacagactacatatttcagatcaattgaccttgaggatacaattcagaaacaagttttactcaacagtttccatgaggagatgtgactgccagattggattaaaggccaaggttttgttgggatgtgtgtgtgtgtgtgt

SEQ ID NO: 18364 - DNA, 294 bp, Homo sapiens
agagcccatgctatggctatttgactttgcagtaggaagctcttgttaaaacaggtgcgcctgaggaactgcgtttatgcgtgaagaacactctccatttgcccctgacgtctgcctcactcttcccagattgaacctttattatcccatgctgggctgggacctcattatggaaggcctcgaaagccagcctgcggaggttgaacaagggagtaggatgatgagagttctgctgtaagagattaacccagcatcagtgtaagagacttgagagggaggaatgggtagagaaag

SEQ ID NO: 18365 - DNA, 276 bp, Homo sapiens
gagcaaatagccctgcgaagacttgcctctgcaaagttccattggcatgaacccccttggctggcatcccttcccaacgtcagagccctgccctggccctggctcccaagctcagaacacctgccttgtccctgcccccacaggggggcagtggttcctgctgattagccagggctgagctatggattagaataggggaaaaaaaaaaaaaaaaaaaaaaaaaagggggggcccttttttccggaaaccccaacctgaaaaaaacccttggggggt

SEQ ID NO: 18366 - DNA, 515 bp, Homo sapiens
gagaaacctgcgagaagagagcatagactcttggtcagaagcccctgcttcctacagaatctctgctaatacccttgataattctattggcccaagatgcaaaaaagcccagaactactgcttaaactttcccaccaaagtacttgcgcctggctgggaagattgtgtcagccccactggaggtctggaaaagaggcccagattcaccaacctcaagcataaaatttctctgaagtctggccgggcggggtggctcatgcctgtaatcccagcactttgggaggctgaggcaagcagatcactttagtccaggagttcaagaccagacctggccaacatagcgaaacaccatctctactaaaaatacaaaaattagctgggcatggtggcgggcacctgtaatcccagctacgtgggaggctgaagcagggagaattgtttgaacccgggaggcagaggttgcagtgagccaagcttgcgccactgcactccagcctggttgacaaagcgagtct

SEQ ID NO: 18367 - DNA, 442 bp, Homo sapiens
atttgatccctactgactgccctgtgccaggcactgtggtaggccgcgggaatacagcagacaaaaacccctgccatgccaaagagggagccagaaaaacccacagtgagtaagtgaatcgatacgtaacacgttccatgcaaaatacactaggagaaaagtagagcagggaggggatgtctttggggggtgcagtttttaacagacgaggtgacactgaaaaaggcctaaaggtcccggcgcagtggctcacgcttgtaatcccagcactttgggaggccgaggtgggcggatcacctgaggtcaggagttcgagactaacctggccaacatggtgaaaccttgtctctactaaaaatacaaaaaattagccgcgcatgtggtggcgggcgcctgtaatcccagctactcgggaggctgaggcaggagaatcgcttgaacc

SEQ ID NO: 18368 - DNA, 416 bp, Homo sapiens
gtatccaagtagagagaagtagaacggagcctctggcatgtggtttgacttattttaaatcacaaaataatacataatcttgctgaaattgatctgaaatatttcattcattacttaccacactatattcatatggtcgggcgtggtggctctcgcctgtaatcccagcactttgggaggctaagacgagcagatcatgaggtcaagagatcgagaccatcctggccaacatgatgaaaccccatctctactaaaaaatacaaaaattagctgggcgtggtggtacatgcctgtagtcccggctactcaggaggctgaggcaggcgaattgcttgaagccaggaggcgaaggttgcggtgagccaagattgtgccactgcgccttagcctggcaatagagtgagactccaaaaaaa

SEQ ID NO: 18369 - DNA, 87 bp, Homo sapiens
agagaaaatctaaagggtaattaaaaatacgccaaaagcagacaaatgaaaatggaaacacaggataccaaaacgtataggatacac

SEQ ID NO: 18370 - DNA, 409 bp, Homo sapiens
gtctctattagcttaacaaattacacacacgcacacacacgcacatgcactcatgcacacacacacacacatgcactcatgcacacacacacacacacacacacacactgctgtataagcaagttcactatgaacccatcagctgggacccaccatttgattctcctgacaacagctgcaaagaagagcaagatatatgaggaacaggacagggcaaaaaacaacatacatcagaaacatactgccatggagcaaatgaaaattgtgaccaaatatttgaccacaacctaagaaattaatgaaataatcacctctttaaaacaagagcacaaagccaaataaaatattcaaggaagacacaacactagaagatgtttcaacataatatgaaaaaacatcaaaacttagg

SEQ ID NO: 18371 - DNA, 509 bp, Homo sapiens
atagtgttaaagtctgtatactcttctcatacacatagattcatgtttatattgatgaaaaagtatttctaataaaacttagcatttttgtgtttgaaaaatatgacttttaatgatagttagtgatttatcagtaatacaaatatccttctctcgtgtaattagtggagacaagtctcaagctgagaattgttaagtgtcagtgcttgcttaattggggcaattttcacttatttgaaaaatacatactaataccatttgttaaatgatcagaacttgctctcattgaaaaagaaaggtagaggccgggcgtggtggctcatgcctgtaatcccagcactttgggaggctgaggcgggtggatcacaaggtcaggagatcgagaccattctggctaacacggtgaaaccccgtctctactaaaaatacaaaaattagctaggcttggtggcaggcgcctgtagtcccagctgctggggaggctgaggcaggagaatggcatgaacccg

SEQ ID NO: 18372 - DNA, 452 bp, Homo sapiens
gagaaatgtcaccagcagaattgacttttcatgatgtccttccaagagtcttatgttctcagaccacaggaaattcatatctgcagatctaacagtaacatgaaagagaagaacaacagcctcactcactctctcctgcaaaagtgcaaagatttctgtttgacacataataaacagtaaatcccaaatgttgaggttgagggtgtcactgggggaaaactactgctctaaaaattaataataataataatagtaatattggccattttttcattaaccatggcctgagtctcagccttaagtattcagaaactcatttattcattcattcattcaacatgtattgagagctgactgtgtaccagacactgtctgaggtgctaaggaaataaaaataggcaggtgagttaacaatctctgctaccatggagtttatattctagtgggataga

SEQ ID NO: 18373 - DNA, 423 bp, Homo sapiens
cacttgaggcgagggttccagaacagccaggccaacatggtgaaaccccatctctactaaaaatacaaaagttagccagacgtggtggtgcaagtgcctggtgcaagtgcctataatcccagctactcgggaggctgaggcacgagaatcacttgaacctgggaggcagaggttgcagtgagccaagatcgtgctactgcactccagcctgggtgacagagcaagactacgtctcaaaaaaaagattttttaatgtatctatgaccctttatagaagacatagtctttcatcattatcatcatacttatgtactgatatatactacataggtttttttagtgtttatggcagtaaaagcaatttgttacctttctatacaagttttcaaaggatttcaagatgctcatatttattatattctt

SEQ ID NO: 18374 - DNA, 527 bp, Homo sapiens
gggtgcctttgacaaatcattaagaatgagttctacattaaaaaggggaagagagggtgatagctgaggaggcagcataggcaagaacatccagcatgaaagaacagtgaaggacatcaggaacatctttcaggaacatcaggtaaaacagacttagggcccaagtcaaaggagctaaaataatacaccctggaaagtggtatgatcatttctgcatctgctccagagaaacctgccaaaatatgattagcataatacccaagagaacatcacattccccatgtgtgaaaatgcaagagggagttatttctaatagttcataagctcagcaacaacagagtagacacaaaagccatagaatgtgcttaggctttactttaatgatatagggatatcacatatcatcagcctgtggagtacagaggtagtttacaaaggataaaccttcattgtttggaaaggaaagatcagagagctctttatgaagtttaaacaaaatcagagaaataaagagatgtgggaaaaaa

SEQ ID NO: 18375 - DNA, 387 bp, Homo sapiens
gtatcctctctttttcatctccaccaacctctgtttactcctcttctctactacgtctaccagatatattaagttaataaaggcattcatatacttcagcaatgtttttggagtgggatgtgtgtgtgtgtgtgtgtgagagagagagagagagagagagaataagaacatgcatgctgaagtgctgaagcacctgcatcaacattactatcactacagtcatagtccaggaaagatgtctctgctctcaagcaagaaacaagaactaccatgatggtttgggaatgaggaaaaataagagggtgaaataagagagtgtatttgacattaagttgggaaattgcagaggaagcaacctaacattaggtgttaaaagacctggattct

SEQ ID NO: 18376 - DNA, 538 bp, Homo sapiens
aggtgcctgtagtcccagctactcaggaggctgaggcaggagaatcgcttgaacccgggaggcagaggttgaagtgagccaagattgcgccactgcactccagcctgggcgacagagtgagactccgtctcaaaaataaaataaaataaagagggggtaaaaaaccataattgtctaagaattgctctgaggattacatcagtgtaaggtaatgaactttactgaaatgtatgcaaaaaatatcactttcattatcattatcatcatcatcatcatcttcacctgatactttaaaaacttcaaatgaaagagggtaagaaagaacccactggatcccctactctgtacctggcattgtgctacaggttgtgcatatgtcacttttaggttacaacaacagcccaactgtctacacataaatttatatctgctgtataggaataaactatatttctaattctggaaaatgaggtgcagagaggattaagtaacatgcttgaattcaagtatgtttcaataattaaatcgaagctgggcg

SEQ ID NO: 18377 - DNA, 502 bp, Homo sapiens
gcatccagcccaaggctacttcttcttagatgacgcacttcactctcccaaaatgattactatttctttggattatactttgagaatactttgagaaatgctgaactcttgaaatgagcattggtctgagagtcaggagacttggccctagtcctggttgtatacaagtaatgttacctctctagacctcagtgtctcttccaaaatgggagggttaggccagagtctctcctccaacatctttttggatctaactatctacaattctatggcttctgcaaagtatactggaatcagtgtgctgctttgggagagaggtgggccagaggacctccaaatttctaaataattcttcagaatatccatcttttaagctacagatcttaaaacagaaaaaaaaagaaatttctccataaaataaaaatttcaaaaatatcacatcttaattcttggcatatgaatatatcattttccaccacctctaaacaccactggctcatct

SEQ ID NO: 18378 - DNA, 439 bp, Homo sapiens
tagcaggaggtagaagaaaaagttattgaagctgaaatagtgatccttagccttagggacagtgtgtgtcagaggttagagcatccagcatggctggtggccagagctttgcatcagtctgagatgtatgtgatgtatctttagctcagggaagagagaggacttgatttttgaggaaggcttgggaaggagggatagaagagctggatagttttgctgctccccagccagaaatttatagtttgatttcattattgccttgaaatattgggatgtcccagaacacacagccattcatatttaaaagtaagcatggcaacctcacgtctgattcggatataaagggctgatttggcttatttatatgatttcaattcacaggcagccataatcaagtgcttactaggcttgtaagagcagccagaggtcagaccattta

SEQ ID NO: 18379 - DNA, 432 bp, Homo sapiens
cctatagtcattttctatgttgctctaaaattattctaaactcctctaataaaaacttacaaagaaaccagacaaatgtgcatatggatatgactatgaactaggaaacatccagatgccttggaaaaccctaagagaagaaggaataactcacgatatgtgaaatgcaagtgagataggtgagcttggaaaatatatcatcagtataagccttagatttattttgcataattgaataaaattctttaaaaataaaaaggtgagtgttttaattaaacttgacaagtgacaattaagttaaacataatcttttgtttacaatcactttgattggagacagaaggaaattagaaattaaagtttgttggctgagcacggtggctcacgtctgtaatcccagcactttgggaggccaaggtgggcggatcatga

SEQ ID NO: 18380 - DNA, 259 bp, Homo sapiens
agtaatagtgattattattatttaaagatgcaactacttctgcaccaatctaatagattacatttaaaatggaagcctttctttgaccttttggtctggactatggctgtacagtgtagcaaagcaaaaggaacatggcggggcaactttctaggcaaacacagcaggagcactacacttactttaagggccctggaaagaggactccaaatcagcatttctactcacattgaaatccaggtctatgtaagtattcttt

SEQ ID NO: 18381 - DNA, 280 bp, Homo sapiens
tgtcccagtttttcctggactgaggggtttccttggacacaggactttcagtactaaaatgtaaaaatcccagacaaactgggacaagctggtcaaacctagttgagtttgaatttgatatttaacactttcaacatcttaatgacatttaagatgtgaaaatagaatgtatttttcatactcctcgtcactgggacactatatttcttcactgacaacttttaatggccaaggatcttatcactaatgaaaaagggaacaggctgggcgaggtagctca

SEQ ID NO: 18382 - DNA, 277 bp, Homo sapiens
cagaagggtaacttaagccttagatatgaggtaaaataactaccctttttaaagcaattaatatatacaaggcaatgttatgtgaattccattcattgtgttcatttaaccctcataataacactatgatttaagacagtatcattttaaaagcataaaaagtaacttctgccatgacacacaattaggataggaagaaatatttataaaagatgttaaaaaggtgacaaaacatcctatctgcaatattctttaaattatatccttggaacttaat

SEQ ID NO: 18383 - DNA, 479 bp, Homo sapiens
attctttatgtttccagcttatctatttcccagagaccaggtcatatctgattaccttacagtctatgaatatatttttgtgtgtgggaagagtgggtctacagtatgaataaagtttgcctatagtcattttctatgttgctctaaaattattctaaactcctctaataaaaacttacaaagaaaccagacaaatgtgcatatggatatgactatgaactaggaaacatccagatgccttggaaaaccctaagagaagaaggaataactcacgatatgtggaaatgcaagtgagataggtgagctggagaatatatcatcagtataagccttagatttattttgcataattgaataaaattctttacaaataaaaaggtgagtgttttaattaaacttgacaagtgacaattaagttaaacataatcttttgtttacaatcactttgattggagacagaaggaaattagaaattaaag

SEQ ID NO: 18384 - DNA, 378 bp, Homo sapiens
tcccataatatgtataattataacatgtcaattttaaaaaaagcaaatgagtaaattttaatacagtcaatgtaggttacaaaactatttaattcatcttcaggtctacacccaggacattctggcacaataatttctatttatgcccaagaggcactaaagatcccttgattccatttatctattcaaattttcaacaaatatttattgagagttcagtatctgtgcaatattttcttaagtgctggaatacgatgggagtaagccaagaatttgccctaaggaagcttatattttagggagaaaatgacgaggaaagaatctctctatagcaaaaaagcagccagccagggaaggaatactacaccacatcagctt

SEQ ID NO: 18385 - DNA, 272 bp, Homo sapiens
cttttaccatatttttctatactcagtacatattacctgtgcaaatttttttaatgattggcaatttcacattacttatcaataatttaggtatgtctatattttattccagcagtttgaatatcaaaaatgtattctgaggtaaaaatcatagctgtacacaataatttagcttcaaagacatgccttgaagtattgattatattattgaagaattagaaatgatttaaatgtctaaccacaggaggctctgtaaatgaattttgattcat

SEQ ID NO: 18386 - DNA, 523 bp, Homo sapiens
cactctttctcaatattagctaataaatatgtatttttaataagctgattaaggctttgttagtttctcaatgataacatcgggcccatggttctcaatcagggtatgattttgcccctcagaggacattttgcaatatctggaggcattttcagttattataagtggggctgggtggatgctgctggcatctcatggagagagaccagagatgctgttaaacatcctataatgcacaggacaggcccccacaacacagaattatccagcctaaaatgtcactagtgctgagggtgagaaactctgacacatcgattcagtgatgttctggcaacagccaataaagtcagcaattaaaaatttgtattgtagggccaggcgcggtggctcacgcctctaatcccagcactttgagaggccaaggtgggcagatcacgaggtcaagagatggagaccatcctggccaacatggtgaaacctgtctctactaaaaatacaaaaattaactgggcatggtggcatg

SEQ ID NO: 18387 - DNA, 370 bp, Homo sapiens
ctcccaagtagctgggattacaggcacctgccaccatgcctgcctaattttttttgtatttttagtagagacagggtttcaccatgttggtcaggctggtctcgaactcctgacctcaagtgatctgcccacctcggcctcccaaagtgctgggattaaatgtgtgagccaccatgcctgttctcagtagattcttatattgtcttttcttctttaacctcttagaaagccaaaaggtaaaatttcagggtttagagagggtatggaaagtctagcttctcatgcccatctggatagagccagctgtttgtcctcattcaagaagatacttgccgggcacggtggctcacgcctgtaatcccagcacttt

SEQ ID NO: 18388 - DNA, 492 bp, Homo sapiens
ggactagctgggactacaggcatgcgccaccatgcctggctaatttttgtatttttagtaaagacggggttccaccatgttggccaggctggtctcaaactcctgacctcaagtgatcctcccgccttggcctcccaaagtgctgggattacaggcatgaggcaccatgcccagccctgttattggatttttctgtccaaattttgaatctagacactgacacagggagtaggccttccagtttctagttggtacaaagaagagttgagaaatttgagagaggcaataatttcagccccattcttaacacagttggcttagttggtaactgttgaagattattcacctactttttcctcaattcttgctttagaagagccatcaaggaacagctattaccagcagaactgctggaaggaatccagtagatctggccccttgggagagtgggggaagagcaagagtagcctcagggaaaggggtcagggagag

SEQ ID NO: 18389 - DNA, 473 bp, Homo sapiens
acagattaccctcggcactttcagaaaacaacacagtgaccagtatattctgtctttttgatacagccagaagcaccctgaaagctgagacctaactgtgcttttggaaaataagcttttaggagttgaatgaccttgtctacttcttttagtcagaataatgttggcatgtctattttaggttaaaaaaaaatacaaattctaaaaagggacttttaagggccccttttgaaagccttagcatttaaactaacattagatttaaaagaagggcttttctcccccattataggaagctgtgtaaaatcatgtgtgaggttgtgagggtcaaatggaagtctaagataaagttctgccaattactggtgtctttaagcttccaccagcagccaagcacagtgcagatcatgagtccttcaaaatacggggtggttttaatgctctaagttggtatgattactttttctaaagag

SEQ ID NO: 18390 - DNA, 547 bp, Homo sapiens
ggtgagagatagagtaaaccttaatttggatttcagagtagagagtctatcttcttggctatatccacctgatataaaatttctgtcaagatgagcccaggataggtgaaggagaaggtctcagataccatggggtctctgtgctcttattaagttttagtagatttttaaaataacttagttttgttaattaggacgatttctagggacattaagtggttgtgattttaaatgtttttatgctagttaggcatttttcacaagggagtgtctctgtgaaacactacatgtcatcattcttaaagaaaagcactctagtttggtttgtaaaaatgagcatgtatgcaaggaaaaaaaaattatcagacattaaacattatacatagttttaattgcattgatgggagtgggagttttgcattttcacatcttacataatggatgaacagagaactttagttcttagtaagaaaacaaaaacattgaaccatggatagaacagtggggagctctcttttgaacaacttgtaggttgatgagtaaatca

SEQ ID NO: 18391 - DNA, 511 bp, Homo sapiens
atttgcaaattttggggctgcatgtgaggctgggaaggttgacccagagcttctaaagtacaaaatgaaatctctcagaacctgatggtatttggatagcatatacccaccagaggaacaggcttttatctagcataccacaggtctcccctttagcacatctgtgctcattttgaaactgtatagggaaggacattaggtggctgggagaactctgaaggacagacctggatctcctgccaccttccaaaggtgaaacaacaaaaatccgccaggctttcaatcaaaagccccggaagggccacttcccaaggaacagaggcaagagcagaagtagatggagtcttactgaaactgaaacccagctcaattcctaataggttgaagatatgattacctcaatgcagtctgcttatcagaaaggcatatcatatcatccggatgttttatatacaatgtttggcatacaacaaaagactgttagatatggaaggaagcaagaaaatgtgac

SEQ ID NO: 18392 - DNA, 473 bp, Homo sapiens
gctttgcgctgggctgagcccagagccgagagcaggagtcggctctgagttccctgcttggtttttgggtggcagcagccagaggaggaatatggcgctcttaggcagccgagcggagctggaagcggacgaggacgttttcgaagatgccttggaaaccatctcaatatcttctcactcagatatggcaacaagcagccttcactttgcatcatgtgatacacaacaggcgcccagacagcgcggagcgtctactgtcagcagttcatcatcaaccaaggtggatctcaagagtgggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatt

SEQ ID NO: 18393 - DNA, 530 bp, Homo sapiens
gatggaaggatgggtgaatgaatgagggaagtcaagcgatccccaagcgacttaggaatgtagttgctcccctgagaaaccaggcagctgccattctccgaagtgccccggcttgccaggcacagaaggtctcatggcacctcagagactggccctgcaagggacatggctgatggccaaatacagtcaccacctcgggctgcccaagctctgtcgagctggaatatggcagggctaacattacagaaaacaagttgacggcgtcagaaatgggagtttcatcaccctcagacgtgtttagccccaactgtgtgtcagtctctgctggactccagagcataaaggaagcaatcattgtccaaggaacagagtccctaaaggaggtagtggggtcaggggaaaaggaaggaaggaaagggacatttattaagaaatttattgtatgctgcagtttactctattatctcatttaatcttctgaacaatcctacaagactgaaggtgtaagagccatttctccacctggcagg

SEQ ID NO: 18394 - DNA, 318 bp, Homo sapiens
tctcctgcctcagcctaccgagtagctgggactacaggcacccaccaccctgcccagctaatttttgtatttttagtagagacaggatttcaccatgttggccaggctggtctcgagctcctgacctcaagtgatccgcctgccttggcctcccagagttctgggattacaggcatgagccatcacacccggcctgggactcttcttgcagtgagccagggccatgggacccttcaaaagttgctccaccctaatccccaaaatatctttttctcccgcctgtcccaagtacctggcatcatactatatgggtcaact

SEQ ID NO: 18395 - DNA, 521 bp, Homo sapiens
ccaccatgactggcaaattttcgtattataagtagagatagggtttctccatgttggtcagactggtcttgaactcccgccctcaggtgatctgcccgcctctgcctcccaaaatgctgagattacagatgtgagccactgtgcccggctgcctgagacattttgggcaacagccgtgacagaagaaacgtgcatcccttctgtgcaggggatttaagaagtggctcatggctgattatgttttctttgctccgtttctggaactgtgggagcatcttctgggataagggtctatctgtttgagtctctgaatgactacgaccaccagagcccccttgttggcccgtgatggatgcgaaatcaattcagaagtaaaggccgggtgcggtggctcacgcctgtaatcccagcactttgggaggctgagacgggcagatcatgagttcaggtaatcgagaccatcctgactaaaacggtgaaaccccatctctactaaaaatataaaaaattagccaggcatt

SEQ ID NO: 18396 - DNA, 283 bp, Homo sapiens
taactatcaatgactttgaggtgataatgagcagcgaagacatttcaagatacccacaaacaccataatgtgatatgaaactatctatgatttccatgggtgacaagtcacaggcattactaataccactgtggcttgttgcctattatcataactgctaatatttcaattagagattagagaagataaagggcttctgttttttgttgctgttgtttatcatcaagttaaaaggcatcctgaaacactttctggcttaaggcttcagtaagaatggagtaga

SEQ ID NO: 18397 - DNA, 558 bp, Homo sapiens
accctattctaagctgtggattcgggatagaaagaaagggggagggcaccacatatagtgtaagttgatttttttctgggttaaaaataagcaggcaaacacacacgtacacagacatgcacacacacacacacacaacatatgaataaatgttcagctggggaaataagccaattttcagttataggcatgaaagtcaaataggaaaaattttagtagtgcaaatgaatacatccctgaaaattcagtgactgtttcctaccacaaaaacttcctctgtcatatggattcaaaatcaatattgagcagagccagatatattcccagaagactatgggattcaatcaggatagagtccaattaagtgcatgcccttcagggcttttagcaggtttctgagaaagaggggttgatttgagacaaatgatgatgcaagattttaagtagtgtaagactaaacttaagatcagttggcactgataaagacacaaagggtaaatgttttcaataccaaatgaaaattatggtagcaatttgaatggttgtatttaatcattt

SEQ ID NO: 18398 - DNA, 578 bp, Homo sapiens
tatcagtgacctaacaataactctataataatagcttacagtctacaaaacatacacacacaagaagtagtgcaacacagagggtaagagtggagctttgaggtcagctgggttggctgcggactgtggccccaccactgtctagttgtttggctttgggcaagctagctaacttctctccacattagtttctatccagccttataaggttgttatgaatattaagtgagatgatataaacaaagagctcagcacagtgcctgggatatagtagatgtgcaacaaatgtcagctattggtatttttgaaatcatctactcatagcaatctagtatctagctgcaagactgtgcagacactgcacagggacagagtagcagcagacaattgaaagttgactgtgaggccgggcacagtggctcaagccggtaatcccagcactttgggagcctgaggctgacggatcacctgaggtcgggagtttgatactagcctgaccaacatggagaaaccccatctctactaaaaatacacaattagccaggcatggtggtgcatgcctgtaatcccagctactc

SEQ ID NO: 18399 - DNA, 351 bp, Homo sapiens
aagataattgtcttcaagatgagatagaagatgggaatgtgaatcaagtagtattaaaagcactatttcctcacataccttacattcatagatgaccacttcatatagttctaatcaatggtggaaaacttctaaaagaaaacacagtaaagtatgacacgctttctgcagtttggcactctctttctcactgattggaatacagatgaaatgcctaggatcttagcagttattgttttttctcagtaaagacaacagcagcgacatctgatatctttgtgcaattgaactaaaccagaaatcttgttccttgctaattgtagcaaacacagtcttttctgaagaaacatc

SEQ ID NO: 18400 - DNA, 477 bp, Homo sapiens
ttaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagac

SEQ ID NO: 18401 - DNA, 423 bp, Homo sapiens
tctctctccctctctcttagaacaagaattcaaggggagcgccacgaagagagatttcacagagaaagtgaatttagtattaaacaggttataattaagctaagaggctacaattaggactcttagtaatgagggggaatccatatgcttgttatgtcaaaaatggtagttagccattacatattctagtacaataaatctgtgctagaaagtcagaccaaacatgagaccaattaagatgaagcatgactttaaacatataatggatgataaatctaaaaacccattttcacaggaaacagtttgatgcagggctggaatggagtcattgtgtccagttttatgtcttggatccatagggggaaagttacgtaatcatattaacctaaatgctagttatttattttacttttcctatttatt

SEQ ID NO: 18402 - DNA, 523 bp, Homo sapiens
ggactgaggggagagaggggaaagaaggagactgggcagaggaagaaattgagatatgatgcagactaaataaagcttcagttgaccctttggccatttctgaaaatggaatgacccttcagagatattcctaattggggtgagaaggctgagcctttatactcccatgttaaacagtcattggatgtggacgaccttgagaagggtggctgtcttcacctggaggcactcccagtagctggggcaatagcttcttcattctggggagagtttgaacacattacagctatcggacaagaacccattccacctctttcttccattcaaggactaaatatgccgtgtgtgtgtgtgtgtgtgtgattgaaagtaaagtaaaacctgacactctggccaggcgcagtggctcacacctgtaatcccagtattttgggaggccgaggcaggcagatcacgaggtcaggagatcgagaccaccctggctaacattgtgaaaccccgtctctactaaaaatacaaaaaa

SEQ ID NO: 18403 - DNA, 486 bp, Homo sapiens
cctcccaaaatgttgtgattacaaatgtttgcgccaccatgcccggccattgtagtcatttatcctggtggattaaaactgaaccagggaggtaccagtcagtggcttcgttatcatcaaattgatgactaaggtcaaccttttagaatcttctagaataaatatgtcttacacctctaaccaaatacacaggtttttaaaaaaaacaaatctataacataggccgggcacagtggctcatgcctgtaatcccagcacttttggaaggtgaggcggccgcgtcacctgagagcagaagtttgaggccagcctgaccaacatggagaaaccctatctcaaaaatacaaaaattaggccaggggcggtggctcacacctgtaatcccagcactttgggaggccgaggtgggaggatcacgaggtcaggagatcgagaccatcctgggtaacacagtgaaactccgtctctactaaacatataaaacat

SEQ ID NO: 18404 - DNA, 486 bp, Homo sapiens
cagagaagtggaaattacttcagattgtcatgaaaaagacaaatggagaaggtgggatgcatgaaaaatagacttttaaaattcctaaatcaatgccctcaagtcatctaaaatgattagaaacagtctatagttgtcttttatgaggagacaagaattatatgtgttccttgttttttttctccttctgcttgctgaagagttctggtttcacttgtcttgtccttttccttccctttgtcctgccttgagagactggttatattaagcttttgtgaggaatttcaggtgagagggaatggaggaagaaaaaagagacttagggacacatattcatacccatgtgtgtatgtgtatttatgtgatatatgtataattttatatatgtgataaatacatacacattacaaatgcaattatactatacttaatctttcatatgttttaaatccttcaagtttattatgaacatctccccatgtcaac

SEQ ID NO: 18405 - DNA, 559 bp, Homo sapiens
agctccccaagataagaacttggctgccagagggcattaagaactaagggcactaacatatgggctatacggaagtgagaagcgccaggaaaaataaccttgtacatctttccgtgctgggaccttgtactaaactgagaaagtattttcagctgagttacttggtgaggtttacaccctacccacctagaatccttgctgctcccagatattccctctctttaaaccaaatctctggttttttaaacccatttctacttaagcattcaactaatgaaatggtaaggactgtaagaggacttgagcaaactcactgaatggctgacacagaagtcttagaaggaggaccgggcgcggtggctcacgcctgtaatcccagcactttgggaggccgaggcgggtggatcatgaggtcaggagatcgagaccatcctggctaacaaggtgaaaccctgtctctactaaaaatacaaaaaattagccgggcgcagtggcgggagcctgtagtcccagctactcgggaggctgaggcaggagaatggcgtgaacccgggaagcg

SEQ ID NO: 18406 - DNA, 558 bp, Homo sapiens
tttctgaagtgtagatgttagaataaggcttttctgaagtttatgaaattttctataaacagattgacctgtgtcttttagtaaggacttattgtataatagtcaactgctattaatttagaaaaattatttgtttattactgttactatccaaatagttttaatgaattaacgtttgagagaagacaaatatccttatgtgcaatacaaaattatttgagattctctttgtatggattaagctgatgattccctgtgctttgccagtctttcagggctttctatagtctgatttatgggctaaataagcattttccacttacttctgcatagttaagctcttaccttccttttaagcattcagcattaacgttcaatatgtaccagaaatttctgctgagtccagggagtctagtctactaggagagtgagtattaggactgatggagttctaagtggaagttgttttctagggtctatctgaagcctgggttaatactagtcctaaaagtcctcagcttctgatggcatcatgcaacctgacttcaaactacacta

SEQ ID NO: 18407 - DNA, 288 bp, Homo sapiens
gaattcagaacgtcgagatggggcccaactcactccagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatg

SEQ ID NO: 18408 - DNA, 438 bp, Homo sapiens
gatttaattgttggatgtatttcttaatgggataattatttaaaaacattcccagttactttaaaagcgtatgtgaatattacccatcagttttgtcttgaccttgcctttggctccttgagtgtctctgttcatgtgacagctttccagctcatccttaatgtcatactcgagctgtttatcttagtgaggtagtgtgggcctaaaatgaaataatatatatcaaaagcacctgtgggggaaagcacatctgaatgccaagcagtacttagttactgcaagtgctacttctaccaatattttttctttctttctgcccctttaaagagaggttgtccctttttaatagatatatgacagctctgcttcctttcttaagtctaagatcaaagaaatgttgtaataaaggggagtcactccctcccattccttctctct

SEQ ID NO: 18409 - DNA, 531 bp, Homo sapiens
ggtgctgcatactatcctggaatcctgcagtataggactaaggatagaaggccctagaatagtgctacccaaagaagtttctgcagcaatggaaatgttctatatctgcactctccaaaagggtagatagacactggcaacatgaggacattgatttgttgacatatgactagtttaattaagcaatagaatttattttatttcagttcatttaaattagaactaaaccatgactaatgactactatattggatagcacagttttaggtcacattgctgatgtttagggatgtgtttggtgccaaagaacaatctgtaatcatccaaaccaaatactttgaagtaggactaaggtaaaaatgatgctaactaacattttgacaaaattatttttattcccctttaactggaggatagcatactatcttctgaaaaataattcttattgacttgaagtctttaacgaagataaacaataacctccaaactaaataatttaaacatctttaaaattttttaaaggtcagcgca

SEQ ID NO: 18410 - DNA, 77 bp, Homo sapiens
tacttaaagggcctttgagtgagagttgggcattcattctgaactaaccactaatatcattaagaattagtgctgag

SEQ ID NO: 18411 - DNA, 405 bp, Homo sapiens
atcttagtaactagtattattgataactactgaacatgtgtcgaatgggaagaggagatcatcaccacatattctttaaatgtcagctgctttcataaaagaaagggttgatgttgttttctgtcaacagaatcaaatgaatcaattctggaaagtcttcctttcctctttggaatttatcttcattcatagaaactgtattcataggtcttaaattctttcttcttagactatagtactattacttggaatgattgagccactagactaaacacctgatactggtgcttatacacgtaaaagataggaacaaggtaagataattagacatttttccattgtcccccatattgcagggacaataaacttcttataggaagcataactaacactcagaaagtatgc

SEQ ID NO: 18412 - DNA, 560 bp, Homo sapiens
gtcgtatgtgaatctgtgaatccttataagaaatgtttattgttcaagaaagaagcctcctctggtggttgataagcaattctccacggcagagaaatgctaatgttttgttcttatgtcttgattgatgctttcactacttattcttcaggctataagacagaaggaaacacagtgttaccttctttcataattacaaattccaacacctctttctcccccccaccccctgtctcccttctacttctcatattaccttaaccatcaaattcaaatgcatctgaatttgtaaagttaatctttcaggttctaaaataaacctgtatatataatatctccattactaatgccatctccacatacgtacaagaaaatgtatagctctacattgtcaatccagacactaaattcattccaaatgtttttaaataaaaataatgaattgatttttatttatggcatgctgcatacacccatctttaagtttcaggtataactacatgcagaaccctcttgttgaaagtgcagagcaacattacagtggctaaatttcaaattaa

SEQ ID NO: 18413 - DNA, 531 bp, Homo sapiens
tgggtggaaaacaggttaaacctgggagaaagagtcctcttttagggataaaaattgggattgttcagctggtgtggtgtgtttgcatggggtagcacaaagcccccgtgaacatgacttttaccactaactatctgtgtgaatttggcaagcgtctcgaacatcctggggctgtttactcatctgcaaaatggacacaaaaacacctgctctgcgatcttcacgggtggtggtcagagtcatgtgaaaagatgcaggcagtagagcgctgtgaaactctaaagtgctcagcaaatgtaaggtaggctgggtgccctggttcacacctttaatcccagcactttgggaagccgaggcgggcgaatcacttgaggtcaggagttccagatcagccaggccaacatggtaaaacccaatttccactaaaaatacaaaaattagccgggcgtgggggtgcgtgcctgtaatccctactcgggaggctgagtcaggagaattgcttgaacccgggaggcggaggttgcagtgagc

SEQ ID NO: 18414 - DNA, 498 bp, Homo sapiens
gcagactcctgggttcaaatgatcctccagccttggcctcccaaagtgctgggattacatgcatgagctaccacacctggtccattattatgaatttaaactgcaggctgatgattccagggtcccaaattcactgacagcaggcacgctggtcttgcacaattccccagagcagatggcccttcctacccatagaagcccatgctcttagctctcctacaaacctatccttagaaatacgaagtgctggccgggcgcggtggctcacgcctgtagtggatcacgagggcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaggcggagcttgcagtgagccgagatcgcgccactgcactccagcctgggcgacagagcgagactccgt

SEQ ID NO: 18415 - DNA, 499 bp, Homo sapiens
  misc_feature 318: n = A,T,C or G
ctaagccaggagaattgcttgaacctgggggttggaagttgcagtgagccatgatcatgccactgcactccagcctgggtgacagagcaagactctgtctcaaaaactaaaactaaaaataaaataaaataacgaagagtataagtggattgtttgtgacacaaaaaataaatgcatgaggggatgaataccccattcaccttgatgtgataattatgcattgcatgcctgtaccaaaacatctcatgtaacccagaaatatatacacctactaggttcacccacaaagctttaaaaatatacatataaagaaagaanaaccccagcccagatagttctaggtgtgggaacctccatgaacctctctgtgttcaggtgaggtgaaagtgactatcccataggttgtcatcaggagtgaatgagaaaatgcaaatggagcccacacctcgaatataattaatgtacaaaaagcattaactaatctagctggtccagatga

SEQ ID NO: 18416 - DNA, 464 bp, Homo sapiens
ttgtacatttttgaggttctatagaaatatataatctcattaattcttatgttctcatgtttcaacaggtactgttattctcattttataaataaactcagaagctcagtcacgtggcctccatctcgtctcacactttttccacctattcctttctccctgtcctagaaaatggcaagaacttcacacttgaacattttaaatgtagtctagcctcagtttctaaatttcatatattcagctggtatgttacagaaactaatagtgagaaattgtcatctgaattaactgctaggcagcaggacctatataactggcttggttttatatattaagtcatatctggatcagctccttatactgctctgctggtttagggcaccttaaaagccctacattggccgggcgcagtggctcacgcctgtagtcccagcactttgggaggccgaggcgagcagatcacg

SEQ ID NO: 18417 - DNA, 497 bp, Homo sapiens
cgaaaatgaatgttaaatatgcaaattttaaaaacttctacccgtgggatggggtagttgagaagtgggtataatgaaaactcagacaaaacagaaaacaagaagagtcttttttaatcaaataaaaaaaataaacatgaaaattagaaagtacaatgttagacagtatctatagtcacaatgatagcaaacaaagtttccactacaaaacacagaatcacagaggagacacagacaagacaaattaatctatataatactgaaagaaacacacccaaagccgaagtatctagaaacactgaaactgaaagaaagcagggcgtagggggagaaataggtttacctagttctattttaccagaagaatatgaaccaaaaaagaaagcttgtatagttattttattctcagaaaaaaatggaaagacagaaagtattatcagaaataagaggctataataaaaggaacatttccccacaaaagtataaaaattctgaac

SEQ ID NO: 18418 - DNA, 558 bp, Homo sapiens
ccagctttttgcttggagatatttctgatctgtgacacagggaaggggaaccatagcagggtcttattatgtgtacggcacagataccagagttctaggaggcagaggtacttggaaatttggaatgcgcggtaaccaagacaagggaaccacacagaaaaagaggtccagaaatcttcaagtcaattcaaagaatgacaaagaaagtgtaggctgcatattctacggagctcacaaagaaatggatatgtgtatttcaattagccagaataaagaatctgtgcagaacacctgcagccttcagaaggggcccctgaagggtcatgcatttgtagagagctaaagtagctccaaaggaaaatctactataagtgtaccataaagtcaaatacaaactttaaataacaaaatagaaaatctgaatagccccatatctcctctaaatattgaatttacaagacaccagaagactacatccagatgaatccaatggtaaattatattcaacatttcttaagaaaaaataatattcttatacaaaatgtttcaaaaaacaga

SEQ ID NO: 18419 - DNA, 465 bp, Homo sapiens
gtgggtctgagtgtggccatataacggcactctggctaatgagacatgagaggaagtctgtggggtgtgcagggagggtgacagtggggactcatcctcatcagaagacagagacttccagggagactgccctttccttgtttcccttcttcctgccttgaatgcagatgtgacagttggcgggtcagcagccattctgtagtaatgagatgataaggatgacaaagagattgcaggaaatccacccctgccatcatcaaggcaagcgttactgcctcctgatttcttgttatggaagaaagataacgcctatttttcttccctaaaccactataaattggatttttctttgacctgacaccaaacacattcctatagaattcactgccacacagccgagtaaatgtttgcttttacctggcttttacaactctctgagcttcccaccatctagaagatgaaagt

SEQ ID NO: 18420 - DNA, 559 bp, Homo sapiens
atatattttatgcttgcaaaaattataaagtttttctggtgggattattaatatatgaaaacaactataatataaaggcagaagttatagtctttattgttgtaaggcaaaatattgattctaaatagacagtgaaaaattcagtacatatattgcagtccccagagaaaccctaaaaaattacacacacacacacacacatacatacacacacacatatgtgtatgtatatatgtatatattcatatatatgtgtacatgtatttacagagagaaaaaaaaaaaattgcaatagatgaactaaaattgaatatttaaaataatgcagataccccaataaaagcaaaaaggcaaaagcagacgggacaaagaagaaacaaataataaaatgatagacctaaatccaaatgtattaataattaccataaatatgaaatgatcctaatataacaataaaaatacaaagtttattgcaactgatataaaaataatttatatgctatccatacaaactcacttcaaaaatgataatataggcagattaatggaaaagaatgga

SEQ ID NO: 18421 - DNA, 155 bp, Homo sapiens
atgagagcccacaggaatccaagttttgagtgaggaaaactgctttttgcagtccatggagccccaatcccaagaaggtgggtcaatcctctattaattttatttctccttgtgtcttcttgctgtttctctctagatgcagaagcatatatgga

SEQ ID NO: 18422 - DNA, 366 bp, Homo sapiens
  misc_feature 106: n = A,T,C or G
aaatgtgagtgcctaccacgtgccaggcactgttgactgttgagagacatcagtgaataaggcgtccaaggccatccggagcttaccagtaattcaggagggctgnggaagaagaattcagagcagtttaggacctggtaaagtttgtgaaggctgtgtgctattcaagtggaaacgcaaacagacagttggcagtatgactcctcaaaggaggtgtctgggctacaggtaacatttaggagttgtcagtatataggaatgctaaatgttaatagacacatggatttcattatactgtttcgtatttgatttacgtttttcataataaagcctggacgcagtgactcacacttgtaatccctgcac

SEQ ID NO: 18423 - DNA, 351 bp, Homo sapiens
tagttaaaatggtaatgggaagaccatataaacaacagaaaattaaaagttcttaaacacatgaaaaggtgctgaacttcacaataagataaaaatgtacaaatatgagataatcatttttaactattcaattgacaaagattcaaaggtttgataaattattggctattttgcaggaaacaaactctccatgttggtataaatatagattaatataacctctactgaaaacaatttagcaaacttttgtttaaaatttaaatgtaggtcgggcacggtggctcatgcctgtaatcccagcactttgggaggccaaggcgagcagatcacaaggtcaggagttcaagatca

SEQ ID NO: 18424 - DNA, 341 bp, Homo sapiens
catccggtattttcacccaaagtctggcagaaattaagtgcaaagattaaaactacattcctttcaaatccaagttcaagagtggcttagacagacaacgtcaagagcagcagtgggcagaatggaggcttctggagcaggcatgtagacacccctaaatgcttaggatgagtaaaccagaactccttactgaccagactgtgtagctccagccttttaccattcccaagatgaggacggtccaggacagctttacagagataacaaagaagtaggattggcaacccaacaagtcaaagtagccgtaaccgtagccactcccatgaccaagcagaagcagc

SEQ ID NO: 18425 - DNA, 549 bp, Homo sapiens
gttttgataataataccctacctagcttctgaacagtttaataatagatttaatccgtgagaggaaataccctcgaaagttactatagaaataacacctcactatctggtggcatttacttagttcttagaactgactaattagtttatcggttaaagtaatttgctattatattgtaaaattacatttgaggctcacttataaaaattggaaaacatcgaaatataagaggtccaagagggtgtttgaaacacattttgctaagttgacaggaaattaatagactttttatgggcccattacttattaatacactcaaaaaaaaggtacagttaaataaaggttttaaatagtctataccgtatactaaaactaaattaatatttaggactgaaataacatattgattaagtaccagctatgtacccaaaaaatgctgggcacagaagttagagtaagatgttttacttaaagggcctttgagtgagagttggcaattcattctgaactaaccactaatatcattaagaattagtgctgagttggtag

SEQ ID NO: 18426 - DNA, 529 bp, Homo sapiens
gtaggtgtgagattttgctttgacaacttactcatagcagttgggcaagtcacaaccccttgtagttgcagcttgctgatgagcaaaaatggaaataatacttgtgtcatttatttggtattactgttgctcatttattcatttacttctttaacaataattgaatgctgaccatatcccaaatactgtgctaaacacagtggcagatgcagaggaataatacaagccctggactttttttccttatgcagtttttgaaacatacgaataaacagaaatactatgatgatgggggaccagttgatctttctcgataaaatataccctatttattgagcactatgttataccagggactatgctcttcataaattacaacattctttaggaattggcattatcatattcattttacttatgcgataactacttgtcatagatcacacagcttgtaaatggcagaactggaatgatttcaacccaggactatccaaactctaaacctgtactctttccaccttatcatact

SEQ ID NO: 18427 - DNA, 559 bp, Homo sapiens
tggatgtagaagggtataaaataaaagttgaggaactaaagttttcatcaaaacctgtggtgttagggtgtaggtttttattttattattttattttcctgaaaagagttaaaggaaatagtttttttctgggaagggtgaagtttctgtgagtgttttgtgggtttagagattggataaatcaggaagacaacagatgtttggtgtgattagcaggtctgattgaatggaaccagctttgaagtctaattgaagacatttgacattaaaacgccaagattatttaggtgcttcacaaaataaaattaaaaatgagacccagtaaaggaaaaatacataatatgaaacatttgttggccaggtgagagactatgctgatgaaattattattggcatccgaagactccactttgattgaaatttatttaaattttccattctactcagtggtgttctgctgaaaacagtaaaaatttgtggaatatgaaaaataagcttaagtacctttttcaaaatcagtagatgtgactagaagaatttaaaacaagatacacaatta

SEQ ID NO: 18428 - DNA, 558 bp, Homo sapiens
ggttacccttagggcaataatagggtaatgattccagatatggaagttgtagacattaaatatctgtgagaaatatttgtgaaagtatattatggaaaaaatggaatatgcatgtaaacttaggctatgttgagtaaaataaaactaatgttttaaatatgaagaaatgaacagttgctcaatgcttgtttctctacacatgtgcaggaagtatataattcagtgctgtacacatatcacattggagcattaatcacagctgtgtcccactttacccaaacatggccacatagtctcttaatcaagcatttgggaaactactagcaatcatttagagtggaaacataatttgacaccggtttagcattccatttgtttgctacatccctctttatgacaagaaagggaaaaatcatgtaatactataatttgaggaaatgtaataatgcattcagggagacagaagcaggaaaattttgcctgtgtagaatattgtcacacatacatgtatgtgtatgtgtatgtatatatcagaaaacatatttcaaaaataaaaaa

SEQ ID NO: 18429 - DNA, 240 bp, Homo sapiens
tcaattgctttatgtagttaatggagtccaaaatgcattgtaatgtaatttattttgcagaaatatcacaaaatagttcacaggtaattatgtttgatgtggaaaaacacaaactctgaatgtgaaaatgtgttctgtaggttgcatttagaaaagtggtgggcagggctcagatggtttgtaaagactagggaaatcaaaattttataaatagggatctattgttttattaaatgagcc

SEQ ID NO: 18430 - DNA, 422 bp, Homo sapiens
atgcccttacacattccacatgcatcacagcacataaccctgacaataaactacaaggtaagcaactaattattccctttttaatattttttaaaacctaggaaggtaacttaatctctttgacttccaggtctcatgaactagaacattagagaatcaagatttgaacgagaggtgatggtttttaaaatatttctgctagatatcaaaatgaatgcatgggatttgatatatctacataagtaggcatagaaatagagatgctcactgatatgtgtatatgcacatatgaatatgtgtgcatgtatatacatgtatccatttcccagctcttcttttaagaggatatagaaacaatgtcaccccagcaacaataaacaccctagtgcccacatcttgatttctctgtaccattttctact

SEQ ID NO: 18431 - DNA, 253 bp, Homo sapiens
catcaacaaacatttttcttcctcatactttttctccccacctcccaaaataaagctcttacctaacctaatacaaccatccttatctaatctaaaagcattccttgccgggtggcgtggtggctcactcctgtaatcccagcactttggaatatcgaggcaggcggaacacctgaggtcaggagtttgaaatcagcctggccaacatggcaaaaccacatctctactaaaaatacaaaaattagcagggcat

SEQ ID NO: 18432 - DNA, 523 bp, Homo sapiens
aacaaaaagtgggccccagtagatggtggcttcttgaggggggaaggtaggagggtgagagtgagatgccgtggaacagcaaggacaatggccttgagaacagggttacattatgactttcagggacccttcctctataacaaccagacatattaaaaagcatattttatgactatactggtataaagacaaatacaatccatgctagattcattattacatacccattattatgatattcatttttcccttctgattttaaaagaaattcataacatttatctgagttccttccagtttcatggggcctaggcattgttcctcctgggtgtaagggttaagtcagccctgcttgaaagaaatacatcaaaatgtgtattctttaggagtgccattctatttgactgaggattttttaaaatgttcttggttgatgatacttcctcggttttctgcaacaagcccggataaaaaggaataataaggccggtgtggtggctcacgcctgacgtcaggagtttga

SEQ ID NO: 18433 - DNA, 526 bp, Homo sapiens
tccaatgagatagatactttctcacccctagtcaggaagctagggattatagatattagggaggcaaatttttcactttgagacactacaacattggtggtggcttatgtgacttcagttagaagctcctgattgggatgttgtcaggagcacgcacaaggctgttggggttggaagagtagattcctggaatgaaatttcctagtaatttcctttctttatttagtcaacaccaaggagtagtctgcttctcccctttctgttgctaccacttctctctaatcaaactgtttcttttctggacttattgcaaaaaagaacattgtctttccttcagcctttttcttactctcctcatttctaaaggaaatgcctgctcagcccatctttctgttttgaaggtttttatagaagattaaaatttcccccactctgttctttgtagtgaaaagagcaacttctgagattttatttttctccttctccttcccagtgttgctgctactcttaatatgtaggtcatatt

SEQ ID NO: 18434 - DNA, 559 bp, Homo sapiens
acaactactgtattatttcataaatatatttggttcatggttgtttatatattcaaaacaattatttgactgtggtacttgcaaattcatagaactcttttgcacctatctacattaataccagatactaaaagttaacttaagaaaataaagaatcctaatcaacatttatctattattaaatttggatttgaagaacttgcgcagtctgtcttctaagtccaattgtaaactccctaaccaaagctttactgttgttacaagacaactggagttagtcatttgtcttccctggtagcattttgaacaataaattgaaaagcctgaaaccaagatacatcaggtatctgaacaaagaagcaagattgatacttttctttccatgctgttgcaaaaacctcactatctaaactcttgactgtctattccacagaccatctcacttctttatcagttccaataaaatatgcattcataaacgctgccctatagcttggtcatatcattatccataaaagttcacccactgaaaatacccctagccttctatactcagtgc

SEQ ID NO: 18435 - DNA, 523 bp, Homo sapiens
accctactacttgagaaattagctgctcaatattgacatggacactgagaagaaaaatacattttggcataaaattaggaagaataaaattttattaaaatataccatttacaataacaaaaagagagttaactgctcggatcccattgaagttcatgaagttgatatactgtagcaatcaaaattctcaagattaatatttcatgacagaatacctggatttagggccaggcgaggtggctcacgcctgtaatcccagcactttgggaagccaaggccggccaatcacctaaggttaggagtttgagaccagcctggccaacatatagtagtaaaaccctgtctctactgaaaaatgcaaatattagctgggtgtggtagcgcacgcctgtagtcccagctacttgggaagctgaggcaggagaatcactcgaacccaggaggtggaggttgcagtgagccgagatcatgccactgcatccagcctgggcaacacggcaagactccatctctcaaaaaaaaa

SEQ ID NO: 18436 - DNA, 492 bp, Homo sapiens
agaagcatccatttaaacaattataaatttatgaaaattaaaaagcagagtaagaacaggtagatataaaaaacaattaagaatcttagaaaataaaagtacagtcaactgaactagaaaaactcaatggatgagttcaaatctatacgtgacatattaaaaatgaacagtaaatttgaagataatggcaaggagctgttatcttactttacctaagaggaagcatgggagagaagagtctgttctctaaaattaaggttcggttgaaaggcctgtaagatagattggccagctccaatatatatctaatatcaatttctgaaaagaatggaaaaaaaattatgaagatacaatatttggagagatcttccagaattagagaaaaagtccttagatagaaagcatgagcaggagaaagataaatccacatctagatacattatgatggaacagaaaaacatcagaataaagcaaaactcttaaaggaacaac

SEQ ID NO: 18437 - DNA, 516 bp, Homo sapiens
gagagccgaggaaaactgagcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctg

SEQ ID NO: 18438 - DNA, 284 bp, Homo sapiens
aaaaagcagtcaggtgcaggtttcctatttccttaataagaaagtaagcaattctcttgcaggaggtacagctgggcactggaatgcctggtctcatgatagcattggtttggtcagaacccagtgcaataagcttgtcaagccatgggaatcagtgagaattctaagccccaaacagaaacaaatgaactgggtttttacaggcagtgccttcatctataactgcactcagagttctttggactcatatttttaagtcaaagagaatgcatgcttggagcacg

SEQ ID NO: 18439 - DNA, 501 bp, Homo sapiens
agccgggtgtggcagcgtgcacctatagtcccagctacttgggaggctgaggcaggagaatcacttgaacctgggaggcagaggctgcagtgagccaagatcacactactgcactccagcctgggcaacatagcgagactctgtctcaaaaaaataaagtgccagtgaagaacaaagggccaaggaaccaaaggggagcaggtaccctgggcagacaagttggctggtgagaaggtcagtaaggctacagcactatgggaggtagtaccaggactttcttgcatggcaaaaggggtctctcagaagcctggtgccaatgtaacgaaagcctgggggagccagggagacaaaagtggaggctgggacaggcatggtggctcacacctgtaatcccagcactttgggaggcagaggtgggcagatcacttgaggccaggagttcaagaccggcctggccaacatggtgaagccctgtctctagcaaaaacacaaaaattagct

SEQ ID NO: 18440 - DNA, 554 bp, Homo sapiens
taatttaaaaagttttctataattataggctacatgctttcttaggtgaattctatcaaacatttaagaaagtacagagaatcctcaacttacagtggtttgacttgtgctcttctgacttgataatggtgctttcatctgtgtacattaatgatgagcatcaatatgaccagtttttcactatcagtatagttttcaataaatttcatgagatactgaatattttaaaatgggccttgtggtagatgattttgcccaattgtaggataacgtaagtgttctgagcaagtttaaggtaggtgaggctaagtcatgatattcagtaggttaaatatattaaatgcgttttagacttacaatattttcaatttaggatgagttcattaagacataagacaattgtaagttgaggagtatctataatatcaatcttgaacggactctttttaagaaatagaatttaagggccgggcacagtggctcacacatgtaatcccagcactttgggaggccaagatgggcagatcacctggggtcaggagtttgggaccaac

SEQ ID NO: 18441 - DNA, 405 bp, Homo sapiens
ctatccacattttacagaatggatgtcatttctgagtaaaaacttaagtctttaaattatttagaaacatttttatctacatacatatacacaagttataagttccaaatctaccaaataaccaagaaaatatcctggagtttatcagttgtaaatgataaactctcaagagttgaaatgccagctatcctatagatgagtaagtagagacataaatcaaaacctgaatttcagctttttgggaaagaagtactttttgggaaagagggacccagaccaagcgtagcaacttggagttggagaggagtaggcatggaaatcaatatttatttaattcctactatgttccaggtagtgtgctaagacctttgtctctgttatctcatttgattctcataaccactt

SEQ ID NO: 18442 - DNA, 531 bp, Homo sapiens
ctccaggaaactctgaacggccttgacacaggtaggagtcatttgatgacagccacttttcacccccacaaaagaccactttgcctgagagttcagaactaggaaggagtctcaagcctgtgaggtgagatggatgctaaaatcttctccctagaagatgcctcagaatttttgtttctttttattggttctatacttttcatttcacctggagctgtgccctcctggagcatctcaacagttacataagccactccacttgatctctgctggacaattacttttaaaatctcacatgtaaatagggcttgcagtattttatgtagaatataaataataaatatttctgtggcttctgtggaagctaaaaatcatgatgtagtgtttgaatatgacttttctttgtattcatcccaagggccgaattctttttattgttatcagtatttacatcttaagctggcctctttctcagcaaggcttacatttatttaggctgcatctattttcccttatgctgtcatttcccaa

SEQ ID NO: 18443 - DNA, 528 bp, Homo sapiens
aaggccggcgccaggtgaggctaattctagggccagtggtgctcacacgggcctgggtttaacctggtgaatccccacacctataaacacctgaatccattcctggtgggcttggacacagcacggacttgcgacctccccaagctgacataaatgcacttctcctggactgcccgggccccaaatctgacctagccttgggggtgccaaccaggactcctggaccaccatctactccatgacttgaccagagcccccgtcggtttatacccatgcaatgtacagaatttttggcttggatcgtgcccaagcaacagaaagctgcagggggctttcaggaagggagttgggtaaagaatcaagcacttgctggcataaacggacagagtccttgctctggagaatgaggcatcagaacatctcacagaggcctaagaacagcattccgactcattccttccccgtgagaagaactaagttatgcaaatcaatgcacccatcaatcgagcatctcaagatctcaataaa

SEQ ID NO: 18444 - DNA, 479 bp, Homo sapiens
ttcttcctgtcttacaatgcatttgaaataaagtgatgtcagattgagagtaaaggcccgaaataagaaaaagtaataggcacaattagcttgctttacctttattgataactaagatttagaactgctttgctgtatactcactgctggctacatgtctgtcactttaatttgcactggactacaaaaacatccacaaatatataatatatacctacaaattatatggtatctatatcacatgtatgacccatgaaagacagatgcatattctatgagagactaaatcattcttcataattggtagcttggcattcatttcttgagaatatcagagctgcttaaacatgaatcacatgtgacatcatgcgcacctctcacctcaccttctagataccacacaccgcccattttcctctaggctttattatagactacctgcaaccagaaaagagctttatagagcatctcatcttact

SEQ ID NO: 18445 - DNA, 498 bp, Homo sapiens
caagacactcactccagcatcctttgataaataaattatccattgttccctacaataattatcacagagctcatagtgcacaataccatgtgcagaaggatacttcgttaagtgttactgactgctgcttagttttgagtgcttcaaagtgaacatgataataaacaaaccttgaagtgattatttaaaaatcttcttagtcggatgttagaagttaagtttcttgggatggatctagataactgaattaaactgaatatgcagtgctactatggtgcctactacatagtaattacctagcaaatgttttttgggtgaatatcacatagaagctcctatccttgcagctggtaaagggttgttaaggtgactgaaagatctcaacaaaagaaagaggctaaatgatcaacaaatatttattgtatattcactatttaaaaggcattgtgctggatttctgcttccagccatgatggcataacaaggactgattttaat

SEQ ID NO: 18446 - DNA, 555 bp, Homo sapiens
gaccatgagttcaagtccagcctgggcatcatattgatgtctcttctaaaagcactactaatgcaataaaatgtattctcattgaaaattacatctgcagacaataaaacaggaaaaaactgctgtcttttcacactcaattgtttatcttctgatctgattcatcttgccattgtgtgttgcataaaagttgtaataaactaaaatttaacatattgtggtacaaacacaccgtggaatagtggaatactatgcaaccataaaaaagaatgagatcatgtccttctcaagaacatgatgaagctgaggccattatccttagcaaactaacacaggaactgaaaacaaaataccgcatcttctcacctacaagtgggagttaaacgatgagaacgcatggatacatagagggcaacgacacacactggggcctacctgagagtggagggtgggaggagggaaaggggtacaaaaaataactattggttactaggcttaatacctgagagatgacataatctgtacaacaaacccctatgacacgcgtttacctat

SEQ ID NO: 18447 - DNA, 524 bp, Homo sapiens
ctactttaataaacaaagaattaaactgtttaggccttaaaagagagagatcaatttataattatgggatgagtaagttctttctaaaatataacatgaaattcagaaaataaaaataaattgataaaattgaccacattactcttgtatggcaaaaatactgtaaaatagtcaaaatataacagatactttctttagtatgtaaagggattaaacaaggtaataagaaaaaatgaaaattacaaatagcaggcagctcaagaagaaaaggtagggctgagcacagtggctcatgcctgtaatcccagcactttgggaggctgaggtgggtggatcacctgaggtcaggagttcaagaccagcctggccaacatggtgaaaccccgtctctactaaaaatacaaaaaattagctggatgtggtggcagacgcctgtaatcccagctacttgggaggctgaggcaggagaatcgcctgaacccgggaggcagaggttacagtgagccgaggttgagccactgcac

SEQ ID NO: 18448 - DNA, 555 bp, Homo sapiens
tagtttgtcattgtgataatagctgaaaacatagcaaatgctaccagagttaagtttatcttccaagatatgagtagattatgaataatattagaaaaagaaaataagcatattttgatagtactaaaacagatttacaaataaaatttactcaaaattcaaaagcgtcattcctacattgtttcattcctccaagggccagtgaaatatgattggcaatgtttttctttgacagactaatattaggatcattaaagataaagaaaaattttaaatgattgtctagtggttatcaacgaactgattctaaactttatgtagaaatgcaaaagacccagaatagctaacacaatactgaagaacaaagctggaggactgatactacctgactccaaggcttcctataaagccacagtaatcaagacagtgtggtattggctaaagaatagacaaaccaatcaatgcaacagaacagagagcccagaaggagacccacataaatatactcaactcgcttttgacagaagagcaaagggaatacaatggagcaaagag

SEQ ID NO: 18449 - DNA, 515 bp, Homo sapiens
cagaagggtgaatcagaccttttgctgcatcctcattgtacctgtgtgcacagaccacaactgcaccacctatatactacatacttgaggcatacatttatcatcactcctctgggtttcttccttatgagactgtaataatgtaggggaaaggcagacctggcccctgtctttatacccccagaacctagcacagaggctggtatgagtaaatgataagaaaattatactcaaggacgggtgcggtggctcatgcctataaacctaggactttgggaggccgaggtgggcagatcacctgaggtcgggagttccagaccagactgaccaacatggagaaagcccatctctactaaaaatacaaaattagccaggcatggtggtgcacgcctgtaatcccagctactcgggaggctgaggcaggagaatcgcttgaacctgggaggtggaggttgcggtgagctgagatcatgccatcgcactccagtctgagcaacaagagcgaaattcggtct

SEQ ID NO: 18450 - DNA, 519 bp, Homo sapiens
tagttaagagtttatgtgccatggtaatggcagagaaagctgaaaaaacagaagactggccataaatgaatacccaaaagatcccagaattgaagccttcatctccattaggaatagagctttttaataagaggactgtaagtttaagaaatgtgaaggactaccttccctttactgtggtatttttatagtacattatccagctcttggttcactctacaagtgaaagagaaatcagatgataattacaaagaattaggattatgcgtccagagttctaaacacaagggtgaattgaatggtgtatataaaaaatgtttttattaatatggtgaatgaggccaaatgcggtggctcacatctgtaatctcagcactttgggaggccgaggcaggtggatcacctgaggtcgggagtacgagaccagcctgaccaacatggagaaaccctgactctactaaaaatacaaaattagctgggcatggtggcgcatgcctgtagtcccagctccagctactc

SEQ ID NO: 18451 - DNA, 492 bp, Homo sapiens
attttcctggattctcagcaatgttagaacacatggagacatcaggaagctcagagtgttaggaaaccaagaaaattaagaactttaaagtactgcaagttgaagtacaaggggtcagagtatggaagaagtattcagatccacatcaaggcaaaaatgaaaatttctgtgatattttccacccaagtgaaaagaaactgctggagtatagataacatgtatttttttatttgttctgttgttcttcaattgactgtaggaattaagagttctgccttttagaataccctgggcatctctttaaaaactggacactaaagggcgagacttttttaaaaaaatgcgtctagttgtcccatggccctgcagttcccatgaaaatgccttttttagctgagctggtggaaacctttcattccctgtggtctgtctctgaacggaagagggaaactgatgcattaaaccatgggttgatgacacatggatttgact

SEQ ID NO: 18452 - DNA, 156 bp, Homo sapiens
aaccttctatccctcatgttagacacaaggaaaccagggccaaggaagacatagttatcactcagctccttatgacttctgacttgatgccctctgtagaatatttcaccctgctatagagacttttcttaaaaaaaaaaaaaaaaaaaaaaaaaa

SEQ ID NO: 18453 - DNA, 265 bp, Homo sapiens
ctttgtcaacagggagctcaggagtattaattataggaaaccgtatgacataaactgcagggcagtaaggttctattcaatcagaagtcaaatcattctctatgtataaatacacaaagaatcctgcccttgatgtgggaagtggcaaagcccttttacctatattaccaccataactgagtctgatcctattcctaaacatatacacatatcacatgtatctacatttcatccaaacaagattcaagacttaccttcttctgac

SEQ ID NO: 18454 - DNA, 321 bp, Homo sapiens
gtgtaactctctagatgggactgggttcataagacttcagttccattggtgatgtacaggctgcaaagcacagcacagcgtaggaagggcactacatccatcggatggccattcagctcttcttcccctgctcttccagctcagcccacttgcacctattgatacattttatctattgtcttttaaaaagtgtattgaggtaaaattgttgtacaataaactgcatccatttagagtacacagtttaatgatgcatttcctgacaaatatatatatccatgaaaccaccaagataatcaatatatagaacatttacatcat

SEQ ID NO: 18455 - DNA, 385 bp, Homo sapiens
  misc_feature 252: n = A,T,C or G
agatggggtttcgccatatcacccaggctggtctcaaactcctgagctcaagttacccacccacctctgcctcccaaagtgctgggattacaggtgttagccaccatacctgtcctacttctaactgatatacatgcatctggggacctctgagaaactctgaacagcaaacaattgaaaaaagaaatttctaaaaaagaataatttttcagcacctaaacttctgtatgtgaaactataacaacaacctanaatgcttctaatacggtaatggccctatttctctgcaaataaggattgctcatgattcttacactgcctttcaattaggattatacagctccattcctcattcaagcttccaatacgtgcacctaagtatcat

SEQ ID NO: 18456 - DNA, 495 bp, Homo sapiens
tatgtatttcccacaacacctggacctcagagccgttgaatatgtatttgttatatttacttgaaaagtccaaaaacaatttgctcattaaatttgtagaagacttggaggggctaggaggagtggtccctaattattagttgtagtagctagtaagttgaatgtcatagtcagaattataaaagttgtcaaaagatgaaaaccttataaaaatcaaaaataccaacacctgaattcaaaaatacagaaatcaaaattaaggagagaatagatgtgtttaatagcatattacacatagctgaagagagagctagtgaattggaagagagctcaaaagaaagcatcaaaaatgaagcacagaaaacaacaaacagaaaatgcagatgaggctcagaaacagagacaggttgagaaatacaaatattactgtgttatagttgcctacagtattcagtacagaaacatgctgcacgggttttcagcctaggagcaaca

SEQ ID NO: 18457 - DNA, 389 bp, Homo sapiens
ctctcagattaacccagacaaagcaaggcttactgcagtgaatcagacacctcaggcacaggtcagaacacatcacgtggccgggactccctgggactggcaccatcacctgaagtccgccctttagaagaccagcggatgctctgtccatctctcaagagccacatgtctctctcacagggtttccactgctccattctctcatccagctttctcatcttgcatgtgattcagccagctcccagctcagctccacattttaacaaccagcaccggcccggcacggcggcttacacctgtaatcccagcactatgggaggccgaggcaggcagattacttgagcccaggagcttgagaccagcctgggaaacatgatgaaaccccatat

SEQ ID NO: 18458 - DNA, 435 bp, Homo sapiens
gtgggagactttcttgtggatcggggtgacctttacattcattagatgccagtaaccacccctcctgccacacctccagttatgacaacccgaaatgtctccagaatgactccaagggacaaaaatcacagccccttgagaacccctgttctagacagatattggcccacccacctatggcacgctgcagctgtgaggcagatccagcaccgttgggcaggtctccactggctctgcagactcttgagtgtttcacctgaaaaaaacaaactggataggtcacgggtggatcgcctgagtccaggagttcaagatcagcctggggaacatggtggaacccctctctaccaaaaatacattacctaactggacatggtagcacttgcctgtagtcccacctacttgggaggctgagttgggaggatggcttgagcc

SEQ ID NO: 18459 - DNA, 473 bp, Homo sapiens
  misc_feature 234: n = A,T,C or G
gcctcccgagtagctgggattacaggtacctgccaccacactcggttaattttttgtatttttagtagagatggggtttcatacattggccaggcttggtcttgaactcctgacctcatgtgatctgcctgtctcagcctcccaaagtgctgggattacaggcgtgagccactgcgcctggcccaattcataacatttaggtatgggatggagtgtgatatgggtgtaatgtangcatgggggatggggagggaatgagaataacattaagagttttccatatttataacagatcctaaaaattaaaatgcaaagcaatttagaatacattgataagtaaaaagaagaaaataaaattacctaataatgactgagaacaattttatgtctaaccgacaaattcatttccacacacatatatatacatttagattattttatacacacacacacacgcacacacacaaaaaata

SEQ ID NO: 18460 - DNA, 458 bp, Homo sapiens
gatatgttcctaaacttttgaggcgacatcaaaaagcttagttgcaatttgttgcttaattgcaattttgtttcttgttcctgttgtcaagaatagaatgttggtctgaagacatcaaggagggactggactactcaagacagttgtgggatgtataaatatatcaccatgtgtcataggaacttaactaatttactttttctttttttttttccccttgcaaaatggccaaagttttctggtcttggatgagcaacgatttgcaaaagaaattcttcccaaatatttcaagcacaataatatggcaagctttgtgaggcaactgaatatgtgtgagtatggacagcagtttattggagtaccattatcagctactgatgaagccattttttttcccattagggtggtaaaggaaaattattccatacaagcaccaccaaattttgacttgtttattt

SEQ ID NO: 18461 - DNA, 509 bp, Homo sapiens
gtaattgaaacatacggtacctattaggacctatctgcacatatgtaactgctcatttcatctgtacaaatgactgcttacttaagcaaatggcaggtctgagtgctcatgttgggaaattttgctaggaagtcatttccttaggaaaggctatattcacatcctcaaagtgctgaaaagtctaggaaacacgatgccatggatgcataaaaagagggctggccaggatcggtagctcacacctgtaatcctagcactttgggaggccaaggcaggtggataacttgaggccaggagttcgagactagcctggccaacatggtgaaaccctatctctactaaaaatacaaaaattagctgggcatggtggtgcccacctataatcccagctacttgggaagttgaggcacgagaattgtttgaacctgggaggcgggaggcagaggttgcagtgagctgagattgcaccactgcactccagcctgggtgatagaggaagactctgtccc

SEQ ID NO: 18462 - DNA, 520 bp, Homo sapiens
agcccctttctagagggagctgatttcagtggtgggagattatttgatgtctcttcttgtttggtctctagtgattccattgaacctgcatctgagactgtgggtcttgaaataaaaatcctgtttatggagaaatgttcaagatggttatttcatcacctataaactattaggagtttatgagaacctacatttagcacaacctaaaactgaagttatctctttaagtttctcacgttattttgtatattaagattcaaaaccaaaatatcattggtctaaacattgttagaatagaaccagactatgccaatatcactaatatagaaccatttaaaagaagccaggcgtggtggtccatgcctgtaatcccagcactttgggaggctgaggcaggtggatcacctgatgtcaggagttggtgatcagcctggccgacatggcaaaacccccatctctactaaaaatacaaaaattagccaggcgtagtggcaggtgcctgtaatcccagctacttggg

SEQ ID NO: 18463 - DNA, 484 bp, Homo sapiens
ggcccaccaggcagcgctggaagggactttccaccacaaaccgttcccacccccaggggtgccagcaaggatgaatagggcccatcaacaccaggtgacctggataaatgttctccccctcacaagcccagggtctccctcctccccctacacacaccgtgaggcctggggaagcactgtccaccctgcaactcagggttgctcacccacctcccaaaaactaagaagcaccaggagacttgaggaaatgcactccacccttctgagtggcactagcaaacagtgagcattctgccaacaccaagtggcctgagaggtgccctcctgcaggaccagaatcaccccccactcaaagacaataacaattacaaatactcttgaacaaagtgaaaaaggagaaagacttagcaaataaatagaagatacaaaaagaatcaaacagaaattgtggaaccccaaaaaaaaaaaaaaaaaaaaaaaaggg

SEQ ID NO: 18464 - DNA, 643 bp, Homo sapiens
aacagctttccctaaatttcttcaccagttcgcacaattgcataaggagtaatctccacaataaatctcttatttcatattgatgataatagttctgattatttgaatgaatcctaaccattacatcccacatcagaccttatgtaggtcttacatatgaccttggcagcacgggtagattaccactgctgtgatgtgattacactgattcaaagatgctataatattttatattctgtagtgctgaaattgagaattaccaaatctagcatgagcagtgaaattagaggcattttattactgcaatatttatttatagctacctatttatatggtagctaaaagaactcctagaaaaaaatagactctacaattatttctgagaattttaatacttattaattggtagaacaaatagaaaatcagtaaagttatagaaaacgtgagtaacaatattaaccaaattattttaccaacctaaaagacaattatggaacagtccatccaacagtaaaatacacattctttttaaggccacacaaaacattcacaaagatagactggatttgaagctataaaacgagtctcaaacatttataaatagttgtaataattgtagcagtggtggatttacacaagtaat

SEQ ID NO: 18465 - DNA, 555 bp, Homo sapiens
caccacgcttcctgtacagtctatggaactgtgaacaaattcaatctcttttctttataaattacccagcctcaggcatttctttatagcaatgtgagaatgaaccaatacagataccagcaccaaagtgcctaccgtgaactttttcctacccaggaaaaaggaattctttattatcatcagcctctaaaacagggctttctgttacttgcctctgtatgaactccaaactgacacgctatctaatttatgctgagagcacagctagggaacatgcccaggcatgcggcttttacctactgagctggacaagattgtggaagtgaaagtaaaatttgaagattggatgaaagatgttaaaatcatgggaaggctgactaatttgagaatactcagacatctcataggtgaggaaaatgacagtattaacattaatacaaagaaggtgatcagtcaaaacattcctcacgagaaaaggtcctttggcaaatactttcctttaaagtaaatgaatataacaggccaggcacagggctcacgcctgtaatcccagca

SEQ ID NO: 18466 - DNA, 614 bp, Homo sapiens
gtaagaacaggtaggatgattccactttgaggaaaggtactttgttactaacgttggtaagacagcttctgctataaatgctcttcacaatccacatgtagagaattctggacaacagtatcagtccagatgccagaaaatgcacagtgagcatgacatgctcatcggctgaggtattctgacttcagctaaggacgcaatgatattttacttgagattcaggaatgcagaggatagattctgtgggagaaagaaaagctttgtttaagtaactgatctaaagacattacaatgttagctgctttcactccttcaaatcccaaatattgcctaatatttgatttgctttgcattgagaatttggaagtaaataagatatagtctctggcatccagagggtcacagtcaaataggaaaggtatggatggatattacccaaaaatatgagagattctttaagtttggaaaacttaaaggaaaaggcagattgattctctagtgctggctgcaatgggcgattcctcagagaaggcaggagaatgattgtcacctgagctaatccttgaacacatagaaattctctggacaagatgcaaaagtattagaaacagaga

SEQ ID NO: 18467 - DNA, 434 bp, Homo sapiens
tttcactaccaaaatatatgaaagaactctaattaatcggctttaagaaaaagtgcttgaatcaagtattttatcagaaaaataggaactgattcaaatgtcttttagttcacatgactggtaagtatttggtaaataaaactagtttgttggtttaaggaaagcagccatctcttctaccagcaaaaatacccatgtattttaacttgagggttttacaggctgtagaaacgatgaacaaataaataacttgagttgatagctagctttttaaaataagctactcaagcataattattaagaatgaataaattggctaggcatggtagctcatgcctgtaatcccagcactttgggaggctgaggtgggcagatcacctgaggtcaggagttcgagaccagcctggccaacatggcaaaaccccgtctctact

SEQ ID NO: 18468 - DNA, 627 bp, Homo sapiens
tgcgcctgtagtcccagctacttgggagactgaggtgggaggatcccatgaactcaggaggtcaaagctgcagtgagctatgattaaaacctgagctccagtctgggtgacagagcgagacctgtctggaaaaaaacaaaacaaaacagaaaagaaagtgttgagtgaaaacgtcttcaggtgcctttcaccttgagagagggcacgaggctgagggcgccttcccgtcctccgaagcctccatccctcccctggcattttgcctttcacactgtaatttctttcttgagaatcagccgaccgaaattaagtctcccaaattcctgagtaagccgaaaagctatttttcttgcaaatcttagatgaacataatttaatataaggcataaactaatgcaataaagaccatatattacagcagtggcacaattaaaaagcaaaagccgacggaagagactgacagacagcgtgttaaccacagggaaaataaaatagaaataagaggtaggttatattctgtgcataaataactttaaagaggaacaataaatgacttctataacttttaatatatgtgttggagattatttaattgcagtgaagtaagaagtgataaattgagctgaa

SEQ ID NO: 18469 - DNA, 455 bp, Homo sapiens
tttctctcctccaatccgttctatacactgtttctagttaaaatccatacaaccccccgcccccacccaaagaaattcccagcttgacatttgtgataatttcacatatattttaaaatttagacttgtcttaccctgagggtgtttggttctcacaatccaaatccattttccaaaaacatttattacatttttatccctgctctagcaaattaccatggatttagtaacttaaaactatacaaattgtgggctggacgcagtggctcaggcctgtaatcccagctctttgggaggctgaggcgggtggatcacctgaggtcagaagttcaagaccagcctggccaacatggtgaaaccccatctctactaaaaatacaaaaaattaaccaggcgtggtggcacatgcttatagtcccagctactcgggaggctgaggcatgagaatcgcttga

SEQ ID NO: 18470 - DNA, 655 bp, Homo sapiens
gagctcccatagcaatgtcatacagtcacagtgatttgagtaaggtgactttgcttatgggaaataaactgtattttatcaggcttatttgaatgacattttgataacctctgtgttatgatactagaatcattaagacaatacaataacctacaaatatctcatctgtatgagcttgctcaatgggttttgactgagtactttcactgagactgttcactgaatcagtgttattcttgaaaggacatagatctattatcatatcttgtaaaaggttcttttttccctctttctcagcctgctaaagaggttaggatttagtttcaggacagatggggcatatgatactaggggtaggtagaagtactcagtctgacaagattaaaggctattgaacttagtttctctcttcttcctcttctaaattttgaattgctttatcctttacttttccatttgaaactcattgtgggtagtgcagtaaaagcagtggccctggtgctcacacatgtaatcccagcactttgggaggctgaggcaggaggattgcttgaatccatgagtttgagaccagcctggacaacatagtgagacctcatctcctaaaaatgtattagctggacatggtggcatgcacctgtagtctcagctactt

SEQ ID NO: 18471 - DNA, 631 bp, Homo sapiens
  misc_feature 504: n = A,T,C or G
gacagaaggggtcacaaggtcttctcacccttgccaattatagaaagccattaatttgaaacccattaaaagccaccttatgatcaagaaaggatcaagctgaattaaattttccagcccaggaatattgatataactgaaacacaagatggaaaatctggacttgaagatcccaactagcctgcgtgttctcaaagccatgtgctgagaaaagaccccaccctgttcattttaagccttgtacttgtactttcctttgaaaacattgaactttagatttatttgactgaaaaacagatcttaaattttcccctcaaagatttttaattaggatatttccaactaattccttttattttaggaatggaagtaaaagcaaatgtatactaattctgtcattgcttgtttagaagagaatgagtagatgcttatctacatcaatagaaaattaagtaacgatataaaattataaacacagctactagaaaaacacaaacgtcccanataatcagaaagaaacacacatacgacaaagaagaccacttattgaaagataaaacaatgaaatacatactaaaagcaaaaaaaaatgaaataaggcatgtgtgaaaataagactgaatcacacagc

SEQ ID NO: 18472 - DNA, 478 bp, Homo sapiens
tatttttcagatatggaaatagtaattaaaatctctaattgtcctaaatttacataattatggattaatgcactcaaaatttgaaatcaagtcttcaatactatttatctttctttccaattagtaagtgaaggacttatataaaataagttgatgtttaaaaaatttaaatttggaataaagagaatgtaaatttgggataaagagaagataggaggatgtaactacatgggaaagcaaaggtgatatgaaagagaagataatggcacagaatggaaagtaatggcaagaaaagtgaaattctgacggacagaacttttaacttttctacacttttgcctaaggaaaatattaaatggagttgccttccatttgcccaggcccctttatatagcactcatattgagattgaaattagaaatatagaagtaaattacaaggaaataacttctcagcattgactaaaagagactcaact

SEQ ID NO: 18473 - DNA, 447 bp, Homo sapiens
tacaaaaaaaaaggaaatggaaatattaaaaaccaaaccaagacttcaatgtgaagtcttcagttactcaccaattgctaatgcaattgtgtctagttttgagattagggatcagactgtgcctgtgtccatcctacagaaaaatcatctatttttttccacactgaaatttaagagaacttactgaagttaacatattccattctgggaagtgaattataatgtgtaattattacaattaccacaactggaatgtaacagggttatttttcagagaacagaatttgtcagaaggagaaggaagaaaaagagattatgaatgattaaataaatttctattggatatacaaaaagtcaaaacttttcaatacatacagcttagcttctagaataactatttactgttgagactctctttccaaagttatttgtgctactccttcttct

SEQ ID NO: 18474 - DNA, 480 bp, Homo sapiens
actgcttgagcccaggaggtcaaggctgcagtaagccttattcaagccactgcactccagcctgagtgacagagtgagaccctgtctcaagtaataataataatttatcctcaaagaccctacagtctagcaagggagagaagactattcacaaatattccttttgcaagtttaaaagtgctcaaaatcacaaggaagacataactaaaatgctatgatggctcaggaaaggaagaacttgcctctataagaatatgtaatcatactaattatgttttcataaatttagtgaggcatcatagcatagttataagaaggttaggcatggtggctcgtgcctgtaatcccagcactttgggaggctgagatgggaggatcacttgagcccaggagttggagacaagctggggcaacatagtgagattcccatctctacaaaaaacaaacaaaaaaagtagctaggtgtggtggcatgcacct

SEQ ID NO: 18475 - DNA, 574 bp, Homo sapiens
ggacgccgaggtgggttccgggagacccgcgggtctggctgcgagagattgggtaactcaaggcgtccctggagtacactgaggataagtgtttgagaaatgctgtctgaaggaatgaagtcagtctatgacaacgtctctctgccgtgaatcattcctgcagatgaaaaagtgtgacttggcagctgatggagtctcgctctgtcacccaggctggagtgcagtggcgcaatctcggctcactgcaagctccgcctcccaggttcatgctattctcctgcctcagcctcctgagtagctgggactacaggcgcccgccaccacacccggctaatttttgtatttttagtagagatggggtttcaccatgttagccaggatggtcttgatctcctgaccttatgatccgccctccttggcctcccaaagtgttgggattgcaaggcgtgagccactgcgcccagcctccaggcctcagttttcttatgtgtaaatggggatgataaaacccggacctgcctatgaacggttcagttggatcaaagtagaatgagtgcagaagaagaagcatgat

SEQ ID NO: 18476 - DNA, 571 bp, Homo sapiens
gcgtgcctgtaatcccagctactcaggaggctgagacaggagaatcacttgaacccgggagggggaggttgcagcgagccgagattgtgccactgcactccagcctgggtgacacagtgagactccctccgggcatctgctggtttgaagaataatttatgggctgggtgcaatggctcacacctgtaatcttgacaccttgggaagccaaggcagacagatcacttgaagtcaggagtttgagatcagcctggccaacatggcaaaaccctgactctcctaaaaatataaacattagccaggtgtggttgtgcatgcctgtaatcccagctactcgggagactgaggcatgagaatcacttgaacctgggatgtggaagttgcagtgagccgagttcacgccattgcactccagcctgggtaacagagtgagaccctgactcaataaataaatacataaataaatagaataatttgtggtcctggtagccaggatagctgagcactgcctctggccctctaagaatgattttttatactttactgtctgggtcagagtcagcttggactc

SEQ ID NO: 18477 - DNA, 594 bp, Homo sapiens
tttatactgcccattgtgatagataggtctctttaccactagatggcctgatcatctcaaaaaatgaaggaaagcaattggtgactctggcattaattgccctagaagtgaagagaactatttcaagtaagcgtatggaactgaaatattttaatcataacaaataagctttaattggctttccctgatttctttagaaaggattattctcacttctgctaatgtatcttagttaatatctctccattttatgtttttcccacatggtatatgctatttattactattgccttttaaatttttcagactatcttgctatggtagtgattaggaataagctgtctaattcccattaccacacatctttttaaaccgtatacttgtagcttcatcattagaaagacattcattgtctttcaaaagtttcattatggctgggtgtggtggcttacgcctgtagtcccagcactttgggaggccaaagcaggtggatcacctgaggtcaggagttcaagaccagcctggccaacatggtgaaacccagtctctactaaaaatacaaaaagtagctgggggtgggggcatgcgcctgta

SEQ ID NO: 18478 - DNA, 541 bp, Homo sapiens
gcacctgtaatcctagctactcaggaggttggggcaggagaactgcttgaacccaggaggcagaggctgcggtgagcagagatcgtgccactgcactctagcctgggcgacagagcaagactccacctcaaaaatatatatgtaataataacaataaattaaataaataaattccaattcttggccaggcacagtgactcacacttgtaatcccagcactttgggaggctgaggcgggaggatcgcttgagcccaggagttcgaggctgtggtgagctatgatttcgccactgtactccaggctgggtgacagagccagactctgcctctacaacaaacaaacaaacaaaaatttgattcctgtatatggcactttctatgtagctgtgtagctggtggaggagaattcctggaattcctaataactccactgaagatggtctggagtcttccctcagagctcagcgcagagaaggtttgctcagcagagcaggtatgcaaggcagaaggcctggctttgcaggccgaccaattcgcttct

SEQ ID NO: 18479 - DNA, 532 bp, Homo sapiens
ctctaggtcaagatttatcttctctaaggtaaaactcacaagggactgtcacattgttgggtgtgtataaatgaattttaaaaatcgtaataggccaggagatggcaccttttcctttaacataagctaaaaggatattttgtgagaactggaaattaaattagggccagccatggtaatgagctgtcaataagccagtcaactataacagagttaaataatatagtatttaagaactggagctggagtcttcattttctctatctttgcacctttacctaaacaaatacatacaccagtaatcttaataatcactttcagggaactgatgatttaaagttattgaatcaaggccaggcgcggtggctcacgcctgtaatcccagcactttgggaggtcgaggcaggtggatcggatcacctgaggtcaggagtttgagaccagccaggccaatgtgatgaaaccttgtctctactaaaaatacaaaaattagccaggcattggtggtgcacacctgaagtcccagctactc

SEQ ID NO: 18480 - DNA, 89 bp, Homo sapiens
ggctgagaaagaggaccgtctgtaagctttcagaagaagaaggatcaacagttggaacgacttcagacttcttgggagcaacgctggga

SEQ ID NO: 18481 - DNA, 608 bp, Homo sapiens
ctgggtgcagtggcaggcgcctgtagttccagctactccggaggctgaggcaggagaatgatgtgaacccggagggcagagcttgcagtgagccgagatcatgccactgcactccagcctgggcgacagagcaagactccatctcaaaacaaaaaacaaaacaaaacaaaaaacaaaaacaaacaaacaaaaaacaacaaacaaaaaacccttctatacatgccattatttacattggtgcatactttttcccaaaaacaaaatccttacagtagaattttgggtcaaatatgtgaaagtaatttagagctttgctatacctttcaaactgaactgacttatactcctacttgtgcactaatgcttttgtaacactatgcttttataaaaagtaataggagggccaggcatggtggctcacacctgtaatcccagcactttgggaggccaaggtgggcagatcatttgaggccaggagttcaaaactaacctagtcaacatgatgataccccgtctctacaaaaatacaaaaatcagccaggcatgggtggtgcacacctgtaatcccagtcactagggaggctgaggtgggagaatctcttgaaccc

SEQ ID NO: 18482 - DNA, 516 bp, Homo sapiens
aacccagcatttgggcatctagaagccttcccaagggctaaggagacacctgaaaaatgagaaagagttacagagccaggcccttaagttggccctgccaaccactctccaaaacccttagatttttgctgcctttgcccttgacactgtcctttccctggagctgaatgtctgggggtagaggaatgactttaaaagtcgaggatcaggcctggcatggtggctcatgcctgtaatcccagcactttgggaggtcaaggcgggtggatcacctgaggtcaggagttcgagaccaggctgaccaacatggtgagaccccgtctctactgaaaatacaaaaattagctgggcgtggtggaagccacctgtaatccaagctactctggaggctgaggcaggagaatcgcttgaacccgggaagcaggggttgtagtgagccaagatcacgccaccacactccagcctgggtgacagggccagactccgagtgttccaaaaaaaaaaaaaaaaaaaaaa

SEQ ID NO: 18483 - DNA, 315 bp, Homo sapiens
aactaggtcaaaacttcccttaacttaaaggtggataaacaattctatttcacataaaataccatgaaattgaaaagatgaccaaactcacaatttcccattagaaaatacctcagttcattcaacaataaatatgaatgaacatttacgaagtgtcaggtgctccactaggagctgtgaacacaggacagaataaaacagacaaaagtacctgtcctcgtagcttttcttaaggctttctggaatgaactaaaacattaatgaattgttaatatgaaaaacaaactagttttcttcattaaatgggtgtagttg

SEQ ID NO: 18484 - DNA, 408 bp, Homo sapiens
tttcctggaaaatataaggtcattagaaaaatttaattccatttaatttcctccaaactttcatgttgattgttaagtattttaactctatataatttttaatcatcataagatttcattatcatggccaggcacagttgcacacatcctataatcccagcactttgggaggccgaggtgggtggatcacctgaggtcaggagtttgagaccagcctggccaacatggtgaaactccatctctacaaaaaatacaaaaattagccaggcatggtggcacttgcctgtaatcccagctacttgggaggctgaggcaggacaatcacttgaactcaggaggcagaggttgcagtgagccgagatcatgccaccacactccagcctgggagacagagtgagacttagtctc

SEQ ID NO: 18485 - DNA, 197 bp, Homo sapiens
atgttggaaagtatatcgtgaatggtgatatttgggagcctccatttccaacttgattcccagaatactggtagcaaagattttaactctcaggcaggggactgaacgaatattgctctgggaaaattaaaccactgaagattgtgtgtgtgtgtgtgtgtgtgtgtgtgtgtgtgtgtgtgtgtgtgtatttcttt

SEQ ID NO: 18486 - DNA, 355 bp, Homo sapiens
ttttcactatgttggccaggctgatcttgaactcctgaccttcaaagtgctgggattacaggcatgagccactgcacccagccggacttatgttttttactgatcagaccagacagtgctcagagtaaagacaccaggaatctcttggtgtcatctgcagaggcagaactggggtgcagcgttttaggctcgctgagactcccaggggccttctttcttcacaccattctaaatgccagatataggcacatggaagtcactatggaaaggaagacaaataaaacaaagtagtctatgactttcattatttggttgtgaaaaataacaataatagattttattttatcttgaagga

SEQ ID NO: 18487 - DNA, 443 bp, Homo sapiens
atatttttttagagaaggtaagctcagaggaacttttaatataccaatcgatgttaataaaacacaagtcaaagacaagtgtcaacatgctttcaaccaacattaatgaggaaacaagacacaaattctttttctttttttattttattttattttatttttgagatggaatctcgccctgtcgcccaagcttgagtgcagtggcgtgatctccactcaccacaagctcctcctcctgggttcacgccattctcctgtctcagactcctgagtagcggggactacaggcgcctgcaacaacgcctggctaattttttgtattatagtagagatggggtttcaccgtgttagccaggatggtctcgatctcctgaactcgtgatatgcccgcctcagcctcctaaagtgctgggattacaggttgagccactgagcctggccct

SEQ ID NO: 18488 - DNA, 413 bp, Homo sapiens
acctgagtctgcaggttgagtgagaagagagttgttgacagctgagtaggctaagagtgtggctacagtcccaggcatctcagctgcaggtatagggagtatagaagtgacactgggagaccaggtggcctggatctgactggaggaggtgctgaatgccaagctaaagagcctgagtgttattctacaggcaatgacagcccaagaaacaggatatcacaaaggttaagaacaaggattctgggtttgaatcttggctccatctcttaagagctgtgtggcctttggcaaggtacccaagctctctatgcttatattttctcacctgtaaaatcagttgtagtgagaattacatgagtgttgatatgcaaagtgcttagaacagtgcctggcacatagtgacatacataagt

SEQ ID NO: 18489 - DNA, 438 bp, Homo sapiens
ttcatcaatattccattgaacacaattttatgtagggtgtgttttcatctcctgtaaaggaccctaacattccatagaatattatattatagtaggcacatttggcaatgatgacagtgtactgtatttttcttgtaactacatctccgatgaagtcactgcagtcatgacaaactccagtcccactggaatgaggttcagagaacggactaagaggtaggacatggtctaagggaaagggttctattatctgtcaaaaccaggtaaaaagggaaggtttctagttctttgaaggctaaacgattaggttctgatggcttttaaatgttgatcatttattattaatatgaaagatcattttaaaatgtattatcttcttgtcttctcacttttgtgaacacaattgtacatgctagaatttagcagattcaggacact

SEQ ID NO: 18490 - DNA, 393 bp, Homo sapiens
ttctccatgttggtcaggttggtctcgaactcccgacctcaggtgatccatctgcctcagcctcccaaagtgctgggattacaggtgtgagccaccgcgcctggcctgattcttttgcttttcatgatatatcctgtgtaccttgagttttttaccaatgaacatgtattatttgcagagtaattttctaagccatatgaaaatgcatacagaaaaaaaattacactgccagattaatagtaggcctcaaaactatagaaataatttaaggagaaggagtaagaaatgtcatctgagattgtctttcaagataaaagacaaacataacagataaaaaataaatatatgtgtgtgcacgtaactattaaaacattataacaccccgggctcagt

SEQ ID NO: 18491 - DNA, 610 bp, Homo sapiens
tgggaccctgacatgtccatggagaggagctgggtgagggagactgactgtgagcaacccagaggagaaaggagttgggggactgtcatggcccatgccacaattgctgtacctcctacctgttctgacattgcatttggcaaaagaggggttggattctggggtgtgagaaagaaaaaaaatgtctctgggcattgagcaacctctctcagcaacagcactcctcagaaagggtaataatgtaaacattcacccattagaggaaaaaacttagcctttatgccaccctctccaccattaacaacattggcagccctattaaagtacaagtcagatttgtgtttaatgatcttgaaagtaaagtaattgcttgagtgttaccattcaaatgttcttagaagtgcagataatatttacaattggattgtcctttcggaaggggtaggcaggcagccttcctccgctatttgaagctgaggctggggagaagtgacttcagcaattggcttatgggtctaaaagctcagcgtttattttcgtttcttcttttcaatatcaagagactccagagcattagccatacctcattccttcaaggaaggagatgctg

SEQ ID NO: 18492 - DNA, 343 bp, Homo sapiens
aaggtgaccaactttgctataaaggtgttggaagtaggaagcattccaacttcctactgaggaaggttataaaatctgtaatgctagagatcttttcaggagccaccaaattgacaactatatatttgtgaatagtttaaaggtacagttttgcttacaataaggcaacaggactagttaatttatagttgtgacttgtgtgggtttttaatgatttttatgtttttaatgtgattttaatgtgattaataatatcttggctaaaatggatacagtgacaaatagtatataaaaatttgcagccgggcgcagtggcttatgtccgtaatcccagccctttggg

SEQ ID NO: 18493 - DNA, 263 bp, Homo sapiens
ccatgtttcgcccaggtttgtctcgaactcctgagctcaagtgatctgcccaccttggcctcccaaagtgctaggattacaggcatgagccaccgcgcccaaccaagagcagagtttagatgtggtacccatggagacgcagactaacaataggtgagtggatacagttgtgactcagtatataaaatcttttctttggaaggctattgatgacacctcagatgccatgctgagagcatggcaaaacaatgaatgtggccggg

SEQ ID NO: 18494 - DNA, 571 bp, Homo sapiens
ttatcaaacgtatacttaattctttgaatgtgttagtatgtgttcaaagtacaccttaattttatatatacatatatttaaattacataaaataaataagccactaaaaatttttaaagattttcttatatttcctttcagtatttttatgtgcatgcatctgtacttggtaatattgttgaattcatgtttgcattgacaaagcctctccccttgcccaaactctagtcaggatcctctaagcctcctctcagccccagccttcagtgttcatcctagtctggcccacatctctcaggtttagtaagaaacttgcaaagaatcccctactctcagtactgatcacctttgatatctgatcaaatttgttatctcccaccaccctccagatgatttctgatcagtctggcctgccttcagtaagaatcctgttcgatctgtttaacccaaatcccctttgcccctgatgtttcctcttagtatccccagttgagccaattttcaaccattaaaaaaatcttggacaaaattaagttcagataggttccagagtgcttatgttcagttcttg

SEQ ID NO: 18495 - DNA, 555 bp, Homo sapiens
atttttgtttttatttttgtagagacagtgtcttgttgtgttgcccaggctggtctcaaaactactggcctcaagtgatcctttgtccttgactgtccaaaagtctgggattacagatgtgagccaccatgcccagccaataagtatattccttcgtttatattaagcgttacatttagagaaattacctagttccctaattcctattttctgctcctccagctgagttacctcggagaggcaacttaacctagatttgctcactcataaaatggtaatactgcggtggctcacacctgtaatctcaacactttgggaggctgaggtgggtggatcacctgaggtcaggagttcaagaccagcctgaccaacatggagaaacctcgtctctaccaaaaatacaaaattacccgggtgtggtggtgcatgcctgtaatcccagctactcgagaggctgaggcaggacaatcgcttgaacctgggcagtgcaggttgcggtgagccgggattgcgccattgcattccatcctgtgcaacaagagtgaaactctgtct

SEQ ID NO: 18496 - DNA, 346 bp, Homo sapiens
gtgatatgccagatgttacaacaccaaatgggttgccattcaattctggatttaagctaaatgaactggttgactaactggattgatttgtcattagacttacatgtttctaacttcttaaaagcatactttaattttcatctcccttatatgccattgtgtgaatactgggtaactctctacattgtaagcagattttaagaaatctgcatttaagagatttttgttcaaaagtagatttaattcacaaaagcctatatagtttgtcgttattgctatatgatttttccaggcagacctgtgtaaaaataatttcaggcagtgggaagagcatgtgcaaaatcag

SEQ ID NO: 18497 - DNA, 496 bp, Homo sapiens
aacaaagtggatgatggttgggcaatctttctccatatcaggattcttgggtttaaagacatagcactccttcagcccttcccgatcaaacacataaggatcaatctttggaaaggggagcttgttcattttagcccacttttctgcaagtagaagttcctatgggaaagatggaaagatgaatttggaaattttcagttttcattgattcagttggtctgaccataattcagtgttcactaggtgtctactgtgtgccagcaatgtactccttgctaggatgaatcacgaccctgttctcaggaagttcattaatttcaaagaaattgaaaacaaactcactattgttatgttaattcttggcacaaggctagctccacagcaggcatttgaaaaattattgataaactgaactgagcaaaattatgttgaagaagctgctagagaaaaaaaattatgggttcagagaatttataaccatgtgaaagttttttta

SEQ ID NO: 18498 - DNA, 463 bp, Homo sapiens
cattttctaaggcccatgcccattttataattttgttttgttttcacatcggtcttcaccaaaatgcatacttcaagaccacagcttattcatttttataaccatattaccaaatactgcagctgtcacacaatggatactcataaaatattggagaataaatattcagggaataagttcttgtgtagaatgttgatagttctctgctctatattcccagccctcgaaggagcctgccaggatgaattcttccagcttcattcttcatatgccttctctgcctcaagaaccagtgtcctgctggtcccagtccatccctgctgtcatcccaactcttccattaattggcagaggcagaatggggccctgaggtggtttaaataaaccatttgttcatttatcagatatttattccagtatttgtctcaatatttatttcatgtctaccctgtgccaggtgcag

SEQ ID NO: 18499 - DNA, 496 bp, Homo sapiens
acctaatggctaccagcattttgttctcctgagtgaggttgaagtagagaggatggggttcgggagttggtggaagagtcttggactagatacctcgaatgctaggagaacctgtgtgcatatgcacgtgtgcatgtgtgttgtgtgctgcgtgtgtggcatgtgtgtggtgtgtgtatgttatgtgtggtatgtgtagtctgtgtgttgtgtgtctggcatgtgtgtaatgtgtaacggtatgtgtgatgtgtgtgtgatgtgtgtgtcatacatttggcatgtgtgtaaggtatgggtggtgtgtgtgatgtgtgtgtaatatatatgtggcatgtgtgtaaggtatgtgtggggtgtgtgtaacatatgtggcatgtaaggtatgtgtctcgtgtgtgtctgtgtgcatgtgtgaaaaaaaaaaaaaaaaaaaaaaaaaaaaagggggcgtttttttcggaaaccccaaccttaaaaaaacccttggggggtt

SEQ ID NO: 18500 - DNA, 619 bp, Homo sapiens
tcatgagattgctgttgtataaatgtagggaaaagcaaataatcaggagccaaaattgtctcttatcagggaaagttcataattagtttgcattctcacagaattctaaatagtactgattaattaagccaatatgtattccaagcagcaacagctaccaatagtcagcctgtgtggggagaagcataaatccaatgaactcaaatttaatacccctaattgtaccaatgtaagtaacagtcaatgactgagcatgcagccttttccctagacaatctctaaaatagtttttaactgaattttgtgaacagtatgtagagaaaatctaaggaaaaaatacagtgaaggcaagaattcccaaaatgcaaatcagaaaacattaaaataatattatgaaagtttggttttcacaattagggtattcttcaagttcaatacactttctcattgttgtatttttcttttaatttttcaatttctagacatatttatgcaattatttgtaaatctctctaaattctagaaaaaatttttcccatttgaatgtcatagaaacagaaatataaaaacaattttaagatataaatattcttgaggatttataaccaaatatttttat

SEQ ID NO: 18501 - DNA, 658 bp, Homo sapiens
atctggacttttcagctcaatatacatgataaataggcaggctttaggcctggctatccatttttggccactttatcactggctaccagcatgtgaacaagtcttgcaggaatagcataagattatggcacacattgattttcagcttttgactgtgttttcaataatcagatataggtgaaactgtttaagtacaagatagaggcccaatttgacagactttgaaccccaaggtcattttaagagtcagggacggaatggtcatttgatagatgggataaatatatcctgggggataaaacaaagctgtctttgatcctcctctttttagtttgttcctgatactttacatggccatcttttcatatacccattgtttacagaatcagaagggtaagatgctattctgtgcagagaatgataagaactagtacctaataactgctagaaagaagggggccgggcgcagtggttcacgcctgtaatcccagcactttgggaggctgaggcaggcagctcacctgagggtgagagttcgagaccagcctgaccaacatggagaagccccgtctctactaaaaatacaaaattagccaggtgtggtggcgcatgcctgtaatcccagctactcaggaagctgaggcaggagaatcacttg

SEQ ID NO: 18502 - DNA, 639 bp, Homo sapiens
acacacattgaattcgccaatcccctgttcctcccaacaagctctgtcctgaacttctgtcctgactggtccagaaaccagctatcctggtgcttcgcagacctctgtaactgagatggaaagggagagaagccggtgggagtggaagaagtcaagcctgtgcacatgccctctttcctggaaagcttctgtttccctctagggtctcggtctagcagatcatatagggccctgtggtaattttaatcagttaggtcttttctcataatgagatgggagccaccagaggggtctgaggtgagaagtgatatgatccaacttatgttctagcctcagattggagaagtagtatggaaggagcctgctgagtgaggagaaacctctcccatgaggattctgccctggtctctcatctgggcttaagcccactgcccgtcttctctctgctggaccattgcaacgactaagtccaggccacaagtttcttcccactcaggtgagtttcttccaaagacggtgagccactgtctttgtcttgcacacagaccgaactctattctgccccactgtcatgctaacaaactcttattagctccatgtttcctacatcatcaaatcctgaccctcttctttgtcata

SEQ ID NO: 18503 - DNA, 618 bp, Homo sapiens
ggaagccgtctgatgacaggatgagcctaaggtggggaggggaggatgcggtgagccacaggttctcaatgttcagagagccagtgtccttaaatagcgaggtgaagagctcaattaggaaccaaagccaaaaatgagctgaggcaagatggtagaacccaggcctggatctgagcagttgtcaaaagtctggttacaacatttgagagtgtggtgttcagctacctttttggattcagttgtagttttttatttgcatattctttttctttttgataaagctctatgaggactatgttttcaactccctagatgcatatagtcctgtactcagatataatgtatctaatctcttcccagatttataattgcaaaccataagccactttgagttgtgttccagcacctgccgaaggagacgactaaatgatatgaaccccattttcctcctaagagggcattcaaattctcttcctcttggattttatgaaatcagatttcagttggaagattctgtcacttggcctcttattgtcaaacacaggtaccttttaacgcagacttctactgagaaataattagagacagggtctcatggtcaggcgcggtggctcatgc

SEQ ID NO: 18504 - DNA, 494 bp, Homo sapiens
ttgcaaaaaaacaacagaagggtacggttgcaaaaaaacaacaaaagggtacggttgcaaagaaacaacagaagggtacggttgcaaaaaaacaacaaaagggtacggttgcaaaaaaacaacaaaagggtacggttgcgaaaaaacaacaaaagggtacggttgcaaaaaaacaacagaagggaaaagctatctatgacgaacccacagccattatcatactgaatgggcaaaaactggaagcattccctttgaaaacgggcacaaaacagggatgccttttttaaccattcctattaaacatagtgttggaagttctggccaggccatttaggcaggagaaggaaataaagggtattcaattaggaaaagaggaagtcaaattgtccttgtttgcaaatgacatgattgtatatctagaaaaccccattgtctcagcccaaaatctccttaagctgataaacaacttcagcaaagtctcaggatacaaaatc

SEQ ID NO: 18505 - DNA, 426 bp, Homo sapiens
atagcaattcttaaaacaaaattcgaggaagaagatgccacagaattctgtggtatgttgcttaacaacaattatatcaggaaactcttactcatacctaaacacaagcccagtattctatattttaaatgtgtttttctccaataaatggtcaaaaaatcatgtttatgtataatgtaattaaatataacatacagttgtgtatgttgccacacacataggcttgattgtattaaaatgcaacattagaagaatagcattctttatagtcgcatatttttgcttgactggtcacatttgatgaataaagggtatttcaatcttcgaaataagtttatgttcttatgctgttggctgtcttattaaatgtccatgaaaggcaagcttaaggatatgtaaatctagctttgaatatatatgtagcat

SEQ ID NO: 18506 - DNA, 253 bp, Homo sapiens
atgcactggaaaaatgttttggcaactgttttcatttaccctatgctctttgactttttggttgttacagataaaaagagattactctgctgagagtactaattttacttaaaggtccttttggtttgcatattaaatatgtcattcagtctctcccgagttaaatagagtgtgccctcctgttactttgaagttaaatgaagttattttctgttttggtgcataagtaaatataatcataacttactttctt

SEQ ID NO: 18507 - DNA, 477 bp, Homo sapiens
gctagagaaaagaggatgttagtaagtttatcataaagaagacaatacaaatttactgttcattaagtggaaatggatcataaaggtttcattctcaagttcatgtcgaataggaggaggagaagaactgcttgatcttgctatctcagggatagcagaggcagaagaacatctgcaaataagtagaccaaacatttcaaatctgtgttgttcaaggatccactgtacagtaatgctaagaaaggcagtggacataatttttaaaaagaactcagatccttaatttatccccaaattcaataatataacaatttttaaaatagaatttgtatgtttgattgtcagagatagatgaaataaaacaaaccattagaaataaaaaattgtttaaaaaatgcatcagtatttagatttgaaaaaatcataattaaaatattttcatcactgaatttaaaaaaatctataaatggatctaac

SEQ ID NO: 18508 - DNA, 569 bp, Homo sapiens
accacaacacatttagttgctcgactcatatgaagaagaggtgccctggttgggaaaagtgaaaattccgaataatggaaacgaatagcccttagtgagaataaatattctggttcatacataagcctcagagtttagtgagtcagtcccttgaatttgatctcttctaggtgctctgacaaggcctgaagtccagaagttaaaaagctaagaacccagagactagattgagattacttgagtcaagtcatgttgcttatggaagacctgcctaagtgaattctctggataacatgacatatctatctcatttcctaacaatggcaggaactcatatttactttatgactcctctgtgttaagtactatgctggtcactttaaatattatcttattttgtcttaacaactcaagaaggtactatttagccccgtttacaaatgaaataaaaacacacaaaactgaggttcaaagaggctaagtaatctgcctaagactaaacagctaatatttaatttaacagatctagccagggctgtcagacttcaaaaatatggctttttcagctg

SEQ ID NO: 18509 - DNA, 177 bp, Homo sapiens
attgtcaaagactgaactaggaaagaaagctgggcagtctgcagcaaaacgacaaggaaaatttaaaaaggatgtaatccctgttcattactacttaatacctccaccaacaaagactaagaatggcagcaaagataaggaaaaagattcgaaaaaaaaaaaaaaaaaaaaaaaaaa

SEQ ID NO: 18510 - DNA, 463 bp, Homo sapiens
aagatggcatggacctgtttttctttcccttttctgctaagcacatctatgaaccctgaaaatggctcaagagacaaccaaaggagaactaaaagaagaaaagtgtgatattgtttggaaccccaggaccaacagaacagtacagtggaggccctctctcctcttgcctggcctgagagtccccttttactaagagatactggagtgaaaagggctccagtcaatagaaaagaatcagagaagcgggtggcctggattggaaagccactctgtcccaatgagttagggactctcttccacttcccagagacaccagaatagtaggagataagtgaaaaagtaggagtatcctgccatgcctgtcctgttccttcatggagagacatcctgctacctggtctggggaaattctgatcattcaggcagtgccaagagggactgctaggacccctagtggcaccag

SEQ ID NO: 18511 - DNA, 605 bp, Homo sapiens
gaaacttacttcaacactgtaaaggctgtatatgaaaaacctatatctaatattataatcaatggggaaaaactgaaagctttttcttaatatctggaacaagacaaggatgtctactctcatcactcctattcaacatagtactggaaatcctagccagagcaatcaggcaagagaaataaaaggcatcaaaattgaaaggaaagatgtagttatatagtcagtctttcatatctgctggggatttgtttcaggaccccctcagataaaaaaatttgtgatgatcaactccctcacataaaatcatgtacagttggccctatgtatccatgggtacacatctgtggattcaaaccaccacagatggaaaatgtgtacaaattttgttcatagttgattgagttcatggttgcagaacacatggatatgaaggactgactatataataaatttactaaagttgtaggatacacaatcgacatacaaaaatcattgctatttctaaacactaacaatgaattgtctgaaagggaaatttaaaaaacagtatcaaataaactactttggaactaactaaccaaacaagtgaaagacttaaacactac

SEQ ID NO: 18512 - DNA, 646 bp, Homo sapiens
taatgctctgtttgctgcattatacaaagggatgttggtcataatgaaaaatgaaatcagagccaaaccctagtgagtgtgagaaattggtgccaggataattgcacagtaaccaatgtaaaactaaatacattatggaggctaaataccaaaaccacaattgttttacttttcctcgtatcttgacattttaaaggcacgatatattatttttcagccaatcaagggccatttactgaacaccaactctaagtatcttccaaaactaggcactagaggaacattatgttagttggtcagtgtcacatagcagaaagagaaagcatcaacataatttactgaaatatatactgcctgctgaaatcacaaaaatatgaaatatttgaaatctttagtgcttacactgaatttaatatgccggcatgttgaaattatctctttaatttaaattaaggtgaattttcctgttcttctaataattttatatagttttaatgctcatggttccaaataaatgtgcattaagtagcacactttagttaagcatttcaatatgcattcataaaagcatgtgtttgaaaatgccgacacatatgaaagctcattcagtagaaactaatgctgtccagcagagaataaagtaact

SEQ ID NO: 18513 - DNA, 568 bp, Homo sapiens
aaacatgtatgcccacttggtgttcatattataatcaatgactgcctttattatttatagtgaaattcctattttctgataaacatagactgattttgttttccatcagcccagttgagcattattttatcattttatgtgatttaaagtgaacttacttaaatatgactgtgatccacagttccactagagtgtactataaagatctggttgaagcggccagccttaatagatacatcttggcagagaagattcttagagaagaatggattttccatctttctcaactaatcagtcccttgccaaaagcagatcttacttttattatctaatggtaaactggaaactgctagcctaatatatatcacccaatttttaaatttctcctgcatgcatttaccttaaaggagcatataaacttagacttttaaaattaatcctgctttcttctaatttgttcactctttttctttgttccaaaggtattataacacaattaatgtaaaaaatacatcattaacatttatccaataaggttaggtactttctaatgaaattctccacttag

SEQ ID NO: 18514 - DNA, 669 bp, Homo sapiens
ttggcccggcctgtggtgggcactcactaagtgtctctggtaccggggccagtgatgggcactcagttagcgtctctggcctgagtgttgcttggctgctttcctggtttgacactgcactttagactattgcagctaaaattaacacacatcatctgttgatgtgatgcttgcctccttttaagcttttctcaagctttcaaaatttcttcctgaagtttttccttcacagatgaaattgctcctgaattagaggtgatttactccaggcttccttgtgcttaaatgtggcaactttcaaggctgccttcatttttgcctcagagtttataaagcagcttagtgtgaatagatgctgtagggccgggcacagtggcccatgcctgtaatcccagcactttgggaggctgaggcaggttgatcacctgaggtcaggaggtcaagaccagcctggccaacatggtgaaaccctgtctctattaaaaatacaaaaattacccaggcatggtggcaggtgcctataatcccagatacatgggaggctgaggcaggagaatggcttgaacccaggaggtggaggttgcagttagccgagatcgcgccactgtactccagcctgggtgacaaagtgagactctgtcccaaaaaaaaaaaaaaaaaaaaaaaaaa

SEQ ID NO: 18515 - DNA, 618 bp, Homo sapiens
gttgcaaggtggcctctgaatgccacactgtgtggccactcccttggacagtggctaggccacagggtcgcctcccctggccccagtctgtgggttgaatatgctaaccgagccttcccaggagcctcctctgcccccagcccccaggtctgtacagatggtagttggtactttcagcccgccttgagaactcagtattcttcctgttagctttccttcaaagtaaaatcggtagaacctattttgagtgtagaaaatttgaagtcgtggacagcagattacaaaaaattgcccaccaccatgcctggctcatttttgtatttctagtagagatgggctttcaccatgttggccaggctggtctcgaactgctgacctcaggtgatctgcccacctcggcctccctaaatgctgggattataggtgcgaaccactgtgcctggctcctttttgtatttttcggagaagcacaaggacttgttgtttaattaagcaagactatactctcccagagcatgcagttattattgagtaaaacacagttaatgagatttaatcacgttccctatcactgttgtgcagcatgataagtaggtgcaaatggcaagaagcacgctg

SEQ ID NO: 18516 - DNA, 357 bp, Homo sapiens
ctcattcaccacatttcaaccatgcttgccttttctctgttctctgactgtgctgtagggctcatgcccatgctgttccctgtacccccaaatcactgtaatgctgtctctttcttgttgctcatatcctagttcaaacctcctcactggccttccctcaacaacccaatttatttttttattttttgtttttttgagactgggtctcattctgttgcccagaccagagtgcccaatcatagctcactgcagccttgacctcctaggctcaagccatcctcccactatagcctcccaagcagataagactctaggcacacatcagtccattattttttgtaaagatggtgtcttact

SEQ ID NO: 18517 - DNA, 563 bp, Homo sapiens
agattgctactggagttgagggtcttatgtagaaaacatgcttgtatttttggaagcctgcatatcttctcagagcaagagaacatgaaatggtagtatcagtagaaccacaggaaaaggacaaaaggaaagtgctcaactctttccacaatccaagtttattttctgtgagagagatgggatggggagatcatctgctgacctgggatgggctctctctttggaagccaggctctgtgctctagggaccccatgaattcctcaggaagtttccttgtggttgacatgctggaaaacaggccctgagagtttaggatgagccttcctagatgctgttttaggaggatcctataggaggctgggctctgagtatgttgagagactgaacatatgtggcacggattcacaggtctctagggagctaaagcaccctcccctacacaactcagcctgctgacccagctcacacagtttatttatagaactcactggcatgtatccagggcatgcttaaagtgtaaagtcctggccgggcgtgatggctcatgcctgtaatcccagca

SEQ ID NO: 18518 - DNA, 83 bp, Homo sapiens
agtctagggggtcactgtcattcccctttccttgatatcatggtctggaggcagtgtgatctgtcagactcaggactagctgg

SEQ ID NO: 18519 - DNA, 630 bp, Homo sapiens
ttgatctcaatcagagtagttgaattattttcttgtgaaaatgtactatccttgtttttgtttctgtatgttttctctatgtaaatcctagcttttcaaataaccattcaaattcttatgctttgtattttattttcctgaacataccagctaatgtaaaataatctttctttccaattcttgaaaccaaatgtaagctccttaagggaagaatctataacaatttgtacttcccacagcaactatattagcagagaaaaatgatttggtaaataaatacctgtgagattaaaaagaaaatcttaaggatgtaatgagatttgcatacacacagacacactctcacactttctttaagaggaggctcttcagtcctatttatttcacccaactctcatcaagttgcagactctgaaccaaaaggaatcttaggaaccctccatactgtgctgatttctcctccgtaatagtctctttgcatccagctgggcttgaatatcttcagccacagaaaaatcacttaacatatggagctcattctattgctacatatgtcctaaatactaaaacattattttaatgcttagccacaacacacacatgccaaaaaaaaaaaaaaaaaaaaaaaaa

SEQ ID NO: 18520 - DNA, 534 bp, Homo sapiens
accggatttcttggttttctgtgcactgagccctgtgctttcaggaggcctccacgttgccacgcataatctaaagtatgtccaaggtgctatgcacagagaatccatggtgtgcattcctgacattttacctatctgctcgcccagagatttaccctttctcctaaggggctagaaaatcagaagaaaaccataagaaacatttagatgtccaaagagaagaatgacagcacatttctcattagcaatatgcaagtcagaagtcatgtggcacaccatctttaaaatcgtgaaataaaaataaatgtcaactcttaagtctatactcaatgaatatcttttcaaatgaagttaaaatagtaggtgtttagacatacagaagttgaaagaattgatcatcaatagacttgcactgtaatattttttaaaacttttatgtttgggggtacatgtgaaggtttgttacatagataaacacgtgtcacgggggttcgttgcacacatgactacatcacccaggtattgaactcacta

SEQ ID NO: 18521 - DNA, 486 bp, Homo sapiens
tgatggttgttggtttagtcacataacaagcgttcttttcgtaagtaacgcccctgtgtgagttcttaaacgcttgcaaagcaggtgggtggtgaataacctccctaaagggtgtgtgtccatatcgttcgctcttataaacaggaacgttaacagatggtgtaggatgcttcggagacctcttcactatttggggtggggcatgtttgtctcatctctctgagccctacttcccctttgggaagaaagttgagggagcaatgtgagagaagtgtattcaatattccccaccttgagaggactattttcttgttttttttttctagggcttttactaagtccctaccaaacaacatgctaattgtaacctgtgtaggttaagaaacaaaataggcctgattttgctggactaaaagttgcttaaatctagtcagtagtacattgtgatgttgtttctagcaaatatttcttggaacactttctgcc

SEQ ID NO: 18522 - DNA, 507 bp, Homo sapiens
caactcaaatgaataggctattgagcatccatgtggaggccttataagaagtcgtgatgcattaaaattgttttcagattataactagtggcaatttggaaagtggataggaactaggaggagttgatggaggaaaaaccagacaaaaggccgtttcactagtcccactagacatttggaaggcttgaaatgaagtagtgacaataaggatagagagagggactagatatgcaaattagtcttataaaaattgacttgatttggtgctttgtgagatgtaaatattgaggctgacctaaaagttgaagaaaatattgacatgtctagtatgagtgactaggtgaatggtgatgtcttttaccaaaagaaaaatttctagggtgggataggtgggttcatgagcaggatgataaattcagtgtaaaaaaatacttatttttaacaaataagccataattctggtacaaaattttaaaagtatagaagaatatatggtgaaaagtaagt

SEQ ID NO: 18523 - DNA, 606 bp, Homo sapiens
cagaataaacggctaatgtgtgaggggcttaatacctaggtgataagttgataggtgcagcaaaccaccatggcacacgtttacctatgcaacaaacctgcacatcctggacatgtatcctggaacttaaaattaaattaaattaaattaaaaaataaatctcagtggcctaattcaataaatgtttatgtgttgctcatccaaattacagtagatttgtggtcagggttggagagctttcctctacagtcactcagggactcagactgcaccatcgggaatacaggatatcaaaggtcacatgaacaagaaatagaaaacataaagtacgcatatctgctcttctatgcattgtactataagtgacacatgtaattttgcttaaagcccctgccagaactagtcacatgggcctacctaatacagataattagtcattcagtaagcagtagaactcttcaccacagatgtaagtcagttttgacaagagtattggggaaaaggtgtagaacattatcatttgtgaaatgtctccacaggagagcagaacgttgatgtgagatacagtacccaaagacaacatcaaactaaactaccaataggtag

SEQ ID NO: 18524 - DNA, 256 bp, Homo sapiens
ctttcttcagatgtctctgcggcagttctgcccttgcccggcccaaggcagctgcagcatctagcttgtggcccttttccatctcttctgggagctgcctttattctgagccagctctacacttaaaggggcgtttgttctattttatcccgaattcctaaatgttttgtggagacggaaggctttttaagatatctagtctaccatatctccaggaataaaaatgatttctataaatttttaaaacctatgtaaa

SEQ ID NO: 18525 - DNA, 362 bp, Homo sapiens
  misc_feature 273: n = A,T,C or G
gtcattcaagtaatttgggtactggaagaatcgggttaattgattacaaatatactgcagtgcaagaaatagggtttaataaattcaatgtctcatttgttcaaataggatttaatgttcactgccagtcacacattggctgaaataatatttcccagaaataacaaagggtcacaacacaagtcagaatcgtcatcctgggagaaatcatagagattaaggtcgccaaggaaacttttttgttatataattacttttatttatgtgaaacanaaccttgccttatctagatagcatatgacttagtaatagaaattcctatacaaattataatgtgtgtagcaatttatatcactgaagca

SEQ ID NO: 18526 - DNA, 246 bp, Homo sapiens
gaggaaatcatccataactgcatattattttgatttagaaaaatcaatagtgtgaactctttatttttctccacaatccttcgtttcttgcattccttattttagaatatgacatcacttgtctaaaattcatgaataggaacttcacaaagaattatgacaataaacatataaaaatgttcatctttactagttttgaaaaaagtagaacaaaataaccaaagtgacttttgtacttttctattg

SEQ ID NO: 18527 - DNA, 287 bp, Homo sapiens
ctctctgcttccccttgctcgctcggctatagcccatgggcttctggctgctccttccaccctcagggcacatgcctgccctgcccctgtggctgggcctctctcccaggcatcagcagggctccctcgctccctgtccctacgttgagaaagagaaaagcaggccctgacctcctggagcccgcctggagcccagcggggcttcggtattctccagctgaacctaaatgacttcacaggacatcagcaacagacaaaccacctgggaccacgatggatcacgacac

SEQ ID NO: 18528 - DNA, 95 bp, Homo sapiens
aaccagaatacaacctgcagtgaagtgtcattgcatgatttcagaattacttataagtctcattagaggcatccctattgctatataaatataat

SEQ ID NO: 18529 - DNA, 561 bp, Homo sapiens
atcagccccagggcgctgtgccagaaaaaggactgcacagcaatgacagctcattcttctaccacggtctagcatgcgtgctgtgtgtgtggtgggtgttatttaggggaggaggaggtaacagtgagacacgtgttttgtgtgttaaggggacagagacactaagcttgacccactatgatgtctgagtcagtctggtgaaccaatcatgaaatgctcaaaagagagttgcacagttacaaagcctttgccattgaatggtggagactgtggcatcagtcccccaccctatcttctgtagaaaacagaatgagagtgcagttgcacagaggtggctccactgtagctcctcatgttatgcatggcagacattgctaatattcattccagttcccggtcaggcatggtggctcacacctgtattcccagcactttggggggccgaggcatgtggatcacctgaggtcaggagttcgagaccagcctggccaacatgatgaaacctcgtctatactaaaaacacaaaaaattagtcaggcgtggtggcagaagcctgtaatc

SEQ ID NO: 18530 - DNA, 374 bp, Homo sapiens
gtgactattgaaatgagatgataacttcccagaaactgcgtagaaataatcatcactttattaccctttgaaaagaagattgatagaaaagtcattcgaaagatggttcattaccatgccctagtacgatttctttactcacatctctctaaagcatgagaaagggaggattattctctaaggtcggaatttgaaggctgtttgcctctttgaagtctcggtatttaattttctgtagtcatttcttgggcaattttctaagaaactagttgaagctaatttatcataagttaaagtcaaatgacagaaaagatttttcccccttaacagcattttattccacagaggttagcttctgaaggaaaatgagactt

SEQ ID NO: 18531 - DNA, 466 bp, Homo sapiens
aaggatttcactatgactttatctcccaggatatttaaggtttggtctcattctctaaatgtacttaaaacaagaccgttggacttacattttgttaacataacaaaaatgtatttatcatttcagagatttccgcatattttgcaactggctcctcaatgacataccattttcaagaacattacactttaagtgaaaactccagctctctcgtttcttcattatacagagatgtaacattgaccagagaaatgatcacactgagcttccgaaccacacgatctccgagcttattgctgtatgtgagctctttctatgaggaatacctttcagttatcctcgccaacaatggtgaatatcttttgtgtaaagaaaaagagaaccctgagttagaaaaataggactgtaatgacatgggtcttttcagcagtcaaactacaaacgatgagagaaaactgtatgccct

SEQ ID NO: 18532 - DNA, 441 bp, Homo sapiens
gtagcaagaatgaggtctgggggcatctttgtgtacatctgtagtgctgtgtgctccagataatcagcttataattacagattatataatacagattttcagattataatcacagattattcatgccagcaaaccacgacctcagattggccatctcttcatgccctgaggcttggagcatgagagagtccgccttggccgtcgtcatgaagctgacagcctttgtttgctgcagagtcacgggaaactacatgctgcactccatctttcttgcaactccgccagatagctgattgcagacccaacagtaatgtcatggggacacccatcagggaatgcattagcaagtgaacaaacggggacaaatacaaaccatatttaagtttctgttatctttaattactgaggacacactgaattattttctataacttgctggat

SEQ ID NO: 18533 - DNA, 460 bp, Homo sapiens
gtaaaatatgtacgtgtttagggactaaaatatcaagaaagaggccacatgttggttcatgcctgtaatctcagcactttgggaagccaaggtgggcagatcacctgaggtcaggagtccaagaccagcctggccaacatggtgaaaccccatttctactaaaaatacaagggttagccaggcgtggtggtgtgcacctgtagtcccagctacttgggaggctaaggcacaagaatcacttgaacccgggaggagaagattgcagtgagccgagatgtcgccattgcactccaacctgggcaacagagtgagactctgtctaaaaaaaattaaaataaaatatcaagaatatccactcctacctgttaataatgcttacctctagagaatgtgatagagctggagaaaaagagagtggaattttatttttttacattaatacaattctatattgcttaac

SEQ ID NO: 18534 - DNA, 466 bp, Homo sapiens
gaggtcgaggctgtagtaagccatgattgcaccactgcacaccagcctgggtctcagaacaaaaaaaaagagagaaaatgcaattatcgtccccagataagaaggattacctttgtcacaactgcgaagtaattgctttggtacggaaacagcacacagagccataaagcaggttaaaaaacacttctgtgacttcctaaatcctctcttgaatacatctctgagttctggcctagggacagcagtttcatttctggctctaaaatttaggtatataacaaaacacaccagcacagaaaaacttcaagaatactatgaatgagtgccataaattcagaacaaacaaaataacttgcactctaaaaagtcttacaaggccaagtgcggtggctcacgcctgtaatcccagcactttgggaggtcaaggagggtggatcacctgaggtcaggagtttgagaccagcct

SEQ ID NO: 18535 - DNA, 208 bp, Homo sapiens
ataaatttgttttctcaaatatttgctatgagaggtggatggattaattaaataagtcaattcctggaatttgaaagagcaaataaagacctgagaaccttccagaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaa

SEQ ID NO: 18536 - DNA, 646 bp, Homo sapiens
cataccaaagtcagtgtcagacagataacttcgaactattataactcattctttgagttcttagatagaattaaatgtcatttctaaaaggtctgttttgttctttctcaaactcaccttttcaaaaatcatatgatattaactcattttgggcattatccttgcatttatcatctttgtgtctcagactcttgataatggcctacccaaactaggcatgacaataaatgttggttgaaatgaagaatatcatgaagacactatgttcgattcactatattatatgctatgacaataatcacataatgtagaagacagattatctgtccttaaggtcattttgttttaaataacaaactggggatcatgaattcagaagcatatgaaagcagatatttacaccaaaacaagtatagtgcttcacatctggagccctatccattaaaggattgaaaactatacctgagagatgcattgaaaagcaatcaaaattaaatatagcatggccgggcgcggtggctcatacctataatcccagcactttgggaggctgaggtaggcagatcacgagatcaggagatcaagagcatcctggctaacatggtgaaacccagtctctattaaaaatataaaaaattagctggat

SEQ ID NO: 18537 - DNA, 585 bp, Homo sapiens
ctgtttgcagatggattggggggagcatctgcagaaaggcaaaaaaggccaaatactcttatcagttgcagatggctctgttgctgatgacagcctgtgtcctgggttctgatgccccctagagacagccgtgaagaggcaattttctcctcgaaggaaggaactggaatgattggttgtataattgcagaattgttttcagtatgtcagcaagcactgaaaatggggaaactgtcccttcctacctctgtaggctggagacctcgggttcagctccatttatcagggcacaggaccttcctgttctgagactttgttccaggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaatcttttgcccagaggggttcctcagtaaatgctggagatgaggctcagacctgacctttggattcccagatggagtgctctg

SEQ ID NO: 18538 - DNA, 427 bp, Homo sapiens
gtttgaatattcagtgcactgactcttacattcagagaaatcttatctgtagtaagcagacctaggatgcagcttgtttgcctttcactctgtagcttcagcaacagcaaacatcattttgccaattttgttcctttcttttgactgcaatcatcttctttctttgtcctagaccattagttttgcggtactcatgagcctctctcaactcccttgagagtgtcatggcatcctctaaaggtaacttgtgggacatgcaaatctctctgccttgacatctttcactcctacaggtagggtttgatgctttacctttccactatcttgtggcgtatctctttcctcaacaccaccaccccccaacccccatagataagtgtataatgtgtacaactaatgcccacatttcatcactaacataaaaatg

SEQ ID NO: 18539 - DNA, 289 bp, Homo sapiens
ttcttatttgtactccagtttatgaatgaattatctattccactgttttaatctgttattaatcctatcccatgaattttttaactggggtaatggaatttttttattttatttttattttttatttttttattttattttttttgggacagagtctcgctctgttgcccaggctggagggcagtggcagtctcggctcactgcaagctccgcctcccaggttcttgccattctccagcctcagcctcccaagtacctgggactataggtgcccaccacaatacccagc

SEQ ID NO: 18540 - DNA, 287 bp, Homo sapiens
  misc_feature 96: n = A,T,C or G
acgctttgaaaagagccattcactgattttagtgaaatgaattgttattttgaaaacagttagtgctctggctaatttctcttgttatggcaatcnttggctctttctcatgtctgtattttcatattgaaaacagatttgagaacataatagcctgagatgttgatgcacagatataggtggaaatagagagatgacctagagaagcatatttaagctaggctgcagtgatctagagaaaatgtatgtcggctgggctcagtggctcatgcctgtaatcccagcat

SEQ ID NO: 18541 - DNA, 285 bp, Homo sapiens
tgtttttgatttcatgcctagatcttttggttttaattcacataaaatagatgacacatgttttctgtgttcactggaattttttaaatcaacaggataatatatattctgtgaaaataaaataaaagcaatgacaatgataatatctcatgtgttttagagttcttcaagggttttcacatgaattacattatcatgattgattttcatttaaaacatgaaaacaaaaacctgtgaggtaggcagggttaaggaaaaaatttaaaaagctccattgtgtataat

SEQ ID NO: 18542 - DNA, 314 bp, Homo sapiens
tcttaccaaatgcagatttgtttgagcattcttttggtagtcatccctccaaatgtgtgcacatgttttccccctgcacctagaatgctctttctccttgaagttcatgctgaactctcatctctccttcaggctcaccctaggtcttggcatatcaggaagtcttcagtggcatccctggaggcagcaggatgaaatgtacaaagcctggacctcagactttggtgttcatcctgtttctgataattacttatgacagccagggcacagcaattcatatttcctagcctaagtttctgcataagcacatacct

SEQ ID NO: 18543 - DNA, 175 bp, Homo sapiens
acagaagggttcataagaatgcatggttcttaaggtataaacataggatactcagttttgctttgactgtttttatttttctgtggtagggataaattgcaaattgttttggacactatctcttaacccattcccgtgagcaaagcacatttttctgtaagatgactaagctaat

SEQ ID NO: 18544 - DNA, 598 bp, Homo sapiens
taacactgatttctagtacaaatcaatagacaacacttgcaaaatggattttgtaatcatatttagagcttgttacaatgactaatggtttgcaatattttctgaattttaatatcctctagacaaaaagaagtttttaataagttaccaagttattcatcatagtaatgaatgtgttatatttgtacatgaaccaagacaatcaagacaatccagtgaacaaactgcagaaaatatattaatcagtaattagggtttagaaaaagtcaagacaagttctgtaataaatggtgttcatcacttgcacgtattcagtacatgtgcacagtcttccaagtaaagataaaagtatatttgccattgtataaagcattgtataaataagcatatttatctataccacacccatttaggaggaaaatattgataggaagacagtcatacaaaataacaacagaatttacttttagagacttccaaggatgctaagggagagtgtgtttactcagtgctactgagcacacacaagaaaacaaagaaacaaacattatgtttggagcgtcattgtttgtcaccaaacaaaatattatgcattcac

SEQ ID NO: 18545 - DNA, 398 bp, Homo sapiens
cttcttcttttgacctgtcacatgatcagggtggaggaagaattaactgacctgacctaggaggattttctattcatttaaattcatagagttcgtgtcctttgccaaacaaatgtgcataacaagtaaagtatagaatgggtcagagaagccataaatagtcagaatcaaaaatgaaatctaatgattcccagatggttgtttcttccactataacatcatattattctcctgcattatcatttaactttctgtttacctgtctcatcttgccaactagattgtctttagtttcattccaaaactatctaaacggcatcctccatttccaggtggcagtaaaagattaaaaagtacctcctggccaggcacagtggctcacgcctgtaatcccaaca

SEQ ID NO: 18546 - DNA, 205 bp, Homo sapiens
cagaccttctgccaccttccattccctggattaaagttcctcttttgtaaatactcaagtgtttcctggttagacactgacccatacacttccctaccaggccacaagcttcctgttgggaagggccctgccttgtatccccagggcttggatactctcatttagcaaaagagaagaggcataagggaatgaattgctccctggg

SEQ ID NO: 18547 - DNA, 553 bp, Homo sapiens
tagaatatggttggttataaggggagaagaaaggtttctagtttggttgactatacagatagaaaaaccactgataaacaggaaaataaaaatgagaaagaaacaaatttatcaaaaagcaaatgagtttggcctcaaagatattgaatatattgttgcagtggaatatcaaaaatgacagtgcacaattatccagaacttatagatgtgacagtagaatttaaggagataatgaatgaaataaaaatcatacatgagagtcttttacataggatgagaatgtataacacagttaagaactcatggagtagagatttagagcaagaaggcagaaatcattggagcaaatgaaggagaagcaatcagaaacagaagaaatgtggccaagatggcattgagacagtgcagagttcactcagctaggtacagagtaagaggccatcaaacatgtggatgatggtggaggttctcagctgagtctgaggcatggttgttacagaacacaacacattcctctctggagtcaaaaacattaatagaggtgacccctcag

SEQ ID NO: 18548 - DNA, 159 bp, Homo sapiens
tagagactattgcatgacttaccacactgataagaaatatcattaggaagtgatataatatgctcttaagagtccacttgtgaaagttccatagatagaaaatcatatctcatgcttagccaacattacatcatgctgtattccaataggcattatgga

SEQ ID NO: 18549 - DNA, 517 bp, Homo sapiens
ttattgaatagcacacatacatgcccacagtagacatcagacaagtaggatttaatttccttttacttccaaaattttatgtgagtacttgtcattagcaacatttaacctgaagcttgattttcaaagaatctaagaaattaaggttccggtattttagcctttgcagtacttgagaaagcacaggaagatgaaagaatattttctggcacagaaagacattaattgctttgagctgatatgttgtaagctctaagtaatccaaattctaaaattatcaatctccttgctatgctgaaagtagaacacagtgaagagcatatgtaaaaaatcagaaaagtcaattaggaatttattccattagttaagaaaagaggtatcaggttgatatcaggatggcagtggtagagttggtaaaatgtagtcagattctggaaatattttgaagttgaaatgaacaatgcttcctgccagattgaatatggagtgtgggggaaaaggtggagtcaaagaacat

SEQ ID NO: 18550 - DNA, 526 bp, Homo sapiens
gagacggggttttgccatgttgcccaagctggtcttgaactgctgagctccagcaattcactcacctcagcctaccaaagagttggtattacaggcgtgagccactatgcctggccatatttttttcccttaatttatatactatagaaatgttggaaatgtcctaaaaaatatgtactcatagttgaggtcaataaacatgtaaagggtagaatcaatctggggaataagttctgatttgctatatgtgaatttaattaaatataagggagttaaaatccaaactagtttacctttgctattttctgagattaaaaaactcatttgtattcacttgagtaatactttaacactgtatatatatatacaaaatgttttttgttgagacagggcctcactgtgttgcccaggccagagtgcaatgatgcaatcatggctcattgcagcttcaacctccctggctcaagcgattctcccgcctcagcctcccagctgggactacaagagtgcatcaccattcctggct

SEQ ID NO: 18551 - DNA, 195 bp, Homo sapiens
aaaagtccagcactaaatcttctagtcacttaatccccagctcttctatgtttggagataatttcctttatgaaaagaaactctaacctggccagatacccttctcagacttgctaatggaacaaagaagcctctcattagactcatccctgtggctgcagaaataagtgtctcggaaagcacagcttttgcttt

SEQ ID NO: 18552 - DNA, 115 bp, Homo sapiens
catcggcattggcgtttttccagagcttcccatgtgcttcagcttcccaaatggtatctgctgtcctaaagaactatgatctcttctctgttccctcataaaccatacactacat

SEQ ID NO: 18553 - DNA, 218 bp, Homo sapiens
agtatgaattccttaaaaaaaaaaattcattcctcctttctgcgtcataaaataagtaacttttttcccattaaaatcttctgtaatgcttctgaaaaaagcacgcagtttgaaaaacagcaatagtaaatgtgggtctctgatatattttcaaatgctttaaaaaattattaatttattcatcacatgtttatgaattacctacaataacaggcact

SEQ ID NO: 18554 - DNA, 479 bp, Homo sapiens
taattgactttatagcagtagaaataatgaaagatacatttgctttcccataaaaatgtgattttagtggagaataacgttcctgaagggatgagttcccaaatgttattaatcaatatattatagcaatgagcataattaacaaaacaaattatattcctcagtattgttcatcacaaacctatctaaattatatatcaaataatcagcaagttaatacagaaatgaatagcatatataacatttatttacttttacttagactccagggagagggaatgtgctcagttgggaaagggttgaaggagggacatgagaagaaatgagttggacataagaaatttagaggccgggcgcagtggctcatgcctgtaatcccagcactttgggaggctgaggcgggtggatcacctgaggtcaggagtttgagaccagcctgaccaacatggagaaaccctgtctctactaaaaatacaaaa

SEQ ID NO: 18555 - DNA, 602 bp, Homo sapiens
cttggcttgtagatgactgtcttttccctttgtctttacatggtcttgtctgactttgtttaaggacaccatttacagggactggataaggtcccaccctaatgatctcatttaacattaattacccctttaaagatcttatctccaaatacacttacattctgagacattggtggggggtggctagggccttagcatatgaatttaggggagaaactattcagcaaacaacactgtataataatgtttcccaaattatagtctgctgagcacttgtatccagatgtactttagtaacagattatactggtgaaacacattgggagaatgctaagtgatataccaaaaagtttgtgtttggttgagattgtggatctttttacaagctaagaatggtaatttccaggagagtgttataggcgttaggctttcctatatttatctgaccaaggaatctgaatttgtggtttagaaaaggctgttgcatatgcatagtaactcttttctttacttaaaagacaataatacaaatctgacaaacttgaaacatatatcttagggtgggcccaattatagatgggataagtaaccatctcaccata

SEQ ID NO: 18556 - DNA, 623 bp, Homo sapiens
ggggggtcaacagtctttatccttttatctcaccaggttctgctgtccaacatgcccatgacctagagctggagttcttaagtgcttttatcacttttcttaggacatcttgggctggctataaaaggaagaggttgagaagggaaagttagaaaagtgcaggaaagaggagctcataaaagtagtgtttcatgctggaagagaacgtataatacatcagtggttatgcaatggaggtccatctggacaggagctggggagactggggaaggggaggtgcctgggaagaggctggtgaccccgaccccagcacctgagctggagagcagcaaagagcaggaagcagagacccaagagggccacaagagaggctggagacgaactcctttgtgaggtctaagggcctcataaagactgctggagactgaatttgtcgacatggagtggtcctggattatgacctgctcaaacttatggttctgagatggcagaagtcaaatcagtgtgaaaattattttatttaaataagcaaggtatgtgagtcttgaatgttggatagaaaattcccctagaacttggccgggcgtggtagctcaggtctgtaatcccagtactttgggagt

SEQ ID NO: 18557 - DNA, 507 bp, Homo sapiens
gcacctgtaatcctagctactcaggaggttggggcaggagaactgcttgaacccaggaggcagaggctgcggtgagcagagatcgtgccactgcactctagcctgggcgacagagcaagactccacctcaaaaatatatatgtaataataacaataaattaaataaataaattgcaattcttggccaggcacagtgactcacacttgtaatcccagcactttgggaggctgaggcgggaggatcgcttgagcccaggagttcgaggctgtggtgagctatgatttcgccactgtactccaggctgggtgacagagccagactctgcctctacaacaaacaaacaaacaaaaatttgattcctgtatatggcactttctatgtagctgtgtagctggtggaggagaattcctggaattcctaataactccactgaagatggtctggagtcttccctcagagctcagcgcagagaaggtttgctcagcagagcaggtatgcaaggcaga

SEQ ID NO: 18558 - DNA, 550 bp, Homo sapiens
  misc_feature 510, 511: n = A,T,C or G
gtgtattttcattttcggatctggaatcagccattcctgcaggcagccccgttctttttggtaggaaatggtatttagagaccacagtgcagcatgacagtgctcagtgctgctgggttgatgatcatttctaggccttttcaggggacagtatcttcttaaagatagtttatatttcctttgagatcaaatgcatcatgaactcatactgacagatgattttgtgagccaggcaattgagcagggactggcggggtgattcttctgtttcaggcgtcctgaacagaagtcacttaattatattcagctgtgaatgggttggtttagagtatttgagtggctgttgacttccatgtctggtgacttgaagtggatgccagagggtgaggcttagctgaggcttaggccgagcacctgcagagtgcttggactcctcacctggcctcagggctcctagagagcatgttcagcagggccaggcagaaactgcaagagttctaatggcctaanngagacagggtcaggctgaagtgcagtggcatagctcact

SEQ ID NO: 18559 - DNA, 586 bp, Homo sapiens
gaacaaagagttgactacacaaagcagacagattccacccatgaccattagaacaaactttttctatgtcacactctcctttccattcctgtctttacggattatctctcttgtacaattcctggctctttcttcctatgtaggaattagtttctttaatgccaatccaggaaaagattaattgttctgcagagttattaagccaattcaaggatatgactccccagtacccttggatggattatgtctcattagagtcctttctgggaaaacaataactagtggaacaaatgcctaaaaatatcaaccccatcgacaggacagtcaattggacaatttgaactgacaattcaaaattgtccatgaagatttacctctcactttggctgatacagtaaataacacagtccaagccctgggggaacaatttaatttccttaactcaaatagttatagttaactgttatagctatagataatacaatggtgttgtattttctcttggccaacctaaaccattgctaacacttcacgctatacctgaactaacattacagatgaaatgaagcaacttatatctaagcta

SEQ ID NO: 18560 - DNA, 559 bp, Homo sapiens
ttactcaaaattctcctggcaccagttacttaactggtattaattacaattaatattttggcatacttcatttttattgcttatataataactagagttaccatagttaactaacatataatggctaataatgtcagttattattagcacgcaccaggcacactaataatagctaacattcttgtgctcttatgtgctaggcactgtgctttcatatgctttatctgacttaacacatgtaagttgcctaaggtgttacaagcggcaaagccaagaaataaacctgagactccagagcttgtaatattaacttctatattatgtctagtcttgccataagtatcttcagagaacagcttcaaaaatgttaaacctggctgggcgcggtggctcacgcctgtaatcccagcactttgggaggccaaggcggacaggccacgaggtcaggagttcgagaacagcctgaccagcatggtgaaaccttgtctctactaaaaatacaaaaattagcgtgtgcttgtaatcccagctactcaggaggctgaggcaggagaatcgc

SEQ ID NO: 18561 - DNA, 171 bp, Homo sapiens
caaaccataggactgtataaaacaaagaaataaattgtgctatatttaaattttttttaaatcaaccaagatgtggaggaaaagatgaaaaggagattatgacaaatgactaactttattacaaattaattataataaccacactggggtggatggggaaggagttgacct

SEQ ID NO: 18562 - DNA, 141 bp, Homo sapiens
ttctccctagctatgttatctgcaatacctagcacattgtatagcctcaactatatactccaaaaatatttactgaataagtgtaccattttctactccactacttatgatttcaacaaagtgccctggagatttctgatt

SEQ ID NO: 18563 - DNA, 401 bp, Homo sapiens
aagtagcaatgagtgtgagatgagccctagtgaaccaagtccaggagattattaaaatgacttttacttgccttccaaaaacataaacaagtacactcaaaatcttgccaaagaatcagacaggagcccaattaccatgcttccatccagaagagcattaaaccatacttcactgggttttaaatatagaaaagtagactgaatattccaaaccaacaaaaattcgcatcgctggaccacctgaaactcttcagtcacttcatttcattctgaagagtatcaccaatgtctatttatctcctatagtcaaatcataaaaccaaatgtttctccaaaaaataatgaagcccagcattgacaacctaagtgtaggtgcacagccagcatgaactataaggaac

SEQ ID NO: 18564 - DNA, 278 bp, Homo sapiens
acaaaggaagaggaagcagaggcaagaattaaatgtgatctggattggcttaaagcagcaatagaatgatggcctagaaataaacacaggctgaccggaaagctgcctccacaaacaattgcccaacagtcaactaaaggacgtgttgttttattaaggcaatttattattctttgtctgatagtggccaattcaactgggtgctacccaggctaccaaagtcattctgcagccactagagatctgcacactactggagatttctaggacaaagcact

SEQ ID NO: 18565 - DNA, 609 bp, Homo sapiens
ccagggggttccacatgggctgaacattctctgattaactctcccctcatatcaacaacttcctcctatcaagcttgacatcttgtgctatttcttcctattctaggtgtaggcaagtctagtttgctcttcagctactctatccctctcctgcatattgactcttgaattcttgatccctagtagcttctcacactgtctgtaaaatggagcatggaaccactacatagaaacaggaaggttctgccctgtactctcagctcttaagggcacagtcacaagaagaccatttttaaattctcattgtgtaacacccttacacattccacatgcatcatagcacataactctgacaataaactacaaggtaagcaactaattattccctttttaatattttttaaacctaggaaggtaacttaatctctttgacttccagttctcatgaactagaacattagagaatcgagatttgaaccagaggtgatggtttttaaaatatgtctgctagatatcaaaatgagtgcatgggatttgatatatgtacataggtaggcatagaaatagatagagatgctcaaggatatgtgtatatgcacatatgaatat

SEQ ID NO: 18566 - DNA, 500 bp, Homo sapiens
  misc_feature 423: n = A,T,C or G
atcagccactgtgcgtggcctggcttcagtcgtaattgcattttgaaaactgggcctgcagctctgtggataccacacatgttctatttgagcctatatttctctgctggccgaatttcttaggaacctgtgccaattgtttttcatctttgatcatcagcccgaaccatgctgtgtccacctgaggggacagtccagcatctctgtgccatggcagatggactgccggggctccacctggttttggaacctgcagtttgcaccatggctctcctgactgcagagccaccggcagctgctgtgtttcctcatttcctctaaccccagtctgtggggccttccccttcagcctgctgcagaacccatccctctggtcagttgaaaaatgtgggtaactgagttggaggtggcatgaggggactntctggaaaaggtctaaaagtctgtctagaggagcgtatacatgtgtgtaggtaagaatggcatcaagttgcacactg

SEQ ID NO: 18567 - DNA, 548 bp, Homo sapiens
  misc_feature 416: n = A,T,C or G
gaataaacagggcatgatgatgagtatcgccaccaagatcgctatgcagatgacttgcaagctcggaggcgagctgtgggctgtggaaatacctttaaagtccctgatggtggtcggtattgatgtctgtaaagatgcactcagcaaggacgcgatggttgttggatgcgtggccagtgttaaccccagaatcaccaggtggttttcccgctgtatccttcagagaacaatgactgatgttgcagattgcttgaaagttttcatgactggagcactcaacaaatggtacaagtacaatcatgatttgccagcacggataattgtgtaccgtgctggtgtaggggatggtcagctgaaaacacttattgaatatgaagtcccacagctgctgagcagtgtggcagaatccagctcanataccagctcaagactgtcggtgattgtggtcaggaagaagtgcatgccacgattctttaccgaaatgaaccgcactgtacagaaccccccacttggcactgttgtggattcagaagcaacacgtaacgaat

SEQ ID NO: 18568 - DNA, 431 bp, Homo sapiens
ttagtatttatataataactagagttaccatagttaactaacatataatagctaataatgtcagttattattagcacgcaccaggcacactaataatagctaacattcttgtgctcttatgtgctaggcactgtgctttcatatgctttatctgacttaacacatgtaagttgcctaaggtgttacaagcggcaaagccaagaaataaacctgagactccagagcttgtaatattaacttctatattatgtctagtcttgccataagtatcttcagagaacagcttcaaaatgttaaacctggctgggcgcggtggctcacgcctgtaatcccagcactttgggaggccaaggcggacaggccacgaggtcaggagttcgagaacagcctgatcagcatggtgaaaccttgtctctactaaaaatacaaaa

SEQ ID NO: 18569 - DNA, 591 bp, Homo sapiens
atcattcttatttttgtttttaatttttagagacaacgtattgctattcaagcctctctgttgcccaggccggacttgaactcctaggcttgagcaatcgtcttacccattgtcccttgtgacagtgactttaagtgattcaaaaggcctttatagaaatgtcttttcttataaaacaagcatactaactagaaggggaaaagaatatttaaatattgacagtcattaacaggatcactcaaacactttgctctatgatgtttgactcttcttagaggagtgcagcggggtatcacacagcttctgctcaggtacaatcatgttttcaaaagaaaagggctgggcgtggtggctcatgcctgtaatcccagcactttgggaggccaaggcaggtggatcacgaggtcaggaattcaagaccagcctggccaacatggagaaacctcatctttactaaaaatacaaaaattagcagggcataccagctactcgggaggctgacgcaggagaattgcttgaacccgggaggcagacgttgcagtgagtcgagatcgcaccactgcactcactcttgggcgacagagtgagact

SEQ ID NO: 18570 - DNA, 558 bp, Homo sapiens
tcctaatcatgctagtcacagtgtggaatgagataaaaaagaacttatactatggaaaattattttaatggatcattttcctgtagtaggcgtgtgctgagggagaaccatgtctgtgctccatgcatatcctctccacatgctttgaggtggagagatcaatcctttaaccagcccaggtggtcatggaagcattcctggaggacgtgaggccgtgtgagtgagcattccaggagagggtctagtgtgaacaaagacccagttacattggtaacattgtgaccaattgggtttggatgaagtaaaaaatgaaaggcatggagtagagctggagaaattttgcagggccaggttaaaaagtgacatttatgtccatctgaggagtttagactttattccatgggcatggaaactactgaaggatttcacaagggaagtggcatagccgtactttacctatagatcgtttactcttagtcatgtggaattaaaatttaagaggacactagaagggagaagacactgtggggtgttttgtgatatttcagaagagaaatg

SEQ ID NO: 18571 - DNA, 621 bp, Homo sapiens
attacacagtttgtagtattttgttataggagcacaaatggactaagacaatcctcataataaccgtctgtagcaagtttcattgttgtccgcgtttgaaatgtaagacagctgaggagcggggaagttatttatccagttgcaaagacactctgctgtagaggcgggaatcgatgccaggcttcttaatgctggacagttgtgtcttaaatagacacaacaatatcagatcaagaaaaaatgaaatgaaacacaaaatcagtaacccacatagaactaaaatcatcaagattttacgccttttttttctcttgcgtttccgcttgtcttgcaaatgtattacgtatttttgacaaattgtcaacaacaatgccactggtttgaattgcctttatttaaagtagcgatgtcacactttcttttatgtcaactgcacagtatttctcctttttatctgatctatagaccacttaggctactataagatcccatgattaccatctctacccttttccaattttgatgaaggagggaaaaataaaaaaacagtaactcaggctgggcgtggtggctcatgcctgtaatcctagcactttgggaggccaaagcaggtgaatcaca

SEQ ID NO: 18572 - DNA, 397 bp, Homo sapiens
aaacaaacctgttttccttatttcctaaacaaaattccaaaaaaaacttttttgaagcaaagatcatatgtgttttcaagtatcaagagatctgaagctttttgccaacataaagctaattaaacttcaagctccagtactgggggacacaattatccttactttgccatgtaaatagttaataggatttatttttgtgcttaaagaatatgtattgttgtatgtacttatatttgtccgtgtcagtcttgacccttagaattttgggcacagatggtgtatatctgacttataaccacagaaacaccaaacacaggagctaagaatattactaggggccagctagctccatgtcatcccaacatggcatggctcccactgtgggtaagagagatga

SEQ ID NO: 18573 - DNA, 305 bp, Homo sapiens
gaccttgccaaatgaccaaatgggacaactctaggaatgagccttcttagcgctgtgggacctgctgctgttagttggcctgcatatgcattctgaggaatgctttttggccaagaggggagaccgaggacaaagctctcatttttttatcttgcccatattcctttcaaaggagtcttgggagtcacgccctacaaaccatgaattctcatcagatgggttttatttaaccctatatattgtgacttaaattccaatctgactctggcataacattatgagacaaaggaaaacctaaaaatatt

SEQ ID NO: 18574 - DNA, 233 bp, Homo sapiens
actacctaattagttaggcagtaaacgtgtcattggccccagacagctgctattaagctattatcattggcatataggcataaattatatacttgaactgcatggatacagttcattaattgatgttttgagccatgataaatcagagagagagagactaggatagcaggggtaaattctgagttttaaaggaaaaagaagacagtggcaaaccagagaggacaggtctgaat

SEQ ID NO: 18575 - DNA, 520 bp, Homo sapiens
gaagttagaaagaatgtggttggttagggcttccaggcttccaaatgcctggaagaaggtgagtttttatatcagctccagcatctgtaggaaagccggagaagaacactagcatccccagcatcccttctgtggagctgaacccctcagcctctccagataggggatccttgttttcatccctggagacccagccctcttgcaaatggctctccatagaggcaatgtctccagagagacttaattggcaatgcttcactgagcacagaaacctgggatatgacagttcctgctctttaaattgtcaaggaaggcaatgtgctctgaactgcagctgctgggagtgcagggggacccatcttagagtctcctccgccttccagcctctgcttctgaatgttctgggaacaagaaacagcaacagagaaatgaacaggtagatggagcacgatgagcaacataagctcaactagcctttttatggtcaggccatgaggatcctggggaaggcaaacctggc

SEQ ID NO: 18576 - DNA, 222 bp, Homo sapiens
tctaagcagatgaggatgggaatgaggagacgttagacccactagttctttggttctgagattggttcttcttgcctgccttacaactcctgctgcttggaatcgttcatacgaaaatagatacacccagaacaaattatcttaaccagattctaaagcagaagcgcttagccaactcatagaattatttaattatttaatattggcactgcaaggagctta

SEQ ID NO: 18577 - DNA, 538 bp, Homo sapiens
ggccagagaacaatgcgaccaggtaagctaccagctggagtaaaagagatggcaaagctaaaaggcatatctcattctggggaaaattaacctcccaattttgcccagtaattgattccatctgactgaggcgtttcagcctccactgtgactgtcatttgggtagctgggaagcgaaagcctgtaattacagtcatgcaaccctgttatcagagcctggggagggctttcctctcttcctaccctgggtgatcacaggtgaggctgaccagagagggaggaaggagagaggggcaagcaggctggtggttctttctccatgggagagagacccctaaggcaaccccaaccatggagaaaaggtcagaggtcgcagggagtcctcttgagttttcatgatatgaacatgaagaggccagagcttcctgcttgctgcaaattcttctctccagggagatgctttgcctagatagagctaataaagagcagggagtgtgattaacagagaattagaagaattcttctaataccatctata

SEQ ID NO: 18578 - DNA, 94 bp, Homo sapiens
taagaacatgcaacatgataaagtgaaaattagtcatacatagattaaaatatttatggcaatgtgctcactcaacccattcctgcttttttct

SEQ ID NO: 18579 - DNA, 586 bp, Homo sapiens
catcctctgtttaaaggaaagtggagcttacatcacagagcacagattcataggtggaaaatgcctgcatccagcacacagggtccctccctgcctgtaaatgatggggtgcagttaatcccatttgacaaatgaggcagcatgcaacaaaagtaattttaattaattaagggattcagagagatgaaagagtggtccttcgttgtcatcttttcccatatagtttataagagcatgacaacatcttaccaacaaagattttgctgtgaggctgggaaaaacgcccagtgtgtcatggttaagagtaagggctgctaagatgggttgccttggcctacgctgcagggtggctgggatctcgtcaccgacaggccactgctactcccacatcccttaccgtgtcccattttacatttcaccctctcccctctgacacatccattttgggtaacccttctacaatcaactggtaccatgttcagtaaatacaaacttaaatctgtgaaacctgggtccacacttgaaaaagctttcttaagcagtcttcttaccaaatgcagatttgtttgagcattcttttggtagt

SEQ ID NO: 18580 - DNA, 574 bp, Homo sapiens
tgcctagaatgctccccaaccactgtctagcctctgcatcgcacctttcaactgtcactttcctacatagccttatctgaccctccagccaacatgtggttttttggaaacatgttaaagaatcaatttcttttcctgcataagttatttagcctatattatatccttgcctctatgattgataaaggcttatcgccttcactatatcaccagatcagtgagaacaagtacctcctacactcataacagtgactgacacatagaaagcattccataaaagattttgttaagttgatgagcaaatggatttttaaaagtagttaaagttttgatgaagatgtccataattgaacaatcaacattctgagcacgtttatgaaaagggaggcaaaataccttcattccagaatgttggaggaagaaaaggtttatctgggattacttaagtagccatcagtgaactctgagggaagattctgggattaagaggaaagagtaggaccataaaaagggtatgtgcacaggagagtcagaagaaatgaggaggagctgagggaaggacagactgatttgg

SEQ ID NO: 18581 - DNA, 446 bp, Homo sapiens
actaggcttactgtaagagctccaaaaatattttctgacatatgttctacttatatgtcattatgtaaaaataaaacaaaattatactcatgcatgataacatctgtattttccaactgcgaagtttgtgtaagtgatctcttgtaagatggaggtctgaaacataaacagtttatcacttgttgctggagtaacaattggcagagattgccctaaactctaatgacattttactctccccaaatcagatcgataggtttttgaagtgcactcatgttgaattagaacaataataaacagtttttaaagaaatgcatgaaaaatacaaagaaataacaaaaaataccttttaaaatacacatcttttcacctttttgaagcatttttacaaagttaaggggtgtgtgtctgtgtgtgtgtgtgtgtgtgtgtgtgtgtgtgtgggt

SEQ ID NO: 18582 - DNA, 596 bp, Homo sapiens
  misc_feature 455: n = A,T,C or G
ttatgtgtttcaactttatgcctgacttataataatagttacaaatactacattgctagtaacaccaatatctaataccatttcctctttcctaatttcttgcagttgaagaaatggagatgagtatgtctatatgcttcactctttcctcagcaagatttatttagcatatgttttgttccaggcaccggctaagtgctaggggtacaaaagttgttttgtctcccttccttccagatgtgtccatgtgtccaggctaacagagtgagtagtcacacaggcaaatcattctcctacagttgtcaggctgaaggctgacttggtgtcataaataaaaaggcagaagatatttgtattcattgtcttggatgatattttcaacttgagtaggcagattgaaaagaaaaatgcggccgggtgcagtggctcacacctgtaatcccagcactttgggntcctgaggtcaagagtttgagaccagcctggccaacatgatgaaactccgtctctactaaaaatacaaaaaattagctgggtgtggtggcaggtgcctgtaatcccagctacttgggaggctgaggcagaagaatcacttg

SEQ ID NO: 18583 - DNA, 450 bp, Homo sapiens
gagtgcagtggcgccatcttggctcactgcaagctccgcctcccgggttcacgccattctcctgcctcagcctcctgagtagctgggactacaggcgcccgccaccacgctcggtcttgtgcctttcttaaaggagaaaccccgtgtatccaaagactgaagaaaccagtttctctaccctctgaattggccctctaggctttctaagatatgttactagctactcacctacataccaaattctggtaggagaaatagaaatggatgctaccaccgacttaaaagagagcaggctactcagttattagtgtggtcctattagtcttttcttcacagaaagatctgtctgtatgctgggtaacaagtgtttttggagacttagggaagggtctggactttgccattttctgcataaggtagagaaagtgcttttggggaacagcatttctc

SEQ ID NO: 18584 - DNA, 549 bp, Homo sapiens
  misc_feature 165: n = A,T,C or G
cagaagggcggcttttcatcaggaaggaagcagaagggataaggatttggcatgcttcaaattgagaggaaaaattaccactgttgtgatagatggtttgaaaaacccatcaagtgggtaactagatcttatagccagactgcagccatcaggaattctaactcntcatttgtattgcagaggaattacttccaatgttcttccagtcctggcccctagtataaactgctgttgataggagatgcagtgagttgtctcccagaaacttgaaagtgagggaaataagatcaccttcaaagatgtatgctgtgaaatcatcatataaatgatccaagcagaaatggctacagtcatcttatagcagtagcagagcttggggcctgagtgtgtgtggcagactcaacagaggtgacattaacctgacttaccatgttagcatatctgaagagtggaagaactagctaatcagaaggtggaagcctcacaaaaggagcatcctgacacatatggtgacagtaccgtcctagcatggtctcaagagcgggagtg

SEQ ID NO: 18585 - DNA, 551 bp, Homo sapiens
tcaggaacgagggacaaagatcaaatattagaaaaaaaaagacattcctatcacccctaacataagggtcttaggagatctatgttacgaactggaaacaaggaccaaatacatatttcttattatgccagatttatgaaagccatggggagggatctggaggaagttccccaggattttctgaaaacattgtaaactttatttatgaaggaaaggaagaaaataatatgcttcagttgggatataagtgtttatcacctgcgaatacatgtggtagaggaaaatgtctaactctctttcttgggggtcacaaatatgattaaatttactatcaccttataaagccaaaagacaagtacgttagtgaaatgatggcaggtataccctgcactgggatttatgttctatgatacaatcttcacatgaaaaacatactgaaaagcaatagataaaacaaaacagcagccttagaggagtgggttttgtttcagcctccatgggcatcccatgccatcgtgtccagctgaaagcctttcacatgatccaccctg

SEQ ID NO: 18586 - DNA, 486 bp, Homo sapiens
tatcagtcattacccttgctcaagcccagactgggtcatctggccacagcaggagatgcagcgggcaacagcagcaggagatgcagcggggaacagcagcaggcatggagctgagacaagatttcactgtgaagacagtttccggggagaggctgggtccgaagctgcatctccatgtccggccgggcctggtggctcatgcctgtaatccctgcactttgggaggctgaggcggacagatcgcttgaggtcaggagtttgagaccagcctagccaatatggcgaaaccctatctctgctaaaaatacaaaaattagctgggtggtggtgggtcagcacctgtaatcccagctacttgggaggctgaggcaggagaatcacttgagcctgggaggcagaggttgcagtgagctgagatcacgccactggactccagcgtgggtgacagagtgatacgctgtctcaaaaaaaaaaaaaaaaaaaaaa

SEQ ID NO: 18587 - DNA, 567 bp, Homo sapiens
gggaattagaaaatttactggcagctttattagttaattttactggacaatagtgaatttggccgtgtcaccacattaaaatgccatcataatattcccattatgtagaatcgcatttatattttccatctgcttctcaggagatctttaagagccaagatattggcttttttttttcctttttatgcatttaagactgctaatgaacccatcagccaaagagcaaatatttattgaacacctacaatgtgcaagggaccggaggaaacacaagaggttgaagactttgtgtccaagaagttgtagtctgatcagagagaaccagactttgcacattaaaactcataagttattaaaagtgggtggctgggggcagtgactcacacctgtaatcccagtactttgggaggctgaggcaggaggattgcttgagcccaggagttcgaaaccagcctgggcaacataatgggacctggcatccacaaaattttaaaaaattaggcgggtgtggtagtgtgcacctgtagtctcagctactcaggaaactgaggcagaaggatcgcctga

SEQ ID NO: 18588 - DNA, 530 bp, Homo sapiens
agtgctgtagggcctcttctccaaaagtctagattctgataactccattctcttccctttgttcccataaccccagggagagtagctgtttcctaaagtcagtgtcccatctttgctttgtcaattctctaatatttatcaatttccttgtattagatcctctcttttaaaataccaagtgtgaggaggctgggtgcagtggttcatgtctataatcccagtatttgggaggctaaggcgggaggattacttgagcctaggaattcaagaccagtctgggcaacatagtgagatctcgtgtctaaaaagctctacagttaaaaataaatggacaaaggccgggcacggtggctcccagaactttgggaggccgaggcaggcagatcatgagatcaggagatcgagaccatcctggtcaacatggtgaaatcccgtctctactaaaaatataaaaattagccgggcgcattggtgcactcctgtaatcccagctactcggtaggctaaggcaggagtactgctcgaacctg

SEQ ID NO: 18589 - DNA, 588 bp, Homo sapiens
ttcatttagagatgatttacatttatttaatgatagaatgggaatacaatgggagggaagcaatgactgagacaagccacaaaaacacgtctagccttgagagttgcaacgaatattcccagccaaatgagtctgtttaatgtgttttcatgcatgcaagtttatctgcttagctcaaactgtttgaacttacagtcccatcatggttatttccaatatttttgaaaacaaacatatacttacacatattttaaaaaatcaccactctgcaatatttctgttgaatcagaccttacgttatgttgtttaataaagtatggtaagttttggcatgtatgatttttatcatataagaagcataatttcttagccaaaaatttagcctttgactctttagtagaaagttgagttctgtacattgtgttctaaagatagacaaaaatctagagattttcttctttcaaagtaaaagcagatgaggcctttttccaccctctgaggcattaaattgctttgctcaagttagacttttaatatatctaatttgataaatgtatctgttaatttatgtaattcagcaatatggaa

SEQ ID NO: 18590 - DNA, 544 bp, Homo sapiens
accgtatgaaaagaagttgtcaatacaattaacttaataacatctacctccaatatgtgaagtatcaacatgatacaatgaatgtgaatcacctcatgcagagtcactgcagcagagatattacaaacaaatattgttacttataatggaaggaaaacatgggttattgtttaggtgtaacatgctgtttgtttgtatctcttcctaaattctgtttagtgggaatttatttgtgcaaatggaataaactgagaatgcacattgcattatgtgatgtcagggtccatgcgagttggcatagcattatgttgaggtctttgtaataaacgcgatgactaagcctgtgggaggtataatggcatctatgggaagagtcaggcatcgtcaattccacagtgtaattgatcccaattaaattttcggcactatttccatttcaactagggaggcgtatacttcttaatctcaattatagtaatcttacttatttcattttccttgaaaaatcttaaaacgtgtaaaaatacttgacattatctatccc

SEQ ID NO: 18591 - DNA, 145 bp, Homo sapiens
aagcgtacaaaactcctttgtttttagctggtgaggaaattcttctctgagccctcagaaatttcatcattaaattgtgttactgctgaaatacaatgctcataaagtcatataatctccaagctggacagtctgagtgtgaaca

SEQ ID NO: 18592 - DNA, 318 bp, Homo sapiens
tgactctaaaaagtgagtcagattgtctctgggagcaaagaaatttaccttaaaaaagtatggaagattgctcatcttggaaaaagccaaaatgtttttggctagattataggcttagaaacaactagaatacccaactcttcacagaaggctgagtaatgatttctgcctttccaaatctctgtggaagcctcttgggctagtataaagggtaaataaatgagtgttcctagaaacagcagtaaaggaacaagaaatagttaaatcttctacatggtaattcagtgcttttaatatacttacacccaatattctcat

SEQ ID NO: 18593 - DNA, 92 bp, Homo sapiens
aaattgcaaaggttgtcataggactatggaggccattaggctaattaaaatttataatattgcccatatatttgtactaagtctcattcctg

SEQ ID NO: 18594 - DNA, 398 bp, Homo sapiens
agggcccaactcctatgccattccagctcttaactgaagcatatatgaaccattaaggtgttatctggagataagtcagctcttgtcttttccccagggacgtttgtattataagagggaacttatagggactttctagacagggatatatgttgggaagaagaaggggaggttagaaaggaataagttggatttgaaatgattgtcagtttccctaaactttttatcggaaattccaagaagctcagaagcttttaggtaaactgaaattaaaataccaaactaaactacagcacctattatacactcacatccttatctcatttgaacctcacaacaaccctgtgaggtagtctgggtcattggccctaatggatagatcaggagagtcactatta

SEQ ID NO: 18595 - DNA, 591 bp, Homo sapiens
gtagagacagggtttcaccatcttgtccaggccggtcttgaactcctgacctcatgatctgcccacattgacctctcaaagtgctgggattacaggcgtgagccactggctgcaagctggtttttctgtgtacttcacttatgcgtgtctattgaacacctactatagctccatgcaaggcattggaaacacgtatagaacagacgtacttcatgtccttgacatgaagaattgaaaaggttagagaaaagtgtattaataggagaaaagagtttctgaagtggacagtaccatctaagaagaaaaattggaagtaaaaggctgggaagaggcaaagaaaattcaagaccagagtcaagaaaagagtataagccgggcgcactggctcatgcctgtaatctcaacactttgagaggcagagacgggtggatcacctgaggtcaggcgttcaagaaccagcctggccaacatggtgaaactccatctctacaaaaacacaaaaattagccacgcatgatggtgggtgcctgtaatcccagatactcaggagactgaggcaagagaatcacttgaacccgggaggcggagctt

SEQ ID NO: 18596 - DNA, 517 bp, Homo sapiens
ctttatactctaaacttttttccttctcttccgtagacttttctcaggaccaagcacctaactaatgattgatcacctttctaactttggatgattggtaaaactgacattgtcctacttatatacacaaaaaatatattccatttcaatactttaatgtgtattctacctcagtgctattagaaccacaaaatgtttaaaagtggaacatccttagttatttttgttacctaggttgcaaagttcagtcaacatcaacaaatatgtattgacatataaatgcaatgaaggattttccatggttaaactaattttttgccatttttaaagcacttttatatctattatgtcatttagtccacacaacaacctgcaagttggaaagggcaagtataattttatcactggaaaaagacagaggttaaatgtcttgctaaaggttgcacaagtaattactagcagaaccagatcttcaacacgagccttctggcttctaatgcagggtcctcccactcca

SEQ ID NO: 18597 - DNA, 615 bp, Homo sapiens
tcctctgaacttaaatcatagttaatcccttacctttttctatgcctcagcagcagtactcactcatccatttattcatgctttcagagaataattggttgggcacatagtatgtattaaggtcatagtaagacttgagagttaggggcatgaaaaacctagcctttactctcttggaacttgcagtctagttcatggtttctacatttaaacccaactagattatatcacaatatatgttccagaagtgtcccagatttggaagagtggaggaaagaggatccatgcgtctgtgtagaaagaaagacagctttaggaccgagtcagattttaaagtattaaggataaggaagctattcctagcagacctaatagcacatgaaaagtcatgacgaaaatgtctgatggggtatctgtagcaggatgggctagaaagttggctaaataaaagggactgagatgaataatatgacatgagtttgtagacatagtcaaaccagattatgggggcttgaaatcctagcataagtacatgagttctatatcatgtagtgtggatgtgctcacatggataagagtgtgtgtgtgtgtgtgtttctgtgcgtgttggaggga

SEQ ID NO: 18598 - DNA, 546 bp, Homo sapiens
ggaagctagagaactaggaccggaagaagaactgagtgttcggagatggagaaatctctcatcatccttgcagaagacaaatttgatatcctctgtccttgtatgctgttttcttaccatagtctgctgaaaggtcaagcagaaggaggaatgaaaagaggacattggatttagtgtattaaataattcaggcaacactagcaggagcaatttcagtggagtggtggatgtgaaagagccaaagttggactgggttaaaaagagtttagggaggctgggcacggtggctcacgcctgtaatcccagcactttgggaggccaaggtgggcagatcacgaggtcaggagttagagagcagcctggccaatatggtgaaaccctatctctactgaaaacacaaaaaattagctgggtgtggtggcacatgcctgtagtcacaactactcgggaggctgaggtaggagaattgcttgaacccagaaggcagagattgcagtgagccaaaactgtgtcactgtacttcagcctggtgacagagcaagactc

SEQ ID NO: 18599 - DNA, 626 bp, Homo sapiens
ccttttctggcatagtagttttaaagcagaaaatacacctagttagtgttgcctataatatacatacttccttgccttgttaaggtcattttaaaagttactgcacaagccatattgtgattaaaaaaaaatcggcctggtctcaatcatccattaagaaaaatctactattaaatattccaatacagaaatttcttttaaagagcgtaatttttagttttctggtctctttctacaatgtacttgcctccctagtacctgcctcaatttccgacatggtttttagaagaaaaccacttctaatctcctcttagctgagaagccaaataatcttattaagaaatatatgttggccgggcacggtggctcacacctgtaatcccagcactttgggaggccgaggcaggcggatcacgaggtcaggagatcgagaccatcctagctaacatggtgaaaccccgtctctactaaaaatacaaaaaattagccgggcatggtggcgggcgcctgtagtcccagctactcgggaggctgaggcaggagaatgtcgtgaacccgggaggcggagcttgcagtgagcggagatcacgccactgacttccagcctggacaagcgacagagcaag

SEQ ID NO: 18600 - DNA, 517 bp, Homo sapiens
taattctgtttatgagaggaatcatgtttatttatttgcatatattgaaccattcctgtatccctggagtaaaacccactttattgttgttatattatctttttaaggtactgttggattcagtttgctaggattttgttaaggatttttgcatccatgttcatcagggatatcagtctatagttttcctttttattgtatccctctcatctttggtatcggggtgatactgacttcatagaatgagttaggaaggcttcccttctcccaccagcaacacatttgtgcagcccattgtcccaccaccaccaacgtaggcacacacacatagacactaccaggtagaccttgtcaatgcatgagcaccctgccatgccctgctgtcaccctgccccagtcagtgattcacctccattgacatgtgtggaccctaatgctcctgctggcacatgctcctttgcacaaatcttgctgccactgccctgatgaaccactggccagcacacccaattggaat

SEQ ID NO: 18601 - DNA, 306 bp, Homo sapiens
agggcctcaaaactagctataaatttcaccattttcacatgtaccaccacccctattatactgacccactaagacaggtaacaatgttatttatatatctacagtgctttccattaagtgagcaaaaactttacatttaaggataaccttgccacatccctaaggaattgtgagaattgtgcaactcaggtttagcaagtgagccattaaacttaattctcattcaaacttagtttgaatgacctttgtttctatgcggtaccacaagaaacataaaatctaacttatctagtgtcttacaacttt

SEQ ID NO: 18602 - DNA, 426 bp, Homo sapiens
cttggcttgtagatgactgtcttttccctttgtctttacatggtcttgtctgactttgtttaaggacaccatttacagggactggataaggtcccaccctaatgatctcatttaacattaattacccctttaaagatcttatctccaaatacacttacattctgagacattggtggggggtggctagggccttagcatatgaatttaggggagaaactattcagcaaacaacactgtataataatgtttcccaaattatagtctgctgagcacttgtatccagatgtactttagtaacagattatactggtgaaacacattgggagaatgctaagtgatataccaaaaagtttgtgtttggttgagattgtggatctttttacaagctaagaatggtaatttccaggagagtgttataggcgttag

SEQ ID NO: 18603 - DNA, 390 bp, Homo sapiens
ctggtgtgctgtatgtactccggaaggtcaagaaatacatacgggctacaaggaaaaatatatgaaatataaagtatgtttccgtctaaggtttcttggaaactctagttgaggcttttacaaatgtgctttttagcatcattcttccaaaagtaccttttaaaatgattctcaaggcttcacaatatatatatttttacaaatacttatttcccaacatctgtaaaagtgtaaatcttagagtattttatgctgaacttacaaatttggtactgaagacaagtatttcttgcagtctgccaaatttctgccacactggaaaatacacagatgattgtttaacattctgtgccatcagacaggaattatatttcacatcttttttttttt

SEQ ID NO: 18604 - DNA, 494 bp, Homo sapiens
tcacaggggaatgttgggtgttattttatttcaggattctgatacctactctaccacttgctggctatgccatcttcacctacttgcacctgttttctcttctgtggataggtgatcatacatcccagtttgcctgggaacacctagacctaatcaaccgcaggagccacttgcactctcaaaggtggcctggtttgtattaaaaacactggggggcctggcgcagtggctcacgcctgttatcccggcactttgggaggttgaggcgggtggatcatgaggtcaggagttcgagaccagcctggccaacatagtgaaaccccgtctctactaaaaatacaaaaattagccgggcatggtggcaggcacctgtagtcccagctactcgggaggctgaggcaggagaattgcttgaaaccggaaggcagaggttgcagtgagctgagatcgcgccactgcactccagcctgggcgaaagagcgaaactccatctt

SEQ ID NO: 18605 - DNA, 343 bp, Homo sapiens
atccatttatccatccacctcccattcatccgtccaccctttcctccatccatctacccaccattcatctgtccacctattcatccacctatcattcatccatccacccatcattccatccatcccccattcatccatccagccacctaccaaccctgcatctacctacccattcatccattcatctgtctatccacccaccatgtatccatctaatcttattcaaggagctacagcatgcgggaccatgctcagcaatgtaaagacaacgattaacagttcaatcatagttcctgtcccaaatggactcccatctactgcagtttgtacccagggatgtgga

SEQ ID NO: 18606 - DNA, 471 bp, Homo sapiens
aaatgactcttttgcagaaaggagtctggaatgatatatccaaatgcatgagtgatgaactctaaagagtcagattattcacaatatggtctttcttcttttttattatctacatcatctaaagtttctacagtaaatatctatgaagtttgtaatgaaaaacctttttgttgaacgtatcaaaatcagattaaattatgaaactataggaatacaaagggtttaagactcagtggctaaaactaaaaaataatttaataaaagttgcagataaaaatttttctgagctagaggttttatgctctattccaatttttcaaaagaagaaatttttcttgtaagccggagatgtataaacaagggtctaaaaccaattttcatcaatcactgaaagaaaaggtaaaacataaatattccatgtcttcaaatgtaatcggattcacattcttcagatacacaaattaaactaac

SEQ ID NO: 18607 - DNA, 488 bp, Homo sapiens
aatgcagctaacagattatctgagagactggccttgtggtaaatcatactgagagcctgctaggagatataggaagaattggaaatgggtacacacaaaactaagcaaattaacaatcagggcaattattaacttcaggagaaataaaaaaaaagtatactacaatgttcagttattgatatttgcataacaatgtaaatactgaatattggtatattgtaaatggtaatatagctatattggggcttataactaatttatctatctataataaagagaagtcaatggatatcttgaaattatgaatcaaaaggatcaatatttatttagaaaaatatgctgggcacagtggctcaagcctgtaatcccagcactttgggaggctgagacgggtgaatcacaaggtcaggagttcgagatcagcctggccaacatagtgaaaccccgtctctactaaaatataaaaattagtcgggtgtggtggcatg

SEQ ID NO: 18608 - DNA, 572 bp, Homo sapiens
ttattgaatagcacacatacatgcccacagtagacatcagacaagtaggatttaatttccttttacttccaaaattttatgtgagtacttgtcattagcaacatttaacctgaagcttgattttcaaagaatctaagaaattaaggttccggtattttagcctttgcagtacttgagaaagcacaggaagatgaaagaatattttctggcacagaaagacattaattgctttgagctgatatgttgtaagctctaagtaatccaaattctaaaattatcaatctccttgctatgctgaaagtagaacacagtgaagagcatatgtaaaaaatcagaaaagtcaattaggaatttattccattagttaagaaaagaggtatcaggttgatatcaggatggcagtggtagagttggtaaaatgtagtcagattctggaaatattttgaagttgaaatgaacaatgcttcctgccagattgaatatggagtgtgggggaaaaggtggagtcaaagaacattggttttcttgagcaacaaaggattgagttgccatttatgcagatgtgaaaaact

SEQ ID NO: 18609 - DNA, 500 bp, Homo sapiens
caaatacattacatgaaagaggtggggctatgaaaaattatctattattagctagacgtgaatttgtttctaaaatgagacccatggactctggagctgggagaaagaaccagacaactggtaagcatgggtcctgccaggtggggcagacttgtggaagtccctgttcattgggaggaagcattaggagagctctgagagatgaagagggagtgacaaaaggaaggagagcaaaaaaagagaggcagaagaaacaccaaaaccaaatgtttcctctttaaaaatgtttgcttcggtcaggcactgtgacttatgcctgtaatccccgcactttggaaggctgaggagagaggatcacttgaggccaggagtttgagaccagcccgggcaacatagcgagacccctgtctataaaaaaacttagaaaaattatccaggccgggtgcggtggctcacacctgtaatcccagcactttgggaggccgagactggcagatcac

SEQ ID NO: 18610 - DNA, 574 bp, Homo sapiens
ggctcaagcaatcctcccacctcagcctcccaagtagctgggactataggcgtgtgccaccatgccgtctaatttaattattattatttttgtagacacgaggtcctgacatattgtccaggctgacctccaactcctgaccccaagtgatcctcctgcttcagtttctgaaagtgctgggattacccggacacagattcatcttctactcttctgctttgctctgtgccctgggtggtagactcctttggactggatcccttgtcaaataggttctgggtgcttccagccaatgggaggtactgtgaagtgagtgtagggagggaggagaaagaggttgtggtatttctctgccccatcattgcttccgttcatctcgagcagtagctgcattcctccacaattcctgccaggtattctgttcatctggggttgcagctctaacttggctcgaataaaagcaattcttcctttaattccttccaccctggaggtgtaatggcttcctgctgctcctaatctctaagcactgcatcctctctagatttatacttgtaaccctatctacatatca

SEQ ID NO: 18611 - DNA, 434 bp, Homo sapiens
tacagtggcagtgaggagagcgagcactggcctgaacacggtcgtcatggggaccctgccctacacaccctgaggccagtaaccgctaaggagagtgggcacagggcacgtgttcaggaggcccggggaacctaacagccatggcctgtcctgaggccatctttgccttcatgtgcctggggtggccctcaggtttccctgaggagctggaaacggtcttcaggctgacctgcaccacccctgtcccagcctcctcctctgagcgtcagtgtcctccctgggagcacgaggacaacgtcagccctgaaaggccacagtacacagtaagacgtgaatgatgtttccctggcctggccagtgcctggctcagccgcgtagccactggtgtctggtattcctgaagaagtggaaggaaatccttggcagattaaaaa

SEQ ID NO: 18612 - DNA, 453 bp, Homo sapiens
gtttctttgttctaggaccccagattagcctctgttaactttgtatgcgtgtgttggtgtgtaggggggttagtaagcaaactatatttgaagaataatgagaagaataaaagctgctaacctgtttctctttctccaaaaacaacgccataacatctggtgtgtgtagaaaaaagatggcgggccgggcgcagtggctcacacctgtaatcccagcactttgggaggccgaggtgggcggatcacctgaggtcaggagttcaagaccagcctggccaacatgatgaaaccctgtctctactaaaaatacaaaaaattagccgggtgtggtggcatgtgcctgtagtcccagctactcgggaggctgaggcaaaagaatcgcttgaaatcgggaggcggaggttgcagtgagccagcactgtgccactgcactctagtctcagcaacaagagc

SEQ ID NO: 18613 - DNA, 359 bp, Homo sapiens
aggatagaggagcatatggaaatgccatctctgaaaaataccattacagaataggcaacaaccttgagttagttggatacaaggaactgggccaaatagcctcttgaaactactttctgctcctcccttcttaccgtcctttcttcctttcatgcatttactgcaggtaacgcatgatacaagtttttttaggagaaagaaatgtggagcccaaaacattgctaatatagaaggaatcaggcttaatttagcatgtttcaaagagccgtgtccaagtcatccaaataaagaccttatttggcaaggtcagctgccctttaaatcaaccctcacaagttaaggtattgtatatggtactc

SEQ ID NO: 18614 - DNA, 437 bp, Homo sapiens
ctcttggagtgcctcaaatctcactgtgcaggtcctcactgctctgcctgtacttatatctcggtctgttggttgctttcattaattcaagctgatttactaacaccaagagtttctcagacaaaatctgctgtgtcagtcctatgagcaggcagaaagataggacaatatgaggtgacatccaaattacaacacaggtggactagccaaggaaaacatttcgctttcaggaagcagtgtgctgtttgttactctagggtgataatgttatgaagaacataaagacaagttatttttgaatgtgtttggggttttctgtaataatttttaccttttttctggtatctttaattcttatttattctaattccagaattgaaaacaagaaagcaaagctcccattatttctacatacatgatatgttatatagaaaatc

SEQ ID NO: 18615 - DNA, 588 bp, Homo sapiens
tgagaacttagcataccaacagcaggaatctgtgttttaggtgtttgtttggctgaatgcatccatactggggcccttcattgtagattgtccccgtgggatcaaagaaaggcacataaccatccttgcccgtacaaagatagactttctccagctggagtttgtaagcagaattaagattttgttctggattccaaagtactcggccataaaggatttgacctgaaaagattgaaaggtattaattaggtcagactttaagatgaaagaaaaacaaatgtcaagggttgaaaggggttaaacatgctcccttaagagtgaaaagcacttttctatgaagagctccatgattccatgtgcccctaaaatactcattcatttattgcttcgtttttattcttattttctttttttctctgagttttcttgctagggaacatttatgccttcttttttttcaataagcattaattaagcatttaagggaagcaaagtattctgttatgcacaggggataccaaggtgtgtgagatgcagttgagaggatggaaacaaactcacagtgattgactaaaataggctcatatt

SEQ ID NO: 18616 - DNA, 457 bp, Homo sapiens
attatccctaagaatatgtaaacgaggtcaaaccccgatcctatttgcattcccctccccacgggtaactatcttgaatcagagccaatactacactattgcattagggtataatttaatcattaggggatagttttcatgcagaaactagaaagcactgatgagattctactcatgttcctttaccagctttagttataaaggggaagcgggaaaatggaagcacgtagaggataaggtgataacctccaccttaccatcttccttcttcccccttaaaaaagaaatggaatgttgagtctatctggaatgttgacaggttaaaaaggagctgttgaagcctgtcgttcacagtagcatcgaaaggtgaaaatttgtctccacttgagtaccttgaaatggcaggtgtgttattggaatattgggctattgttggtcagtactgctgagtatagac

SEQ ID NO: 18617 - DNA, 438 bp, Homo sapiens
gtttcaacatgtgaatgtgggggaggacacaattcagtccacagcgggtactgtaagactctgggaattaccctgaactagtttattccaagcaggtggccctgagctgtgcttcctttaaaatctatttgtagccttaccagactatattatataaactcctctccacatggccacctctaaaacttcctcagcattttcagaacttaattttgtccaaatgcttcaagtttcttccagatgtctgccatctcccagatacagctacttagcaaaatcagagacattccctgtcatggagacacggcccagttcccatgtggttccagggaagatttggtcaaaacattgcccatttctacacagtgtctaaatggaactagcacccaatggttaaagaatattctcagccagggaccgtggctcacctctgtaatc

SEQ ID NO: 18618 - DNA, 559 bp, Homo sapiens
cacacagattgttagtggcagatgtagtgttcaaaaccaggtagcccagctccagagcctactctctaaactgtctttgataagaaatgaattttaaccaaagaaaactatgctttgctttattatgactttggctgaattgctggggtcagcaaactttttgccagggaaagctgttctgcagatgtcaagaggaaaatgaggttatagatctcttcctgtctgggatatatatttattgtacagtagaatgtaatctaaattattcacagtttatattttatggaaattttagcttctgtaaatctgagttagatttcaggactagagttatgtgtaataaaattcttataaaatccatttaaaagattaatgatagatgtagaaaattaaatctgggtattttattttctccagtttcctggatcttccaatttcatttgcagagattgtctttgtgacaaaaatcttctctttagatttcctggggaaaggtaagagcaaagtggctttctttgctggtcctgtggatacagaacatgctcttgaaaagaaaaga

SEQ ID NO: 18619 - DNA, 494 bp, Homo sapiens
atagaaattacagactacactagagatatttcataccttcaggttatttgtaaagaaatggcaaatattacctttatcatttttgacatttatgttaaatgagataataatcactgctatttgaaacctgtcatataggatttgagtctgtctgctggtcaggaatatttgcctcaccccaggatttaaagtacttctagaaagaagccaaaggccgggcgtggtggcttactccttgtaatcccagcactttgggaggccgaggtgggtgaatcacctgaggtcaggagttcgagaccaatctgatcaacatggagaaaccccatctctactaaaaatacaaaattaaccgggtgtggtggcgcatgcctgtaatcccagctacttaggaggctgaggcaggagaaccacttgaacccgggaggcgtaggttatgatgagctgagatcgcgccattgcactccagcctgggcaacaagagtaaaactccgtct

SEQ ID NO: 18620 - DNA, 581 bp, Homo sapiens
catcttacagtacagaggatgtgggatattaggacccatcacccctccctctactgtctcccactgtcccccaaaggccctccagtaaagaaaccatactttgatacacaaagaaaagaggatgctcttgagcttggaattttggaagctacctacaaactgtcagtcatgttcatagaaattctgagatgcaaccaatcttcatctataccaagctactatagaaaaaaatcagaatatgagaatagaaagaaggcatttgatgaacattccctccaatacagaatgaacaagccgaagaatatgctagcaaaacacttcaaaaaaaatctgcaaacaagcatgttaaggtattaaaaaatgtactttgaagtagtaatctaattactaagaatagaaatggtcaaaaaaataggacagcatgaaggaaaattaactgaattcaggacaaataaaatagaagaaaaatacatcatatcaggaatgaacataaaaagcacccaacgaagaattgattcatatgaagcttaataaggagtatagaagaaaaacagattaccaaagagaatgaagatgagacg

SEQ ID NO: 18621 - DNA, 509 bp, Homo sapiens
aatgcagctaacagattatctgagagactggccttgtggtaaatcatactgagagcctgctaggagatataggaagaattggaaatgggtacacacaaaactaagcaaattaacaatcagggcaattattaacttcaggagaaataaaaaaaaagtatactacaatgttcagttattaatatttgcataacaatgtaaatactgaatattggtatattgtaaatggtaatatagctatattggggcttataactaatttatctatctataataaagagaagtcaatggatatcttgaaattatgaatcaaaaggatcaatatttatttagaaaaatatgctgggcacagtggctcaagcctgtaatcccagcactttgggaggctgagacgggtgaatcacaaggtcaggagttcgagatcagcctggccaacatagtgaaaccccgtctctactaaaatataaaaattagtcgggtgtggtggcatgcgcgtgtagtcccagctactc

SEQ ID NO: 18622 - DNA, 539 bp, Homo sapiens
ggtagccacgtccaagagtatttgttttttagtctgggaaatatctcctgcttgaaactatattctgtcttctgctctcaacttttatccctttcctatgtttcctgacgtctgtctgtagacccctgttggtaatgggtatgtgtgggaagataattatgggtcagagaggccttctattgccaaggggagacatggtacttcatctctcatcctcttcctccacctaaacaccattttaacttttgctgccttgttaggaatgtattagaggattccatgttttataaagggataaaccagaggagagggccaagatcctgagattctgtaaatatccaatggaccactcttgccatccccattgtaattgaggcaatggaaaaaggtagcctacatctatgatatagaattaatctttgttaattattattccatctacattgtgtgccatacatgtgtgaagatgtaaaatgaataaagcacagaccttactgttaaggagctcagagtctagtagaaagagagatgcataaatc

SEQ ID NO: 18623 - DNA, 553 bp, Homo sapiens
cctcagtaattttatttgtgtgggggcctaaatgtttccctactagtcttttcggaaaacatgtttgttttaatttcatcttccctcactttatttaggtagaatttttcccccttcatttctgaaattttttgctcaccgccatgtttaaatggggttgaatcatagcgagccatgggctcttgccaaagtgagatagatgtactgaggagataattgaaaagtcagactctgtactgtggggctttaatcggagcactgctggaaatgattgcagagaatgtagtgcttcatatatccatgaccaagattgacatgttgctcacaacatgtcacaatttagtgaggagctacatgtatttccaagaattccagcatagattataatttaaataatcgaatttggtatttaggtacattgtttatatagccaagtgtatatgctttactacctaacaattattctagcctaggtgaatccctaattgaaacacctggctaacactttagacacataaattaagtgggatacagttttctcatttgtattatc

SEQ ID NO: 18624 - DNA, 627 bp, Homo sapiens
ccattagaggaaaaaacttagcctttatgccaccctctccaccattaacaacattggcagccctattaaagtacaagtcagatttgtgtttaatgatcttgaaagtaaagtaattgcttgagtgttaccattcaaatgttcttagaagtgcagataatatttacaattggattgtccttcggaaggggtaggcaggcagccttcctccgctatttgaagctgaggctggggagaagtgacttcagcaattggcttatgggtctaaaagctcagcgtttattttcgtttcttcttttcaatatcaagagactccagagcattagccatacctcattccttcaaggaaggagatgctgagaggaacaatttgtggtgcaagttaaagcacaaccaaatagctccttgggaaaacagcagaaggcatttgtgttgagtcagtatttcaggaatttgggaagccagattgtatctttcctgagagaacagtaaaaccaaatcaaaacgcaagggccagacacgatggcttatatctgtaatcctagcactttggtgggccaaggcaggaggattgcttgagcccaggaatttgagaccagccagggcaacatagtgagacccagctctaca

SEQ ID NO: 18625 - DNA, 636 bp, Homo sapiens
ttaagatctgattataagccattttattaaagttttccagtatgtaacagtttaaaaaattataaagtcattcattcctatatttcaaaagtataactgcaatgcaaaacctttcatgagttaattgggccacatgtcagaaagagagttgaatttcacagtatgtgatcctctgtttcatttcaactcattttagattttcagagtcaataaatgaaaggaattgaaatataaatattcaacttcacctacgttgttatatgtgtgctttaagtattagaataaattgaatctatgtgagctattcatgtgctcaatttaaaatatgtaaacaagttttcaaaactgatacacatagtatttccttatacaagggagattatgcatagaaattaaagtattgggtagaggatgaaaaatatttgattagttggtgaaaaaaataacttaaagtgtattataggtaataaaattctgtaaataccatttttaataatcactgcaaaatgaagtaaagtttatttagcataaaagcagtaggaaataaatgttatgtttaaggaatgagaagaccctcaaagtaggtagccttttgaatgaaaatgattgaataaactaattccttaataagggaaa

SEQ ID NO: 18626 - DNA, 459 bp, Homo sapiens
gacagaagggatcctactcaggtgaaaaataagaattccagatacctcaagcatctggattgtgatagaatacctagacaaagcatcccttcttaggccgacctcatcctcgcttctcctcaacccctgaaaataaaaaacacatctgatagaaaaataatttccttgattatgaacatggataaagaaaaacttaaaactaaaaggatttgataaaaataattataaaagttcaacagaataagaatatttcaaacacaggcatgcatgccttacacacacgtatttctaaaaattatagggttttaggctgggcatggtggctcatgcctgtaatcccagcactttggaaggccgaggtgggtggatcacttgaggccagagaccagcctggccaacatgacgcctgtaatcccagctacttgggaggctgaggcgtgagaatcacttgaacctgtg

SEQ ID NO: 18627 - DNA, 607 bp, Homo sapiens
aaggagtgtggcttgaagtcttttgattctctttccaatgagatgtatataattatggaactgaaaactcacaactaaatggaagtcagaagtgatcatagagtgacagagtttgccaggggtgtttagagtcagtcctaggaggcaacctttaaacatctgtgagagtgcctagaaaacagggctcaattaaaggagactcaacaaagaaataaattacataatgaaatcccagttatttgcataaatttctatactaaatgatatacagaggtcccttacttaacctgtgatttaatgacctgaagtgtacctctctaacaaattaatctcgcataaggactgtttattattgtttgctacaaaataacttctaggcctgtaattccaggatcacctgaggtcgggagtccaagaccagcctgaccaacatggagaaaccccatctctactaaaaaacaaaattagccgggcgtggtggtgcatgcctgtaatcccagctgctagagaggctgaggcaggagaattgcttgaacccaggaggtggaggttgtggtgagccgagatggcgccattgcactacagcctgggcaacaagagcaaaatt

SEQ ID NO: 18628 - DNA, 512 bp, Homo sapiens
aatcccagcactttgggaggctgaggcgggtggatcacctgaggtcaggagtttaagaccagcctggccaacatggcgaaaccccgtctctactaaaaatacaaaaattagctgggcctggtggtgcatgcctgtagtcccagctacttgggaggctgaggcaggagaattgcttgaacccaggaggcagaggttacagtgagctgagatcacgccactgcactccagcctggccgacaagtggaaactccatctcaaaaaaaatagaatacaggtgggtttacaaaataattttatgaggaaaaagaccactaagaccataaaggaaaatactgccaagtttgacaacataaaggattttctaaggcttaaaaaaaattaataatattgaaaggcaaacaaatgggaaaaacatatgcaacaactgacaaagcattagcagtagttctatatataggaagtatatgaataggagtaaaatgaccaataaacatatgaagagatttcaatca

SEQ ID NO: 18629 - DNA, 566 bp, Homo sapiens
actgagtaatgtagtatattattttttcttcacagtgttgcattattttatatgttaacaagtagtagcttaagtaaccgtatgttttgtagctgaggaaatacctgcataatgatccagagtgttttaggagcagtatatttcaattatttttcaaatgtgatttttcaaaaaaagtctgtgtgaaataattgcaaaggatgattgtgaaacagaagaattttaaaataggaataagaataaatctgagttgagtagtttttactgtgttttgatgtatatttgtatttgtgtttctcttcttgaccatctattatttaaaatcatttctcacataaattaagaaagacgtactgagttcttaaatggttttgatagtagacatttcctttggagtacatttgtcatttcttgtactgcagtaaatgtgttttgagtcatgatgtctttaatagtaccaatttaggccgggcgcggtggctcacgccgatcacgaggtcaggagatcgagaccatcctggctaacacggtgaaaccccgtctctactaaaaatacaaaaaaatta

SEQ ID NO: 18630 - DNA, 632 bp, Homo sapiens
tatggttaagtcacttcaattagttaaaatagttggatgagaacacaatagaatatttcaagcaacagctgagtagaagattttaatctcattacaactgatgtcagcattctacctgaggcaaaactaattgcagcagcttcctcccacagccccacctcaccacatactcatcccagataaccatgcaaaagaaaatgtactaataaaggaagagttttcatttgcgcctttacagtcatgtataagctagagcacaacgtcccccatgtacctaacagaaagtgtccatgccctttcccacgcctctccttagtgccaatatctgggatggaatgctggctggatgtgctattttatgagaacaaaaggaatataggtgtcttcaaggaggatgaacctaatttagagtctcaggtcaaccttgagtaagctactcaacatctcagaacctcagtttccttgtctataacatatgggctccgtttgcttttaattctcttgaagaattaaatgaaagtatgtacctctcagagccagtacctggctcagaaaatgctaaataagtacatatttgactccctgagttggcaatgacaaaacagtggaacttggaggagctcacataactc

SEQ ID NO: 18631 - DNA, 669 bp, Homo sapiens
tgatctcagctcactgcagcctctgccttttgggtttaagcaattctcctgcctcagcctcctgagtagctgggactacaggcgtgggccaccatgcccagctaatttttgtatttatagtagagagggggtttcaccatattggtcaggctggtcttgaactcctgacctgaggtgatccacccacctcagcctcctaaagtgcttggattacagacgtgagccaccatgcccaacctaatactatgaactttctaagaaataataccaattatccccaatctattctaaaaacttgaagaggaaggaattctccctaattcattgtacactgatagtggggtaatgctggcattaccctggtatcaaaacagacaaggattattctgcattatcctgctatcaaaacagataaggatgccacatcaaaaagacaactataggccaatatctctgatgaacatagatgtataaatcttcaacaaaatattatcaaacagaatccaacagcacatcaaaaacaaaacaaaaacaacaacaaaaaaacccacaacatgttcaagtgggatttatcccaggaatgtaacaacggtttaacatctgtaagtcaataaacgtgatccatcacattaacagaatgaaggaccaaaactatatgatcatctccat

SEQ ID NO: 18632 - DNA, 567 bp, Homo sapiens
agccaaaatctatatggtttcttatgatttttttccctaatggattttgaatccctggaggtcaggggttcatactctccacagcaactggaagtagaagcccttacaagtaatatctggaatctttttaagtttgaaaatctaatggctatttgtatcagatttatatgtcctggctcttaataacctcctagcctacctgataaacctgtgaaattgcactttcttccagtagataactatgctgttctcaggtgaaatacttcgcttatcccttgccagtccagcctggggaaggcagctggacctgagctgggaattttatttgagggagtggaaataggaggggttggccaaggctgagttagaggggacagctctttagtggcctgagctggctctttggtgcagccgaagattgttagaattttagaggtggagagactttagagatacatcccagtcctctattttacagatgaatgaaagtgagtctcaatgatgttaagtgactttttaaaggctacagaaggctgggtgtggtggctcacgcctgtaatcccagca

SEQ ID NO: 18633 - DNA, 637 bp, Homo sapiens
actatctggtggcatttacttagttcttagaactgactaattagtttatcggttaaagtaatttgctattatattgtaaaatagtacatttgaggctcacttataaaaattggaaaacatcgaaatataagaggtccaagagggtgtttgaaacacattttgctaagttgacaggaaattaatagactttttatgggccattaactaataatacactcaaaaaaaaggtacagttaaataaaggttttaaatagtctataccgtatactaaaactaaattaatatttaggactgaaataacatattgattaagtaccagctatgtacccaaaaaatgctgggcacagaagttagagtaagatgttttacttaaagggcctttgagtgagagttggcaattcattctgaactaaccactaatatcattaagaattagtgctgagttggtagcaggaaataggtaattctgtctaaaggaatcatgaaatggaaaataaataagcttttaataaggagaaggaagagctgaagaaatggcacagtgttcttagaatgacagatagtcctatggggactgcagcataaaagtgaaaaatgtataagataaacctttagatggtaagcaaggcaagattct

SEQ ID NO: 18634 - DNA, 646 bp, Homo sapiens
atattatgtgatttggcagatgtcattctttttctttattacaaaattttaaatcactaccatccctctggtaaatttaaaaagtaaggcctattgctcatcctaaaaggtagagcttgcccaccaatgatagactggataaagaaaatgtggcacatatacaccatggaatactatgcagccataaaaaaggatgagttcatgtcctttgcagggacatggatgaagctggaagccatcatcctcagcaaactaacacaggtacagaaaaccaaacaccacatgttcccactcataattgggagttgaacaatgagaacacatggacacagggagtggaacatcacacactggagtctgtctgggggtggggggctaggggagaaatagcactaggagaaatacctaatgtagatgacgggttgatgggtgcagcaaaccaccatggcacgtgtatacctatgtaacaaacctgcacgttctgcatatgtatcccagaacttaaagtataacttttttaaaaaggtagctctttcccaattagctgttttatctctatcttatttcctattatctttttctgtaaattatcaaactttaaggaccatcgaagtctcctgatagatgcctttatgaagttaaaaac

SEQ ID NO: 18635 - DNA, 623 bp, Homo sapiens
gcatttgatgtttgaagtaaaatacagcaaccttacatagagctttataataagcttcatgtgttcaaatataattggtacttttataaccgatgctgtttgtgttatactcagaaagttatttcttatcgtaagattaccaatatagtcaccaaaattttttttatagtttgaattaattttctacatttaaataaaacaagcgctgctgctgttgttactattcccttttaacatctccccaaattagtgttttattctgtacactttatgagatgccagcttaacaatacccttaatatggcccaaggattttacaaaaggaaatgctggtgtgtttgtcaaaagtgttttctggctgggcatggtggctgaagcctgtaatcccagcactttgggaggctgaggcaggtggaccacgaggtcaggagttcaagaccagcctagccaatatggtaaaaccctgtctctactaaaaatacaaaaattagctgggcatggtggtgcatgcctgtagtcccagctactcgggaggctgaggcagaaggatcacttgaatccaggaggcagaggttgcagtgagctgagacagcgccactgcactgcagcctggacaacagagc

SEQ ID NO: 18636 - DNA, 591 bp, Homo sapiens
ttccctcgcttcattacactctcccttcccttataagcaccagtccaaaggctagaccactgaaaattctgtagctcccctgggtctggccacccctgtgcaactgtggcaatccgtgtgggcccgggggaatgtctgtggaagagggtggttcctgtaatgtggacagacagaggctgaggttccctgggcagaaaatgctcccctgaggcctgctcctgtagtatggcacccgcagccacagttctggtcctggggagggagagcaatggggagtgagttggtagtgtggtataaagacctcaaaaaatccccaaatcaccaccaacattagtgtttgggtccatgtgggcagagaaactctcttacagtttggataccagtggtctgccacagagccaagaggactcagatcattccaacctgccactttgatgaaatgtcaagtcgcgatcacgaggtcaggagatcgagaccatcctggctaacacggtgaaaccccgtctctactaaaaatacaaaaaattagccgggcgaggtggcgggcgcctgtagtcccagctactcgggaggctgagtcaggagaatggc

SEQ ID NO: 18637 - DNA, 602 bp, Homo sapiens
  misc_feature 156: n = A,T,C or G
ggaatgctgtcgggactgagcaggcaatggcctaaaaacaataaaaagccctactaaaagctggttttctttttattattatcctgtactgacaattcttagtaatatcagtgatgaaataaatcactggggaagacctctcccacaccagccccncggagtcttgctctgtcacccaggctggagtgaagtggcgcaacctcggctcactgcaagctccgcctcccgggttcaggccattctcctgcctcagcctcccaagtagctgggactacaggcacccgccaccacacccgactaattttttgtagttttagtagagatggagtttcactgtgttagccaggatggtctccatctcctgacctcgtgatccgcccgtcttgtcctctcaaagtgctgggattataggcgtgagccactgcacccggcttccgatatctttcttaggaaggatacatcatcatttaaataatgaaagcaatatatattcactgtagaacatccagaaaaatttgaaaaaatatttttaggagagaatcaaaattcacattaactccaccacttattgataatcatagatctttatgtcattattactt

SEQ ID NO: 18638 - DNA, 635 bp, Homo sapiens
accactgatccaagcaactggttctcccttctccactgggctacagctctgagcttctgcacaaagagtggagtctccatctttaaatattctgcttatttttcaatttgtcattatactaagaggtcatgtgtgtggattacttactttgtgctgggcagtatgctaaattctttatacatggtaactctttatgcttgtaacttcgtgaggtatcacagtcctcatttttacagatgaaacttcagcccagaaaggtaatttgcccgaacagcaaattctgaaactggaattggtggctctggtgcccaagcttgcatatttagaccaggcatcagtaatagcctcagttttgtttattgctttgttaagccttagttttgaagcacttgttaagtgcgaggctccatgtagagtgtataaacactcaatctctgtgtgacgacagctccaaggagcagtccagcaagttctgtctggccaaatctagacctggttttgattaactttgttcatgatctctagatcactctgctctatgcttgaacctgtatgcttgagtcaagcttacctctctgatgggtgaagaaaatgatatttcactgttatattaattttatttttcttaccacaaa

SEQ ID NO: 18639 - DNA, 622 bp, Homo sapiens
gtgacccacttaagattccaaccatctctattttactccaaatcctaaattcttagccattatgcatcactgccttgacagctgttttgtacctgcttccttctccctgcagagtgcctgctgcactgtaggtatttaatatatgtgcttagaacgtgaactaagctgaaaagcacaccaaccaacaagtttttttgatgtcattctttctatttaaaaactgttgtgactaatgagctattttaggtctggattactgtggctgaagtaacagatatgtgatcaggtcctcctcatccccatgacacatagagtgtatgcttcccaatactgagagtcaccatttccttcctgtatattcctggtctttaatataacctcaaaccaaattccattatattgtgtacttgatgctaccattactcagcatgttaaacgaatgccataggccaggtgtggtggctagcacctgtaatcccagcactttgggaggccaaggtgggcagatcacttgaggtcgggagttcgtgaccagcctggccaacatggtgaaacccatctctactaaaaatacaaaaattagccaggcatggtggcgcactcctgtaatcccaggaactcg

SEQ ID NO: 18640 - DNA, 588 bp, Homo sapiens
atttacccttgtatttcccacagtacttcccatagtgagttacccttagtaaatactcagtaagtttaattgaatttaaattacctgtaagtcttaaaatgtgggattaaattaagaatatattgtcctggaaatacccaaatgtctattgatggatgaatggataaacaaaatgtggtatacacataatggaatattattcagccttaaaaaggaatgaaattctgacatgtgctacaatatgatgaacctggaagacattatatgtgaaataagccagacagaaaaggacaaatactatatgattccacttatatgaagtacctagagtagtgtaattcatagaaacagaaagtacaggttgacatccaaaatctgaaatgagaaatgctccaaaaactgaaactttttcaatgccgacacgatgctcaaagaaaatgctaattggagcatttcagattttggatttttggatttgggatgctcaactggcataatgtgaatattccaaactctgaaaaaatctgaagtctaaaacatttctggtctcaaggattttggataaaggatactcaatgtgcaacatgt

SEQ ID NO: 18641 - DNA, 660 bp, Homo sapiens
taccctcctcctcttcagttccatcaaagtgaaaccagatcaaatggattgacttagtagagccagaagcctgtgtgtggggtgctgttggggtgaagaagggttaaattcaagaaaaattgtcagagacatatcaaaaggaggcatttcctgatgcccaccagaggtaggcttgcgaatcaggtcagccagccacagatgtgcaggttgtggcctgcacaaccctaggaagcaccaccagcttgaaaacacaccactgttttgtagatttattacacttttctgggagacactttcttgttctaacaaaatctctacataatgacaatttttccaacagatgacagtaaagcgtcttgagaaagtgtaccttttaaaaaattcacatggaggtcccttatgggctagccctggccctgagtaagttgaatccatggaaaatctaaagaatcccttttcaggccgggcatggtggctcacgcctgtaatcctagaactttgggaggcctaggcgggcggattgcttgagctcaggagtttgaaaccagcctgggcaacttggtgaaaccccatcgatacaaaaaattagccaggcgtgctggcacacgcctgtgatcccaggtactcagaaggctgaggtcggagaatcgcttgagtctg

SEQ ID NO: 18642 - DNA, 637 bp, Homo sapiens
tttcccaaacgcaggttaccttggcatcaaatttctcaagtgtctggctccgaggtggatctggaattttcagcctctttgtgatgttagcagggctttttatttccatgaaatcttgaggtaacagagggtagggaggagagagcaaacactgacatcccagactgggaaaggggagagatggtggaaactgagaccaaaacactaaaaactgctgggtccatttttcttcccactgggaattcaggcaacagcatcaagggctggtacaaggcatagcctcggagacagacctgcctgtggcctggcaggatctcctgcttaagggccttattgccctgcttcattaacaaccacggcttagcaacaatctgccagcaggggtcagtctcggtcgccacacagaagccaggaggctctctccagctacaaagccacgctctggaatgttccagaagttgttcggtgccactgcacaacactcagcttctcttcctatcttgtcacctcggcacctgtttcctagtttttcaagattgcatttcatacttagagaaattaattaccttatattcctgtggcagaatttcatactgagctaaataattataccaagttccccatatcatgtataaaa

SEQ ID NO: 18643 - DNA, 592 bp, Homo sapiens
gtgtattttcattttcggatctggaatcagccattcctgcaggcagccccgttctttttggtaggaaatggtatttagagaccacagtgcagcatgacagtgctcagtgctgctgggttgatgatcatttctaggccttttcaggggacagtatcttcttaaagatagtttatatttcctttgagatcaaatgcatcatgaactcatactgacagatgattttgtgagccaggcaattgagcagggactggcggggtgattcttctgtttcaggcgtcctgaacagaagtcacttaattatattcagctgtgaatgggttggtttagagtatttgagtggctgttgacttccatgtctggtgacttgaagtggatgccagagggtgaggcttagctgaggcttaggccgagcacctgcagagtgcttggactcctcacctggcctcagggctcctagagagcatgttcagcagggccaggcagaaactgcaagagttctaatggcctaacctcacgagacagggtcaggctgaagtgcagtggcatagctcactgcctggaactccttggctcaaacaattgtcacacctca

SEQ ID NO: 18644 - DNA, 668 bp, Homo sapiens
gggtctggatgatgaaccacagtgtctagtacaataatttctcttatgtgagcttcaagagtgatattgagttaatgtttctatatcctacttttttgttttgttgttttgttatgactttgttctcttaacaattaattttccaccttagtgtttcttatactgaggaattgtagctacttatactacagaggaatgctgaggaattgtagctacacatgacgattgcaatttcaaggaaagggaatttatgctgaaatatttgaataacttcccctcttagtttttactatgtcaaaaaaattcatataaatgtatccctttacacaattggtctactgaaatttttggtgaaactaaaacacagtattgccttttttactgtaaaagagaaaaaattaaatagatttatgtacagagacacctattacaaaaaatatttttaaatgaccctacactgtatttgcataaaagacttaatttgtcatttccttagaaatgagaggttaggggccaggctcggtggctcatgcctgtaatcccagcactttgggaggctgaggcgggcggagttcgagactagcctgaccaacatggagaaaccccgtctctactaaaaataccaaaattagctggaccgtggtggcacattacccgtaatcccagct

SEQ ID NO: 18645 - DNA, 549 bp, Homo sapiens
tgatagcaaatataaatgtttatgagtaggggcatgggtggtgtagggttgattgatacacaaaggcctttgtgaggactcgtcttcatggaagtttaattattgcaagtacttttttaagaaagcatgacaggaacaataaaccttaaactcaacaatgattgctacctagaaaaatatgcttgaaatattgtctttttactatattagaaaagttgattcaatacaaaataagctcctaatgtagaagtgatcattaaaaaggtaaaaaagtggatcacgaggtcaggagatcgagaccatcctggctaacacggtgaaacccagtctctattaaacacacacacacacacacacacacacacacacacacacacaaagttagccgcgcgtggtggcgcgcgcctgtagtcccatctactcgggaggctgacgcaagagaatggcgtgaacccaggaggtggagcttgcagtgagctgagatcatgcccctgcaatacagcctgggcgacgagccagactccgtcccaaaaaaaaaaaaaaaaaaaa

SEQ ID NO: 18646 - DNA, 588 bp, Homo sapiens
tctgccaagtaaagaaaaatccatcttaaaatattttgctatactatggattttagtatatatgtttttcttctagtttctataaccaattatggtcctatatgaataataatggttttcatatttataacaaaatctaaaattagttatatttatcctactggcggtgcactgagaaaattctactacatttgagcttaaaaaataaataagccttaatgcctcaaatgtatataaactgactcataatttgatattcagcctttgaaagtggttttgggggtacacatttaaagatgtatgtaggccgggtatggtggctcacacctgtaatcccagcactttgggaggccgaggcgggtggatcacaaggtcaggagattgagaccatcctggctaacacagtgaaaccccatctctactaaaaatacaaaaaattagccaggcgtggtggcgggcgcctgtagtcccagctacttgggaggctgaggcaggaggatggcatgaacccgggaggtggagcttgaagtgagccaagattgcgccactgcactccagcctgggctacagatcgagactctgtcgcaa

SEQ ID NO: 18647 - DNA, 655 bp, Homo sapiens
tgcccatggctatattgatttgggaatatatatggatactaattatgttaggattcatacaattccttgagaggcacaagtgctaaaaattacttgtatgaattatttaatatcattgcaaataagatgttattttaactttttttaagtttctgcaaatatgtttattatgactttttatttttatatgattggaaatacatatactaaaattccacgttaccagtttcttaaccacagaaacctgaaaaattgccatagttgatttgttacttctaccttggtgcatttacaaaatagtcatatttttattatgaagttaaatattcatttgtttatagctacttcagaaggctcaggttatttttttctttaatagcacagagtcctctcaaggtaagcactgtgcagttagtataaaccattattccccatgtgtacatgattcacagtttgtattgtgttccaagtgaaccatagccctttcagaaatcaagacttatattcattttacttctttgagtactcttgaattttagaaagtccattatgatcctaaggtagcaacaacatagcctattaccgtctatgatggtttacagatctattattccacgttagttcatcactatcaactaccatgatagagttaagc

SEQ ID NO: 18648 - DNA, 635 bp, Homo sapiens
atgcatatttattaaaagtctctgaactccaaacctcttgccaatgtttcttaagcctgatgattcctactattgctccacaacgtgtatatgggagttcccatgtaggaagaaaaatagcatccttgtataactaattaagaaagattaaaggaaagcaaagaatttaactatctttacacagaaaaggtggccggtgttttagtgagtattttctcaaaatctatacccatgcctggcacatattaagcactaaataaatctgttagataaatgttcaaataattagcctaagcttatagacaagagtctaaaacattgatggcaaaattcccaaaatgcaaaataactcaagcaataggcattcaaaagtattgatttatattacagagtcaaaacaaggtggagagtatggattctagactccaggcttggattttggctctacttctttgacatcttgttataaccccctgagccaaagtcttctcacccgtacattaagaaaaataatattggccaggtgcagtggctcacgcctgcaatcccagcactttgagaggccgaggtgtgcggatcacgaggtcaggagatcgagaccatcctggctaacacagcgaaaccccatctctacg

SEQ ID NO: 18649 - DNA, 616 bp, Homo sapiens
tacaagctatgaagccaaattagacgaggaagcaagttacagtcttgatgtgtgacagggtagaaatcagccttaaaaacaatgcatgagaaagtgacttgataatgctagaagctgcaattcccaatgtagacatgacaggagtatctatgcaccacataaaacagcagtcttcaaaaaacggaaactgcaggataggtaggaataaaaaaacacattcataaaggttaacattgccactctgaatccaagacaggttaagaggccaaaatgaaattatctagaagccttcagtttctcatggatatgataccaagcattgcgcttcaataacagagaaaacacctttccaacctcccttgaaacgtttatggaaacttgccacatattaagacacaaaggaaacttcagtaattccacaaagcagagacaatctaaacatattctctaaccacagtacagtaaaactagaaattaaagactcaaaaattccctactggaaatgttactaagaatttgttcaaaatggtaacaccttgtatcagaatccatgatgcaattaaagcaatgaggcaaagaaaattacatccaaaatgaaaaagaaacatcaaatgca

SEQ ID NO: 18650 - DNA, 637 bp, Homo sapiens
ctagagtgttacgatttcatgggcaaaatacaaagttgaagtgtccctgataacacatagcaagcagcacatttcccaggaaaggccagcactgcttattctcacagaagtcacccctgcaagggttctttagatcagtggttctcaaattgagcattcaagagcatcccatggaaggcttattaaaatgcaggttgctggcctcagagctcagattcagtagaagtcagttagagtctgggaatctgcatttctatgcatccttgctctctctccctcccttcctgctgctactgctggttcagggaccacactttgagaatcactgctttggatattagaatgatgattctctcaagtcttgaaaaaaaattgcgaagttccctctaatttagcagagttaagacaaatgtttcatttaatttgcatctatacatagctctgatggactaatcctttataattcaaagggaagaatttaaaaatcataatgatgaggctgggcacagtggctcacgcctgtcatcccagcactttgggaggctgaggcgggaggatcacctgaggtcaggagtttgacaccagcctggccaacatggtgaaactccatctctactgaaagaaaatacaaaaatta

SEQ ID NO: 18651 - DNA, 630 bp, Homo sapiens
cttatcactaagaatgctttatctgttacagtctgttttgtatagtattaatatagtaatatgcagctttaaaaaattatttgttcaatatttacttttctatttattttcaatcttttatgctcttatattttaggtgagtctataactgaatgattataaagatacttgttgaattcaacaaaagccatgctttgtgaaaaatttttagcctcaaatgaacataaaataagagaagaagggctaaaagtctatgacctaagtatataacttaggaagttagtaaaataacaagtaaacccaaagattccttgaaaaccctccagattccttgaaaagactaacaaaatggacaaacttctggcaaggcatataaattggggaggggggcaaagaagaaacaaacaaataatggtaggaatcaaaaaggccacaagagtgtctatgagtgagtctcagccaggctcttccagaggataattgacaatgtctgaagacatttttgaccatcattatttagggagtgttactggcatctagtgggtagaagccagagatgctgctaaacatcctacaatgcacaggacagcccccacaccaaagaattatgcagcccaaaatgtcagtagt

SEQ ID NO: 18652 - DNA, 654 bp, Homo sapiens
agggcaggatggagggacgtacagcctgaaaggacactgccatggtccaggcaaagggtcaaagcaggaacagatgaagatgtatctcctttaaaaacaaacaaacaaaaaaagacagtttccctctgtcacccaagctggagtgcaatggtacaatcttggctcactgcaacctccacctcccaagttcaagcgattctcctgcctcaacctcctgaatagctaggattacaggcgtgcccagctaatttttctatttttagtagagacgaggtttcgccatattggccagactggtctcaaactcctgacctcaggtgaaccgcccacctcggcctcccaaagtgctgggattacaggcttgagctaccgtgcccggccaaagacgtatctctaatagtttttgtttttgcttttttgagacaaggtctcactctgtcgcacgggctggagtgcaatggcacaatctcagctcactacaacctccacctcctgggtttcaagcgatcctcccaccttagcctcccgagtagctgggactacaggcacatgtgtctacacctagctaatttttgtatttttagcagagacagggtctcgccatgttgcccaggctggtcttgaactcctaagctctagtgatccacccacctt

SEQ ID NO: 18653 - DNA, 648 bp, Homo sapiens
aacactaacccacagggaggatgagagaggaaagtgcctcctctggctgaaactgccaggatgccctctacttctaaaaacatttggtattttccatagcgcgtttctataacaaaaaatatgtgctagttcccgttagctggaactgacatgtggaaggggccaggtcttgtggggcctggccaagactgcccccctgtgtacagcaagggaggacctgcggttccaccagagccagagcagggccagaggccgcaggggcacctctgagctccaacaaagccagcaacaccccataccgccgaacagacagaaaggcgggccaggggccctccatgtcctgaaagacccagcacagcactgtccatttcacaccaggattcttccaacatgagaaagcaataacctttaatattcacgtgctcattcaacttaactgggggcgggctcagtggctcatgacagtaatctcggcattttgggaggccgatgtgggtgggtcacttgaggtcagaagttcaagaccagcctggccaacagggcgaaaccccgtctctactaaaacatacaaaaaaaaattagccaggcattggtggtgtgctcctgtagtcccagctactcgggaggctgaggcaggagaactgcttg

SEQ ID NO: 18654 - DNA, 657 bp, Homo sapiens
atgtcagcaagcactgaaaatggggaaactgtcccttcctacctctgtaggctggagacctcgggttcagctccatttatcagggcacaggaccttcctgttctgagactttgttccaggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaatcttttgcccagaggggttcctcagtaaatgctggagatgaggctcagacctgacctttggattcccagatggagtgctctgaaccgtgtacctggggctgtcttcaccactcaaatatcgatagagataacatagagatgtcctcaggaagataaccaactgttcccatcctgtgtggtctacagattgggagatagggcctacccaagtgtagaaataaacattttttacaacatagagaaggctgagaaccaggataccaatatcaataaaatctggatatcatagagcacatggaagctaaagaaaaataagtaactggtcaggtgtggtggctcacacctgtaatcccagca

SEQ ID NO: 18655 - DNA, 253 bp, Homo sapiens
gttggctgccttcatttcagctgcataagattggttggatccagagagattgtcctcactgatgctctgagccagccttgaggaaccaccacatctgacctcattctgtttgctgtgacaagagagggcagagttttgtgatattgcttttgaagacaatgtcatcaagatacaaaagccatgggaatagtgtgtatggtgtgtgtatacaagggaaatggggaaatggtgtgggatgtgaacacaagtgtgt

SEQ ID NO: 18656 - DNA, 662 bp, Homo sapiens
gagccaactcttagggcacattaatcttgaacttctggcctccaggattattaagaaaaattttctgttgtttaagccactcaggctgtggcattctgttctggaagcctgagctgactaaagcagaatcatgcactcactaaagaaacttctgaaaaatgcacataaggaagaagaactgaaatcaggaataaaatgatgagtaaagttacagtgatgcatatcagggaagatcaaaataagtaatgactgcacaaaacaatattaaatataaggattggattgagagaatatatgcaactgtaatagaattattgagcaacaataatatgcacatttgaaaacggtgataaagaatacaaaagatctattatttggaaagaagtagagatatgactcttttgtctttaacttaagaaagcacataaggccccgcgtggtggctaacgcctgtaatcccagcactttgggaggccgaggcgggtggatcatgaggtcaggagatagagaccatcctggctaacacggtgaaaccccatctctactaaaaaaataaaaaaaaaattagccgggcatggtggcgggcgcctgtagtcccacctactcgggaggctgaggctgaggcaggagaatgacatgaacccgggaggctgagcttgcag

SEQ ID NO: 18657 - DNA, 667 bp, Homo sapiens
gctgggattatgggcgtgtgccggcacacccggcttatttttgtatttttagtggagacggggtttcaccatgttggccaggctgggtcttgagctcctgatctcaggcaatctgcctgccacggtctcccaaagtgttgggattacaggcatgagccaccatgctcagccttgtgtccctttttgaatgatctgactcaatcttccagaatacttcatcttgcttctgtccaactgcctttgagatttcggactttttgagtctgtatgctatgctcactggaaatgttatctcaagccttcatagccatgtgctatttgccatctccacaaagctgacttcttgtattgcttttaaaagggatcttcatggggctatgtaaggaaatattcatgcattttagaggtgcatactaaagtaggaaggagtgaaatggcatgaggcctgcgatgctctttaaaagatttcagcaaagagaaaaaaagtagaacacaataaatgaagcaaacatcaaaaaatcgagtaattgttaatcgagtgacagttatatggagagtcactgtgctatatgctccttttgtcataataaaattttaaaatataaaataaacattgtcataataaaagtttaaaatgggctgggcctcgtggctcacgcctgtaatc

SEQ ID NO: 18658 - DNA, 351 bp, Homo sapiens
ggctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaaccaaaagcaaggcaaaggcaaaacttgtaaaaaaaaaaaaaaaaaaaaaaaaaaagggggggcctttttttcggaaaacccaaccttaaaaaaaccct

SEQ ID NO: 18659 - DNA, 611 bp, Homo sapiens
acagtcagaggtaaagaggtcactgatgatcttggtcagaggagtttcaggagcctgacagggacggaagccggcaagccccgaatcagggaaggagtgggaggtgagaacagatgatcaagggcagatgactcttgcaaggcgtggctgagaagcagagagacacagtgaggctcttgggggacaactggaaggcatggggcactttgattttaactcagggaaccctgagcttacctaagtgcagatggccagtcacagctgcaacccatagactaagaagccatgggccaggtgcagtggctcacacctgtaatcccagcactctgggaggctgaggcgggcggatcacttgaggttgggaatttgaaaccagcctgaccatcacttgaggtcgggagttcgagaccagcctgaccaacatggtgaaacccccgtctctactaaaaatacaaaattagccaggcatggtggtgcatacctgtaatcccagcgacttgggaggctgaggcagaagaatcactgaacccaggaggcggaggttgcagtgagccaagatcatacaattgcactccagcctgggcaacaagagcaaaactccgtctcaaaaa

SEQ ID NO: 18660 - DNA, 652 bp, Homo sapiens
ccttgattttgatcaaataaattacaggcaccagctggccaagagttttaatcaggctttgagatagtgggtcattacatggcaagagcgcccaggacaagagacacgggtgccctgcagtgtgggaacatcatccagggcagggaatatcatccagagagaatgattttgtcttgaattttgcaaatgttgaacagatataaaaataacttcataaatgattaggagaattttttccatctttaatttcataagaaaattattgaataataattgcttaataataattgcttaaagcaagaaatagggagaagcttaaaatgcttatttaaaataaggtggcaaaataaattttaaatgcttataaatttatacatgtacatatgttgttcacagaattaagtgtataagacagtgataggccgggcgaagtggctcacgcctataatcctggcactttgggaggccgaggtgggtggataacttgagatcatgagttcaagaccagagtggccaacatggtgaaaccccgtctctactaaaaatacaaaaattagccaggcatgatggtgggcacctgtaatcccagctactccggaggctgaagcaggagaattgcttgaacctgggaagtggaggttgcagtgagctg

SEQ ID NO: 18661 - DNA, 657 bp, Homo sapiens
ctctagtcctcattctactcatgcttcagtacatcagcgtcacagaccactctgccaggcaatattaggttcacgatgaaaagggagaagaagaaatgttggcagattcccgcgatactcagaaaacagtataaaaaggaccaagtggtttgaaacaggatttaagatgcaagagattacaaagaagccttccttgtagattgaatgttagcgtcaattactgatataaacatctttggggagacctcgtttgagcaaagttaatgacttctgttctggatgtgtacaatttaaagggcctataatatgttttacccatgcatcctcaacaaggatgatattgccaccaaagggggtaaaaattggttgctggggagtaaaaaaaatcttactttttatgcacaaagtatagaaaggcatatagtacataaacatttatgctactgcatatttatcaaaatttcatggagggcaattaggaaaatattgtctataacacttatgggaagcacagataatgtgaagaagtatgaagttattcaagaagtatggaatttatgtgagaatatgtgtgggagatcatatgtgtgtatgtatgcacatacacatatacatctaaaggaagtcagtgtacacacaggaattgaagccccatgc

SEQ ID NO: 18662 - DNA, 579 bp, Homo sapiens
aactagatattcgaatgaatatatagggccattcaacatagtcaccattgagctatctttagagcacagggcatttaataatgggcatctccctgtggagagatctggagctcaggagcattcaggatttccatgccccttctctctgcatcctcctgcctctaatctagctatagcaaggacactacagcagttcactctttaagagtatttctggttacccagtgaagggtgggatcaactctcccacccaaaactgggttgggtgtcaagactgattcaccacatctcaggagggtgtggaaagatgtattgctcacatgaggctttctggggagagcagggcagccatccaaacgggtctagtttttattttggttggagagtgggctggggtgaggctacttatgaatgggcagaggtttgatcttcctgctggcacagggaagaagtgcccccactttcttattggcttacacagatgtggggcaaaaggggagtgatggggctcaaaagccttcaatggtcaaataccaaaaatagggccaggtatggtggcgcatgcctgtaatcccagca

SEQ ID NO: 18663 - DNA, 687 bp, Homo sapiens
tagatgcacgatattacttctgaacaagagaaagaaactggtaggaaaatttattttaaaagtgttgaagggaaagaatcaagaccacagatccagatccggagattattttgctaaagaatagcaattgtgaggcatgaagtgggaggggggaagaagctatgaacttaattttgaggtttctgagaaggaagcttgagtgaattcacttcagatgcatttggaatgtttgcactccagaagatgagattgtgtgtgctctggagagtattggaagaaggaggtattactagatttggcgactcccacagtgactcattactcttctctgttactttcaggattcatagagatatgttttgttgatattatttatttaagtgagataaatttgaatatgaatccattggcttttttttgtaaaatttctgctttataaaatctgttagaaggctgggcccggtggctcatgcctgtaatcccagcactttgggaggccaaggcgggcagatcacttggggtcagcagttcgagaccagcctggccaacatggtgaaacccagtctctactaaaaatacaaaaattaattagctgggcttggtagcacatgcctgtaaacccagctactcaggaggctgaggcaggagaattgcttgaacccagggggcagagactgcagtgagctg

SEQ ID NO: 18664 - DNA, 661 bp, Homo sapiens
taaactctttagtgagaattttttaaataaccagttgaccctggattttctcgtgtactctctaacttgaaccacacattctactatcaagacaaatccaagttggtagccaacacatcttcctgagaatttgagctagttaagttaagaacaaatgaatgttttcttgattcttggtattagtaagaatggaaacctgaagttgataaagtttttgattgagaaaagtagtgtaatgaggttttgcttttaccctatttctcctaagtgaagaacgacaaggcattgacagtgaaattagtctcttcatttattgatttggctcttaaaaagaaagagattttagagatgtcaaatagtaaaatcaaaaagggatgtgtaaagaagtttttagagaagcagaatggatgcagatattcaatgactgcttgagacctaacgagaaatattggctggttgtggtgccatatgctcatcatctcagccctttgagagactgagctgggagaattgcttgaggccaggagttcaatcccagcaatatagcaagacttgatggtacatacctgtagttccagctgcttggctggatgaggtggaaggatcatttgagcacaggaggtctatgctgcagtgagctctgatgatgccattgcactcg

SEQ ID NO: 18665 - DNA, 665 bp, Homo sapiens
tgagaacttagcataccaacagcaggaatctgtgttttaggtgtttgtttggctgaatgcatccatactggggcccttcattgtagattgtccccgtgggatcaaagaaaggcacataaccatccttgcccgtacaaagatagactttctccagctggagtttgtaagcagaattaagattttgttctggattccaaagtactcggccataaaggatttgacctgaaaagattgaaaggtattaattaggtcagactttaagatgaaagaaaaacaaatgtcaagggttgaaaggggttaaacatgctcccttaagagtgaaaagcacttttctatgaagagctccatgattccatgtgcccctaaaatactcattcatttattgcttcgtttttattcttattttctttttttctctgagttttcttgctagggaacatttatgccttcttttttttcaataagcattaattaagcatttaagggaagcaaagtattctgttatgcacaggggataccaaggtgtgtgagatgcagttgagaggatggaaacaaactcacagtgattgactaaaataggctcatatttatcaaactcatactattttccaggtactgtaccaagtcctctcatgtaataactcatggagtgctcacaattttgc

SEQ ID NO: 18666 - DNA, 644 bp, Homo sapiens
gttcgttactggtgaatttcaatgtagtgacatcatgttaaatgaatacacagagaatgcatataaaagtacaatccttacttgggccctggagttcgggaccagcctgggtaacatagcaagacctggtctctcaaaaaaaaacacaaaaaaacaaaaaaacactgaaatcacatgtttaaaatatgcaaaccaacttctaccaagttctaaatatacctttgccttctgaaggcttttttaaatactgcacacattttcaacaagcattcctttagtatttccattgtttagggtaatatttagttttctcccatgggacgagcccagatcaagccctcaacttgtcatgacaatgtttattcaggtaaaacaaacaaattgccctctaaaaagtattttctacagctcgaattacccacttacacaagttataacaactattaacaattttatcatttatatttgaagtcacttgctttgggggttttcactgagtgggagtagataactgagatatcctcaaagtcagagaaattctgtgattcaactgctagaggtcatttgatattaataatagttgaagttagtgaagcatgataatctccacattccatttatttacatcatgctcctgaatatat

SEQ ID NO: 18667 - DNA, 603 bp, Homo sapiens
tagcagtgaaatttattatcatttgtattaagaagagatgactattagatgccatgccataaccaactcttctccattagattaggaggaccaggcctgatactgaatattggaactgttggcaagaaaatgaaagttcgtgactgcttgagttatttttaaaactctagttgcatggctgttatgtctcaaatactatataattatccctagttactggtatctttagcatatttgaaaccatccatatgtgacctaaagccacacagctatattaagacatttttgaacaatcaaagcaaatgacactttaaattaaaacaaaactaatatgaagcaactactttaaaaaaaaaaattgggaccaggcacggtggctcatgcctggggggccgaggcaggaggatcacttgagcgcaggagttcgagaccagcctgagcaatataacaagacctcgcctctacagataattaaaaaaaaaaattacctgggcatagtggcacacgcctgtggtctcagttgctcaggagaccgaggtgggaggatcgcttaagtgtggacagtcgaggcttcagtgagccatgatcgtgccactgcactcc

SEQ ID NO: 18668 - DNA, 597 bp, Homo sapiens
ccacatctgtaatcactgcactttggcaggccgaggtgggaggatcacttcaggtgaggagttccagaccaacctggccaacagggcaaaaccctgtctctacaaataatacaaaatttgctgggtgtggtggcacacgcccgtaacctcagctacttggaaggcagaagcaggagaatcgcttgaacctgggaggtagagtttgcagtgagctgagatcgtgccactgcactccagcctgggcgacagcaagactctgtctcaaagaaaaaaaaaagtagaaagaataaaaccatagtcttgtttataaaaggtgaaacatattgggataaaaagcactgaaaacagttttcttccaaagatacacttaactgctagaaacatctagaagtcgttggcatagttctaagacattttagagcccgctgaagggatgcttgcctcttaagtcatcttgtctccttttcttgacattcccaatagttttaagctcaaatctgagttctctgataacatcataatttttgtttcaaaaaaatactcctatgtatttcttattaaagaatacacactgaggtttaaaattgatcgtatatg

SEQ ID NO: 18669 - DNA, 656 bp, Homo sapiens
gcctgggtgacagagcaagactcccatctcaatctcaaaaaaaaatagtcatgaattatgcaattattctaattgtatctgcacttacgaagtcagaggtctcctttttcagtccctctgatagtaccacctaagtgctgtcctgctcctgtgaacactttcctgtgcaaccaaacaggaggtgccaggttcccagaactctctaacattacagatctctgtccatctttactaaaaaaaggaaatgtgagggaaagaaggggaagaactctagcataaataatgtattaatataaatatctatattgattttcaccccccattcccctttgctaatagaaaagagtctagctatgatgtgtcccaaatttaagagtgtgatgtgaaggactgaatttttgtttgttcgtttggtgagcttttcactcgtaggtgacatcttttgtatatgctgtaaagtctcagttaatggaatcctacagtgcatttctggctagctcggttggtagagcgtgagtctcttaatggaatccttaattagctagaattttcctgcaaatggctttggatgagggaaattctataaaatgacaatttggatatactttttgttaaatgagagcaattttctctgtatgctttgtctatgcatggct

SEQ ID NO: 18670 - DNA, 684 bp, Homo sapiens
ttttaacttcaaacaagagatgacaaaagactcttcaaggaaaggacaatgaacaaaccagtactacctaagaatcgctgcttcagagcatacatcagaatataaaaacgggcatgcaagcttcattatggcaatccagggatagcatggttaggaagaagaaaaaaaaatcagagatcagttaatagccttctcacttacaggagaaatggaggtatgaaccaaggaggaagatgttacagatgactccaatatcataagcctggtaaacaagtgtccagagttgtcaatgataataataggctagttggggaaaatgcaggtttggagaaaaacaactgacttcagtttgggaacataaatattaggttgtatcatatacaattgccatttaaccattaaattaataatttcatatgacacaacctaaggttttgggtggagaggcttctgataagtggtatgtcagacatgtgtctgctgcactaagaggtgtatatgtggatttaagagtcatctagacagggctgataacatggaaccatgtcagaggttacatttccaagggtagcaaagaggaggactgtcagggatactcactgctagaaaacagaaagaagccagggacatgaggataaagaagaagctctgccatcactgacactgaggccataaatgactaat

SEQ ID NO: 18671 - DNA, 648 bp, Homo sapiens
actttctgctttgccccctccctacctctatgctgatgaagagccagccatgcctccagcccttcctgaggccaccacatgatcttgcttattttcccattccaggaggtcacctgcagggctcctcccacctagccacaatggctagtcccgctgcctccacagtggccctgcagccccatcccagacccactgcacggggtcacaagcttgtgcagggtggacagagcagtagctcatggcagacattccttctgttcatctgttgcagggaaaatggggtgaggcatgggaggggttcccagaatcccagaaaggcagaaggagttgagatctgagacagagtaggctttggagactccctccacagaccactctcccaggggctaggttaatgggcctgctttgggaagctggggcaggtgaatcacctgaggtcaggagttcgagaccagcctggccaacatggtgaaacctcatctctactaaaatacaaaaattagccaggtgtggctgcacatgcctgtagtcccagccactcgggaggctgaggcacaagaatcacttgaacccaggaggtggaagttgcagtgagccaagatcacgtcactacactccagcctgggtgacagagtgagactctgtctc

SEQ ID NO: 18672 - DNA, 612 bp, Homo sapiens
tcaccttctgtctctccagtttgggggcagctgtttgacctgtgacttaacttctcttacagatctaagaaaagttgttgatttttcagtttgtttagctttttacttgctcttaagattgagtgacagatttttttttgcatttttttattgtgataaaatgtattaatacaaaacatttatcatttaagtgtacagttctgtggcattagatacattcacactgtgcaattaggactcttaaaaggaaaaagtcacatactgttagaagggtcatacaaggctttatagaaaggatttttaagatgagcttctatatatcaattaaaagaacatttcagtagaaacatgggcgtatggtatgataattaccagaagacaaatgcaaataagtgctgaacacaggaaaaaaataatcaacctctccaataatcagaaaaattgaagttaatcatcattaactgttgggggagtagctaccaaatttgataaaaactcaaaaattcgtaataattcagaaattgagaatagcggccgggcgtggtggctcacacctgtaattctagcactttgggaggctgaggcgggcagatcacgtgagctcagaagttc

SEQ ID NO: 18673 - DNA, 624 bp, Homo sapiens
caatttatagagacaaatttccaggggacctaagaatactgttggtccatatggatataaagtgaaaaatgaaagaactcatgcaaaaatctatgctatctttattcttcctaggttaattaaatctctatttaatgcaaattttataagtgtattctgctgttattggagaaaatgaatgttttcaaagaattcctatgctccaacttatgaaaccatactctgtctagacaagggcataggagatatttctaaatactaataataaactcagatttaaacaaagaagtgaaagatctgtacacagaaaactacaaaacattgataacaatggaagaaacataaataaatggaaagatattccatgttcatggattggaagaattaatgttgttaaaatgttcatatttacccaaaatgatatgtagatataatgcaattcctatcaaaatccaatgacagttttcatagaaatagaaaaaaaaattctaaaattcatatggaaccacaaaagagggaggcattatattacctgctctcaatattgactacaaagctatggtaattaaaaccagtatggtagtggcataaaaacagacacacagaccaatggagaatagagag

SEQ ID NO: 18674 - DNA, 554 bp, Homo sapiens
ctcacacctgtaatcctagcactttgggaggcccaggtgggaggatcacttgagctcacagaccagtctgggcaacacagtgagaccttgtctctctatattttttttaaagtagaagaaaaaaaaaagaagtaaactaagcttctagggtctttttgtttgttttgtttttttatcactgtactcttcttccagaagacaaagactactaatacacacacggcaatcttaatactaagtaatctgacaaaaaaaaattacagcagctagaattttatctaaaatttatataagtttaaatgtttaaaaaaaaaaattttatgaggctgaatgtgggggctcatgcctataatcccagcacttttggaggtcaaggcaggtggatcacttgaggtcaggagttcaagaccagcctggccaacatggtgaaaccctatctctactaaaaatacaaaaaaaacatttagccaggcatggtggcacacgcctgcaataccggctacttgaaaatgtgaggcaggataatcgcttgaacccggaaggcaaaggttgca

SEQ ID NO: 18675 - DNA, 504 bp, Homo sapiens
tttggagttttaatttctcaaatgatcccttctttttagatttcaaattataacctatttcctgcaccattgctgacgcctggtgatccatgtcagaagtacttccaggtcagatacattttctcatatttcaatgcagagaagcagttgaatattaaaacttaaaaaaagataatgtttaatgttaaacttatgatttactaaaataacatgttttttaatttcattgttcttcactaatgtaatagaaaaatgaatcttggccgggcgcggtggctcacgcctgtaatcccagcactttgggaggccgagaccggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccact

SEQ ID NO: 18676 - DNA, 484 bp, Homo sapiens
tgagcccagaggtaacttcagaatcctccctaacacaaaactccagcggtcactactgatgcaatacatgttgactatcacaaattcaagcccacctaaaagagagaagaacaaaagcagtgcaactggatagagagctatggctgaggccaactatgatcaaatttattgtctacgaaaacaagtaaccctggtgactgagagatttattaaataatcctttgggctttacatagatactgggtataataatcaaatagcataaaataccaaaatataattgtcaagatatactagggagtggtaaagatacggaaacatgttaaatattatctgtcatgtatattaaaagagatataggggtggaaaaccagtgctatgaaaaataagtgctaaaaacatggcaaagttcaggaaatggagggtccattgtggtaatctagagagctttcatatggatatactaaaacttaagacagacctt

SEQ ID NO: 18677 - DNA, 624 bp, Homo sapiens
ttttagtgtagtagtcaaagcattaatttctcacattgcaatttccttcaaagacataaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgacctcggttcactgcaacctccacctcccaggttcaagcgattctcctgtctcagccccccaagtagctaggactacaggtgcacaccaccatgcctggctaatttttgtatttttagtacagtcagagtttcaccctgttgtccaggccggactcgaactcctgacctcaggtgatccacccaccatggcctcccaaagtgctgggattacaggcataagccaccgcacccagcctgatattgcactcttggattttgaacactgaatatctttttgaaagattacacctctttacctcttcgtgcttcagaaattattttccttcaagtgttctaagaggctaatgaagaatgaagtcatgttttatcacttttgtccttaaagatttcagacatgctgaaactg

SEQ ID NO: 18678 - DNA, 531 bp, Homo sapiens
tgcagtggtgcgatcttggctcactgcatcctctgcctcccaggtttaagcaattctctgcctcagcctcctgagtagctgggactacaggcgcccaccaccacacccagctcatttttttttgtatttttagtagagatggggtttcaccatcttggccaggctgatcttgaactcctgacctcatgatccacctgcctcagcctcccaaagtgctgggattacaggcatgagccaccccgcccagcccggccgtctctttttctacagtagaatttcttttctaattttttgatctcacaagaggatgtcctggaattcagtagaatttctaacattgtcactggttttcctgaaagtgagatttatctcattagacatgtttggtataaatacctcctctgtttgctctactcccaaccaggagggatggttgcttttatacagaccgcattctggaaccttctttacagatacccagcccttcacgggcatcccatcagtaggcgattgctatagtttgaacttgca

SEQ ID NO: 18679 - DNA, 535 bp, Homo sapiens
tctccatgagaaggtaagctccaggagtgcagggatttgatctttttgttcagttttgtcttaccagcacataaaacagtgcctggcctcatgatggtgacctccttatcttcagtcatctccttgatctcagcttagtccctcacaaactcccatgattttttttaaaggacatggatcttttactttttaaccttaaaaaaaatttactgccaatatctgtctagaccccttcctagtcttaaggaatctgctatctgagtgagctttggggtgacacaaaccctttctgctacaacggaagccaaattgagggatatccttactttctttgcccttaggtaaaatgagcaaggaaaggcacatgacctgggctcagacaataggtttcacctgcttgggcatatgactcttacagggggcaactaaaagacaaaggatgagattcatggttgtgttctaggccctagcagtatacagtggcagtgtcagcatcctgactgcgttgtttctgctactcagccttttctgcttt

SEQ ID NO: 18680 - DNA, 585 bp, Homo sapiens
  misc_feature 577, 578: n = A,T,C or G
aatacttaatgagaaatatgttcttggaaaaatagaatatatacaagcaggataatcaagcaggacattctttttattatattatctttattattttggctctgccatgttagcaataataagtaaattctgatcaactaaaatgaaaaatgcataagatggatttaacagtagatttcaataggcaaaagaaagaattcatgaacttacagatagatttatttagactaaacaatttgaattaaaaaatgtgaaaaataaacagagccttagaaaactggaggacctcattaagggcactaatacatgatgatgggagtaaccgaagaagagaagagaaaaaggaacagaaaaaatattcaaaaaataatggttaaagttttcctagtttgatgaaaaatactaatctacacattcaagctcagtgaactccaagtcggataaactcaaagacgacacagacgtatcacagtaaaaatgctgaaaaacaaagacaaaaaatctttaaagcagcaacagaaaaatgactcatcatgtctagtaacattaatggctaaatttcattagaaaaaatganngatcatg

SEQ ID NO: 18681 - DNA, 569 bp, Homo sapiens
agatggatgaagtacaatgatattgctgtgacaaaatcatcatgggaagagctagtgagggactcttttggtggttatagaaatgccagtgcatactgtttaatgtacataaatgataaggcacagttcctaatacaaggtaagaatatatagggtggtgtgtatttttaaatagtcataaatgtggctctggtatgtggtgtgattagttaagtgtaattcactcagacgatgaaggatgtggttaggaaatgctactgggttttgacaagactgaattgaaaagtaatgtcgtcagggctaagaattcgtatatattttgtattccaagtcaagactgttccacagattgactcacatttaatatttaattccttagcctaacatatatggcctctgttcttggcctctgattatctccccaccttcattgatcaccagtgttccttttgaatttatatccttactgaacttcttgctgtatctgctcatatcaaaccatttcacacatttatgtttgcatgttcgtatatgttttattttttgctagtaattcttttgcctaattc

SEQ ID NO: 18682 - DNA, 646 bp, Homo sapiens
ctttgtgggtggccagcacacggatgtctatgaaccacatttgaaaaccaccactgaagctcataagatgtgcgagttggaccatctaaccatgaaaaccccctgatggtggtggcagcaattatctgattgtagaacaacaggatccatgtcctgaatggatcccaaccaagaattgaatccctatctccaagagtcatattaccctctaagaatgctggtcaccacagagaatacagatagaggcttagaatgtgtgtgcctgtgactgtgtgtgtgtgtgtgtgtgcgcgcacgcgtgtgtgatggaggcatttggagaggaagagagagactgtatttcagcctctatcactactgcgactgttaccttggaggcactgtgtttgaatctgcttagttttctaagcagatgaggatgggaatgaggagacgttagacccactagttctttggttctgtgattggttcttcttgcctgccttacaactcctgctgcttggaatcgttcatacgaaaatagatacacccagaacaaattatcttaaccagattctaaagcagaagcgcttagccaactcatagaattatttaattatttaatattggcactgcaaggagcttagagattgtcatttgacaaata

SEQ ID NO: 18683 - DNA, 678 bp, Homo sapiens
ggtgctagtgaaaagttaaacagtatggtatttagatggctcaactgacttacctatggtaaatgggccgtttttagtcttgagggcagtccatcactgggaggtatccacaaggtaggaagagacccctacacaattagatgccccttgaacaaagatcagcaaacttttcctgaaaagaaacagattataaatattttaggctttgtgagccatgtaatctctgttgcaactacccaaatctgttattttaggccaaagcagccatagacaatatgtaaatgaatgagtgtgtctgtattcctataaacctctttacaagaacaaatggtattctagatttggcccatggtctctgctagaataaaagtcccacatttggtttttatcctactagtattcctggttattttaggcattgtcctttctagaattcactatgggtatctgccactgcttgagaaagctgctgagaatcaacactgcaatatattgtggaaatatgctttgggggcaccaagtatatgatgaatgatgaatgaaaccgagttctgtggttagatcatttccagtcagaatagagactgaggcaggattggaagatgtgcagataacattcttagaaatacttctgtagagggaaaatgtcattatgagtttaaaataaattactatatg

SEQ ID NO: 18684 - DNA, 566 bp, Homo sapiens
ttatgtcacactatatataaactagtaagaataatgactaccatctattgaatcctaaccatgtgtgaagcactgggctagtatattacatggactgtctaatttaattgtctcacaaatgctatgcatgcataggctttatttacatctccatttcatgggagtgaaaagtggtgctcaaaggctaaataacttaacagttggtaagtgttcgaactaactgggatttgaaccaatgtttgtttgtccagtatgccaatcagccaatgctaaatgtttaggtgcagtttgcattataatctttaaccacattggctgattaaataatagttcttttgttattttctataatgaatatcttattgaatcctctaaataaatttcacgtatgtataatacaaaaaatcccaagagatattgaataataaaaatattggccgggcgcggtggctcacgcctgtaatcccagcactttgggaggccgagacaggtggatcacgaggccaggagatagagaccttcctggctaacatggtgaaacctgtctttactaaaaatacaaaata

SEQ ID NO: 18685 - DNA, 586 bp, Homo sapiens
taattttcttagtttatttcttcttttctctgtaaaataagattagtagtcataacaggcaactctggcttacatctgggttctgctattgcatttcattttcatctcatggaaaaggttttataaagcgtaatgcattgctcttctcagcctagaggtgcaagaacattatctagctgagaaaaagtagttttgagtattaattaatggttgttaagatgtcaaagaaactctatttttgctttcctctactgtagcttcattcatgaatatgttttggttgtaattgatctgcatgccttatccattacactgctcaggctgataatattcaatatagttaaaaaaagaagtacgtattaaggctaggcacagtggctcgcacctgtaatcccaaaactttgagaggctgaggcaggtggatcacttgaggccaggagttcaagaccagcctggccaacatggtgaagctccatccctactaaaaacaaaaaattagcagggtggtggtggtgggcgcctgtgatcccagctactcgggaggaaggagaatcacttgagcctgggaggtgtaggttgcagtgag

SEQ ID NO: 18686 - DNA, 630 bp, Homo sapiens
cgccccagctctcagaggcctgccatcactgtgcacccacacaccaccagctgtagcccaggcacaggacctcaaggtgggccagctcagctgccaacaggagcgagtggtgctgaggtatccagcagggcagcacatggtcctcccaggagccgtggcccagcacctcctggccggaacagccatcctattcaaataaacgagtaacaaaaatgggcacactctccacttccaaaagcaatgctggccaggcgcagtggctcacacctgaaatcccaatgccagaggcgttggaaccagagcaactccatcttgaacaggagctgggtaaaatgaggctgagacctgccgggctgcattcccaggagtttaggcattctaagtcacaggatgagataggaggtcggcacaagatataggtcatgaagaccttgctgataaagcaggttgtagtaaagaagccggccaaagcccaccaaaaccaaggcggccatgagagtgacctctgattgtcctcacggctcattatatgccaattagaatgcatttgctgctaaaagacacccccaccagcaccatgacagtttacagatgccatggcaatgtctggaggttaccttataaggtctc

SEQ ID NO: 18687 - DNA, 614 bp, Homo sapiens
aagaaggggaaatgttgaattgtgttttccatcccaactggtatagagatttttttttcttttagttaaaagcaagtgattataggagaaataagcatgtagctcctatgactacgctgttttagagttagctggggaggaaaggctggggccaagcagttaccaagtgtacattgaattgttttaaagttgataactagatattcgaatgaatatatagggccattcaacatagtcaccattgagctatctttagagcacagggcatttaataatgggcatctccctgtggagagatctggagctcaggagcattcaggatttccatgcccctctctctctgcatcctcctgcctctaatctagctatagcaaggacactacagcagttcactctttaagagtatttctggttacccagtgaagggtgggatcaactctcccacccaaaactgggttgggtgtcaagactgattcaccacatctcaggagggtgtggaaagatgtattgctcacatgaggctttctggggagagcagggcagccatccaaacgggtctagtttttattttggttggagagtgggctggggtgaggctacttatgaatgggcag

SEQ ID NO: 18688 - DNA, 349 bp, Homo sapiens
gtgaggtatgtcacttatctttctgggtctctacttgcttgatttttaagaatcatatacaaattccagatctgtgcctctgcaatgtgttgttttcctggtcagaaatgacctttcacctttcatcttttcaccccaacccttccacatgtgaggacctctgcaggtcgcacctcaaaccacagagttttttctaatttctcccttctctaaaatcatatataatctctgatttctataaacagaataaaaatacgaggctgctgctatttgtatatgattcttaaaaatcaagcaagtagagacccagaaagataagtgacatacctcacaattttttttttttctg

SEQ ID NO: 18689 - DNA, 629 bp, Homo sapiens
gcagtggcgtgatctcggctcactgcaacctccgcccccaggttcaaccgattctcctgtcccagcctcccaactagctgggattataggcgcccgccaccacgcccagctaattttttgtatttttagcagagatggggtttcgctacgttggccaggctggttttgaacgcctgacctcatgatccaccagcctcggcctcccaaagtgttgagattacaaacgtgagccactgcgcccggcaattctaattattttcttaaaacacatctaagtcttaaatttttacaagctgaagacttgaggtttcttatcattcaacttgcatgagggggaagctttcagatgaagcttttctctgcttggagaaaaagctgttgctttcaatcctgccaggttctccaggtcaagttctctgtatttcctcctgatcatcacgctgatgtttctggctactaaggagctgggggtggcgatgagtgacgcagatatgaatcagactgattttcaagcagcagagtttaaggaaaatgaaagaactaggcactggaagtgactgattgctggccgattcattgttgtaatgataagctggtactggacaagtgatcacaggcctgatttctac

SEQ ID NO: 18690 - DNA, 601 bp, Homo sapiens
aatatctcactgcctcccccgctttggagttagcaacttacacattccttttctgcctcttatcagcatcaggcttatctagtcctctgatgagccccacacagggaaattgtaccacctttgctttggtgaacctctcatgtcaaattgctcctctttgtctgctttaaaaagagacaggagtaaatgtgatgttactctcttagctaatgcatttatgcatttccacacttgtgaaggaaggtctgtttcagatgcttagtgtggattgtatagtcttctgcttctgtaagtcacatggaaaaatcattctagtattatgtgaagtgtaacaaataattgcttttggctttcttcttgggtgtgttagtccattttcacactgctataaacttccctgagactgggtaatttataaaggaaagtgggccgggcgtggtggctcacgcctgtaagatcacgaggtcaggaaatcgagaccatcctggctaacacagtgaaaccctgtctctactaaaaacacagaaagttagccgcgcgcggtggtgcgtgcctgtaatcccagccactcggggagctgaggcgtgagaatcgcttgaac

SEQ ID NO: 18691 - DNA, 593 bp, Homo sapiens
ggtgcatgttgggggttggatgacacaaatactgagatgaaatgtaaagttaactgttgttaacgcattttatgcagctaggagggcaatggaagaggaaaaaagcaggaagaacggataatgtcagtacaagtgtgacttgtgtgaggataagaagtactcacttctacggtcaccaggtcgtggctggtacagtctttatggccacgctctcccgtcactcctgcgtggtccctttgccctctgcaagcacctctgctggtcgtggttcactgtctggtggggtgacccaaacgttccttcccaaaaggcctatgctgttagcagttttgccttatggggtggttctggttttccagtggtgttttctgcaaggcttagaggagctacgtgatattacagacgatctcctgcctcccaaatttctcccccttagccccattctgtgatcaggttccaagttccccttgttgggctcagtcagccggaccagcacagggaccctcttctttgtcgaccccctggtgtgaggaaccggcgtccaggtgggcagtctcagcttcctgcgtaacgtgtcccctggtggaaacact

SEQ ID NO: 18692 - DNA, 595 bp, Homo sapiens
aagcctagagtttttgttgttgttgctgctgtttaatttttaattttcataggtttttggggaacagctggtattcgattacatgaggaagtacattagttgtgatttgtgagattttggtgcacccatcaccccagcagtatacactgatttttgatgtagagctctaacaactgaaaaagatgattaatacgacaaaaaggaacaaaccttgggctgaaagccagtcttttgttctagtctggattctgtccctaactgtaacactcactgttcatcaagttctcattgtgtcagacatttgacaaagtgcttttcatgcattatttcgttgatccttatcacttttccaagagaagggtactattcttattactcttttaacaaatgcagaaacagaggctcagagaggtaaaggagcttgcccaagatcccacaacttacaggcgttggtgctggtgtctaagccagggggtgggactctggaggtggagctcttaatcactgcttgcccagagtactgggccttcagagagtcaatcaaccgctttgagccacagtgtacgaaatgaagaaaatggccttgattcataag

SEQ ID NO: 18693 - DNA, 640 bp, Homo sapiens
atgccatcaactgagtggggagcattttttctataacccctgttgccaggtcatataacctattgccaggttagatgaccatcacaaggatgatcagccaggacagaggggtgacctggtgacctgggtcatggtactctgcagggctccctagctgtctggccagtcattggcagctctgcagaacatcaagcaagttacagtgtggcactgaaagctgatgggtatcgagaaggtggtggccacttagaagccccactggggccttcaagaagctgatcacaaggtgcatgttcttagatggacctctgggcagctgcagagtgcaggcttactacccagatcagaaaccccatgtagggtgaggattgtcactgagagaggaactggtggaggaagttctgctgaaaaagtcctggtgaccccatcccctgagcaaaatgcccaggtaagccacctcctgtctcttcctccctccttctctttcatgcgaacacagaaaaggcagcacagcagtgacaccaaccacaccgcagttcccacctggagaggaggtgaggtcaaaaaacacatgccctgccatgccggctggccctgaacacaccttcctccatgcacacaggtagacaggtgaatcctg

SEQ ID NO: 18694 - DNA, 600 bp, Homo sapiens
cgtggggctcagcccaacctcgaagcgctgagaaggcgcttccaaagtgatatccctggaatgatataatgatttccttaatacgtgagcatctttcaaaactaggaggatctggaattaagtttagaagtattaatcaaactcatgccactgacgtttctgtgtgtcaagaagtgcatgcatatttggtatttaacttcagcattttttttttgtttaaaagactacggccggccgggcgcggtggctcacgcctgtaatcccagcactttgggaggccaaggcgggcacatcacgaggtcaggagtttgagaccagcctggtcaaatggagaaactctgtctctactaaaaatacaaaaattagctgggcgtagtggcaggtgcctataatcccagctactcaggaggctgaggcaggaagatcgcttgaacccgggaggcagaggttgcagtgagccaagattgtgccaatgtactccagcctctgggtaacagagcaagactctgtctaaaaaaaaaagagccgggcacggtgactcatgcctgtaatcccagcactttgggaggccaaggcaggcagatcacatgaggtcaggag

SEQ ID NO: 18695 - DNA, 465 bp, Homo sapiens
tttcgccctgtttgccatggcgggtcgtcaaactcctgacctcaggccacccgcctcagcatcacaaagtgctgggcttataggcataagccactgtgcctggccggaaacattttttgatgtgtctagttccacaatgctgtttttgaagaacagcattctggtctatggatgtattatactttaaaacattacctactgttggccgggcatgggtggatcacctgaggtcaggagcttgagaccagcctggccaacgtggtgaaaccccgtctctactaaaaatatgaaaattagctgggcatggtggcgggtgcctgtaatcccagctacttgggaggctgaggcaggagaatcacttgaacccgggagtcggaggttgcagtgagccgagatcgtgccactgcactccagcctgggcgatggagcaagactcggcctcaaaaaaaaaaaaaaaaaaaaaaa

SEQ ID NO: 18696 - DNA, 559 bp, Homo sapiens
acaatattgttttaatgggtttacaaagaccttttttttacaatgaactcaaatctcttatatcaatgttagcaaagaaccaactgaaaggagtctcagcaactcttaggggctggacaagtttccttagttaatgctgtgaatagaagttttaaaagcatttatttctcacaaaaagtaaccatctgttctttatgatggctcctatcatttctaactacgtttctaaaagagatttttctgagagctgctttggaatgatggggaagagttcttaggaaaaactcactggctgaagtgacccaaaaccagaggagtatctggatggagcatatcctagataataataataataacgggttttgaaaaaaatgcccaaaatatgttccaaaattaccagagatttttacatctgatcatcaaatcctgagatcctaaggggggaaacttccaatcttgagaatcagataagcatctcaactcctggaggctatttgaatactaagataattttcatatcccaagttgcattagattctcatgggactaggttttacta

SEQ ID NO: 18697 - DNA, 633 bp, Homo sapiens
ggctcaagcaatcctcccacctcagcctcccaagtagctgggactataggcgtgtgccaccatgccgtctaatttaattattattatttttgtagacacgaggtcctgacatattgtccaggctgacctccaactcctgaccccaagtgatcctcctgcttcagtttctgaaagtgctgggattacccggacacagattcatcttctactcttctgctttgctctgtgccctgggtggtagactcctttggactggatcccttgtcaaataggttctgggtgcttccagccaatgggaggtactgtgaagtgagtgtagggagggaggagaaagaggttgtggtatttctctgccccatcattgcttccgttcatctcgagcagtagctgcattcctccacaattcctgccaggtattctgttcatctggggttgcagctctaacttggctcgaataaaagcaattcttcctttaattccttccaccttggaggtgtaatggcttcctgctgctcctaatctctaagcactgcatcctctctagatttatacttgtaaccctatctacatatcattaagtagacccttcgttaaaatctcttcatttgtaccatctgcaatgagttctctttc

SEQ ID NO: 18698 - DNA, 556 bp, Homo sapiens
aggtgttcattgtggtgttattgcatcggggtttaggtattttcctaacaaaaagttggggacaaacacagtacctccagagacctgctctcttcttattaaaagtcagcccaggtcacccccgtctgtttggctatcgttttttcacaggccattacgagtgagttgcgggagtcagagggggcagtgagccgagatcacaccattgcactccagcctggtgacagagcaagactccgtccacccaccctcccctgcacaaaaaaacaaaaagttgcagggccaggcatggtggctgatgcctgtaatcccagtactttgggaggtggaagcgggtggatcacttgaggccaagaatttgagaccagcctgggtaacatgttgaaaccttctttctactaagatgacaaaaaatcagccgggcctggtatcgcgcgcctgtggtcccagctattctggaggctgaggcatgagaattgcttgcacccaggaggcatagtttgcagtgagccgagatcacaccattgtactccagcctgggtgacattgccagact

SEQ ID NO: 18699 - DNA, 574 bp, Homo sapiens
agttggtttgttgtacaggttttgaaatcgctggattggaaatgagaaataaacctatgagactgaggggtagagatgaaagaaaacagagaaacggtctcaacattagaagatgggaggaagaaaacaaaattatttctggaaaattatcatagtctattgtctcataagaacaataaagtagatataataattgggaaataaattgctgaggtaaaagagatagatcagaggtgaggtctagatacattataataacccaaataataaaggtacatgagaatagaaggagaggagtaaattaaaggaagatgtggacaaaataaggatgagaaaaactagatacatgtataggatcaccaaggagcaaaaatgattcaagaaacaaggaattaaatttatttatcattcatattctccttcagttcctttctcttttcttttatctctttctctctctctctctctctctctctcacacacacacacacacacacacacacacacacagagaacagtgaacccagggattcagctcttaatctaccagcccagttctatctaatactgaata

SEQ ID NO: 18700 - DNA, 552 bp, Homo sapiens
atcacaagcgtgtgccgtcattcccagctaatttttgtatttttagtagagatggggtttcaccatgttggctaggctggtctcgaactcctgacctcaagtgatccacccgccttggcctcctaaagtgctgggattacaggcggggggcaccatgcccaggccctggcttattatttttaaaaagtaggacttgagtttcccaccatgtgatcttcccacttccaaatttattattggagagagagataaagcagaatgcatagaagttcctttgcaagctaacctggcagtacggcatgggggaggaggaaagggatgaagggagaagtgccacaagtggtttttaggtaacttagcagtttgatttccaagctgtttcagggctgctagttttgtgtgtgcggctgctggatggactgttttgcatatcactgatttatatctctacagaacaaatcttgtgtttcttttggagatccacgagcaactggcatttgaaaaaatcaggcattattgactttaaaacacagtaatgttttctatatctct

SEQ ID NO: 18701 - DNA, 386 bp, Homo sapiens
cgttcgctaccacgcccggctaatttttgtatttttagtagagatggggtttcaccatattggccaggctggtctcaaactcctgaccttgtgatccacccacctcggcctcccaaagtgatgagactacgtgtgagccaccgctcctggccaggttatgaattcttaaaaaaagaaggcaaaggatctagactttgtttttaaagttatctttaccgctaggactaaggcaggaggtctgtttaagacaagccaatctcttcttgttatcatctatccgccaaagacatcaaagttagtggtccaataaaaatcatcccaataatttcatcttttctgcaaactgatgtatccccactcaatacctagaacaatatctgggatac

SEQ ID NO: 18702 - DNA, 175 bp, Homo sapiens
aatacttttttattttgttttattttgaatgatgagccttcgtgcccccccttcccccttttttgtcccccaacttgagatgtatgaaggcttttggtctccctgggagtgggtggaggcagccagggcttacctgtacactgacttgggaccagttgaataaaagtgcacacct

SEQ ID NO: 18703 - DNA, 594 bp, Homo sapiens
cgccttgtataccattagaggtttttaaacagaggagtaacaagataggacctgcattttagaaaggcaattccccaaaactaggactgtgtggacaacaggcccactggatcttcccatctcaaagtgaagctgagggttcagcttctaaaatagccagctcttagtcatcgcattcagctccacagttgatccagccaactgagctgcagagctgctctagctggctgcctatgagaagtggaaggaaagagaattggagcaactatcaggttaataaactctgtggagagagccaaaccaaatttccaaggccccacgattagtttgtctaaatgaagcacaacaacataatgctgataggcctgacttcctttagtgttaatggaccttacagatcttctctaacttctgggctgtggccttgtctgtcttgtttaccacaatatctctagtaccagcagagggcctgccaatggtacatgttgataaatctatgatatgaatgactagtcacttgttctggagctctgggtaccccaagcttggctgaatgctcccacaattgagtctttcattattaattaaagaagt

SEQ ID NO: 18704 - DNA, 551 bp, Homo sapiens
attctgcttgctcatgctccacatgtcttagcactttggagtcctacgtgaaggaacagcccacatctggtacatgccacactcatggcaaaaggcataaagataaaaaaagctgcatagtcacatttaaaaccaaaacctggcgtgtaaaaagttgattaacattctaatggctagaacaagtcaaacagccaggctcaatatcagtggagtgggaaataccttcattctacaaggagaggggagtgaatatttgaaaatgagaaaataatttatcacataggaccaaatgataattctacttacatgcatgtctaaatggcccatgtaatcctacaaatcttctgagacctacaatttggctccactacttgtatttgaccaaaatatcttctcaaagccaagtatgtatcttctcagttatcgctcttccttgagacagtatagaacaatagagaaaagatagaacttcgaacttctgatcagaggacatgagttagagcttcagctctatgagaagctagtgtttgattgtgtttaagtcagttcac

SEQ ID NO: 18705 - DNA, 483 bp, Homo sapiens
cttcagcagatctctggagctgtatgtgcagctctgttatctggcattctgtctcacaaattctagtttccctgcgcccaccaaagaggcagtcatgttgtttacctcatttgtttttcctctctcagggtcacggttctgcaccaagtgttgtccaatacctgagaagttttccccctcatgtgttttgtccagttttcttattgtttatgattggaggacatttctcatgcagttacttttttatgaatgaaagcagaggtcaggtggcacaattgaacactgcacagaaagaagagaagagggaggctggagaaaaacattctatgaagtttaaaacatgattaccggccaggtgtggtggcttatgcctgtaatctcagcactttgggagggtgaggtgggcagatcacctgaggtcaggaattcgagaccagccttgccaacatggcgaaaccccgtctctactgaaaatacaaaaat

SEQ ID NO: 18706 - DNA, 318 bp, Homo sapiens
ctttgaaaaggggagctgctggaattggtcaaaaccggcgggctgtgtttgagcccagtttggttgcctcctggttcaagcacttgccagtcttacgcacaggccttgctcagatgtgtcggaatgggagcaccagggctggtggtgccctggatgttcctttcctagggaatctttgcgaaggtatgttttagactcccccaagaaccgcccagtccctgttcagttcaggtgccacactggggcagaggtagagaaaagaaaattctggaaagtggcttaattgtggaggttgggagtaggtaggacctgtgcctt

SEQ ID NO: 18707 - DNA, 409 bp, Homo sapiens
  misc_feature 258: n = A,T,C or G
tcttaaaacacattcctacataaaaaaacgaattccttctgtaaaacgacctcagtcgaaagcataataattggtataaattcttactcttttaaaataaagattaaattccagctaaaaattctccagatatggcagtatattgctctttgaattgaattgaggaagggcgagggtgagagacataaaagactaaaacagcaaaaggaagaaaaaaagggaaggaaaaaggtaaaaagaaaaagaggaatataggtngggatcacttgaggtcaagagttcgagaccagcctggccaacatggtgaaaccctgtctccactaaacatacaaaaattagccaggcatggtggcaggcacctgtattcccagctacttggaagactgagacagaagaatcactcaaaccc

SEQ ID NO: 18708 - DNA, 539 bp, Homo sapiens
tgagccactgcgcccagctgactctctgtctcttaatattcgtttattccattttccaaattaataggaattggcctgcacgtatgactgcctaggataaaaaatacacttccagccgagcatggcggctcacacctgtaatcccagcacttggagaggccgaggcaggcagatcacgaggtcaggaatttgaggccagcctggcaaacatggtgaaaccccatctctgctaaagatacaaaaaattagccaggcgtggtggcgcgcacctgtaatcccaggttcttgggaggctgagccaggagaatcgcttgaacccgggaggcagaggttgccgtgagccaagagcgtgccattgcactccagcctgggcaacagggcaagactttgtctcaaaaaaataaataaaagactgggcgcggtggcacacgcctgtaatcccagcactttgggaggccaaggtgggtggatcacgaggtcaggagatcgagaccatcctggccaatatggtgaaactctgtctactaaaaatacaaaaa

SEQ ID NO: 18709 - DNA, 603 bp, Homo sapiens
gtaccttctctcctaagaaaagtcaaggagactgtaaagacagtaaaaagaaaaacaaaaaccaagcctcttcctggtctttggaacctggaaatggatttatgtgaaatcttaattcctctaaagtaaagtgatatatgatatacaccaagtttaacctataaatcaggttttagtaaaattgccagataaatctgtacaatggtcaaactagagaaattcagtttttaatcctcccaaaatgacttgaagtagaatttactgtttctttactatatatcaaatttgtataactaggaagaggtacatatgctctcctactagggaaatacaacatatatattagctggataatgatttacatttacatttttgcacctttatgaaatttgataaacttctagaacgcttgtttttaaatgttttaacaatgtaaaagttgttcagcaattttttttaactcctagcattacagaagttaatttctacaaaactggttttctgggctcacaggtaaatgtaaccagaaaaagccctaaacaaattgatggaatatagatggatcaatttcttagtacagtcatgtaccacataatgacattt

SEQ ID NO: 18710 - DNA, 491 bp, Homo sapiens
tagcaccttgaacagaaaagtcagttataaatactttaataaaatatggtgtttgttatttttaggtttcaagccagcagagttgtaaactggcgtgtgactggagaaaaaggtttccattcatgtttctagaagaatattcacaatgagattttaaaagttttcaattcaaataaatcatgataccataataaaacatttattagtgagtatttctatatattcaaagaaccatattcaagtattcttaatttcccattgtattatgaggagctgatatggtttggctgtgtccccatccagatctcatcttgaattcccaagtgttgggggagggacccagtgggaggtaattgaaacatgggggcaggtctttcctgtgctgttgttgtgatagtgaataaatctcaagagatctagtagttttacaagggggagtttccctgaacaagtctctctttgactgctgccatccacataagatgtgactt

SEQ ID NO: 18711 - DNA, 323 bp, Homo sapiens
agatggatgaagtacaatgatattgctgtgacaaaatcatcatgggaagagctagtgagggactcttttggtggttatagaaatgccagtgcatactgtttaatgtacataaatgataaggcacagttcctaatacaaggtaagaatatatagggtggtgtgtatttttaaatagtcataaatgtggctctggtatgtggtgtgattagttaagtgtaattcactcagacgatgaaggatgtggttaggaaatgctactgggttttgacaagactgaattgaaaagtaatgtcgtcagggctaagaattcgtatatattttgt

SEQ ID NO: 18712 - DNA, 557 bp, Homo sapiens
  misc_feature 300: n = A,T,C or G
tggaatcgtagacatgtaccaccatgcccagctaattgttgtatttttagtagagatagggttttgccatgttggccaggctggactcaaactcctggcctcaagtgatccgcctgccttggcctcccaaagtgctgggattacaggtgtgagccaccatgcccagcctcaggcagtgagttttcaaagctgagtttcatgcacatggtgactcaacttttgtggggaggcattgacaattccagctgtattcaaattcattaaagagccccttcattcgggagtagtttgaaaacttanaaactctgaggctcagtgaccatccctgtctcatcttcttgtcattatatgaatagcagtggagaatgagatcagaacaccagcaagggaaaaaaagtgtgctagagtaaggctaaggatgagaaaacatgaaattatgctatttgggatggtgggtgggaactcctgggctggggacgaggatgaagtgtttttggtgggcatttcctctcctggtaataaccccagttttgttttgagggaagcatccttccccc

SEQ ID NO: 18713 - DNA, 538 bp, Homo sapiens
aaattcaaagaatcatagggcctgccacactgaagggaaaaataatcaacaccagaggcttggggtggcctcctttaccaggagtcaggtggacactaatgcagaaacccagaactcacagagtaccagcaagaatcaagggaaggacaggtcatccagagagggctagcaggttctgcctaggcaggaggaaagataacacattttccccccaagattatagaacaggccttggccaacatgctggaaccaggagaggaagagagctatatagagcagggccaccacagtcaacccctcaacatgagacaaagctgtctcagctgacttgtaaactcataagaaagaaatacacgtttcctggggtatgccattgagatcttgaggttgttctgcagctacagctgaccaatacaaagacagagtttaacgtgacttgatcataccttgtgacattgtctgtcaacacgagccacaaacacagtattagaatttagaggccaggcgcggtggctcacacctgtaatcccagtacttt

SEQ ID NO: 18714 - DNA, 534 bp, Homo sapiens
gagagaacaaactccttaaaaagagaaaaataaagaaatagaaatatgccaaaagatttgcatttaaaaaatcagaaaacaagaaacaactaaatgatatattgcaagatataataaagtgaacccagatgagtgatttaagatacaaaaaggaataatgaagaaacaaaacacaaattgagaaaagacatctgcaactcatatgagcaacacagaatttatattcagtatacaaagtgaaattttgcaagccaaacaacatttttttaacaaatacgaaaaaaacaggtattttacaaaagaaacattaataaaaaaatctatatagaaatattcaatctcatttataataaggaaatgcaaattacataagcaataagatgctagtttacactcatcgcctaagcaagtgtcagcatcacatgttggagatgacttatagcaaagggttgtattgtagcatatgattgtattaaattggtacgagtattttggaaaaccgcttctaactgtatttttaataagttttatctt

SEQ ID NO: 18715 - DNA, 442 bp, Homo sapiens
tacataggtatatacatgccatggtggtttgctgtacccatcaacctgtcatctacattaggtatttctcctaatgctctccctcctgtagcaccccacacgccgacaggccctggtgtgtgatgttcccctccctgtttccatgtattctcattgttcaactcccactcatgagtgagaacatgtggtatttggttctctgttactttacagagaatgatggtttccagcttcatccatgtccctgcaaaggaaatgaactcatccttttttatggctgcatagtattccatggtgtatatgtgccacatttactttatccagtctatcattgatgggcgtttgggttaagtcactcagatatacaccggctctttcagtaaccaccccccaacccagttttaaaataatgtcccttttctgattctttccctcccttaag

SEQ ID NO: 18716 - DNA, 347 bp, Homo sapiens
aggtatagaaaatgaacaaagtatatccctgatttttgcttacatcttttctgagtaagacattttgtgcttacatactatggattagttaatcattggtcagttaaatacaaaacatcatttcgatctggtagcttagcaacacttaaaaaaaaatcagctaatgcttagcaaaggtttccactcaagatattagattatgaaaaacttcctgcttaacaatagtaattccttgcagagtttatttgacttcattcaaaaccattcaccaatactagagttaggtgccggggtttcatatttccttttagcacttttagtgtttggttttatcagaatcccaaatc

SEQ ID NO: 18717 - DNA, 480 bp, Homo sapiens
  misc_feature 305: n = A,T,C or G
ttactttctacttgagttccattcacgtgcgttttctgatgctccacttatcatcatgtgcttactgggctctccccaaagaacccaggacaaaggggcccgccctgtcttgcctccctccaccctgctccagcaagctggcccagctaggagtcctgaggatacttacttattatggggcagcctggagcacaaggttctcaggtcatctgcaattaaggagatacaagattaatgaacatactggtgacaacacggtgaaatacacactgacgttctttgcaaggatgctagcaagacagcanaagcgcctcatactacatttccctagtgtcatttagaaactgagttctagccggggtggatcacccgaggtcaggagtttgagaccagcctgaccaacatggtgaaaccccatctctactaaaaatacaaaaatcagtcaggagtggtggtgggcacctgtagtcccagctactc

SEQ ID NO: 18718 - DNA, 552 bp, Homo sapiens
  misc_feature 234: n = A,T,C or G
gaactttctgggatgaaagaaattatatcttaagaagggcgtgtcacataggtgtatttattttgccaaaattcaccaaattatatacttataatttatgaatttcactgtatgtaaatgtggcactaaaaattacaacattaacaattataaacaaatattaaactcagtttgcctatcatggtggtatcagcaagcagttttgaaactacttactgtatattctaggctcangcaaatgagtaaacatattaataaggataatggaagccaggtttctctctgttacagaaggcagcagaaatacaccaaggaaaaagactaggatgtacctgaggtactgaattgaatgggaggtatcaatatgaacatatggtttttattggatagagaaaaatacacatatgtgcatatacttgtatatgtgtgaattttatgagccatattatgagtgtattatatattatagtaagtatgcatgtacatttcctacttctgtctactgaagtccataagtaatggtacacctatagcattgagcatacatagtat

SEQ ID NO: 18719 - DNA, 538 bp, Homo sapiens
  misc_feature 333, 367: n = A,T,C or G
taatcagcagataaaagctcagatggtcagaaacatatagaactataatgccatctccaaagtattgcatgcatacaaatgacgttcaatccgttgaatataatggagacacactatttcaaaaattaagttcttctttcttgagctttaaaagtatacacatttacccaaatgaattaaaaacatgcacacaaatatttatatcaaaagtgtacatgatttccaaaacttggaagtaaccaagatttacttccatgggttagtgcataaattaactgtgatacatatatactatggaatattattcagcaacagaaataaatgagctatcanaccacagaaagacatggaggaaacttaaatccangtggctaagtgaaagaagccaatatgaaaaggctacattctatatgatttcaaatatatgacattcaggaaaaggcaaggctgcagagacagtaaaaagatcagctaggtgcagtggctcacgccactttgggaggctgaggcaggtggattatctgaggtcaggagttca

SEQ ID NO: 18720 - DNA, 576 bp, Homo sapiens
ttaatgtaatatttgttaattcccccataaagaggtgtcaatatttttgcctagtcgtgttaagtggtaaaagaagttatatatcagagattttaaccacaagaaaaaataaaatatgaaataaatgttaatgggtacatttatagttagaaaacttaatgctatccttagattcactattttatgtgtatcctaaactataaaatttggtttgtgtgactcaaaattcatcaaaatattccagcaataaatcttgagaagaggagtagaaaaaagtaacatttatacaggaattactattggatgcatttgctaaatcagagatgaaatatcttaaccaatctgtaatgtctttctcaaaattaaaaaagataactaatgtagactaaaaaaagaaatgtagactaattacttgtcaaattttatttttaattgcaacccttttgtggtagcttttacaacagacccatacaacattctttagccttctctttaatttcttcaaagacagtcaagcacgaatctcttagtattaaattgaatagatggcaaacagaaactttggctggatacttt

SEQ ID NO: 18721 - DNA, 539 bp, Homo sapiens
tgtgcctggcacatgtgtctttctttgatattcttaaaatatcaagtttgttggagttggtatttggctcatggagcagattgtattcacatgtagacagtcacttaggtgatgcgattccaggagcccctagaagtccatgaatctccactctcttcctctattatctgtaccattgtgggctattctgtcattgacgtttattctttgtgttgagtcttcacctgttaatgctctgtcttggtcacactcacacaaattaatcaacagaacatgatcttatattaactactaatttctggaatgcttttgaatgctgattacagtatacatctataatttgtcaatttaaagaaacacacagtgctgatccgcactcccagagttcccgatgcattagatctggggcagggcctaagaatttgcattcccaggtggtgctgatgagcctggtcagggaatgcactttgagaaccactgctctaggctatatctggaccttaccatatacaaaaataaaatcatttaagacacaatta

SEQ ID NO: 18722 - DNA, 407 bp, Homo sapiens
ttttgtatttttagtagagacagagtttctaccttgttagccaggatggtctctatctcctgacctcgtgatctgcccacctcggcctcccaaagtgctgggattataggtgtgagccaccgcccctggccaagaacattattcttaagggaggagacctggatttcagtaccagttgtattttctgattaaaaggaaaaatagcttgcctggtcttagattctcctacaaaactaagtgggttggtctggatgatcattacattcccttatcaccttagcatttcttcacaatcctttactgtgctggttattactgaagagtatttagtagtactgtagctctgtaagattaatgtcaatgagaggctggtattgaagtaatttctgagacctttaaaaattatc

SEQ ID NO: 18723 - DNA, 575 bp, Homo sapiens
gcggtggctcacacctgtaatcccagcactttgggaggccagagcaggcagatcagtaggtcaggagtttgagaccagcctgaccaacatggtccaactccatctctactaaaaatacaaaaattagctgggtgtggtagcacacacctgtagtcccagctactcaggaggctgaggcaggagaatagcttgaacttgggaggcagaggtcgcagtgagccgagatggggccaccgcactccagcctgggcgacagagtgagactccatctcaaagaaaaaaaacaaaacttatgttttgaaagtcatgatataactaagtgagaaaggatgggatactaaactacacaaaattataacttagtaaataaaacaaaatcaaaataaaaatgaaaatacgcatcttaaatatattactattacaaacaaaaaaggtttaaacatattgactttattaaaaacagagtttttactatacttctagaatacaacttatgaaaataatgaaaggtattacaatgtttaaagatacaagttttaggccaggcgccatgccccacacctataatccctgca

SEQ ID NO: 18724 - DNA, 352 bp, Homo sapiens
ttgtgactactttactacacaggacagtttctaagtccaatttccagtctcccagtttactcgaacatactgacattacccaagccatgcccagactcatctaagatgcagtgtctcctttcacatcccaggtgaaactagacctcacctcccgtgtttattatttctactacttatggtaaaattgttattctctaaacttatcctttttttatttctctttgttataagggtattttctgaatatttatttcatttgtgcatcatgatgtcaacataacgttaagctaacttgtaaacaggtgtttcaagagtgcctgttatttgaataaacctggagaaacacagtatt

SEQ ID NO: 18725 - DNA, 544 bp, Homo sapiens
atcaccctcattgtcactactattcactgagcactaaactggtacacatttattgtctgaattatttcttgcagcttccctgtaaggaagatatgattaaccccctttgggcttggtgagatgaagcagcttgcccaaagttgctaggccagggagcaaagccaaaatgtgcaaacaggtctgtctgactctgaaggcagtgttctcatcctatcctccactgctgtacagcacccttctccttcctgcactgccctttctctccctgatgcagcccccaagctttcttctcttaccttttgtttcttccatctttgccattgtaatatggaattttctattattataaacagaaaatagaagctatagactattcaagcagaaagaacttcagtggtggagtcaacataaaagcaggtcactgtagcttccactccacaaaatcactgttcctaatgtacagatacagattgaggcagaaaccatatatttcactgtcacccatgtgggtcctgcctcagctgtcacacccaaagccatgctg

SEQ ID NO: 18726 - DNA, 542 bp, Homo sapiens
  misc_feature 291: n = A,T,C or G
gaggccaatccttgggacaatgaacccagggagaagaggcaaagtccttaatccaaggagaacagctggtggcatgttaatccatgggtgatgcagggttgacacaccagtactgcacattctcaggtcacttgctgagttcatggatgtgaaacggaatgctcagatgccaaacatctcatgaccatcacatagccagtcagcgacagagctaggctgtgaactcgtatctgtctcattccaagatccctgctctttctatattccgtattactccatgaaaaaccatanaggagggtggctgaggttgaaaagaaaagaggatgcagaaattagagggctgagtcttcaggatttgatgaatcttagctttcctgactacaacacaaaccaaagtccagtccaaggggctcctgaatatcagttggacacccagataagctcctgactgattgccaccctctagcccccgtaggccatactcctgcacttaaaatgcaagattcttgtctgtaatcccagcactttgggaggctgacatg

SEQ ID NO: 18727 - DNA, 531 bp, Homo sapiens; identical to SEQ ID NO: 18678

SEQ ID NO: 18728 - DNA, 546 bp, Homo sapiens
aatacatgtgagcttttgcaacaaagggttgcagccatatcgtccagttcttgttggttacatgtcaacaacctgtgatccactacacctgtaaaatactgttagccctattttcactctcattatttaatacaaatgatcactgttcttttctattattttctcttcctttaattttcttactcccagtttttctccaccactccatcttcttcttgcataaacctctgctggtatctaacattctttattctcaagggtggcatcttaaagggcgtttcagatctttgggtcttacattaatttagttgtgggtccacagctgggaagctcagtatcaagactgcccaattactgataagaagagatagatggtcgggcacggtggctcacgcctgtaatcccagcactttgggaggccaaggtgggtggatcatgaggtcaggagatcaagaccatcctggctaacacggtgaaaccccgtctctactaaatctacaaaaaattagctgggcatggtggtgggcgcctgtagtcccagctact

SEQ ID NO: 18729 - DNA, 521 bp, Homo sapiens
ttgtgatccgcctgcctcagcctctcaaagtgcttgtgaactaccgcgcccggcccctaattactgcttttgaatgttaactttaagtgaaaaatcttttagcaatgttttgttatgtaaggatattttcatattcagtgactatgtcatcgaaacacatgaattacttataggggtaccttctacattcagagttccttaatttgtcgtcaatgaaccacctgaataaaaaaacgtaaatatgtgacaatgaaggtccacgaaagctaggtgcaagattacatgatccgattcttcacaacacacagctaaatgaaaatacagctactctatgaacctcaaagatctttgatgacactgcaaatgacacaaaagcaacctaagctgtatgcttttttagcatctactatttaggagggccaccttataaaatagatttgaatctcaataaaagtctactgtatccgcaggaaaatcctaataccattcactcacacaaataatttaactatccatttcga

SEQ ID NO: 18730 - DNA, 305 bp, Homo sapiens
ggtctcttgttcaaaaattattaagaatttcaagacagtgacagcagaacgttaaatcacacgtgaggctcctgggattgcacagatcgcaggccttcaaagctggttagtaatgtgtgcggcctggggagtcagggttcaggggagggttgttaggcctgccaccaagaggacgagaaactgatcggggtagccaacctctgccctctagaccagtggtccccaaccgttttggcaccagggaccagtttcgtgaaagacaatttttccacagacagtgggagggatggttttgggatgaaact

SEQ ID NO: 18731 - DNA, 509 bp, Homo sapiens
  misc_feature 432, 433: n = A,T,C or G
caaaatatctaactcagtaggaaaaatattattcagaaaggacatttggtttatgaagaataaagacctattggattaagtggaatgttttacttaaaagtagtttcctactcttttcaggaatattattggcaattaatcattgacgtctaagccagttcacattaaaaataagaccacaccaaaagacattttagattgagaaactaatgtgaacaattcatggggagaaaattgaaatatggcaatagtctattgtacagctgtcttgaaggggaatttgaaggccataactgtcgaaggattttcctaacttaacagaagcctgtgtacactaccagaagaattgatgtttgcagttccacccactgtgtactttttcatgatcagagaaatcattcaggacaacgcagttagcaaaccataactcannatggcaatatataaaataagcataatactaatagtatataaaccataaagtaaaatgtttaacatatattatttta

SEQ ID NO: 18732 - DNA, 607 bp, Homo sapiens
ctgctaatcatattgatgtgcatttagtgttcttttacctacacctgtcaaagtggctaaagtaatccttcataaggagataatttttttcttgtaggtgatttttttccacataatactctaacatttccaattcaattttcctcaaaaaagtttacatgatatacatatacaattactaaaactttggctgcataaataatttaaatggactttatttcaaagataatatttactttgaaagttgtaaacctttgaatcatcagttaattagaattatcttatatctttctttataaaataaagtttttttgtccctacatatttatgatttggaaattttcacctgaaaaatttcattttcatttggatgccttgtctttagtataaaattccatatttcaatttcaatataattttttgatttttacttgaagttatgataaaataagaaaagtgaaaaatagagataaactttaaataccatgttatttgtgcttaataataaaatcaagaaaataaaatatctaaaataattataactatttaaataaacaaagtatcatataatgggcaaaatattcttctggctagtcagatgattttg

SEQ ID NO: 18733 - DNA, 187 bp, Homo sapiens
tctaaattaacactgtatttcatattctccaggtctgactattaaccagattttggaacctttagggcttattatttagtaatccctgaagctctcaagtaggcgtttttaaattcatgcattagaacggattaaaaattagctagaaacgcatgttaaatggcccactccctttcttttgctaatt

SEQ ID NO: 18734 - DNA, 496 bp, Homo sapiens
tttatgctttggtaagcttttttgttaagttataacatataaatagaaaataaggtgtaacatataaatagaaaatatatgcctaatgcatgtgtgactcggtggatctttctggagctcggctctttcttatctttgtgctgttttatttcccgtcattctggagactctgccctgcatattctggccaccttggtcttccccaggtctcgtcagtgtcttctactcagcaagatggcagggctctttttggattccccttcctgtgctgcaattcagatactgcctccaggcagaaagctgaggcaatttggggctcacttcagtctttcccttctacagagaaagggctgcactgccttttgtcccctatctgaaaacagttatttcatgtattttgtccacttttctagcaatgatggtgggaggctaagtccagatcctgtttcttccttatggtcagcagtggaagggaggggtccagaatcagatgtct

SEQ ID NO: 18735 - DNA, 305 bp, Homo sapiens
gagtatttttagatttagctttattttgcatatgttagtgagctagaataaaagaaagacatattaatctctttccaagagccctaattctttatatcttctctattgaatgatttgtactattgtgaaaatgtaaatttttagagttttgcagtctaagatttgcagttcagctatttaaggcagcaactgccacattatagaactgacatttattaaggatcttttatgtaccagacatgttgaaatccattgtctaaatcatcacaacaaacctataaaggtaattattatatctattttac

SEQ ID NO: 18736 - DNA, 448 bp, Homo sapiens
tactcaccatcgatgaaggtaccctgagagcactgagaattcccacaggaaagaaatctatttactttataaaaaccaatatttccccaatgtaattgctctcagactatgtttaactctgaggaatgcacttgtggatgcctgctttagaaagatgaggaggtaggccgggcgcagtggctcacacctctaatcccagcactctgggaggccgagacaggtggatcacctgaagtcaggaagtcaagaacatccttgcccaccatgatgaaaccccgtctctactaaaaatacaaaaattagctgggcatagtgacaggcgcctgtaattctggctactcgggaggttgaggcaggagaattgcttgaactcgggaggtggaggttgcggtgagccgagatcataccattgcactccatcctgagcgacagagtgagactctgtctc

SEQ ID NO: 18737 - DNA, 226 bp, Homo sapiens
gttgagtgtgagcctgaacacagcatgaaacctgggaagtctctgtgaagcagctgtgttccctgggtccctttctccaccaccccctgcagcaggtgtctgtatgtctcctgccctctaggatcccagagatttattcttgagatgttgaaatacagaggctttgcacatgagggcacttagacaaaggagctacagatattggttgggagacctcaaagaaaat

SEQ ID NO: 18738 - DNA, 520 bp, Homo sapiens
cagttgctataagaggtcagtgaacacaatgggcctggctaggtacctttgcttttccactcagtgctcctgagtatcagtgaaggtctacttcattcaacttctgatgccaaattattaaataaaaaactttagacaaattaaatttagtagagtttatttgagaaaagaacaatttatgaattggacagcacttaaaaaccaagagaggttcaaggagctccaagtagcaacaaaggaagaccatatgtatagatagaaaaagacagaaaaagggtgtctgtatttatagatgtaggggaacagcttgattggtaatagcttggcattttccttgtttagatatggtgagatgagtcattcactttagatggacatgatcttcttggttggcattctgtgattggctaaagcttggctgctaagattacttgagagttggctacttattttagaatatagtcttaatttgtgttgcagtttgcctacctactacgttaggttgcagttctgcacatag

SEQ ID NO: 18739 - DNA, 352 bp, Homo sapiens
ttctttaaaatgttacatttgtactttgggaggctgaaatgggaggattgcttaagcccaggaattcaagatcagcctgggtaacatagtgagaccccatctctataaatataaaagtaaaataaaatggtatatttgaacactacacatcgaagataaaatcctcaagtgttatagaaatcaagttttgcatcattttgctggaacccttgtttatgcaagtggctccataatccccttcccccacctttaattagaagcaagcataaaggtaaaaaaaatcaatatacataaaattggtgaggatggctaggtgcagtggctcatgcctgtaatctcaggactttgggag

SEQ ID NO: 18740 - DNA, 535 bp, Homo sapiens
gtttgaggtctgagttctccattatctttgggaaactgggcaaattacctacgttttctgagcatcacttttcttatttgtaaaatggtccaacacctgcttcatcttcccatggtgttatgcactgaccaacataatagacatggaagtatgctgaactgtaaagcattggagaaaaaaatgactttagtgtgtggtgggagataatgggacttggtggatgggtgggtgtagggtattgtgttttaaggagtgtggaggggggaccatttcttcttagccaggtgcaaagaaaagctcttcactgtgttcaggttgtgagacaagaggatccctcctgatagataagtctttcttctagtccagaaaagatgctcttcctagctctgtatggctctagataattttgctgtacatttctaaatcttgcttccattgtggtgcaaaactaacaggaaaacattcactctgcctctagctttctcttcctaaactctgcccttcattttacctggagaacttgccttttccttct

SEQ ID NO: 18741 - DNA, 564 bp, Homo sapiens
cattttttatctgccagaaactctgaaagttttaggtctttacaagtatttacttcaaacagtatttctcaaactactgctacttgtgaaacgtttattttacaaaactgtcattaatcccacagggctgtcaagaaaaactattaatagctagagagcgaaaaaattagaagttgaaagattttatatcagaaaacaaaagttataaaatcggcagcaaaagacaaggaggaagaatgtgaaataggaggagagtaatcggtcagatgaaattgaagtcaacaaggttaagacgaagagctcaatgctggttttgtcaatacctaagaagttaaaattaaaaattaaagattaggccaggcacagtggctcatgcctgtaacctcagcattttgggaggccaaggcaggaggattgcttgaagtcagcagttcaagaccagcctgggcaacatagccacaccttatctttacaaaaaatttaaaacttagctgggcatggtggcacatgcctgtagtcctagctacttcagaagctgagataggaggatcacatgagccctgg

SEQ ID NO: 18742 - DNA, 306 bp, Homo sapiens
gcacaccaccatggcacatgtttacctatgtaacaaacctacacatcctggacatgtacacctcaacttaaaagttgaagagaaaaaaaagaataagcaaagcaaaactaaaacaaaacagaaaacaattacttctattactgacttgtttttaggagatgtatcataggttctactggtctttagtacctttcacatcctgattccgggaggtaacttctatggggttggcttgccagaaagtgaattcaagtacctactctctgtgtgatacctttgttaaactagatttcttaacatttgcct

SEQ ID NO: 18743 - DNA, 563 bp, Homo sapiens
gtatcctaagacaataattaaacaaatgctcactctgtcatggtttataataacaatattggacattactagaaatgaacagagaaaggcctcattcaatagacacactcatatagtaccataatgtattgttaagtgaaaaagcaggctataaaatgtatgtagaatatgatcctggtttgtaaaaagacaaaaaaaggaggaaggaaggagaggagagggaaggagattgaagaagagaggaaaggaggagggggaaggggtgtctgtgtgtgtgtgtgtgtgtgtgtgtgtgtgtgttgagaggggggaggaagcattggggtatgtgtgaatagggaaaacctcagacaggatcatgaccaagtgttaactatgcttgtatgcataatttttcttctcttctatatatttttctagaatgcctgaatgcccccaaaagctattttcactacgaaaataaatttaaactgtaatcacatttgcatagccactttataattaaagagaaatctttcaacaaattctccatcattatcttcagaggcagtcagtgattattt

SEQ ID NO: 18744 - DNA, 565 bp, Homo sapiens
gtactagagtataatgcaactacatgaacaatagacattcaaactttatgtgcaaaagtctttcttctattctgcaatacattttacatcatccaatgttataataaaatctctattctccaggcttgttagctgttttattcatttatatccttgagaaaaagggacaatttaaattgatacaatttaacctacttctagaatttatcctaaggaaatcaacagaaaatgtaccaaataaatatccataaaatgttaataatagtatttactttatttcatttaattacagtatttttaaagggagaaaagtaagaattgtgtaaaatctcaaacaataagattatttaaataatgatacatcacacaaaggagtcctgaaaagcaataaaaatcatgatgcagaactatatttattgacatgaataaaggataagcccatttatctaaacaaacggatattgctatatgtttttaggcctatcagtgtatcttcaaagaaactctaaaacacactttgaattgtctataacaggactatgaatgagttgcctttattttttat

SEQ ID NO: 18745 - DNA, 383 bp, Homo sapiens
atacactcgaaaccagctataaatattggttattattgctaggatgctgacgttcaaatataaattgccaaaatcatttgggaagcattgcatactccattcccacatggagagttgcagggcatgtgattatctgtttgttcatttagtcacaatattgatcaatatagaacaaagcagtatattttaaaaatcaaccaggagcagccattctttgaagtgttatgcaaccattaaaaattaggtttggccaggcgcggtggctcaagcctgtaatcccagcactttgggaggccgaggcaggcagatcacctgaggtcaggagttcgggactagcctggccaacatagtgaagccttgtctttactaaaaatataaaaatc

SEQ ID NO: 18746 - DNA, 557 bp, Homo sapiens
tctatagttttgtttgggcacagagaatattaagtagtggtagttattgactcatgaaactgatcaatttgggggaatataatgatgaagggtagagggaagagtatgtttcagaacttctcctgtgtctctattgcttgatttatttaaacaggcatataatcttcgtgctttaagaaaaaagtcaaatgaagttaaaatcaaagaaaatgtaagctattaaagataaatttttaaaaggttgctaagaatttcaaaagacacacagtagtcaaagagaataaagattcaggaaaggtcatatgattagtcataagtcataaggtgacttaaaggttactgtacaatgttccatttaaaacaaagtgaggatgggaggttgactgagactttaacagcaaaggaggagaagaggagaaagcagtatgtatgtgtgtgtgtgtgtgtgtgtgtatatatgtaaaataaaaacatttatatataatatataaatatacataaaatatttatatataatatataaatacataaaacatttatatataatatataaatat

SEQ ID NO: 18747 - DNA, 518 bp, Homo sapiens
gcatttattgaatgatatattatgccctaagctctgaacttgaggctgtaggcaccagaaaagggggaggtgctctgctgcagcctggtctgcaggtaaaggcatacagacattgcgtgtgcttacacagtgccaagcacatccaagaagcaaaggcggttctgaaattctgaactgattcaaggcttattttgatctaagatgaccatatgtccaagtttgtccacaacagtccaatgtgtagctccgtgagaattgttaagaatgtcactaagtgctgtcaaatatgtcccagtttaaatagtaaaatatggggaccaccctttcctagtcccaaattaatctaagagggcaagatttaatcttacaggcagctcgtccctcttgctccttcctattgcagagctagggccctaggaagacctggtctaaggcagatcttgactttggcaaccacaaaattgccctgctaaaaatctccaagaaggatgtaaattcatacaccctctgtggaaaac

SEQ ID NO: 18748 - DNA, 565 bp, Homo sapiens
ctacgcttcccatggtcgttgtgaggaaccagtaatccgtgctgtcacggctcaactaggcagttgtagtggaccaggaagcaagacccttctttgctctgggcctctgtaaaataggacatccctctgtcctgattcatgcctcttgccacagcataattcctcgtagcacccacttttactttcagagctgccctggtttttggatgacaaaatatacgaataccttcagtaccccagaggttgcttatgagaattaaatcaaataactcatctcacttctgctgattcacagggtacctcaggcaagttgctttttccatctcagcttcagttcgcccatctggaaaatggcaataataccaagcatctggcagcctgaggatgaaataaaaatcacagaaccttagagagttcagatcaggcaatcctgaggttcagatcccaattcggcctcttgatggctgtgtggcttgggcaaattgctcaacctctctgtgctttattttattcatttagaaaatgcagtgtgaagctgggcactgtggctcatgcctgtaatccc

SEQ ID NO: 18749 - DNA, 414 bp, Homo sapiens
gcatttattgaatgatatattatgccctaagctctgaacttgaggctgtaggcaccagaaaagggggaggtgctctgctgcagcctggtctgcaggtaaaggcatacagacattgcgtgtgcttacacagtgccaagcacatccaagaagcaaaggcggttctgaaattctgaactgattcaaggcttattttgatctaagatgaccatatgtccaagtttgtccacaacagtccaatgtgtagctccgtgagaattgttaagaatgtcactaagtgctgtcaaatatgtcccagtttaaatagtaaattatgggaccaccctttcctagtcccaaattaatctaagagggcaagatttaatcttacaggcagctcgtccctcttgctccttcctattgcagagctagggccct

SEQ ID NO: 18750 - DNA, 563 bp, Homo sapiens
gataggttcaaagctttgattataaatcagttgtttagaactaggaacacattttcacatggaatcataatcatagttaaaatgtgatatatctcaataaaatcagtagtaaaaaacttacgaaatatcaaacaacacagaaagccaacagactttaataaaacataatttaatttactttagaaagtagcacttcaaggaaaagattttatgcgaggcttctaggtgattcagaagagattttcagagaaattctaaaagctttgtaagagctgatgaccctagttctttatggtttattttacctcaaattttatggtttccctttctttcagtataagcaaaacaccagtactcttatacttaatagccatgattgctatcatttatttcacaagcaagagagagtaattggggaagaattagaagaaggacaggaaagagaaaggagtcataaaggatgtgcccaagtacaaagaaaaaagacttagattagattaggtaacttcagtaggaaaaaataaaaaatgaaaaggaggtaaagcacagcattaaaatattga

SEQ ID NO: 18751 - DNA, 454 bp, Homo sapiens
gaaagtattcaagagcaccatgaccctagttgggcggagatgaagatgagataccttggcttcctgctttggaagacctaacagtggcttgtaaaacaggctggtgaggacccatgctcccaattacacagggcctggagaaggcaggaagaggctttccatttaattttccattttaagtagtttaatatttgtcagccagtagagctgggtttggaatggcagaagctttgggggtggactgttacaaagtgcacacagctgccgaggccttgcaagctttgggcagctgtgggctcaaagcagggttctccatacagtattcacatggtttattcagagcagtttggggaaatttcagacaatgctaaaccatcctttaaaattcctggacctttctttactctttaagctgattcgcatcatgttggttatatttaatctaaatattttt

SEQ ID NO: 18752 - DNA, 553 bp, Homo sapiens
aaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaataatgtagtcttgttctttgtggggaggggaaaggagacagtcattttcctagaaaatgaatcctatccatttctcactgagcatcaatattggcttgctatttcaaagttacttgtcatagattatccttgtgttttattagagataattaaaaatttttttttcttaccatcttcaataatgaatttaagccatgtgcagatgttagctatggacattttaggaccatcatcatttgttaaaatgaatagaatttaaaaagatatttctggatatgtagtcttcccagaaaacaagaccatccccttgtatgtagtattatcttaattaacttgagttttggctgcctaacctacttcttgaaattttatggggtcattctactcatattatat

SEQ ID NO: 18753 - DNA, 412 bp, Homo sapiens
atcccagcactttgggaggctgaggcaggcagattacttgacgtcaggagttcgaaaacagcctggccaacatggtgaaaccccatctctactaaaaataaaaaaaataaaaaaataaacattagccaggcatggtggtgtacacctgtaattccagctacttgggaggctgaggtgggaggatcactcgaacccaggagctggaggttgcagtgagctgagattgtgccactctcctcaagcctggatgacagagcgagactccatctaaaaaaaagattatagacatttaaatttttctttttatctgtatttttaaagttttcctaatgaacttagacttgcttttgtagtaagtaaaatttgatcaaaattatttttagttaaaaaaaattaacttcaggctgggcgc

SEQ ID NO: 18754 - DNA, 554 bp, Homo sapiens
gtgctactgcgcttgctgcaggactcacaacataacttgttataacctggtatggagcagtatcgtgccaacacttccatttgacagaatatggacttgtctcccaaacatggttcatctgcaaaaataaaaagaaaataaactaacactagcatctaaacataaaataaaaggaggaaaaaaattaaaatttttaatgaatgtaaaaagatttaagtgcaatctgacactaacgggagtgatccacacgagcttttgcattaaaaatatgaatattagaatgaattcactaaaataagtagttctttgtctacaaagtccttgtgatgatcattattttaatatttccaccaggagtcttcagaccacagagggtatttttttctccaagtaggaacctatatctgattttagaatgggcaaagataatttatttaacgttgtggttaaatttttaggatgcaaaggggcatctgtatttttattttatggtatttctgactttctcagagggtactccctacattacgttaaaatgtgaaatcaaaataaat

SEQ ID NO: 18755 - DNA, 374 bp, Homo sapiens
gaaagggacctggacagccatggggtggccgggatgagccccttcctctctgtgccttggtttccactgtgggataagggggccttagcatcagcgctcagagctgtggagccaggattcctgatcgggcgctgtctctgccaggccagggcacttggacaccacgctgcaggaggctggtctcgcccaagcctctgtgggaagggccgccaggctgagtggagggccagccaccagctaattccagcccagggatcccccatcccaccctgactgcatcctgagaaggggggacgccacttcgggaaggttgttggggcagcacaggccctggggccctgctctgtgaccttgggcggccccctctgtctctc

SEQ ID NO: 18756 - DNA, 511 bp, Homo sapiens
caacaatatacttttgacacacacaaacctttgatttggtttcaaagattttgcaaaatagtaccaatgtaatttacaactgtcatctttgaaattgtgtaaaagtggaataattttctgaagaaataaatcctggtttgtcaatgagttgcagagactgtctgacattaactttgtcaagattaaaggataaagtatatgacaatttgtttcatcatgctcatgacattatgcaattttctccctagcttttaatttttggaggcagaaaattgagccagaaatttttagtcattaagtctcctagcaacaagctgtaaaccttccaacaagcttggactagaatctagacactgaaatgcacatacatgctttatgtaatgcagaatgcatttattggagaactcataaacatcctataaaattttcttccctgagatgcaactataaaacttggccctattctgagaatgcttaacatagatttcatccatactgtaacactgatttt

SEQ ID NO: 18757 - DNA, 372 bp, Homo sapiens
gcccaccaccatgcccagctaattttttgtattattagtagagacagggtttcactgtgttagccaggatggtctcaatctcctgacctcgtgatccgcctgcctcggcctcccaaagtgctgggattacaggtgtgagccaccgtcccgacttatttcagccatttttaatttgctaatagtcacgaaagatttttcctagtaaaaattctgaactcaacagcaaacaagttttcatgtttaaaacaatcaatcctcaaaatcctctaatcttcctaaatattctatgtctgataggaataaaatgatgagataacgcatatattttgctatagaattttgcacagaatttaaacagaaatgtcatttatc

SEQ ID NO: 18758 - DNA, 553 bp, Homo sapiens
actgcgcccggctgaagaaggctcttaattacctagtgatgatgcgatttttttgaagtggtaaaacaatctgtgctaaaagtgatagacagagcacagtacaaccacccttccatttatacaataatgacatccctttaaaatctagagtatgttaaaactaggtaaaaatattttgtgtttatatgtcaaagcagacttagattctaggttcagattgttaaaaatgtatcatacttatacatgaatgtccattttgatattataaagtcgtggtggatgtaggacaatccaatgtcttacaagactgtcctgcacattgtaggatgtctaacactcatggcccctgaccatcaaatgctagtagtctctctgtgacaaccaaaaataacaccacaaatttccaacattcctctaggaggtgctgtcactttgatcaagaaccatcaatatagaggataacttccaggctgtaagccatttatgtttgcattcatgaaaccctagatgatccatggccatcaaggtaatttgatgggcttgataatttgag

SEQ ID NO: 18759 - DNA, 554 bp, Homo sapiens
aggacggctgctcagagccactcctgtagggagtaaatgaggaaggagaaatgactccatctgcaaggagggaaactggccgaagtgagttctagaaccaaaaccacaatcacagatgcaggggctacccacaaatcacaggtgcaggggctacccacaaatgagttgaacagaaagctgggaggtaaatccagagagacttcctggaggaagggtgcttgtggttctaccaaaagaggggggagtcaaggtaagagggaggcattttgagtgaggaggggacacaccaagcactttggcttagacgaaaccacaagaaagcgaattcagagacagagagagtttgaagcagcaggtatagatgaaggaaaggtgggcagggtgcagtggctcatgcctgtaatcccagcactttgggaggatgaggtgggcagataacctgaggtcaggagttcgagaccagcctggccaacatgacaaaaccccatctcttctaaaaatacaaaaaattagccaggcgtggtggtgcatgcctgtaataccagctagtcgga

SEQ ID NO: 18760 - DNA, 493 bp, Homo sapiens
cacccagccggggaatcagcaagtccatctacgcttcccatggtcgttgtgaggaaccagtaatccgtgctgtcacggctcaactaggcagttgtagtggaccaggaagcaagacccttctttgctctgggcctctgtaaaataggacatccctctgtcctgattcatgcctcttgccacagcataattcctcgtagcacccacttttactttcagagctgccctggtttttggatgacaaaatatacgaataccttcagtaccccagagattgcttatgagaattaaatcaaataactcatctcacttctgctgattcacgggggacctcaagcaagttgttttttcatctcagcttcagttcgcccatctggaaaatggcaataataccaagcatctggcagcctgaggatgaaataaaaatcacagaaccttagagagttcagatcaggcaatcctgaggttcagatcccaattcggcctcttgatggct

SEQ ID NO: 18761 - DNA, 315 bp, Homo sapiens
tatatatttacgtattcgcatcctcctatctgcttgttccagaaggaagacattctgaccttgtaaatggcccatgcttacaatttattttaaaagaaattttaggtttttggaactacccaaagatattttttaaaaacattaggtgataggtaactaaaactaaatggtaagtttggctaaattcagcaaacattaggtaactgtaatgtataaggtattgtgtttggtggacatgagagaaagatgacaaaaacttgatgtctgtattcctgtggcttgtatgccattagctgactcagataaattcataaa

SEQ ID NO: 18762 - DNA, 551 bp, Homo sapiens
cactggtaagtagatgcagtacttgagctaaaagttttatttatttatttattatttttttaaaagacggggtttctctgttggtcgggctagagtgcagtggcacaatcttggctcactgcaacctctgcttcccaggctcaagcgattcttgtgcctcagctcccgagtagctgggattacaggcatgagccaccatgcgtggccaagataaaagttttttgttttaaaaacctaatgatttcataaaagcactatttgtatagatttttcacaggaaggcagaagacattgaaaatgatgccctttctcctgaagaacaagaagaatgcataaattatctgagaaagaccagggactacctaataaagattatagatgacagtgattcaaatctttcagtggtcaagaaagtaagtagcaggttgttgtatgtacgttcttactgataacccactggtcaatgtttttgcgttggtcttatattttggtaatttcaaaaatactcagtaatatgttgttattaatgcacagaagggatatgtgtgtct

SEQ ID NO: 18763 - DNA, 545 bp, Homo sapiens
caggggtgatgttcttctttcctcccaaataggccttcaaagtttccgctttatggttgattttccagaacttttgattttcaaaataacattctgaagattttgtcctgaaatagtattcaaaaactagtcttcccatatttaatgaaccctggattctttacttagttgcttttttcttcttaaattacataccacagaattttaacataaatgtagcatttaatttggctttttagaaaagaccagcacctgctgtcttcattgccaaattctatcaaacatgcaaagaagaactgatgccgcttttcctcaaactatcccagaaaaatgaagagaagagcatacttccaaactcattttagtaggccagcattaccctgatttctaaacattttgttgtgacaaggacacaacaaaaaataaaattacaggccaatattccttatgaacatagacgtaaaaatcctcaagaagacactatcaaataaaattcaccagcatattaaaaagatcatttattatgatcaagtaggagacattct

SEQ ID NO: 18764 - DNA, 387 bp, Homo sapiens
atttttagtttactaacaggaagtaatttctttcccttaaaattcccttattttaaaagaaagattgtgtataacatatgaatcctgtcatttttgtcttgttggtcaggaatcgaaaataaaatttaacaggttttaacaagtgtgattgagatttgtttcctaatcactctacatgttttttctcttttgcatatatgtcattatttataagcaacttcaaatagaacagaaggtagggcataaattatcaacaactttagtccaaaaagatgttaatgaaaaaagtaacaatatttgtggtataatatatgccgtgctggtgagtattgttggttgtcttataatcccaattgctgtgtgtagttactgttccctctcctttcc

SEQ ID NO: 18765 - DNA, 416 bp, Homo sapiens
gggagttaggacggcaccatatagattttgaggggcccatgatatacctgtggcttctactaatgtctttattccaacacagccacagtggttcctgttctgcaaacgtggcagagcctccgctcctccccttccccagctgccactccccatcagccacaggccccatctctaccatgccctgtcctcagtgccctcctggcctccccactgccctgcctcagcccagaccctcagctccctcccctacactcatgtacacctgaccggggagccagaaacgtgccccagccctgttactgccccagcagaatccttcccagctgaagaagagactgcctccattcaggatccttccctgacctctgcaggtgtgctcatccccatctacagatgaagaaactgaggacttgata

SEQ ID NO: 18766 - DNA, 541 bp, Homo sapiens
actaacaagggacattgtgactcccatggtttttttcagcttagagggaattgacttatcacccagcttctcaccaatgcaatcattctcttactgtcaaagttcctgggtgtttgtttggaatagtggtgatggtgaggcgggtggaaggagcaaaatgtcgattacacttgagggaagagatttcagaaatctgagaagaaaaataggagtcaccacagaccctgcttatccagagataggacatttctctattgtagacttcaaactgtggttatctcaggccatttttgtttgtgtgggtgtcttttttgcctgtactggcagcactctctgcagagtggatggtggaggttctatgggataagatagagaagaacatttccgtatgtatgatctcagtgactctctaaataaagattcctggtgtgtaaatgtgttggctatctatcatcgtgcctctgttgtcactgactgcttttccaacattaagcaatttaagattgtgtctacactgcacacacacagatgcacacacaca

SEQ ID NO: 18767 - DNA, 405 bp, Homo sapiens
cttcctgttctgagactttgttccaggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaaatcttttgcccagaggggttcctcagtaaatgctggagatgaggctcagacctgacctttggattcccagatggagtgctctgaaccgtgtacctggggctgtcttcaccactcaaatatcgatagagataacatagagatgtcctcaggaagataaccaactgttcccatcctgtgtggtctacagattgggagata

SEQ ID NO: 18768 - DNA, 563 bp, Homo sapiens
tatgcagaagctttgtaaagaaaaccagagcttgggtagtgggtagcagtaatctcttctcaatttcccctatgaagagataaactcattgcagtctatagctaccaaacacagaggtcacaagatttctgtgacaagaactcccactgctatggtcttccacaaataatgctaatggaaacagagaggaaaaacaattatcaaacaatcaaataaaggtctgactgtaagctctttttcaagattttgcatctgaagatatcagaaaggaaagcaattcagaggtgcaaattgcctaaagtgcaaatcaataacatgctgatctaatgctcgatttcatgagattgctgttatataaatgtagggaaaagcaaataatcaggagctaaaattgtctcttatcagagaaagttcataattagtttgcattttcacagagttccaaatagtactgattaattaagccaatatgtattccaagcagcaacagctacgaatagtcagcctgtgtggggagaagcacaaatccagtgaattcaaatttaatacccctaattgtacct

SEQ ID NO: 18769 - DNA, 311 bp, Homo sapiens
tacggctgccagaagaccacagaaggggctgcagtccctgtcctcatggagggatgccccaagctgtgcaaacagccattaagcagatggtcacacctgtgatggttgccaggcccaagaagcatcatgagctgtgaaaacgtggagcagggaacctagaatttatttctgtgcctccacagccagcctgttcccagcagctactcactcagtcactcatcaaatgtttgctgtgccttgttggaccaccctgaggaggtggagatgaatgaaagagcttcctgcctcaattaacagagagcacatttaag

SEQ ID NO: 18770 - DNA, 423 bp, Homo sapiens
ataagtatttttcttttgtactctatcattcaagttgctactatggttctgtcaagttagttatctcccttattacaaaggtaatacacttgatttgcttaatctgtgtcttttggtggaatttttggggagtcagcaatctacagagattacattctcaaagtcgctctggcttcagtcccttgatcttactgagtttttgtgtattgtcatctactcccttctcttgtctctgttctgtgttgaccaagacataaaactaactccctttcttgtttttttaaactccctaatccccagcaacaaccacaacaaagtccagtctcacaaagcatttgcatgtcaaacaaactttaaaaatttagtaacataaggattcatatagattagcaataacaacttacatttgaatattagatatcc

SEQ ID NO: 18771 - DNA, 528 bp, Homo sapiens
cagccactagagaggaacagaactgcgacggggccttatgctttccgacctttgccccagggctttatctgctaagaatggtaacagtcaccacatattgattgctggcattgagccttggcctttgcgtttacatgtaaccagtggcgaggcatctgccacagtccccacggttcaggtgagtcattgaggtgacttgcccagggttgcatagccaggagctggccggacgggaatggacctagagtccccgactgcaggtcttgtgctcgttgcccttctccacgcaggagaaatgaatgttccttttgtaaccacagagaggaaagaaggtggcaagcctttttcctcaggcaggtgcttgctggacttaggctggtgggctgagggtgtgagtgtgaagaagaaaagccgcgctaaagagcataggcacaattgtggaaatgagttgtctaaggctgtttaagtaggagaggggatctccgggctgacacagtgcccaggggaacatcaagatgattaacaacg

SEQ ID NO: 18772 - DNA, 386 bp, Homo sapiens
cttcataccaaccccttaaagtactatttgaaaatagtactttaggccaggcatggtggctcacgcctgtaatcccagcactttgggagccccaggcaggtggatcacttgaggtcagtagtttgagaccagtcttctctatgtggagaaaccccatttctactaaaaatacaaaaattacccaggcgtggtggtgcacacctctaatctcagccacacgggaggctgaggcacaagaattacttgaaccgggaggtggaggctgcagacagtctgggcaacagagtgagactccatactttacatcaagaatcagagaagagtgatttgactcaactcacatagctagtaaaatgcttaagctataccatctaactacttgactc

SEQ ID NO: 18773 - DNA, 554 bp, Homo sapiens
atgaaccagcatactttaatctgcttgccatatatcataatttgtttctgaatagttatacagtacaggcagtaaatgcctatagagcctagacatgagaaaaagagagtctttggagataactgtgagtgagaaagtcattggagggttttgagcaaaagagcgtatgatataacttgcatttttaaaggatcactctagctactgtatagaaaacaaacagggaggttgggggatgcctctagtagggagatcagtcagagaccattatatcaattcaggcaaggagatagagactttgacctgggtggaatagtggagatagggggaaatgaacagatttttgacatatttttttaaagtcaaagaagcagaacttgttggcaaatgcaataatgcaatatgaaaggagtcaaggatcagtcttaagtttttggcccaagtaactggaagaataaaattgccttttagatgaaattgccacaagaatgagtattgatagaaaagaaaagagactgaagaactaaaccttgagacacattagcaattagaaa

SEQ ID NO: 18774 - DNA, 526 bp, Homo sapiens
tctgggaacatttcctaatccgctttgtaagggtgcttcaatcttgtctgaaatctacaataaactaataggattttttcttaaagataagtaagttcctggcttattttcactaagctgagactaataacgcttcaattctaaacaaaatattatttgtatcttatggctttgggtcagattacccatctttccacactgtctctaaaaataatacaaatgacgaagaacaagttgtaccaaaagcactctgttattcccactctctggtcttttgcgagacaaaatgacataactgaaatagcaagtcagtctggctggggaatcaatactgagtctgtaaattatcagctgcatagccttaaacaaatcacttacctgctctttgcctcaaattcttgatttatccttcattctacagcaaagggagacaaaggggctttcccagttttctacagtttggactctagggtaagaggattttcagtaatcaatactatctaaagtgataaactgcttgtatatc

SEQ ID NO: 18775 - DNA, 302 bp, Homo sapiens
tatataatccttggttgcagttcattctctgttagcacagtgaggctataatcccactgtactccagcttcttttccccctcctaccgccctgatctagagctgctgtgcagggagagttgtgtcctgccagcagggaaacacatgtttccaaagaaacattatgcgatgtcacgggttctattatctgttgcagtgtctttgggctgagaagcctgcttagcccggcatgggtacctaagtaagacgggtaacactgtctctgttggaaatgcgtcacacatttttaaagctgagcgtaat

SEQ ID NO: 18776 - DNA, 541 bp, Homo sapiens
tgggtctcatgagatctgatggttttaaaaatgggagttgccctgcacaagctctcttctcttgtctgccaccatgtgagatgtgctccaccatgattgtgaagcctcctcagccatgtgaaactataagtccagtaaacctctttcttttgtaaattgcccattctcaaatatgtctttatcagcagtgtgaaaatggactaataaagcatgatatgctgctggtccatgtaccactctttgagttagcatcatttttttcccccagatcctgtgcccaggagacatttaataaaggtgatgatggtaaaatatttttgttgtagtcgggactttagacaagaaaaattatattccaagtaggcctgaaatctaggatctttgcccaagtttattcattacatttcatcataatcttcccatctttatggtctcttggaaatgtaaattggtattttatacctatttgagaggtggcgattgtgatcatcttatatttacttagaatgttcctaaaaagtcatgagattctctttggaaa

SEQ ID NO: 18777 - DNA, 432 bp, Homo sapiens
actagagaaattcagtttttaatcctcccaaaatgacttgaagtagaatttactgtttctttactatatatcaaatttgtataactaggaagaggtacatatgctctcctactagggaaatacaacatatatattagctggataatgatttacatttacatttttgcacctttatgaaatttgataaacttctagaacgcttgtttttaaatgtttaacaatgtaaaagttgttcagcaattttttttaactcctagcattacagaagttaatttctacaaaactggttttctgggctcacaggtaaatgtaaccagaaaaagccctaaacaaattgatggaatatagatggatcaatttcttagtacagtcatgtaccacataatgacattttggtccacaggagattgcatatgtgatagtggtcccata

SEQ ID NO: 18778 - DNA, 521 bp, Homo sapiens
gctccaccttctggttattacgctgttaataaaataaaaacatctcgtaaaagagataaacttctctttatgcaaacaaaggtggctaatggaaatgtctatctagaaagtcagagtttgttgtctttgttttgcatacctgggctctcgacaatggaaatgaagcaatgccaagagattcagggccctcacagtgccaggccaggtgctgtgtagctatagatattagcccatttaatccccaccacagccagatgaatgagatggcacaagattacaacaatcctcccaaatgacagtaggtgaaatgtggaaccaagaggttaaatcacttgctcgtgttaacacagctatgaaaggacagaggcgggatctgaacccaggccccctggctctagagatcatgctgtctagagacctctctgctatcctgcttcttgatatacaactctgaaatttcagggcagttaaaatgcggcagcaccatgtcactcccacagtggcactgtgagtgacagcgc

SEQ ID NO: 18779 - DNA, 492 bp, Homo sapiens
atcactcatgggataaaatctaagctcttttgcaacaaacccaagacccttcaagatccaggtcctacgatttgccttacctcatcatctctacacttccagctccaccccaacatgtaacttagtcaaattacacaactcagtagattttacatttcccattctttcacatttccatctcttactactccatttgcttaagaaactttcacccacttcatcacctagctcggccaggaccagctactgcacataattttgggggtccagtataaaatgaaaatacagtccccttgtttaaaaagtatgaagaatttcaagatagccagaatagatgtgcatgccatgaacccagccctgtcctcagctcaatttttccttccttgtaaatttttcccattttctccctaagagatgtacgtttcttctctattcccccttcaccccacagagtttccatgttaacatttaccctgtgctatttttattttt

SEQ ID NO: 18780 - DNA, 162 bp, Homo sapiens
ataggaaaagaaagcagtaacccatccccagcaaggccaattggcatctgagatgaacaaagacgtcaccaaatcttccaccaaagctccccctccagtggatttcccctgtgtgtagcaagagagagcattttcagtcattcagtataaatgaacattcag

SEQ ID NO: 18781 - DNA, 521 bp, Homo sapiens
ttgctttcaatgatcctgatttcctctctccaccgcagtatcttgattgcagtaaagcacatttcctcatcattctttccacacacattactcattcccatttctatccttttgcccagacattttctagaatttactcttacacattctctagcccagatcattagctgtaacaaatgagggttgcctcaatcatatcttttgtctcctaattgaaattctatcttgtattatttgttgcttcatatcagtgaagttgtgtccccaggtatataattagaacatttatagtaagcatcatatcttaatttctttaggaagtgtctaccatgtaaccacagatgaaaaataaactcttgctgattaataatgaatgtgattggcccggtgcagtagctcatgcttgtaattcctgaactttgggaagctgagatgggcagatcacttgaggtcaggagttggagaccagcctggccaacatgatgaaatctgtctctactaaaaatacaaaaattatctgg

SEQ ID NO: 18782 - DNA, 399 bp, Homo sapiens
gaagcatgcaatgtatcctctattttcaagattcacacagcctagatgaatatataaggcatttaaccaagagcaagttagtgacaaagtaggaacatgggcagtggttagtgcagaggatccgggaggggaaagaagctgggaaaccttcatgaaatagatgagcttgaagaaaagaaggattttcacacataaagaaggagggcatttcaggtgggtgagcaaaaaactaaaccaaggcttttacagagcattcctttttatgcacacttgaaaatctcaagaacttattctaagagagcattctttgcaaaaagcaggtaattgagaaactctgaagtatagatttattcataaagtttgttggtttctatgaggaagaaatttcatatatgatga

SEQ ID NO: 18783 - DNA, 537 bp, Homo sapiens
tgttgtatccaaaagtctctgataaattacagtggctgttaatatttcaagaggttatatcagatacctgggaaattttctcctgccaaattttgctatacttcatttttttaattatcagtttcataatttataccttttttcacagagtctttaaaaattttcctttgaaaaagttgatttctttctttgttaacttagaatttcttttcattttttaaaaatgtattttgccttttgtgttttggtataactttataccaaccaagagtgtcatatttagacaagaattaaaattatggaccttttaatggtaggttcttgagaagtttgtagttaagtggaagagaatatcagacatttgcgattttgcattctggattgtgagctctaaaaaggagataattaaaataaaataaacagtagtagactaacttctaaagaattaaaggaagtaggccaggtgcagtggctcacacctgtaatcccagcactttgggaggctgaggcgggcggatcacgaggtcaagagatcga

SEQ ID NO: 18784 - DNA, 571 bp, Homo sapiens
ttattttcatgtgagcctctcaacaacctgtaaggcaggcagggaaggtgtaactagtattactgcacagggactcatggagttattttgatagggtaatatataaaatcagaggtggggtgtacatttattgctgtgcatgcaacattgtctaccccatttcctgtaactaatatcctcaatatctatctggttctttgttttggtttttcacctatacctagtcaaagtttatatgtgtcactgtttattcattcagaatacatttgaggatacattggggtgggctggggggacgtgaaatgtggtaggtgttgtagtaatgaaaggacaattaaaacgaaagcttaagatttcttaagagaatcctcgcaaatggcagtaggaagtaaaattagctacccaattgctataaacacatacaaatgtttgatagagtataaccaagtatctgtgtatgcacttatatatgtatatatttatatttaaaatagatattcctaatgctagatgacgagttagtgggtgcagcacaccagcatggaacatgtatacatatgtaactaacctg

SEQ ID NO: 18785 - DNA, 559 bp, Homo sapiens
cagagccatagtaagtcaaacctcaaaagaatcttacttaagatatatttaagagaatggggcatgcagtgtggagtatgaaatgagaaggtggcatttaaactcacgttaggaagaatccctaattggtagttttgctaattcaatgcaaagatgctgagagtggtgggaatctccctggcaagttgtttgtgtaagtataacagtgtggagcagctttggacatgccagaaacaaagccgctcttaacaggagggctagagggcttcctgatgccaagcagtgctaaggagtccatcccccttgcagaagaggggcaccaactgttttccatgtcccccataacctacaccactcataccttataggaaacaggtgcagagaaggacttacccctggacttgaagtaagtgaactccaattggaatcaaagtcttgtgactccagaggtgggagagggataagttattatccctccggagggataatttaaggtagcaccataccgtggggttaagaatgggggctctaagtcacataaacttaagtttgaattttg

SEQ ID NO: 18786 - DNA, 495 bp, Homo sapiens
taattggctgggtgcagtggctcacgcctgtaatcccagcactttgggaggccaaggcggtggatcgcctgagatcaggagttcgagaccagcctggtcaatatggtgaaatcccgtctctactaaaaaaacaaaaaaattagctgggcatggtggcgggcaactgtaatcccagcacttgggaagctgagggaggagcatcgcttgaacttgggaggtagaggttgcagtgagccaagattgcgccactgcactccagcctgggcaacaagagcaaaactccatctctaaataaataaacaaatgaattttttaaaaagagtataattaactgggaacatatcaactttagtttttgtttgttttttagatgagtcaagggaaaaatacttcgaaaattgagttctcaggccaggcttggtggctcacgcctgtaatcctagcactttgagaggccaaggcgggtggatcacctgaggtcaggagtttgagacc

SEQ ID NO: 18787 - DNA, 539 bp, Homo sapiens
gttgacacgcaataacaaatatgaaagttgggtgtccataacacaatggcttttcccagtgacttgtaaatcattcagattgtgttctttggggatccaagaccaaaacgtcaacatatcccaatttgaaaacactattcaggaagttgcttctgatggtgggaaacatcccagacagcaatgtggcatgtagcactacttccttcttttatctttcgttaatcatcaataaagatttctattttgtttgaatcatatagattataaaccatctattttcctctcaaatataatttggtcacttgtggtaattctgggggaatttaaatgttttattttggtcttgttaagtttgaaatgcctattgaacatccatgtagaaatatcaaataggtatatgcatttgcaagcctagagttctagtgtaagtcagagatgaatatagatgagtataaaaatgaattaaataaaacagggtaaaaaatgttcaagaattaagatcaagggattacagtaacttttgggatgaaatgagggca

SEQ ID NO: 18788 - DNA, 477 bp, Homo sapiens
ggtacagaggaaagtttagaggcaactgaccatttggagttttaagacaattgatggaagagggcttggcatctggatgagaagtggagggagaaggtaattttccttgcattttaaactcagaccacatatcacatcagaatcacctgagggagacattttcaatgcatattcctgggtttcttcccttggaaatttttatttcttaaatcttgagttgtgctgatttatccatatttaccataagaattttggataattcctactttgggaggcccaggcagtggatcacttgaggtcaggaattcaaaaccagtctggccaacatggtgaaacttcatctctactaaaaatacaaaaattagccaggcatggtggtacacatctgtagtcccagctacttgggaggctgaggcaggagaatcacttgaatcagggaggcagagatgacagtgagctgagatcacgccactgcac

SEQ ID NO: 18789 - DNA, 510 bp, Homo sapiens
gggctcaggtacataattttatatgcaaaccaccattctcctaggttttctatacacatggcctttatgatactaatcattctttgaaattattaaaattaatgtccacaactggaaaatatgttcacttatactatttgggtaaacagtctacataatgaaaaggaattgatggaccctcagacatcactggggaacttacaagagattcaagaaactgctaaatgagcaaagatagagggaattattattcgatgcttgttaaatcttcatgtacatcaccacaccagcatatcaagataggaaaaatattactcaggaaagttaattccacataaaagtatcctttctatggagaagaacttaaaccaaactttccacttgaagtaatatgagaattggtttactgtaacatttaagtgcaaaagaggaggtaagaatgggatcactgtgtaagtttcataaagtaatcaactaatcttaatcctcccattttcacttggaaaggac

SEQ ID NO: 18790 - DNA, 187 bp, Homo sapiens
ataaatgagaataaatagacgtaaaatagatcttttcgaggatgaagtaaatggaatgaaaaccaaaacccaagctgaccagaaatcatagagggaagaaaaggttataaatatatggatttttcaaagtgattttaagctattaggaatcagttaaatgttgggggattttgtctgagaatgggct

SEQ ID NO: 18791 - DNA, 402 bp, Homo sapiens
  misc_feature 104: n = A,T,C or G
ctgacctgtctgatcttgcaaatgcagactgcctgattctttaaattgtcttaaaaataatacttatcagtttaatgcattttgatttaaaagatacagactgngccaggtgcggtggctcacgcctgtaatcccagcactttgggaggctaaagcaggtggatcacctgaggtcaggagtttgagaccagcctgaccaacatggtgaaaccccgtctctactaaaaatacaaaaaattagccaggtgtggtggtgggcacctctaatcccagttactcgggaggctggggcaggagaatcgcttgaacccgggaggcggaggttgcagtgagccgagattgcactccagcctgggcgagaagagtgagactctgtctaaaaaaaaaaaaaaaaaaaaaaaa

SEQ ID NO: 18792 - DNA, 555 bp, Homo sapiens
agcctaataatttctatttagatcttacagaaaaatttattgacccctggagtccatgatgtaccttcaaaaccagcctgctacacctacattctcaccctcttttcagatgagaaagctgacaccagaaagattaaatggcttgctcagagtcattcagtttctaaaggcagagctgggatttgaaccaaggtctgtcagactccacagcaaatgctctctccaaaacgtaattctataggttatccaccccctcagaggttgtgattttaattgcttttataatgttgggtttttaaatttttgcttttctagtttaggtaatacatatatgacataaaattcaaaaggtggctgggtgtggtggctcatacctgtaatcccaacactttgggaagctgaggcagaaggatggcttgagccaaggagtttgagactagcctgggcaacatagtgagacctcgtatttacaaaataaaaaattaactaggtgtgatggtgtgatggctacttagctattcatgaagatgaggttgggaggatcgcttgagcctg

SEQ ID NO: 18793 - DNA, 561 bp, Homo sapiens
cctgggcaacatggcgaaaccccgtctctactcaaatacaaaaaccttagctgggcgtgttggcgggcgcctgtagtcccagctactccggaggccgaggcaggagaatcgcctgaacctgggaggtggaggttgcagtgagctgagatcacaccactgcactccagcctgggcaacagagcaagactttgtctccaaaaataaaaaaataaaaaataaaataaaataggtcatttccccccaaaactgcacggggctccctttcccacacacctggcaggtgagtgacagggaaggtggattcctttcatttcttcagtctgggccaaaggtaagtaggaaggcacatctggggcggggcccagggccgaacgtgaacgccttcaggggaatctgccacactggatcactccttggacccctgattccttagaaatgcagtgagcgacaagaccctgaaaagccatccctcatttcttgtgtgtttttaactcacacgtgctccctgaggactgagctgtcttgcccttcctctagtgcccttgttgatggagctggagc

SEQ ID NO: 18794 - DNA, 519 bp, Homo sapiens
ctaaatgctataagcaaggccaaaagttaagacagatcagcagaaggaaggctaaaataaaataagatccagccaggcgcagtggctcacacctgtaattccaacactttgggatgccgaggcaggcagatcactggaggtcaggagtttgagatcagcctggccaacatatagggaaaccccgtctctaccaaaaatacaaaaattagccgggcgtggtggtgtatgcccgtaatccccagctactcaggaggctgagatgggagaatcacttgaatctgggaggcagaggttgcagtgagctgagatcacaccactgcactccagcctgggtgacagagcaagattccatctcaaaaaaaataaaaagtaaaataaaagatcatatttgaatggaatgccgataataatccccctttcataaatatttattcctgccatactattattcatttttcctctgactataaaaaccatctgcctgaaacactgcaggctgtcagtttcacactacaggct

SEQ ID NO: 18795 - DNA, 322 bp, Homo sapiens
catattctctttctataagtatgtgttaaacattagctaagtggctactgtgtatcagtcactgcagtggacaaaacaggggaagccaaggggaaaaaacaaaacctcatcttccttctgatgaataataaagattgaaatagagaccttatataagggtcggtactgctaggctcagtgaagaacaacaaagccaagtaaatgctgagggagtgagggtggtgggtggcggtggctacccaaggtgcaatggtcaattatgagttcctgttaatgatgctagaaatcaagcggcataggccaggcatggtagctcacacct

SEQ ID NO: 18796 - DNA, 491 bp, Homo sapiens
ctctgtctcaggctggtgcaggccagggcctgagcctgggcaaggcaacactgcacccctgtgaatcatgcacccagcaggggctgtaacagggctgcaaagccaccaccaggcagctgctggcaggactaggttagatggtggcatgcagggcaggcagggccttctgcacgtaagagggacagtggcacttcagtcccaccagaaaacccctttcgtcacccatatgttcagcagccacgcactacctcccgctgtggtgtatgcagtacagaggctgctgagtgattgtggaggcagccaggacagaagctgggaggcatattgtacagtgacaaagaacaaagacgttggagtcccacggtttcaggttcgaatccagactccacttcttagcagatggatgatcatgggaagtcattgagtctccctgtgtgccagtgtcctcatctgtatactgggataggacagcacctcccacaggggttctg

SEQ ID NO: 18797 - DNA, 94 bp, Homo sapiens
aggcatgagccacggcactcggtcccgactttctcttcttttccatctcactctgcagcgggcagtgtggagggtggagggagctgggtggttt

SEQ ID NO: 18798 - DNA, 173 bp, Homo sapiens
atgccccagcctgttttcccttgcaatacccagaagtctgccctttgtataagtgagggaccaaatcaaagccagcaaatggaatgtgtaggttatttacggattgttgctgagcaaatgtaatcaccagcctgctgtacctctatcatcatttcccttgacgagaacatcac

SEQ ID NO: 18799 - DNA, 102 bp, Homo sapiens
caacagctggaaaaagacctgaacctgatggacatcaagattggactgctggtgaagaacaggatcacactagaggatgtaatttcacacagtaaaaagctg

SEQ ID NO: 18800 - DNA, 514 bp, Homo sapiens
cctgtgtttcctgttttcttgaaatgaagcagcggtcccaaagtttgcagagtgttaagattaagatgtgtaggttgaccattcctgcccgacgtttgccagtgtgttcaacttggctttattggtttgttccttgcttgataaaaattgtgcatcgcagccctgaggaaacgtcccaggtttaagtattagggctttgatgtgcagctgggtaatagctaaatccagagtcatcacttgagaatcaagtcactacaataaagatgttgaaaatgatttttaaaaaaaatgttatttactatctcacgacactttggtaggccagtaaatttctgagcctatctaaacagtgagactggagatacattgtgcattttatatcctgttttttatctttttctcttaaacttatttacatcaatataataaaggaattgaggaaggctaagcttttcttcaccctttattttttaacaaatgaaaatgccgggtgtggtggctcacgcctgtaatc

SEQ ID NO: 18801 - DNA, 530 bp, Homo sapiens
gagggttttagtagaggtggggttttaccatgttgcccaagctggttgcgaactcctgagctcaggcgatacacccacctcgccctcctaaagtgctgggattacaggtgtgagccactgcgcccagccaggaatgacatattattatatatattattgtatatgcgtatacttgtgttaacattaaaaagtatcataccttactcagcaggctttattcctgatagccaagagccggaaacaactatctggatgtccttcaaggggcaagtagttaaacaaatagttggggtagttgtggaatgcagagaaagtgttttgaagatatatattggaggaagaaagggcaagacacagtcacaggtcatttatgacatggaagatacaggatgaggaaacaatttgctttttttggtggtagttgttcaacgatacatcttgtatatctacctatgttagtaaagagatttctctcattatttcaaaacactgcatgatattccaaagtaatagtaaatttgtttagggct

SEQ ID NO: 18802 - DNA, 313 bp, Homo sapiens
atttttagtttactaacaggaagtaatttctttcccttaaaattcccttattttaaaagaaagattgtgtataacatatgaatcctgtcatttttgtcttgttggtcaggaatcgaaaataaaatttaacaggttttaacaagtgtgattgagatttgtttcctaatcactctacatgttttttctcttttgcatatatgtcattatttataagcaacttcaaatagaacagaaggtagggcataaattatcaacaactttagtccaaaaagatgttaatgaaaaaagtaacaatatttgtggtataatatat

SEQ ID NO: 18803 - DNA, 430 bp, Homo sapiens
cttcctgttctgagactttgttccaggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaatcttttgcccagaggggttcctcagtaaatgctggagatgaggctcagacctgacctttggattcccagatggagtgctctgaaccgtgtacctggggctgtcttcaccactcaaatatcgatagagataacatagagatgtcctcaggaagataaccaactgttcccatcctgtgtggtctacagattgggagatagggcctacccaagtgtagaaataaac

SEQ ID NO: 18804 - DNA, 568 bp, Homo sapiens
gcccacctcggcctcccaaagtgctaggaccacaggcgcactttttttgtttttgtttttgtttttgttttgagatgcagtcttgctctgttgcccaggctggagtgcagcggtacagtcttggctcactgcaacctccgcctcctgggttcaagccattctcctgcctcagccttccgagtagctgggactacaggtgtgtgccaccacacccggctaattttttttagtacagacagggttttgccacattggccaggctggtctcaaactcctgacctcagacgatacacttgcctcggcctcccaaaatgctaggattacaggcacgaaccaacctggacccaccctaatatagtaatttttattatgcataaaaagttataaagtaaatatgcctcatgggacatcgttgtttcatttttatatgaaataaaataactttctatttttacatggaaatcagaattcatatgtctcacgtgtttttggtgttgttatccacaggagaccaatcattttgcaatggcaatccctaatgatctattccctaatcaactggaaatac

SEQ ID NO: 18805 - DNA, 564 bp, Homo sapiens
acctaaaaaaacaaaaactaaaaccaaatgtttaggcttaaacatttgaaaactacaaagtaattctgatcaattcattatgacatcaattttctaatgctaggctctatttccactcatcaccatcatgcaaaatgctataatcttagattattcctccatgtattcttgtaaatcaagtattttcttcctcatctaaatttcactctccagtcatcatcttcacgtaactacctaataaatcaaatccatgccttttaaacatttatatcattcatttgccaaaatcaatttgctttattctccatcagaaacatttatctcctttaaaactttgtgccggtcaaaattcttgcacttggctgggcacggtgactcacgcctgtaatcccagcactttggaaggccgaggtgggcagatcatgaagttaggagtttgagaccagcctggccaacatggtgaaaccccatctctactaaaaatacaaaaattagctggtcatggtggcgggcgcctgtaatcccagctacctgggaagctgaggcaggggaatcgcttgaacc

SEQ ID NO: 18806 - DNA, 362 bp, Homo sapiens
ttgctttcaatgatcctgatttcctctctccaccgcagtatcttgattgcagtaaagcacatttcctcatcattctttccacacacattactcattcccatttctatccttttgcccagacattttctagaatttactcttacacattctctagcccagatcattagctgtaacaaatgagggttgcctcaatcatatcttttgtctcctaattgaaattctatcttgtattatttgttgcttcatatcagtgaagttgtgtccccaggtatataattagaacatttatagtaagcatcatatcttaatttctttaggaagtgtctaccatgtaaccacagatgaaaaataaactcttgctg

SEQ ID NO: 18807 - DNA, 465 bp, Homo sapiens
accccttcactttggtgctccggtaggagcgcacagaaggttctgtacttgtttacacttaagcttgctgtgggtaggttagaccttgcacaaaaataatatcaggcttcaatatcatatggccaagacaatattgtagcaccatgtcctctctaccttggatcgtgcttcttcttgagttcacttgcttacacaggaagctgttgcatgttgccaagccttctggcaagggtaaaagcatttaaacagtgtaatacattttggaaccaaaagctgtggtcaggaggaaaagtaaatcatcttgagtagatgggggcatctccagtgatgtatgattataacatttgatcctactttgtgctattcagtttgctgttggttgtgtaacttacccctgggctcctaggttagagtaaatttaaggaagctggacttaaaatagatatttgtaatcacatttatgcg

SEQ ID NO: 18808 - DNA, 425 bp, Homo sapiens
tatagagtatgttataccatgatgcaggaatcctgggagccttcttagaattctgcttaccatgttgtctccagatggctggttgaatgacttttctttgtttaatggatgcaacttactgatgactcctaggtgacaagtactcaatagacaggtaaataactgttagtctgtatcccatagtgtagatatagaatatttctcaacaaataaaaacatggctggagtcaacttttttattttgaggaagcatcaattgctttttatctccttagaagtaaaccttatatcctccaaacaatttactgtaaaagcaaaagaaatttaatactagaaatatgacaagatatttgatatttcttatgttagtatttgtgggaaactatttttatataactaactcctgctgtaattcttatttgaca

SEQ ID NO: 18809 - DNA, 516 bp, Homo sapiens
agagcttggggggaacacattgaagactaagagtttttaggccaaatcatcgaaaataaataacatcacttgagaaatgatcagagaaataagaaagggccaccataacatgaataagacctactgtgaaggagaaggctttgccatttctatgctatttagggtgaactttgagttatggtgttctgttgggcacatcacatattgaaagaaaagtttgaaaagctaaagtcattgggagagcacacaggatggcaaaaagtcataaaatctttcttaacagcagtggttgaaatagttggagccacttattttaatgaagacaaattagtgaagacagtgtggctgaccccaaatatttgacaggctttcataagtaaaagggatattggcctcatatagctctgaggtatgaatggctgtaaatggaaattggacatctcttatgataaaaagaaatttcatatgacctagagttttgcaaaaagcttccacattattggatttatacaggta

SEQ ID NO: 18810 - DNA, 483 bp, Homo sapiens
tgcatgatggcagagtgtttattaccagcgcagaagatacagtatggtataggatagaaggaatacaatgcagttctataaatattgagaatttactatgtaccagtgctgtgcaatgaactgggtccccctaaaatgtatgtgttggagccctaagcccacagtgtgactgtatttgaagacagggcttatttggaggtagtaaaggttaagtgaggtcataagggtgaagcctcaatttcctagggctggtgtccttataagaaaaggaggaggccaggtatggtggctcacatctgtaatcctagcactttgggaggctgaggtgaggcgagaggatctcttgaagtcaagagttcaagaccaacctggccaacatggtggaaccccgtctctactaaaaatacaaaaattagtctgggcacagtggttcaagcctataatcccagcactttgggaggccaaggcaggcagatcacttga

SEQ ID NO: 18811 - DNA, 592 bp, Homo sapiens
agttttttagtgattaaaacacttttctttaataaaacaccattaacatgatttctcttttaaaacaagcctctattaaccctgaattcatcactgggctttttaaccatcccaaataccataccagagatattgtccctaagtccaagcagcctttatgttgtgtaaaggtcactgtttgaacaatggtgtctgtgtatcatctacttatacagaacatttaaaataaaagttatcacataaataacagatttcttatttgcagtacctttgaatatgatgatcaccaccatacctaagatttcattcaagctctaataccatatcaagtgtctatacattcttagattttaagagcttttaaaggcaaacacggccgggcatggtggcgaacgcctgtaatcccagcactttgggaggcccaggcgggcggatcacaaggtcaggagatcgagaccatcctggctaacatggtgaaaccccgtctctactaaaaatacaaaaaattagccgggcgtgttggcgggtgcctgtaatcccagctacccaggaggctgaggcaggagaatggcgtgaatctgggaggcggagc

SEQ ID NO: 18812 - DNA, 559 bp, Homo sapiens
ctagagagcgataacaggatatatctagactagaggacaacaaattcaaatgctcaattgaatttgaagggtgccataatgaaaactggggaattaggttaatctgcatgcttaaagatgagacccatatccccttttcctactcagctctcaagcttgttctctcctggcaaaagatgagaaattttgtctgggaaaacaatccagcacaagagaaaagatgtgtcactgggtgccctggtctaaatgcctatgtctccttaccccaaaattcacatgttgaaccctacttgccaatatgatgatattaggaagtgggatctttggatggtgactggatcaagaaggcagggccctcataaatgagattagtgcccttgtaaaagaggccccagagagctgccttgtctccttccaccatgtgaggacacagcgagacggtgctgctctgtgaaccagaaagcaggcttttaccagacaccaaatctgccggcacctttatcttggacttcccagcctcactcacaggaactgtgaaaaataaatttctgtggattat

SEQ ID NO: 18813 - DNA, 540 bp, Homo sapiens
accgtatgaaaagaagttgtcaatacaattaacttaataacatctacctccaatatgtgaagtatcaacatgatacaatgaatgtgaatcacctcatgcagagtcactgcagcagagatattacaaacaaatattgttacttataatggaaggaaaacatgggttattgtttaggtgtaacatgctgtttgtttgtatctcttcctaaattctgtttgtgggaatttatttgtgcaaatggaataaactgagaatgcacattgcattatgtgatgtcagggtccatgcgagttggcatagcattatgttgaggtctttgtaataaacgcgatgactaagcctgtgggaggtataatggcatctatgggaagagtcaggcatcgtcaattccacagtgtaattgatcccaattaaattttcggcactatttccatttcaactagggaggcgtatacttcttaatctcaattatagtaatcttacttatttcattttccttgaaaaatcttaaaacgtgtaaaaatacttgacattatctat

SEQ ID NO: 18814 - DNA, 464 bp, Homo sapiens
ggtgacagagggagaccttgtctcaaaataaataaataataataataataaaccaacacagtgcctggaatatagtaggtacttcataaatgctagttttcttcccctcaagaaacacttgctaaatgagctgattgtcaacaattaatcccaaaccagaacgatttttagggttaaacatgcaggccgggtgcggtggctcaggcctgtaatcccagcactttgggaggccgaggtgggcagatcacaaggtcaggagatagagaccatcctggccaacatggtgaaaccccgtctctactaaaatacaaaaaaattagccgggtgtggttgtgggcgcttgtaatcccagttactcgggaggctgaggcaggacaattgcttgaacctgggaggcaaaggttgcagtgagccgagatcgcgccattgcactccggcctggtgacagagcgagactccgtctc

SEQ ID NO: 18815 - DNA, 432 bp, Homo sapiens
cgctgtgggaggctgcagatcgactgtgctgatggtcgactgatgggtgcgctgagcagacttacagtttcccatcattccctgcagtgccccgctcccactgcaggcagccacatggccaagctgtaaccttgagcaggcccaggctctgagatctgcaggccaggaagccttccctaggtcagagggaaggggccggggcacaggagagtggcccccgtgcccattgtctctgagacctcacgtcccttggagtggtcaggaaggagccaggtgaggccgacagccagcactcctgtcactgtccctcgggttctcttggttctttcaacagtttcaaaatgcccactggctgggcgcagtggctcacgcctataatcccagcactttgggaggccaaggcagggggatcatctgaggtcaggagttcga

SEQ ID NO: 18816 - DNA, 443 bp, Homo sapiens
gtataaatgggggtagaagcttagagcaggagaatgaacaatagttttagtgtcagaaaatgtgagttaaattcccagcttaccttattactggacctatgacttgaggaagttttgtgggttttttctcttttgtttatgtctctgaactttgggggaaaatgtgagggggatgcataatcacatttgggaaactgtggatattcttagaacagaaaaaatagattagtgaggttttgaatctttccacttatcttggtaaggattatatgccaaagactagttattgtggccatactctttttccattagtggcattggagaaccagaaacatgggatccaaagagaagcttagcaatgttaagtcatgttaatactaatttaatttttgtttgccaccctacccccaccaaaaaaaaaaaaaaaaaaaaaaaaatttggg

SEQ ID NO: 18817 - DNA, 428 bp, Homo sapiens
gtttgcttgtttttgaaatggagtttcgctcttgttgcccaggctgaagtgcaatggcgcgatgtcggctcactgtaacctccgcctcctggattcaagcgattctcctgcctcagcctcccgagtggctgggattataggcatgcgccaccacacctggctaattttttgtatttttaagaaaggaagaaagtgtgtttcggagaagccaggaaacaaagtcaaggcacatggtgggaaactggtaggtaagctccaccccaccaagctagtacctctgccctctcagagtccagaagctaccagagggctgagcaagaaaccaaagctgaatttcgggcaaggaaggtaattcagaagcccaggccctttcttagaagcgggcacaagggggctgggtgcggtggctcaagcttgtaatcccagcg

SEQ ID NO: 18818 - DNA, 144 bp, Homo sapiens
aagaagtcattgctagaagatatcatgattaccaaaataaaagtaaagcataatagttcgtgtttagtcaccaaatatataaaattattagttgtcatatggaggcgataagggacgttggatgatctccttatctaacagctg

SEQ ID NO: 18819 - DNA, 593 bp, Homo sapiens
tgagttaatacgtaaagaaggaaaagatcttcatagtacaatgccaactaatagatgtaaaatccgtaatggtgttagaatattatcaatggaagataaagctaatgggtgaaaactgaatgaaaaaggatatttctatagcctcatttcatcactccacaacttataaattacaaacaaaaatatagttactttacattggcacattctggcagacagtattttaaccaagttcagggaatgtatgcatacacacacacaaacacacacacacatatatttatagaaggagggaatgattaaggagcaaaacaatacataaacaattggtagacttgataaggatatatgacagttctttgcactatttttatatcttttatctttgaattcatattaaaattaaaagttaaaaaataaaatatcatcgatgttctggtcccactgtagtagtataaacccactacaacccattgccccattgatgacaacaacaactctgaccaaaatataaaagccagctacctgaggactctgaaaagtaaagaaaagcaggaagattgtggagggaggggatcaaaacatggtaaagc

SEQ ID NO: 18820 - DNA, 562 bp, Homo sapiens
cacctggccggaggtgctcactaaatgcagttcctttcctctgctgtacttagacattttctaggaaggataggtccaataggactgaatattttatttagaagagatggcttcctttaagttgcccaacaagaggtttggaagaaaaccaaatgcttaccagccacttcatattaataccagtcattttctcccttcagtatcaatgcctaggagccaggaagctgtgccaatgccagtggttgtggagatggcaaaagaagggaggccagccacctgggacagctgaatccaagcctgactctcagccccagaaggaaagtgttctctgtgtggtttatgtcatttgcttaaagaaggtggggtaggggccgggcgtggtggctcacacctctattcccagcactttgagaggctgaggcaggtggatcacctgaggtgatcgagaccagcctgaccaacatgacgaaaccctgtctctactaaaaatacaaaaattagccaggtggcacatgcctgtactcccagctactcggaaggctgaggcaggagaatcgcttga

SEQ ID NO: 18821 - DNA, 573 bp, Homo sapiens
gtatattgttttatctgtgactgaaacaaacctgtaaagtgggtacaacaggttactccaccacccatctacagatgagtgaatgcaagtgacttggccaagatcacaccagaagtgaggggcagggtattcaagagccatggtctttctgctccccttgtcactgttaatttccaattgcatggccaatttctgagacaaacaatgtgacctagtggaatttgacttcattgttacttttctctccaccaccccaacctggatgacatgagaacttattattcattcataagccctctgcaaaaaatctaggataacagtggtgccagtaggaagattagttgaaatctgggatgccggccagacgtggtggctcaggcctataatcccagcactttggaaggctgaggtgggtaaatcattcaaggtcaggaggtcgagaccagcctggccaacatggtgaaatgcccacctttactaaaaatacaaaaattagccaggcatggtggtgggcacctgtagtcccagctacttgggactacagctacttaggcaggagaatcgcttcaacgc

SEQ ID NO: 18822 - DNA, 462 bp, Homo sapiens
taacagaagctggatttacacagaaacttctagtgtaatttgtagataaagatattaaaactgaaagtaaagaacattactccttctacatgtaaataatagaattcaacctaaaaagactagaccctaaaaaaaaaatttaagttaaatctaagtagtttttacccatccaaatagttgcccaagatcaggatttgatagaaaaaaattgataaaatcatttcacttcttgctcagtgaagagaaaactgagcctgagatagatgttaactaatgtgattcatctagaatggctttacacgaaacaaaaaattaggctgggcatggtggctcacacctgtaatcctaatactttggaaggccaaggtggaaggattgcttgagcccaggagttcaagatcagcctggacaacatgaggagacccccatctccacaaaaaaaattttaaaactaggatcatg

SEQ ID NO: 18823 - DNA, 626 bp, Homo sapiens
atgaaacaaaaaaaaggatatgctgaagatacagaaatcaggtattattcaatttggggggaaatggtttgttactttactctcatttgtggaattcaagaaatgagattttgttgattgctccaacaaaactgccagcaggtaaaactttatctccatttatcctaaagataagattactcagatattaaagtgggggaaaaactcgattataaaagtgcttttcagaattgtaatctgatttatcaaagtgttaatatgaaacttttccgtaggacatcctcattttgtaccacaatgaagaaaagtgcttgacagacccagacctattttaaactaagattatttaattagtaatttttatttccagtgagtctggcaataaactgtggggaatcatttcattttcattcattacaagaagccatagtttatatttcccccaggcagagatttttatctgacaatttgaatgctttggtgacagaaatatctgatgataaatatggtattaaggagatgccaagtggcatgatagcttgaatcatttttggtaacagctcatgattaataatcgtgcttatgtatgtattcacgttttttattattgaataacattttgcatg

SEQ ID NO: 18824 - DNA, 367 bp, Homo sapiens
tgcctcagcctcctgagtagctgggactacaggcgtgcactaccatgcctggctaatttttgtatttttttgtagagacgggtttcactgtgttgctcagaactcctggcctcaagtgatctgcctgccttggtctcccaaagttctgggattataggcattaatcaccacgcctggcctaattttgggaaatttttaatgcatttttgggactgctatttttcagatgttgccccttttacttctgacttccctatctcttaacttctatttttcaatttctttatggttttctataccttttgagagttccttaatctgaggaactgaaatctattcttcatctacactcattgtagagtatctt

SEQ ID NO: 18825 - DNA, 425 bp, Homo sapiens
aagctggattagaacatctgccaccagctgaacaggccaaagccagactacagctggttcttgaagctgctgcaaaagctgatgaagcattgaaagccaaagaaagaaatgaggaagaagcaaagagaagaaaggagggagacatgaggtctcactatgttgcccaggctggtcttgaacttttgggctcaagcaatcctcccacctcgaactcccaaagtgctgggattacaggcatgagccaccatgcccagtacaattgttaatcattcattttcttcaacaagtatttattgagccacctcctatatgccaggcattgttgtcatcctgggccacagtaggaaacaaaacatggagtgcacattctagtggaaagagacagataatgaataaacaaacaagtaaatgcatacagacatacc

SEQ ID NO: 18826 - DNA, 497 bp, Homo sapiens
ttgtgactactttactacacaggacagtttctaagtccaatttccagtctcccagtttactcgaacatactgacattacccaagccatgcccagactcatctaagatgcagtgtctcctttcacatcccaggtgaaactagacctcacctcccgtgtttattatttctactacttatggtaaaattgttattctctaaacttatcctttttttatttctctttgttataaggttattttctgaatatttatttcatttgtgcatcatgatgtcaacataacgttaagctaacttgtaaacaggtgtttcaagagtgcctgttatttgaataaacctggagaaacacagtatttccactttccaagaggcccacacttcatgtttacatatccaatggcatcaataatcatcaccaacattcatgtacaattatgcctccagtcctctaacggcagtatcaaccttcacatcagtggatataattctaagagaacagc

SEQ ID NO: 18827 - DNA, 384 bp, Homo sapiens
gtaaacttatttatctgatggccttgtcatcaagagaagagtgtcagcaaattaggttataaaaatattcttattaaattattttattaaatacttatattcgtatgaatttttttagtggactctgacatacctttagaaaatttgtgaactggtatttctagatattaaagtacttttcgtctagaacagtaaaatatttttggatctctaagtgaaataccttttgtggaaaaaagtaattatgaggcattttcttccctttttaaagattttgatggatcatcaaaatctgtcagaacatgtactctgcatggttttatatctgattgaattaggacttgaaaattctgctgaagaagaatcagatgaagaggtaagtag

SEQ ID NO: 18828 - DNA, 353 bp, Homo sapiens
tatcctttcttgaaattgagttgtcttacctctcattttgagcagtaccagcaataaagctaatgaactggcctctttttctgaaaagccttcctatgtccctatgtcctttgctcctttgcttttagtgttttgttttgttttgttttgttttgttttgttttgttttgttttaagacagagtctggctctgtcacccaggctggagtgcagtggtgtaatctcctctcactgcaacctccacctcctgggttcaagcaattatcctacctcagcctctggagtagctaggattacaggcatgcacgaccacacctggctaatttttttttctttctatattttcagtggag

SEQ ID NO: 18829 - DNA, 366 bp, Homo sapiens
cagaagggcaccctattcctttctttgaattcatttggtcagaacctgacacgtatcacccagtgccccagttcctacttgtcttctctatcactctgcctcaaaatccagagattccaaggatgataatttattgtgggcccaaatggctaagagaggctcttctgggaagctttcttacatcatataaatttttgttaacatgaattatttgtatttgaaagatttaaaagacaaggaagctatgtattgttcttgttgttaacaataaattacctcaacactatttgaacataataacaactaacttacactcctttcctggtgagttaccttgcattcaggtgttctgagccatgaaaacat

SEQ ID NO: 18830 - DNA, 450 bp, Homo sapiens
ctgtcacatgaaaaaccaattgacattcataggtttattttgcacctttggcagtcagcctacttctgacctttctttagttctgctatatctttagttcttgctcttgtatttcttagcactaaattatatatctgcaaataattttagttttatctcttcattttgcaagtttgtaccttatttcttttcttatttctagtgattccagaataatgtaatacatggttttttaaaatctagtttttaattgataattgttgtacatatttatggggtacatagtcatgttttgatacataataatgtataatgatcagataatggcaattagttttaaaagctgttatccttgtcttaatctgggctccagtaggaatgccagtcatggtttcctgttagctctgatatttactatttatttttaatagataacctttatcagagtac

SEQ ID NO: 18831 - DNA, 572 bp, Homo sapiens
agaagggataggaaagcaggtttcaaagacagtagtaaaaatatagtatgaagttgttttctgtaggtaacccacaaagttgaatcatttcacttgctctcctaaaatctgagaggcgggtggaagggaaggttctccttacacatgaagtaagcttaggaggttaacatgctaactttttatcaaacatcttagagcttatatacccaaatgaaggaagctttcttcaaaaaaagtcacttcagaaggctctagttcttttattgatgttgcctttgctgaaaatatctggaaatatctctttaggaattgctctccaagtttatagcacattctttggtaccttatccatcactaatcttacctgttagtgctaagctggatttttcaaaatagacaaaagttatttgatgccaaaactaatgaataggctgggtacggtggttcatgcctgtaatcccagcactttgggaggctgaggcgggctgatcacctgaggtcaggagttcaagaccagcctggccaacatggtgaaaccctgtctctactaaaaatacaaaaattagtcgggt

SEQ ID NO: 18832 - DNA, 457 bp, Homo sapiens
attcacgcatgtgacttgcagggatgtggactgctgggtgtcagggaagggcatggagagagactcagtgacaaacctggccccggattccagcagtgcttggtacctctggcaggtgaatgatgtcaggagtccacagaaacagccgaagagctttccctaccacctctgccccatcccaggcttcctggccttcctctctcctgcttactatgggatgtgggttgttatggtaatggaggaggctggatagagtgaggaccacattgcctccttccacactgcagttggcaacatcagtttttctgcagtgaatgaataaaagtgggaaaatgatgaagtttcttacagtggcatttgctttcattatctgaccccaggaccctggggaagccaccttaatagtggggcaggatttaggaggggaaagggagaggccacataaagagaacttaca

SEQ ID NO: 18833 - DNA, 621 bp, Homo sapiens
gtatgtgtgaatatgtgacgttgtattgagtgagtcatttcctattgcgcctcaaatggtaagtagggacagatcccttccccaggattactaaggaacaatagaaagaactttgaaactccatttccactctaatgatttcccctgcactcctccacacctgctgtgtaagaagagtgagaagaggaggggcagcaggaaccatggctctactggaaatgtggtgttagtgataaggtgttggagtgggaggtcacttccttccctcttatttgggaagggggtttgagccccagttctctcaaaggcaaatgaattgacagctccaagaaactggctgatatataatgggagtgattctctctgcctgcctgctcaactgctaaagttgagtcttctctgctgtggccaaaacagtgaaatgtggtgacaaagtaccagcaagaactggactgtgtttctggagcctaggggcaagttaatcttgaggattgagataatatcttgtgtgacgtttctgaatgtagaggcttttgagagtagccacaagcaacttggaaaaggtccatggaacagtgtccttgagaagatgaaagcaatagaccccccatgttcatctct

SEQ ID NO: 18834 - DNA, 542 bp, Homo sapiens
cgaatacaaaaatcctcctaggaagtgggttcagccctcccaaggaaaatggattgcttgttctggtaggatctccaactctgtgaagtcttccttatccaaatttagtgagataagattggaatgtcagagctgaaataatttagaccaatattctggttttctaaaagaaaacggaaccatgccattacctcacttccccgtttatttcttatttatttatttattgtgacaggaatctcgctctgtggctcaagttggagtgccctggcacaatcttggctcactgtcgcctctgcctcctgggttcaagtgattcttgtgcctcagccttccgagtagctgagattacaggcatgagcccccatgcccagctaatttttgtatttttagtagagatagggttttaccatgctggccaggctggtctcgaactcctgacctcaagtgatctgcccaccttggcctcccaaagtgttgggatgacatgtgtgagccaccatacccggcctcacttccctgtttaaaaccctccatctctc

SEQ ID NO: 18835 - DNA, 691 bp, Homo sapiens
ctttttatattgtgtattccttaacaaattattatatctattattattttaatagttttgtcttttaaccttcatactaaagatgtaaatgatttatataccaacactaaaatattggagtattctgaatttgactgagtacagttgtccctcagtatctgtggtggattgtttttcaggactccccatggatatcagaatccatggatgctcaagttccttacaaaaaatggtgtattatttgcttattacctatgaacatcatcacatatactttaaatcatccttatgatacttataacacataatacaaggtaaacactatgtaaatagctgttgtactgattattttggaataatgacaaagaaaaacgtctgttcatgctcagtacagatgcttttttttccctaaccattgttgatccacagttagttgagtccatgaatgcggaactcctggatacaaagtgccaactctacttgtttttatactttcatatggtggcatattactaattagtaccttttttttcttggcttgaagaattccctttagtatttcttgtaaggcaggtctagtaatgatgaactccctcagcttttgtttgtctgggaaagtctttttcatgatatccattcttgtcaaatcatagaaccatcaaattttataatcttgttgctggaagtgact

SEQ ID NO: 18836 - DNA, 492 bp, Homo sapiens
aaaggctgcagatcagtcagtctgtgggatgtcagcacattgctcctgcatgtggactgctgcaacactgaagacaataaagaagtaagaatgcagtaggaccacataaattatgacatgttttatatgggccttgagatttagtattcatgaaacatagggatccttaggtctgaggcacactggggcctctacaacaaggactgttaagggaggtacacaccctgtccacatccaagaagaccccacagagtgtggtgtggatggaggtgctcaaggaaaatccagcacagctactgtagcgagatggcccttgaaaattagatgaagcagcaggtagcagtacaaatcctattcctgtactggtgggtagaaaagtgagcagatcttgaggagaaatcaacattcttagagagtgaactgccaaaaaaattaaaaagtatgccccagtgcacatttattttactgtgagtctatttggcaatgaaaaag

SEQ ID NO: 18837 - DNA, 526 bp, Homo sapiens
aagtgggagctaaatgatgagaacatgtggacacgtagaagagaacaacacacactggagcctatcagaaggtgaaaggtgggaggagggagaggatcaggaaaaacaattaatgggtattaggctcaatacctgggtgatgaaataatctgtacaacaaacccccatgaaacataaacatgtttgttacatatttacctatgtaacaagcttacatatcctgtacatgtacccctcaacttaaaagaaagtttaaaaagaacttttatgctttttttaaaaaaaaatgtttgtttgtttctttataagtttagtgggaatgaaacatgagacaaaaatgctgccttcctgttgcctttcagattgctggaagtctgtccttcatacctgaggaaagttatgtgaagagccttttgagataaaaagaggaaacagaagacttgagcaatactataaatcaacaagatttaacttataaagagcattccacccaacaacagcagaatacatactttcccaatgtata

SEQ ID NO: 18838 - DNA, 511 bp, Homo sapiens
gaagggaaggatgggggttagggttggaaaactacctattgggtactatgctcactatctgggtgacaggtttaatcatactccaaacctcagcatcatgcaataaacctttgtaagaaatcttcacatgtatcctctgaatccaaaataaaagtcagaaaaaaagactacttcaagccacaagtgctcagcaaccacagctaatgtagcaccccctagatgtcttgcctgaaatccagcccagacaagaattcctgaagaattcagtctcatttaggagataaagtaacctatatgaatcaatcaagaatgttaaattgtgatgttctgctgaaaaaggaatttaaagaaggaagagagaaacgtggacaaaatagacaaagaggatttcatggaggatttgaacattagttgttggccttaaaggataagtaggagtcaacaagaagcagagggaagaaatttaaacagagaagtaaagaggtaaactataaaaagctatgaacaggtc

SEQ ID NO: 18839 - DNA, 576 bp, Homo sapiens
attgtttttcttccagtttttctttttccaaaaaagggattcaagctggcctgcaaactcaaatggcttgtacatagttgagattaaggcaaatacacaagattgtatcctgtttttttcagctacattatacacaagtatcttcccttgtgataatgtagtttttataaatataagtttttaataactaatatttcattatgtgatacatcatgatttattattttaaaccatttctgtattgtcttgttttcaacttgggagtgttctacaaaattctttaacaagatctgtatgcggcagactcagtggctcacgcctgtaatcccagcactttgggaggctgaggcaggcggatcacctgaggtcgggagcttgagactagcctggccaacatagtgaaaccccgtctctactaaaaatacaaaaattagccgggcatggtggcacgtgcctgtagtcccagctacttgggaggctgaggcaggagagtcgcttgaacccaggaggtggaggttgcagtgagccaagatcgtgccactgcactccagcctgggtggcagagcgagactccgt

SEQ ID NO: 18840 - DNA, 519 bp, Homo sapiens
gatgccatgctggtgagaggagaggcagcagagccacgcctcagagccctcagccccgttctagtgatggggaaaggcagatgaggtccgggtcttcttctgtagagggaggagggaaagcgaggaagttcgctgagctggtcacttctaagaaggcttatatttgggttttacaatatgccagaatctggatttatatagaaagctgcttttatctcactcattcacttattcattcaacaaagtcttcttgagaaccagccacgtgacaggctctgggctctcaaaatagataaaagtccttgggccgggcgcagtagctcacacctgtaatcctagcactttgggaggccgaagctggtgaatcacctgagatcagtagttcgagaccagcctggccaacttggtgaaaccctgtctctactaaacatatacaaattagccaagcgtgttggtgcaggcctgtaatcccagctactcgggaggcggaagcaggagaatcacttgaacctggcaggt

SEQ ID NO: 18841 - DNA, 611 bp, Homo sapiens
caaaggggactcaggattggcaacttggcctgtgtccagccttgctggttggagagctcagacctccccaaccccaaatactggtctaggagaagcagaacgatggagtgggtttctatgtgagtctccagcagctgcccctgttcagttcagttcagttcaacttgattcatttacattgaattcaactcaactccaaaggttcaggctagagtcttccttggggaaggattgtcacgattcctttcttagagctctcagtcctatctctgaagcccagggcactctgtgtgcaggaggcacgtaatgtttagaaagagaagtggaggccgggcgcggtggctcacgtctgtaatcccagcactttgggagactaaggcgggcatatcacgaggtcaggagttcgagaccagactggccaatatggtgaaaccctgtttctactaaaaatacaaaaattagccagacatagtggcgcacggctgtaatctcagctactcaggaggctgaggcaggagaattgcttgaacccgagaggcggaggttgtggtgagccgagatcgcgccactgtactccagcctgggtgacagtgggagactctgtctcggaa

SEQ ID NO: 18842 - DNA, 138 bp, Homo sapiens
atagttatagttaactgttatagctatagataatacaatggtgttgtattttctcttggccaacctaaaccattgctaacacttcacgctatacctgaactaacattacagatgaaatgaagcaacttatatctaagc

SEQ ID NO: 18843 - DNA, 428 bp, Homo sapiens
ccaacagtagttaaagtagtaaagacagatattaatcagtgatatactattgtaataacataatatgatattcttgtctgctttcagcaggtctaggatagaaattgttcataaaattttaagtctaagatcaggaggcccaccctattgcttttaaccctcttagttgtaagataggtggtatctccctcatacccctccaaataggtaaaaggaatacctgctctatcagggtataactagacatctatggtcttagccccctcttgtttatagtctttgggttcattgtgccttgtcgcttaagcgcttgtctagtggatgagaatgttattctctcctctaaatcaaccaaccttctatggagtaaagggtactgaagaggatatgtcagtcagttcgggctgccataacaaataccacacact

SEQ ID NO: 18844 - DNA, 508 bp, Homo sapiens
aacaaatgagaaacatatcatgatattgaaaaagaacactcaagatcacaaagataccagtttccccaaagtaaattgaaagtgtaatttagtcccactaaaaatgtaagtaagaattttgaattatatgagttcattctaatattaacataaatagaaacataaagactacccagaaaactcaaactacatagtaagatggaggggactagccttaccagatattaaaacatggtaaagctaatcaaaacagtgtggtattggcacataaatagacagacagaagaatgaagcagaaaggatagtgatgagaatgaacaggggatctacagaccaggagaaagtatttgcaaagcacttatcagacgaaagacttgtatacagtatatataaggaaatctcaaaactcaacaagaacaaacaaccaaatttcaaaatgggcaaaagatttgtacagacctacaactaaaaagataaatggatggcaaataagcacattaaaaaatgc

SEQ ID NO: 18845 - DNA, 572 bp, Homo sapiens
agccctgacacaaagacatttacttccttccatccttttaaaaataatggcctcctgttgaatggtagttgccaagaactagggggaagtacagtagaaagttattgtttaatggctacggaattttagtttgggaagatgaaaaaaacttctggagatggatgatggtattgattacataacattgtgaatgcatgtaatgccactcaattgtattcttaaaaatggttaaaatgatcaattttctgaagtgtgctataccacagtttaaaaaaattaaataataattaccttgttatcaaaaggggctaattagctcactcccttcactccatacaaatttatatcattggtttaagactacatctcccagaacatgctggtcccttttcagcttaggtgttccatttcttcttccttctagggtttctcttctttaccagccaagcctccagatggtatttcagtcactcagccaaacaccttcattgcagtcttttcccccttctcccccagttcacttaaaaataaattgtcttttttcgtaactccagacagaacatgaagcactc

SEQ ID NO: 18846 - DNA, 589 bp, Homo sapiens
tgtcccttggaatgcagcgtgtttccacttgcaaaatgcttagatcatctctaagtattgcttcttctgcctcttttcttcactacatcaaggattactgcatgactctgtgaagttttatacaaccactgcaatgttctgccctacagctaactgaatttcagcatcagtgggccaaatccacacacttacaggagcaaagtttgagcccaagttttggagtaggaaaaagccatgcttacctctttctctatttctgttcagcatgaagtcccttggttgatgtcttcacactgcctggtcaaatccctttgcctttgtgtctgacctaaagtaatctaaaactaccaggcaaggactaggactgccacagccttccttgaatgtggcactgtaatagggaaaacatgcttatcctagagataagttttgtcatgcttcggttatagccaagtcggtcagttatatgctcagtttgccatcttctgaagtttcctgaaaacacagtagaaaaatggtgcctgacacgaagaatcatggaaatctcaacaaatgtttttatttttttagtcagagcttcatatccact

SEQ ID NO: 18847 - DNA, 445 bp, Homo sapiens
ggtagccacgtccaagagtattttttttttagtctgggaaatatctcctgcttgaaactatattctgtcttctgctctcaacttttatccctttcctatgtttcctgacgtctgtctgtagacccctgttggtaatgggtatgtgtgggaagataattatgggtcagagaggccttctattgccaaggggagacatggtacttcatctctcatcctcttcctccacctaaacaccattttaacttttgctgccttgttaggaatgtattagaggattccatgttttataaagggataaaccagaggagagggccaagatcctgagattctgtaaatatccaatggaccactcttgccatccccattgtaattgaggcaatggaaaaaggtagcctacatctatgatatagaattaatctttgttaattattattccatctacatt

SEQ ID NO: 18848 - DNA, 491 bp, Homo sapiens
tgtatagatggtccaaaagcatcagaaaaacgaagtgatgaaagagtgtctagcaagcgggttctcgcacccctcaaagcacaggtcattatcaacctaggggaaaactgcaactgagttttccttcattttcttttcctattcaggaagaagcaactagaaaaacaaatgtaatttttgtttctttttagctgtaattgctggagttaatcttcattttcactactagaaaataaaggggccaggtgcagtggctcatgcctgtaatcccagccttttgggaggccgaggtgggtggatcatgaggtcaggagtttgagaccagcctggccaatatggtgaaaactagtctctactaaaaatacaaaaattagccaggtgtggtgtcgcgtgcctgtagtcccagacacctgggaggctgggacaggagaattgcttgaaacccggagcggaagtttcagtgagctgagactgcgccactgcactccagc

SEQ ID NO: 18849 - DNA, 432 bp, Homo sapiens
gtataccatacatgtttcaagtacatggaaaatatcacgaaattagagacaaccgcagaactatttcactattattttgttacttcattttccatcaaagaaaatgtcttttaagctaacacataaataaaacgaactaagaagaatataaaggttagttatcaacattaagtgatggagtatgtcaaaccctactttaaatatcagtgtaaccagaatcagagaaattagacgccagaagctcacggggtttatatatatactaaaccacatcagaaatctacccattccagaagaagaatatttccagaagtcagcaatttatatgaggaggcatccggaaatcatttcaaataaagaatagctagatgaactgctaaacttaccaaagaataaagtaggcagacacataaggggagctgctttcattca

SEQ ID NO: 18850 - DNA, 438 bp, Homo sapiens
aaatcctcggtgtctgctcaatatttcctacttatagtacaaatgaaatgtagtcataatgtttacataatcggtataaagacaattttataccaaacatacatgtaaccatctaataaacacagcttaaaatatattacctatttaaaaggaaaatgcttgcagatgaggcaattcaatttgaaaagtattttaagtataaatgtctaaagaggtaaaaattaagaaaagatgttaagctaatactgtcttataattgagttcttattagtgtatagacagcagttaattcagtcgagattaactagtacttaaagaaagtgaaagcaatttacactttggtgtgagcaacatcaattgtctttgcttttttgcctctaactaaggctattttgggctgtctgccacttgggaaatgctgcttttactgtatttcac

SEQ ID NO: 18851 - DNA, 557 bp, Homo sapiens
gttcaaatctggtctcccacatgttagctaagagacctacaaattatgttatgttacctctctgtatctcagtcttctcatctggtaaattaagctcaataaggacagagactttgtttactgtcataaatatcatcagcacctagaaacatttgctgtactgaatgaatacctgagcagagaatgaagggaagaaatatttcataaatgctgtggtaagattcacgtgagttaaaacatataaagcactaagaatagccatggcacagtaaatgctcaataaatgctaattattattatttcagcaggcaagttattagtcaaaaaggctcccattttgctcccagattctttacaccttttctcaagatatttatcagactcaaaagcacattacagtgtcttataagcagaggtaaagaatttgtattggccgggcgcagtggctcacgcctgtaatcccagcactttgggacacagaggcggatggatcacgatgtcaggagatcgagaccaccctggccaacatggtgaaaccctatctctactaaaaatac

SEQ ID NO: 18852 - DNA, 499 bp, Homo sapiens
atacactaaggtgaacacatagtacagctggatgcccgctgaaaaaaggcaagggaccctttatctcagaaagagcttttttccagcaggaaaatggaatttcaatccctgcattaacaacctagtaatatttgacttgcaaatgactactgcgtgtatcagttgcttgactatctagatataagagacctgagccatggcttgaaaggacatttggcatgtatgataaacctatcacagctgttactatcattcactttgcagattatcgtaaacaaactacagcaaccagaaaacatgccattcaaggtgtagctgaaattagttaacctttcatttaattgcattctttacaagcctgacatataacgatcaattgtaaaaatcataaatattatatttggtttttcttattgttaccaagaattttttgccttaataatatttaaatattaaaacaaatgttacctcttctgaacaaagcactaatatgagttgc

SEQ ID NO: 18853 - DNA, 470 bp, Homo sapiens
aagatttgtgggttcattatatttaattgttacctccattttcctttttaagccttctcagattaatcttcagttttgatttttaataacttttttaaataaatttatttgtggggaggttagattagcgatttggttggggatttttaggtacttttacctgctttttaatacagagttacagacgtgtttttcttcttttaataaattattcacatacattcccagatgccagcctatattttcctggattctcagcaatgttagaacacatggagacatcaggaagctcagagtgttaggaaaccaagaaaattaagaactttaaagtactgcaagttgaagtacaaggggtcagagtatggaagaagtattcagatccacatcaaggcaaaaatgaaaatttctgtgatattttccacccaagtgaaaagaaactgctggagtatagataacatgtatttttttat

SEQ ID NO: 18854 - DNA, 529 bp, Homo sapiens
aagaatggagactggactcagaggactaaagggacatgcctgagattatatcaaatatagtcaatggagctgagcttaaaggaagtctatcagaggccccacaatagcaattgcccaccacacaaaagtatcttcccaggttattgctcagaaaaggtgtgagaactagatgaggaaacacaggctgcatactttgtattctctgaagcagtgatcttgaccttaaatgcctaccatggcaagcatgtggcagtggtgtgtggatcaggcttgtggtaaggccctatggagaagaatgtgagtgaagctcactggaaacagcctgcaactgttcataggcttatttggtcttgcttttatttttgatgttggctcagtttgattcactttcatctttgtcaaacagatatgcgtattatttctggagctggaataggcaagggctttctggtcaacttcatgtggcttttgcttaaaaacagtgtaatcagctgggctcggtggctcaagcctgcaatcccagcacttt

SEQ ID NO: 18855 - DNA, 427 bp, Homo sapiens
ggaccttttaggtcttctctttcaactatgaacattatcttttattatgtatatgcttaaaaaagaatgagctatccctgaccatgacaagattctacagaggaaaataactaaaatgaggtcatagaaagatcttgcaggggttcagaattcttcctttatgcatctacttcttactatacaataacataactggttgacatgactgtgctctcctaagagttccttgagaataggaacaaaccatgtcttatttaccagttcctgccactctattgcaaggactccattcaagagagagaaggagagaaggggttttaaacaacacagtgtgcccaataaagtatactgatttatacactatctatgtctctttttagagaaaggatttagaaaagcagtatagggtagcagttaagagttctag

SEQ ID NO: 18856 - DNA, 562 bp, Homo sapiens
attgtaccaccacactccagcctaagtgacagagtgagaacttgtctcaatcaatcaataaaaataaaatgaaataaaatggcagagtacagccagcactccgtatccatgatgtagaacctgcagatacaaagagccaactgtaacctcctcaaaaatccactggagaagggaggcctctgaacaaccaactctaatttcaagttcctcacttctttagtgagagtatgaataaaatgctagggctacacagaggttactactcatttatggaaaatagcaaacataaatccttaaaagaaatgcaaaaaagctgcagcagatccacagagagctcatacaggccatgacactatactgaccacagtttaattcaagatcaacagaaggctgggcacggtggctcacacctggaatccctgcactttgggagaccgaggcaggcagattacctgaggttgggagttcgagaccagcctgaccaacatggagaaacctcatctccactaaaaatacaaaattagccaggcgtggcagcgcatgtctgtaatcccagctactc

SEQ ID NO: 18857 - DNA, 570 bp, Homo sapiens
catgtttaagataggctaggctaagctatgatgtttggtaggttaggtgtgttaaatgcatttttgacttactatattttcaacttatgatgagtttatagggacaaaatcccattgtaagttgaagaacatttgttctctatttgggtttgacaacatccctgtaatgtaggcattattaactccattttgcaggtgaagaaactgagtgtatccatatttgactgtttctcattatacgaattcaagaatggttaagttaaaattttatttctatcattttggtgtggaatagttatggatagtagatcagagtgatacaccagttgacttcttggcctaaacatttgaaatagacatttcaagattctttgacagtctctgttttggtcatcaaatgtgcacactgttgatgtgcataaagctttctgttgtttcaagtgaaattgaattttgggtagagcacagtggctcacacctgtaattccagcactttgggaggtcgaggcaggtagatctcttaaggtcagaagttcgagatcagtctggccgatgtgacaaaatcccgtc

SEQ ID NO: 18858 - DNA, 629 bp, Homo sapiens
ccccatcttccccctgtgccctctgcataaaatcccagatcccagctgctgtcacgatcatgactggccctttctaccgctcccttgttcctcacccctcccctccaccaaccctattgctatgctccagctggactgagccaccttcactatcaagttctcactcacctccatcccgatctttgcaaatgctgtcccctctgcctggcacatcttcctccttcctcttcttttatttattttttcaattgaaaaatgaaaaattgtatatatttatggcatacaacgtgatgttttgatgtatgtatacattgtgggatgattgaatcaagctaattaacatatccatcacctcacatactaatcattcctcatcctttagaactgtactcagaagtcatttcctttaggccgggcacagtggctcatgcctagaatcccagcacttttggaggccgaggtgggcagatcacttgaggtcaggagttcgagaacagcctggccaacatggcgaaactctgtctctactaaaaatacaaaaaagttagctgggcatggttgcatatgcctgtaatctcagctacttgggaggctgaggcaggagaatcacttgaacccgggaggctgag

SEQ ID NO: 18859 - DNA, 620 bp, Homo sapiens
tgctctgcagggtccaggttattttctttcggagcacaaaataattttattctgaggctaaaacatatgtgtcagtctttatttgcaaggtgttacatcctacaggaaggaaaatgctgggtggaggggattgtatgggaactttgggtaatctgggttgtgagacctcagagctctcatacggtttcacatgtctgaggccagcaagtaggtcagtatgagatattcagactggggaatgggcaaggatggagagaatcctccaatagaaggatgtgttcctggggctaaaaagcagtcagcctcgggttttacaagagtgaatgggaagttactgggcatgagtagtttcccaggagccttgactcaagatacacgcaaagacttcatttcccagccttccttgcaactgtcagtagtcacatgactgagtttagccaatagaatgtgagcagagatggtgcacaccatatccgcccatagcctctgcaaacctgccatattgcatgtccacgttctttccccttctgcaaccaagtgacaaaggccatgtgaccttgggaagccactctttgaaaatgacagaccttccatcagcctgagctctacagcgatccaca

SEQ ID NO: 18860 - DNA, 190 bp, Homo sapiens
gctgaggaaggtgtggcccgtgggcattcctgtccagcaagaacccctctggcttgtctgtattcattgccacccacatggacctctctatggttgcttgccaaagccgggagggagaagggtctccccttcctccaagcccaggatcaccgggaaatgcccttcccacctactggacttgactaatgct

SEQ ID NO: 18861 - DNA, 264 bp, Homo sapiens
ctttttaatgaattaaagcaggattgaactcaatccaaagacagcatgtttggccatttaaaggaagaaaaaatgaaagagaaggatgttttcttctctcctggcaatggtgtgcagtgaagtgttgatgatttagtatgggtagtcaacactccaggaaagctatctaaaggctgttttgttgttggtttcttttccctctaatcaaatgcaccctattggcttgaggcaaacagaccactccccattctttcttagataaac

SEQ ID NO: 18862 - DNA, 504 bp, Homo sapiens
ctgaaggatgaagtaaaggagactcttcagaagcatttgacagtcctgtagttctgggtactgactcgattcctgctacaaaaacaaatagtaaaaagaataaaattaaaatatcataaagaaatttctaggaacataaatttaaccctgaaagaatgaaatacaatctatgagacataaccaccaaatattataatgataaatacaatggatgctacatgtgcacaaatttacatgttataaattaaaggaaaagcccattatgttatataaacctaacttacactaaaatctccaaatttattaatgattccaccaacatttgccaatattaacattgattttctcatgtttatctgtaatttgcagtgctgctcaataacatatcagtataatattatgtcaatatttagcaaacatggtatgtaataagtaatgatctaacatatctcagaaagaggaaggcgaaatacagaaggaataaagatgattctgagaaaatga

SEQ ID NO: 18863 - DNA, 428 bp, Homo sapiens
caaatggcctggccacatggtcaggcagaagggcaacggaaacctggcctattaaagaaatgcccacatggggtatggccctatggaaatttgaggggtgtgttaaagtagaacaaatgcccatcagaagaattcccttccaggtctggaaggtgactggaatcaacaagtaggtatccctgtgtgctccctggaggtggccacctgggtccatgaaatgaggggacataggtcactgcagcgggcagagatgggctgaattgaggcatgctacctttgcaccctctctggcacataatgcaagtaagaattactctgcttgttaccaacagagacagaaattgtggatagctatgagacaggtttcctgatggaaaggccctcactgataagccttcacgagtgtgtgctcaccccgaacatgaacg

SEQ ID NO: 18864 - DNA, 472 bp, Homo sapiens
ttttggaaagatataggctgggtttatcattctcctaccaggagtccaactaagccagctagcccttcagtatgtgacagccttaattctggcaagaatccccaattcgagtctgatggaaagttgtttcctcttatcgagcagttttgatgttagaacagtccaagtaatgcctgaagaaaaataatgtatatagattatgatgatttattgctctaatttgtcttctcctttgtgtactcagggttcagtcaagagacaggaactatgcagagttacctgaatacatataatttttattttttatatttatttattgagacagagtctcatgtactctgtggcccaggctggagtgcagtggtgtgatcttggctgactacaatctctgcctcttgggttcaagcaattcttctgcctcagcctccagagtagttggtactacaggcgcccaccaccatgcccagctaat

SEQ ID NO: 18865 - DNA, 366 bp, Homo sapiens
tttaatcttcaggtaaatagattatgtctgctgtaggcaaaagaatggcctcccaaaaattttcatgtcccaattcccagagtctaacatacaaatatgttagatttcacggcagtgtgaaattggatttcaagtgaaattaaggttgcggaaaaatgatagagagattgtcttaaatggctgggatcaatgaaatcacaaacatccttataagtgaaagaagaagacagaagaaaggcaaccttggaggtggtggcatgagaaattactcaacatcactgacttttaagatacaagaatgaggacccagcgcggtggctcacgcctaatcccagcactttgggaggttggggtggggtggatcac

SEQ ID NO: 18866 - DNA, 426 bp, Homo sapiens
catcagtgtaataagttggggccaaaaatccaaattcttggtggttggtccctgatcttcacgaggaatatcctgtttcttactctgctcacaagttcacgcaacatgcaaaagaaaaggttaaatgggatgactttagttagatgtcactgtcaaatagaagatcaaagaaaaatgattgtggaaatgaaacttagattatgggagtcaaagctgttaaactcaggtttcttttcttcattgaatgacatcccgtagaataaactcacagtggcctggcttgtatttctaatcactttttaaatattgggttaacttccattgctttgttgctgttgttgtcgttctggattagaggtttttcctgcctctgatattacaagttcatgaccttaagaattattattattagaaattatgccttta

SEQ ID NO: 18867 - DNA, 498 bp, Homo sapiens
ctatttaacagagttcctttctaccagtacatcatttccagatttcaacaaaaaatttacaagatatacgaagaggcaaacaacacagtttgaagagactgaacaagcaccaaaagtagactcagctatggcagggatgttggaattatcagaccaggaactttcttaaaacttaataccctaaggccttaatggaaaaagtagacaacatgcaagaacagatggataatgtaagaaaagaagttgagattctaagagagatcaaaaagaaatgctagagatcactttaacatgaataacaaatacttttgacagactcaataccatactttatacagctgaagaaagagtatctaagcataagtatataatgatagaaacttccaaaacggaaaagcaaagagaaaacatataccggaaaaaaatcagagcaaagtaatcaagagctataacatacatgggaatatcaggaggagaagaaagagataaaggaataga

SEQ ID NO: 18868 - DNA, 519 bp, Homo sapiens
aaaaaaagcttaatagtcataatatatatgggatttttacaaaagaaaaacaccaaaatagaaacatgtataaaggaaattaaaaggaaatcaccaaagacaaaataagaaacccctcaaaaaacagcaaattaaaatgagacatttttgggttgggcgtggtggctcacgcctgaaatcccagcactttggcaggccgaagtggctagatcccttgaggccaggtgtttgggacgagcctggccaatatggcgaaacccctctttactaaaaatacaaatattagccagtggtggtggtgcacgccagtaatcccagctacctgggaggctgaggcatgagatcacttgaacccgggaggcagaggttgcagtgagccaagatcgcaccactgcactccagcctaggtgacagagcaagactctgtctaaaacaatttttttaaaataaaataaaatgggacatttttatccaatcagatcaatatagtttaaaatgttagtggagagtatgagaaaa

SEQ ID NO: 18869 - DNA, 518 bp, Homo sapiens
aacaatataattacattgtagtgtcttctaaatcccttattatacaataaatcttctgcttccaaatcatttttatatagtatgctattttaatgaaatacttttagagaatcaaagaacactggagctagataggactttaaagattatcgaacaaaaccattcattttaaggtatattggaaacttcatctcacaaaatcacgaaaaaccccaattcagcaagtcaagtttcagttatcctttagataccttctaatggagaaagaacctgcagcagatgacagaaattgtagaatactacctcacatctgaataagaattttaaaaatttccaagcactttttcatattctgtatttcacttgaccctccagctgaatgatggatcacaaatgaagtcattaaaaacagtaattcctccactttgtccaagagtgaattccaccaattaatccatcagggattctttcccatcggtgttcattttctctccctttctctctctctatctctcact

SEQ ID NO: 18870 - DNA, 435 bp, Homo sapiens
gtaactcaattacatttgagcatagcatatgattatagatattataaactaagattcaaatgaatattaataagtaaaatgatataaatcaattaaaattaaaattacaagtactggtaggcctatattctttaactaccaagaaaatgaaatgtctttaagattgattgttggactgtcttgactacctactataccatgtcaacccacatttactatgcccctattccaatctaccaaacactactagccagctgtgtcaaagaacagatccagtgatactaccatgcttacttaaaaacttccattatttcctatcactgctggaggggagaggcaaaaccagaggcagggagagcaattatgagactactgtaataatctgggcaagtgataatggcatcatgaactagaagggaagaagtagaggtagaa

SEQ ID NO: 18871 - DNA, 549 bp, Homo sapiens
gaagctatagttttaagtgtagtgacactcctgctctgtaccttagtaaaaagaagtgtcccccttccagtaaccaaatttaaaaccacaaagcttatagttgcagggacaggaagcacaatttccccaaaacacatgaccatgaggtccactggttctgatatgtattgtactttctaaaggtaccagtccaatagtgtttgatacccgtgtcaatagtcacagtaatttgaagacgaaaacactggatcagtaaaagggatttcaaaggggcatcaatctcatctactacagtcttagttctattataattctagccccattttatccccttttatagtggaaatgaatattgcaattttcctgccccaaacttctcattgtgtattgagagtatagtggacagataaattgtctctttaattcacaggtcttcagaatgagagaagatatgccaaagactttttatctatacctgttcctgttatgatgatgaaatcctggactactagactgaatctgataccaaaattggaagagtttttgggt

SEQ ID NO: 18872 - DNA, 518 bp, Homo sapiens; identical to SEQ ID NO: 18869

SEQ ID NO: 18873 - DNA, 465 bp, Homo sapiens
aaaaaaagcttaatagtcataatatatatgggatttttacaaaagaaaaacaccaaaatagaaacatgtataaaggaaattaaaaggaaatcaccaaagacaaaataagaaacccctcaaaaaacagcaaattaaaatgagacatttttgggttgggcgtggtggctcacgcctgaaatcccagcactttggcaggccgaagtggctagatcccttgaggccaggtgtttgggacgagcctggccaatatggcgaaacccctctttactaaaaatacaaatattagccagtggtggtggtgcacgccagtaatcccagctacctgggaggctgaggcatgagatcacttgaacccgggaggcagaggttgcagtgagccaagatcgcaccactgcactccagcctaggtgacagagcaagactctgtctaaaacaatttttttaaaataaaataaaatgggacat

SEQ ID NO: 18874 - DNA, 409 bp, Homo sapiens
tgtaatgacaagataagtacaaaaacagagagtaaacatttagagacttctagtgcctaaatcgctagctcagaaaggttgaaggaactttttataattctttttaatcaggaagcctaaaagttcagaagaaccttaaactttttggtagctagccctatccataagtgtttgaatatatcatggcagtttttgtatgttaccttcttggttaagaaaaggaaaggggcctgacctggtggctcatgcctcccagcactttgggaggccgaggtgggaggatcacttgagcccaggagtttgagaccagcctaggcaacatggcaaaaccctgtctctaccaaaatacaaaaattagctgggcatggtggtgcacgcctgtagtcccagctacttgggaggctgaggt

SEQ ID NO: 18875 - DNA, 590 bp, Homo sapiens
tgatccagtaccactagtagtgacaatagaacccacccattgttctaagtgacaacacactgatgcaggtactattattttctcaaacaattggaatatagtctaatttgccgacagctgcaaagcagcagagccaggattcaaacccaggcagtctggccccagagtgcctgcttcaaatcactacatctcttcctctcttatacttattcatcagtagatgcctagatgtggggctttacacttcagcagatactaagagggccatgtaccaagcgccaagtactgaggaatacaaacataaatactgcttgagggccaggcgcggtggctcatgcctgtaatcccagcactttgggaagcccggctcaacgaggccaggagatcgagaccatcctggctaacatggtgaaacgccgtctctactaaaaatacaaaaaattagccgggcgtggtggcgggcgcctgtagtcccagctactcgggaggctgaggcaggagaatggcgtgaacccgggaggcggagtttgcagggagccgagatcacgccactgcactccagcctgggtgacagagcgagactccgtctc

SEQ ID NO: 18876 - DNA, 563 bp, Homo sapiens
tattaatttggggaactaacaaatgtccatgaaatcttcacaatttatgttcttctgccgtggcttcagccggtccctccgttcaggttccctgacttcccgcaacagttccaggtggttatattcatttaaaagggctaattaaatctcatgcataaattaattgagtgaaaatagactcttgaaggggctgacttctccaaaaactaatttacttactaaactgtatgctgaagtctgaagcccatagaggggatgataagctaaggaaagtataacttgattgaattctcatttgcctatgcctgctaagaaaggtggctatgggtggcccttttaatccagagatctgaaatcacaagttaaatcaaggtgattatacactaatactcaaacaaataaagggagtggctaatgagtagagagtgtttgtcttttcagctttgactattattgtatccttggtgcctagcacagtagctggtataagtatatacactagaaacatttgttgtgtatatgaaagatattaatctaactacccaaaccttctaccttaatta

SEQ ID NO: 18877 - DNA, 290 bp, Homo sapiens
gtgtgaattttaaacagagatggaaaatatagtaaagaatcggaaagaaaagatagaaatttaaaacagtaacacagatgaagtgtcatcagatggctcattagcagacctcacacagcctctgcaccccaccccccaaaaaagtcaagtcacactgaaagacacggcctatgaagaatggaaacagaatactgtggcacaacaccaacaggctgaaatacttgagatttgagtcctagaagaagagagagtgaacagggcataggaagtgtttgaagggaaatggatga

SEQ ID NO: 18878 - DNA, 450 bp, Homo sapiens
cagaggcatttcttaaaagagggtgaacaaagttgggggcagggagagcaagctcagaaatcagggagaggttcttttgtggggatggtgcagtgcaggccagcaggcttgccagagtgcagctagattttgggcagccacccattgaataagaaaactatggcccaggccgggtgcggtggctcacgcctgtaatcccagcactttgggaggccgaggtaggtggatcgcttgaggatagacgtttcagatcagcctggccaacatggtgaaaccccgtctctactaaaaatacaaaaaaattagccaggtgtggtggtgcatgcctgtaatctcagctattagagaggctgaggcaggagaatcacttgaaccccaggaggcggaggttgcagtgagccaagatcaccccactgcactccagcctgggagacagagtgagactttgtc

SEQ ID NO: 18879 - DNA, 329 bp, Homo sapiens
aatacaacatctataaagaactattcttatagtttctttttctgtttccttgtgtatttactcttgcatctgtcatctgtattttcctcatgttctgattcttctttatttaccctcttgcctgcctaaagagtttcatactaattggattgttattattattttcaatgaagctatttgttgaagaatcacttggggagaaatagaaatagtaaaatgagccagtcagcatcttcttggaattgctgttgcaagtatcctcaataagtttattttcctttgtcctgggggcaactttcctgtccttgttattgttgttaatgtaagag

SEQ ID NO: 18880 - DNA, 320 bp, Homo sapiens
ttccctctaaggaatcattttcttattgataatatatagtgataaaatatttctagttttttttcaaaaatagtttggatttaaacaatttgtactttttttcttttctaattaaagaaatcatagaagtaataattcactgcatgcttatgtcaaacaatccagaaatggctgcagaaaagttatattcacccatccctctcattgatgtactcccagccatcaatccatcaattctacttccctcccaagaggtaacttctaattacactttggagttttgggtttatattttcttttttttttcttttttttttttt

SEQ ID NO: 18881 - DNA, 454 bp, Homo sapiens
caagtctatgatttttatgtttagatgcaattgcacatatcacatttagggatttgtgtcaaacttgggtttaaatggtgacaacttatttctctattttgaattgattcacaaaatgtcagagcccctcaaaaatcaatctctttgcaaaaagacatcaagttatttgagatttttactacaaaatctactatgcttcagatatgctatcttcttaaatgaaatcttagttggcataaaagttcatcatagtaggactcttgatggcttcagagaaacactttattagattctaaagcactcaagtcatacctccaaagaacaggctaacctacagagtctccataaattactcatagcccagctactactggggccataaaaggcaacctcaggaggatcacgaggtcaggagatcgacaccacagtgaaaccacgtctcttctaaaaatac

SEQ ID NO: 18882 - DNA, 363 bp, Homo sapiens
gagagaggagtgaaatattctatctaggtaacctttaacaaaattgcaagtttgttttcaaagtttatacggtaagagggtacggtggaagaaagacctcatcgttaaggcagagaacatccacagagcaagatcttgtctctgtagggctatattgcttcctttctaaaaaaaaaaaggttttccttcacagtgcatttacgtcaaaattctaaaacctctcacatgagcctatcacatcaaccttgtcaagtctcacttgttgaaatgagtgggatttgaaaacttctgagtgtgctattacattttccatttatgttcagggaatatggctgtgtgaaaaggaggccaaaagttgtgggg

SEQ ID NO: 18883 - DNA, 404 bp, Homo sapiens
  misc_feature 255: n = A,T,C or G
tatgtgtctgacaaactcaaaagtatgtaaactatgatacaactaaaggttttgattgccataactgaaaagttatacaacatttaagaagcttggaaaacactggggctgtttttaaaggaggaaatgactgtgaacattacaactcatgtaacctacgctttttgctgatacagaggtatctgtaaaccactataagatacaaaagtaaggccgggcttggtggctcaagcctgtaatcccagcactttgggngtggatcacgaggtcaggagttcgagaccatcctggccaacatggtgaaaccttgtttctactaaaaatacaaaaattagctgggcgtggtggtgtgcgtctgtagtcccagctacttgggaagctgaggcaggagaatcgcttgaacc

SEQ ID NO: 18884 - DNA, 230 bp, Homo sapiens
gtcagtcattacagggcaaatggtgtctgaagatgttagttgagtctagggatatcttttcaataaatgaaattcaatcaagacacatagaatttgtgctttttcagagtggacaaaaggcaagttgcagacctctgggtatagtatgataccatttttttgttattttgttaaaaaaaagaggacaaaaataatatcacaactgtgtgtgtgtgtgtgtgtgtgtgtgt

SEQ ID NO: 18885 - DNA, 465 bp, Homo sapiens
ggaagaggcatttttctcaatgaaaaatagggttgagagagtatttttgtgtcatcagacatctcaaactatgttttaatagtataacctaatttatatttcctttgtgtttgtctctgatttttcagttcattttaataaatactttttgagcacctgccatatgaaatgaaatgagccaagcactataaggataccaagttgtaatagtcaaggaaatggctctagctctgtaggaataaaacatcagatttcaggccgggcacggtggctcatgcctgtaatcccagcactctgggaggccgaggagggcagatcacctgaggtcgggagttcgagatcagcctgaccaacatggagaaaccctgtctctattaaaaatacaaaattaggccgggcacggtggctcacgcctgtaatcccagcactttgggaggccgaggtgggcagatcacgagttcagga

SEQ ID NO: 18886 - DNA, 496 bp, Homo sapiens
atctgcccccccgacaaattatggaactcagtggctaaaaataaatagcccctacagagggggtttgaacaggcagtgtgagaaagaaaaatcatcatgttaccatacttcaatttcattcaaactataattcataaataactaaaatgtttaatcaatagtttgtgaataataaaatatcttcatatgtttaaaaataacaagggattctacttttcttatagaatcaattaactgtgaaaacaaagcaaatgaatagtcaaacatgtaggaagtgatagctttctttttaaaaattatagaatgttgtgaacactttcattttatttccttctgtaaatttcattgatatgatcaacaaaaatataagatagaagctatagcaatgattaaaaaaatcttgggtgtcatatgattaatttatatatcaacttggtaagccacaatattaaaatatttggtcaaataccagtagagatgtcactagaaggggtgt

SEQ ID NO: 18887 - DNA, 457 bp, Homo sapiens
gaataaatcaacatcagagttttataaatcagagtgtctttgtactctacaaattagtatgcttaatatacaacttgaagtccttcagagaaaatattaaacagaaatgccttctacccagagatatgaatgtgcctttgcaataataaagaagagactaaaaattgtatagcaatacctagtatctgaccaatacattatttcacaaaaataataaagtatcttgcatcatacatggaagacagtgacttattcctgaatctactatatctacagactttcttgtaccaaatatttactataagtacatacaactatggaaaatgctatgctatgcctttgagaggtagagtactgtagaaatctacacttattaagagcacagtattttactcttttccctttcctatgacatctcttcaccagtccccttctttctatgtgtgtgtgtgtgtgt

SEQ ID NO: 18888 - DNA, 379 bp, Homo sapiens
ttaatatccggaagtagctgtcttcctacaccttagtcaatagctaatcaaacttcttaatcatgttaatcgggtatttttaaaatgctttcagtatagtttcaatttgcttaactcttacattgactgcaactgaggatcatttcatacatttaggagccacttgtctttcctttgaactgtctctgaatgtgcccacttgtctactgagttgttggtcttttctatcagcaagcgatcttgctttttaaaggaaattagccctttgaacatgctgcatggcaactatttcttcccagcttatcactggagtcccaattttgtttatactagtttttgccatgtctaggttgtctgtttgtttgtttatttatttatg

SEQ ID NO: 18889 - DNA, 534 bp, Homo sapiens
tatgtaacatttaacttccagtttgcttatttttttaagacctattaacaaacaattaataaataatgagattagtcttttcttaaatttatctaaagtaactttagaagaaagatatttctagcaccttttatatttatttacttttacaacttttcatgttttaggaatgacttctaacatttctactgaatcaaatgtgtacaagagtttgtaaaggctggctgtaagaaattattttcatgctgtatcagattaacaaatactatttagaaaattcttccccaggtacataaccccttttgcagtagtgtttattgaaatgaatatgaatttgcagaaagccacatgatactgtctgagcacagactttggagtcagacagaacttaaaggcacagcctcttgccaacggtgtgaccttggcttgttatttactctttcagaaggtcagtttgtcactcaagtaatataatatagaaatgaggtatgaaaaattattagcatattatcagacacaaattacattctgagc

SEQ ID NO: 18890 - DNA, 145 bp, Homo sapiens
gaataaaaacctgctctctcctgaaaatatggttcatgtagaaaagtggcttagagattaatagaaacttaatttagagactgatatcaactgcacagttactagtaaatgtcatttcatattactcatgataagagttgatatc

SEQ ID NO: 18891 - DNA, 250 bp, Homo sapiens
tagagatggggttttaccatcttggccaggctggtcctaaagtgctgggatcacaggcgtgagccaccgcacccggccactgtcttgtatttctaacgtccccctgacttttctgatcatgtaattcttaactttctcaaaactgagatttgtcacgtgtcctctccccactccattttgtgaatcagagtcttccaggggcaggacctggagaatgggtctttattaacacacatgtgaaaatgctttt

SEQ ID NO: 18892 - DNA, 444 bp, Homo sapiens
gaaatgatagacacctgctccatacgtcacttcctacccatatttgtatgtaaactgagattataggacaccaggttttgaatatgtgctcacttccttgagactatttaagcatctgtattgtggaatttctgaaagaaagtgtaaatggcaatgtgtggaactaaagggtaggcaggtagattaagcagtagattaagccagcagtaactgttctgtttgcttccgaaaagcatgctattttacccacaggccacagtttctccattcccagttgtccaggatattttctcctagagttgttccataattgcctatgtctctgatactaaggattcttaatatatgtcattcctccaacacacaggcatacacacatccatataaagttctattatattggtttttcagcaactatattaaaaatctacattgggccggacg

SEQ ID NO: 18893 - DNA, 312 bp, Homo sapiens
ccaccaccacacctggctaatttttgtatttttagtagagacgaggtttcaccatgtcggtcaggctgtcccaaactcttgacctcaaatgatccacccgccttggcctcccaaagtgctgggattacaggcatgagccactgcacgccccgtccaacacccttttttactatcatagctgggagcatggacaggggtgttaatgtcagatgagaaagtgtcttataaggaaaataagcctttttctccttgaatgaagcttaaggtgtcattgacaatggcgtagaactggctttgaaagagatcaagtga

SEQ ID NO: 18894 - DNA, 558 bp, Homo sapiens
acatttaagatctttatattacactgaatgtagatcttactatgataaaaaatcaactgaaaaaataaaaaaactcagagcttatgtgagaaaagttaaaaaacaagatgaaataagctatataatccaatatcatttatataaactaaaaatatgtccacacaaaataacaatacatgtttcataaaacacatacggggtgaaaaaacataacattcaatggtatagaatggttgctgtggttgggtaggggagaggggagcaggggaaggagtggtgcagaggaaaagtgagaataaacaagtaaagtggaatttgcttccatggacctttcacgtacgtattcctttcagatacaactttctgacctaaaatgcaacctatgcatttgacgaaggtctaatttccagaatcgataaggaacttaaacaaatttacaagcaagaaccaaacaactccattacaaagtgggcaaagaacatgaacagacacctttcaaaagaagacatacacatggtcaataagcatatgtaaaaatgctcaacatcactactcact

SEQ ID NO: 18895 - DNA, 492 bp, Homo sapiens
atcaaactcaactataatgatcagaaggttttaatatttaaatatataaatgggttgcccaaatagtcaccctggctaaatgctgctaaataaattagtgctccttcttatccttctatgaaaagaaaactgaaatcaaatgttaagatctttaatatgatcaggtttctgtgacatagcttcaccttaaatattagctttacagcctgaaaatatagagttttaatacagtttagctggagaagttgttttgtacacaatgcatttttagaggaatatcttaatatattgcccatgtgaagctcctggtgttacaaaaaaggcagtttatattcaacatacttcaagtttagaatagcagagcattttgtaatttagaacaaaggcatgttccctctagtagtttctgatatcaactgcaacttataaatttgccttgagacatgtttgcaataaaaattacaggttttctgattcagcatgttccatcat

SEQ ID NO: 18896 - DNA, 321 bp, Homo sapiens
aacatgtattaaaacttagatatcgcctcaccgtgaatgcatcagacactgtactgttctcaccactagggtgggccctctgcagccacaaatagaggagacagttggggataaaatcataactgatgaatagagagactgagtgcactagcaaacctgtagaaattctaggctcacaggaatagcaaaagacagcccactaaataaagagactgtcaagaagcatttcacacctaacatgagcaataaatgaattcccatccaccaacaacgtttctcatgattttcctcatccacaggttcaattagaagctttgtaaa

SEQ ID NO: 18897 - DNA, 217 bp, Homo sapiens
aaaaacagcagcagcatttacttactgaaagccatatggagaagctgtactctttcactaggtcacttggcaaacattacctttgtgctccctcgacatttcctgatctcaagagtaggaaaccagaagagaaccaaatcacttccttccctacttcctaaagagcaacgttgacctcatcagctgggcttcagggttcagtaaacccacatatttc

SEQ ID NO: 18898 - DNA, 551 bp, Homo sapiens
gatagtttcacttgcatggcaggacagctagatgttaaatgagaatatacaaagcacagggcttggcacacagtatgtagctttgcctctccccggcctgtctctgccccacagcgtttcttgtttggcacaactttgggccgcgaggatctgggggatggtcaggctatcaacgaggtctcagctgagcctgttggactcatggcccaatctgatggaaaagaggcaaacacaggcaaaaggtcagagccgttcagtagaatggtgacggcagaacataaccctgctccagccagctgcaaacctgcacgcttcccttctaggcatgacccagtgctgttcacactttgaggcccagctcaaataaatgacacctccttcaggcagccctctctgagcctccaggggaagtggtctccttatggtgctttatctgcctctgcatcgcaggaaagaaacagaaagacttggccgggtgcggtggctcacgcctgtaatcctagcactttgggaggccgaggtgggcggatcacctgaggtcaggagtttga

SEQ ID NO: 18899 - DNA, 289 bp, Homo sapiens
gatctgtgtcttgaactacacatttccttcctgacatatttcaagctcttcctgttcctgttctcagcagcagggtggtgtcactgccgtgcagttgcagactgaggcccaggtggcatccgcctcaggccagcaagtccagaccctccaggtagtggtaccctctctgattctctgtgagcactgcatgaacttctcctctcctcatgtctggtgctgtttgtgttaggatctccagtaggaatggcaaagtcagttgcatgtctttgatgctgctaacttgtctttg

SEQ ID NO: 18900 - DNA, 497 bp, Homo sapiens
attggttttgggccaggcacggtggctcatgcctgtaatcccagcactttgggaggctgaggcaggtggatcacctgaggtcaggggttcgagaccagcctggccaacatggtgacaccccgtctctactaaaaatacaaaaattagctggatgtggtggcacacacctttaatcccagctgctcaggaggctgaggcatgagaatcacttgaagacagaggttgcagggagctgaggttgcgccactgtactccagcttgggtgacagagtgagaccgtgtctccaaaaaataaataaaataattgcttttgccactgttattcatttgacataatcaaaaatgggactaaaagtacattatcatagaacccatgagttcttagtgggataaaagctgaatattgtattgtagctacagttaagatggacaaatatacttctggcatccaaaattcatactgtaaaaggaatttcctattaaaaatgtaaaaaaag

SEQ ID NO: 18901 - DNA, 675 bp, Homo sapiens
aaataattaactcgatggctgggcaatggttcactcatcaatatctcttcctaggtgctctgtaaagagttaagtccaatgtgacgtaggtggagctagtgttcatgatgtcaggccatccctgccatctgactcacgggcacccagacagggccacgtcatcagctgacaccaggtcccacaagcaaggcccacacagcttcccaggcttcaaatacttgctctgattgtcagcttcatggcagatcaagccaccaatgtgttatttagtgggatgaaagaggacgccaccccaggctctgccaagcacaccccctagtagcgcccctccagccaccaaggtggcaacacagcctgggagaaaggtcagagcccactgacttgcatttctgtcccagcaactagaggttgctgagctgtctccattccatgagtcacacctttgcatgtgggcacgtgaaagagcatacatcatcttgccagtaacgaaatgcaacaccaggccaggcgcagtggctcacgcctataatcccagcactttgggaggccgaggcagacagatcatctgaggtcaggagttcaagaccagcctggccaacatggtaaaaccccgtctctactaaaaatacaaaaattagtcgggcatgatggcaggtgcctgtaatcccagctact

SEQ ID NO: 18902 - DNA, 566 bp, Homo sapiens
agtcatgctagataaataagtcctagagatcttgtgtacaacatagtgccatagttaacaatacagtattgtgcactttaaaatgtgttgaggatagatcttatgttaagtgttcttaccaaaacacacacacacacacacacacacacacacacccttgggtgtggtgatgatatcacagttttatgcatacattcacattcatcaaatcgtatacattaaatatgtgcatttttgtatatcaaatatacctcattaaagcgtttaaaaacactgatatgatactaaaatatattcacattgaaaaatattaaaaataaatgcaaaccattctgttatataatgaatacttaaaattattagcattattaagtatttgcatgtttaattaaagattatattttattattatgggtctaagtaagccaaaattaaataggccaggcagaatacacattctcaagtaatccaaggtttttctatgcctcatcaacttgcagaggattataattttagagcaagcagttattttatatatcagcacacacatgaggaaacttttatgc

SEQ ID NO: 18903 - DNA, 468 bp, Homo sapiens
tacctcccatctcttccaagttaaagcctggcaaggatgagatattaccatctggtttaaatgtcaccaaatgatgagttggtataaccacagaaaattgggaggatcctgccttaaagaccttgtaattatgtgggcttgatagggatttgttctttgtttctggggttatgtgattagagtagtattaaaatgtttcagtatctgtagcctgtagtatgtatgccccataagaatatgtgcttaatgaaaagttccaatcaagtgcttgaaacacactaagtttaggctttagttctctgaacattacaatttggtcaagccagtgagatggcaaaaattaactcaagaatgcacaacaatctgcctaagggcacataaagtacatagctgggaaaagaaatcttagcctagctatctactcctaacaaaaatacctaagcatttgacaattttaaatggtacata

SEQ ID NO: 18904 - DNA, 615 bp, Homo sapiens
agtgcacatttattttactgtgagtctatttggcaatgaaaaagattccagtaaaagggggtgggggcggtcacatgcaataattggccaagccaatcctgtggctggagaccctgaggtatttgccgcctcagaagggacccgctgaggaattggaatgagaccaagcctgcagacagaacaaatgtacaggacccagcagtgaggagcttgggaaggcagcaaagccagaaatgaagcaaggactgacaaatccaccaatattgagttatgaaggctaccagacaagtcatatctctatttataggcagtcacaattttttcaatctaaagaggtgaatcaggaatatattagagagttgataaagcagatacagtctgcttatgataagctctgcagagaaattactacatttggaactcaaggaagaactaatcaatacagatatgctagtattaagatacatttgtaaacttctttgtatttttaaagagtgtttcacataccatcccatttactttggctcagtccatgatatacgggagacaggtaaattgaagcaacttgcttgaagtcatacttcttagtggctgagtttgagcttgaactgcaca

SEQ ID NO: 18905 - DNA, 644 bp, Homo sapiens
cccactttaacatttaactttttaacaaaactgtaattatcttcaaaactatataatttatcttttctgaagttaacataactcacagtgctgtgtttttagaacagctgggttgaatgcttgtgtgtgatataattaatagaaccctaagtgtaatagtgagagagggaagggtatagaatttaaatagtgatttttgtcagaaaaacctggggaaattatttgtgggtttagttacaattttccagggatttgcctttattttctctgtgttccaggtcttgcctgaaatttagaagcccctttcttgcccttcctttctggtgctatcaatggtggtaatcacctctgaggaagaaaagccctcttcccactgtccatggagaacactcagcatctatgcttgattttgacagggcagattttggatgaatcatgaaatgcttctaaagtagccaagagttaactcttcctaacctttttatatagtaagcatgttaccccacaaggtaacttacccaggggaatcaactacatagtggaatcacgttattcacacatttaacttacacaaattcaactctactgaaaaaaacatgaagtacatgagtgagagagaaaaataacaatcttaagtagcacat

SEQ ID NO: 18906 - DNA, 634 bp, Homo sapiens
tctgtctcagtaccccctccctaacttgccccacaccacaggcctgggaggagcagtgcagagcccagaacttagagtaagccagagagggcttggcccactgggaggggtcctcccggggagggaaggcagtgggctggcctctgtttcaggtcaaatgcaccagcacagaggacagtggcctctgactcttagaaacacctcaagtagaaactcagaaatggcctatctcagctctgtctctctgcccagggtcagaaaggctggtctggcttccccccagcctgggaggccctggtgtccttcctaggtgtggggctgccctaatgtcctcagctctgctctgggtggggggtccccagccactgcatgggagcatctgtttaatcattgcattccccctcctgctgcctgcacaggaacaagccatctaaggagctggttgaaccagccttcccacttgtgctcagggagacacctgccccagtgggcccccagcaggcctggccacctcccctgccctactcctgccccagtgctcagagccagagctaaggtgtcatcctgtttctgagccataccctccccaggagtcccttcccacccactcccttgaaggcctgatggctcactg

SEQ ID NO: 18907 - DNA, 206 bp, Homo sapiens
gagactcgtaacttgcactcgctgttcctcggaaagtctatggatggtgacagctgtaacactggatacagtaacatctgcaggtgtgctagcaacagcaatagcaccagtggtagtcctgttatgctcctctaactcaccagtggaggtagtgtgggtcaatgtagaagaatctgtgggacacagtagcactagatgctaacttt

SEQ ID NO: 18908 - DNA, 594 bp, Homo sapiens
aattcagtaagatcctccaaagagtatgtaatccaaaactaaaataaaaatcatcatcagtgttaggaagaaagcagggaagcaaaactggtaaatgttagatataattttatttatatatatcctcccttatcctaaagataatataaaataactttagcattttatttttcttttttgagacaaggtctcactaggttgcccaggctggccttgtactcctgggttcaagcaatcctccctgctcagcctctcgagtggctggggtgacaggcgtgcaccaacgctaccagcaagatgactttaagaattttagacacaactgaactaaatgaaaaaataataaaatcagagcaaacagcatgaaaagaatgaaacaatacttgtatcattaagtcctgtattcttacaagaggtgagccacaaattgctccttatgatttctttttaatttttattttaggctctttctttgaattctacatactttctactaggtcatttaaacagggaaaaggagctgattacatgtctcagcattggtaagattaaaaactccctagatgctcagtagaagtacaaactattggtact

SEQ ID NO: 18909 - DNA, 578 bp, Homo sapiens
gtgtctgtgtatgcgagaaactatatcctggaccatgagaagggctgacctggccgcctctgatataattctcttgggatgatgaggggcctccaaaactcatcattcttcagggaacgaagaatttttttctttgcctcttttctttagctctttcatatgcattgtgcttaataaatagcagatgctccccgctaattaattactgcttaacaaactatcatactcataagaattcagggggagaaaaaggaaagaaagaggtcaaatgcactatggaccaatattcaaggtagtttcagaaagccttttcttagttctattattgtataccttaaatatttcatgttagggaatctctatatttatattcctatcctagaaagaattgtcatttttattttttagttctaacactatttcccacttgaaaacaaataatgcattggaaacaaggaggtcaatctggttccaggagcttcattcatcttatgacgctcttaggagacccctagggaataccttcaggcataatgataaaatcatgaggatccatagaatctattacaatattttct

SEQ ID NO: 18910 - DNA, 493 bp, Homo sapiens
atagatgattcttaaaactcttggagactaacaatcacctgcagaacttcttaaatatatccatgagcagacctaggcacagagctacagaatcaggcgtcccattactccattgagattttaagcattgcctttgtttgcacatacagatgtaggtttggttccagatttatctaaatattttaagtttcttcctataaagaataaagggtttgatataaatatatgttataaattgtttacttaaataacatgatgttttagaaattgcttccttatattatctttttaaatcttttctttaaaccaacaagcacacttgactaggaagttatctttaagtatgcagggctcatgttttctaatactttgaaattgttctcatagttcttcataattttctcttgtttttcgcatataatcataaggtagaataaaaagttaaggttttatggctaagaggatctagctctgctagtaaatcatcttgctt

SEQ ID NO: 18911 - DNA, 648 bp, Homo sapiens
tatccagcaggtatctgttgatattcttgtccaccgttgtcttttctgccattccatttgttcctgtggatttaaacttttgtattcttttactgacacttaagtgggtttctaaggagtggaaataaacacgtgaatgtgtgtgtgtgtgtgttttcaatgtcctgcatctaagtggctataaattttgtaatttgattgataattacttctgagttttagcttatttcttaaggaatattgatccttaacacactgataaataaactcagtgtgggaatttataggccatgttttcatagcatttatttcagtgttggtaactcaaaaactgggttttcctttttaagttaaaccaataatatgtgaaaattagatgtgctaaccagggccagggttggtcttattcagttttgtgttgaccattcttctaggactttgtgcagacctttgcaaataaactttaaaacaaaacaaaaaccccgaaacccacaatgggttaatagagttaaagttttcttcttttcctcgataaacattttaatgatcacttacgaagtacaatgaactgctatatgagctgaatatatcatggtgaacggaacagagttcctagtgtggagggcttccctagtgagggagactaac

SEQ ID NO: 18912 - DNA, 605 bp, Homo sapiens
gtttatttctgggtgatataaatgtcctaaaattgattgtgaggatggtcgtacaactctgggaatatactaaaagtcattgaattgggaaaaaaaaccctagggatagaatctgaatgacctggtttgggctatatatctacccctagacccatcagctatggccagaaagatgtttagtgaatatgtctgcttccataaatatgtggacagaaggatgcaggggaggaaggggtaattttcaaaaagaagctgcctagatagataagtaacacatcagatgactcagagctaaatattctctctaacagcaagttagtagattagtacgatgaatatgaatactttatttaaacttaccttcccctcttttttatttagtccattgcagggtagctagaacttgttaaaaacattactggataatataagcaacattttaacttacagacaagttttgactcagtatcgtttttcttttgtctctgaaaagatatttttaaccaaaggctgttagtgaaaaggcaactgacgtttgctttatttgcctgtcctctcagaacacaaatactcctatgtgaaatgccacctggagacagtggcta

SEQ ID NO: 18913 - DNA, 538 bp, Homo sapiens
aggctatttcagaagtgcacttctgtttgggacatgggcattaagggattagattacttctgccatctttactggtgctatctgaaatgatactgaaaaatgccgatgccaaaggtcacaatatctaatatgatgagttgttgttaaatttatatgtggtttatatcttttaaccacagtaagcatgttctacttcagagtttatagcttaaatttgtacctaggtaacactgttttatccctttttttggtttgatttctctctaataattgatcttaaagaatagaataaacagaagagactctggccccaagcagtcaagttataggtggattttattcagtaaaatcaaggcaaaataaagacctattgattcctgggacattttgtcattttatctttcctgagttagacatcctgaccaccctaatagccaaatgaaatggatagcagcagcttgaagtcatttataattttaacctgacaaggttctgttgaaaaagattactacaggcatatgcaatcaatgagttgcat

SEQ ID NO: 18914 - DNA, 595 bp, Homo sapiens
gccatttagcatctatcactagctgagtgacttttaacaagttctttagccttcctgtggctttatttcttttgctgtaaaaggttccacttgtgagatgatgcatataagacatgtaatacaatgcctagcacacagtaagaactcaatagacttaaattttaagtaaattaagccccataccagatgtgtgaaatacaaagaaatcatgactacattctatactgaatatagagaaaacttaaagcaataagatttttttgtaggtttaatggagagttatcaatagtattgctttctactttatatgaaaaataatacatgttgaaactcctgcaatcttcggttgaagtaagataaatatgacataaaggaagatcagctggctgctgacgtggcacctcatgaggtggaaatttattagtggggtcactgggctctggttttgtaagtgaagaaatttgattttatgcagatcagaataattcagattgtctagaatagattcacactgaatagcatgacaagggtggatatgtaaatcaaatgccaatgtgttaatttgcctttctcaagtactgaaatacttgaactc

SEQ ID NO: 18915 - DNA, 604 bp, Homo sapiens
tgactaggctaaaaatgaacaaatcttaattaacttaaatatttctaacaccttgggcattcaggaaaacagctccatttatgttgtgaagtaatgggaagcatatggcagtggataaactttgaatgaaaatattaaacaaggccttaggagaaaagtgtaatatgcttattatagatacattaatttaaaaaattctctggcttaatatcattatactcaaattagactttgatttaaacataggtcctaaatttggattaaatataatagattgaccacaaatttatttcgtctccctctggaagcctcattagtcataaaataaaggttacacccatgaccagcacagaaggttgacagagataatttttagtaaatgctgagacataaaaagtagacaaaggagtggtaaataacacagaaacacaactttgctgactacagaaagtgactggaacagaagcgagccagtttgtcttgcagaactaaggcaggttgtgaacttacaggcaaatggcactttggaaagtagggtaaaatgtaaaaaaaaaaagccagcaaggtcagttgcaaatctctaactagagcccaaagtctacct

SEQ ID NO: 18916 - DNA, 631 bp, Homo sapiens
agtctacttgagtaactttatgaccttacatttgaatgtctgtgtattcgtccattctcacgctgctaaaaaaagacatacctaagactgggtaatttataaatgaaagaggtttaatggactcacagtttcacatggctgcggaggcctcaaaatcatggcagaaggcaaagaaagagcaaagggtcatctcacgtggcaggggaactcccctttataaccatcaaatctcatgagacttcactatcaggagaacagcccaggaaaaacccaccccattattcaatgacctcccattggatcccttccatgacacgtgagaattatgggagctacaactcgagatttgggtggggacacagccaaaccatatcaatctgcatgtaaaggggtatgatttctgctctcttttaaattaggccagatgacacgtgtagctttgattatgtagtgaaacatgtaatctccttgcttgagtcacacgggcagagcctgacaccacatcaaaaggccctgagtacagatgaagtacaaggaggaccgaatggaagaatgcctcttgtcattattcgagtgcacgatcccttgctcgcctctcaacattcatctctctttacgtcttatataaacc

SEQ ID NO: 18917 - DNA, 555 bp, Homo sapiens
catctacttgtgcagccactgacaactattagaacacagaactaaatagtggtcggcgctataaagtgaaaaatactttgtagatttaaaacattctgtaagtactcactaaactagaaaggacttgggaagcttctgttcaaaaccactacttttgacagaggaagaagctgagatttaaatgaaataatgggctgggtgcagtggctcatgcctgtaatcccagcactttgggaggcccaggtgggcagatcacttgagagctcatgagttcaatcctagcctgagcaacatggcaaaaccccatctttactaaaaatacaaaaatgagctgggtgtggtgtcgcatacctgtagtcccggctactggggaggctgaggcagaagaatcacttgaacctgggaggcagaggttgcagtgagccgagatcatgccactgcacttcagcctgggcaagagagcaagactcagtttcaaaataaataaataaacaaaataaaaataaacaaataaatggaataatgtatgtagactgcttagcaccacacttggga

SEQ ID NO: 18918 - DNA, 496 bp, Homo sapiens
gaaatgtagggaaggcagcaagatccaccaccaccaccaggatgtgccgcgaatcttcctcctagctttcaaaaggaatctcagccatttatcatcgtgacagtgcaatggggaaatgaaaacacccaaacctttagggtaacatacaagacatcattgcgatctacaagtcagggtggagcttatggggcttagaacataaatgacgtggccgggcacagtggttcatgccggcaatcctagcactttgtggggccaaggcaggtggattacttgaggtcagaagtttgagaccagcctgaccaacaaggtaaaaacctggctctactaaagatacgaaaattagccaggcatggtggcaggcgcctgtagtcccacctactcgagaggttgagacaggagaatcgcttgaacccgggaggcgggaggcggaggttgcagtgagccaagatcgtgccactattccagcctgggcgacagagcaagactccatctc

SEQ ID NO: 18919 - DNA, 547 bp, Homo sapiens
gtgagaccctgtctcagagaaaaaacgtaagtataaatcacttgacaaatttccagtttttataggcattattgttcaggccaagattgagcaaaacagagaaaaaaactaagtctatttaaatttgatttaaggtggatgaatgacttagaaattgagaaaacagaactaaagctttctcccctgctttgactcctgttcctacgacaaattgctcactgatcccccatatcccactaattaaaatgctgactacacaagcaaatcacattcattaaagaaatattagaaaatacaggtaagaatcaaagaatgaaattcactacaacccgtcacccaaagatgactattcaaatactaggatacatcatataaaataatcatgctctatatgatattttgaaccttatgctttttaaaattggtaattcacaaaaatttgatgttgataaatgtcataagtgccatttattgagtacttactatatgtgaggcatgttgcgaagtgctttgtacatgcgacattcattctcaacagcataactag

SEQ ID NO: 18920 - DNA, 229 bp, Homo sapiens
cgggcatgcgccaccatgcccagataatttttgtatttttaatagggaaggggttaacagtgttgcccaggatggtcccgatctcttgacctagtgatatgccagtcttatcttccctgagtgacatgagtgcgagtctgtcgattaaaacatggacttctttgtggggaccattattctgcctaccagaaggtctaataagtgtgaaatgcctataaagtgtccaagt

SEQ ID NO: 18921 - DNA, 627 bp, Homo sapiens
gtctcctttcatatctttgcttatagttcattatctgcctggcattatctttccttatttttaactgctgactgtacttcaaagcctactaccaacttaaagtttttgtagaatttcccattcaagatggattttacattactttgttctcttgctacattataaaattagcatatcctaccttcattacttttgcacataaatctatttataagccaccagagggcagggatagtcttgctctcctctttatttcttagcacagagcttgcacaggaagagactgaaatgtttgctgaattgtattctgcatatttgtgtatgcatatatatttagacccatttcatttgatatgtggttcatttgggggtgggaaaattactagaatctacaataaagggaagttcattgacagttacactcaaggtataacggaaagagtggactggatatttatgttcttctagctttgctacttattgattgttgccatgggtaagacataatatctctgagcaagtggctgctgtatctataggcggcaagtctatattccaggcaggaggaaggtgacagaacaaaagcaaaggtgaagacaggaagggcaaagggctttctcaactttc

SEQ ID NO: 18922 - DNA, 533 bp, Homo sapiens
gacgaccgaaggggcagagagagcttccccaggcccaggtctcaggccaactttgatgggtattatcttcccactgctatctttctgacacactcaaaaatgcctcatgctcatacattaggacattctagccagccttctcatgttttatccacatctcccacatctaagcctgcactcaccagcaatagcccatagtgtgggaaaaggcgcacacagtatttggggacgagttcaaaaacacatgggttggaaactcaggagctgtggaccctgtagcatggtttagaagggtacacgtaggctgggtgagcagatctctttggacccaggacccctcaccaatggggaaggtaacccaaataaatgccaaaatggaatgggggagggggaccctcaactatgatctaagagtactaagtcaaaataaactttagaggatatacacccaagttacatatacatcaaagtataatttcacaatgtttgtgtatgtcagtaatagaacctagtcataaaatgattctacagga

SEQ ID NO: 18923 - DNA, 588 bp, Homo sapiens
gagactctgcattttagcaagccttgcagatgattccaatgcacactacagtctgagagcacatgggctattatgaaccaacctatggttcaaatccctggaaaggcagataacccctctgctgtcacctgctgccgtgtcatactggtctgcccacagttctctgaggttgcccacagtgaattcgttcttgctcttccccttccctgaatgcccttccccattttgtcactttgagaatcttttaaatgtctgctcaaaatttatgtcttctttggcacttttcctagccccgttaggcagagcttataggcacttatttatagcctcctctttaaaaataataattatgatgaagataatgacaactaaaatatattgagtatattcattgtgctaattactgtatgcattatcttatttatttcttgccatgatgatgtgaggtgggcattaatcttgtgtcataagagagtaaattccccatgctccatagctgtttggtggagaaaccaggatttgaaaataaccagttgtttcagaaatgatttaataaagctcataacataaaatccaacatgatgatat

SEQ ID NO: 18924 - DNA, 668 bp, Homo sapiens
gtgtttagctgggttaggggcatcgaccatcaaggccgagttagccaggcacaaccacagagacacatccaagcctaagtccccgggttagtggcggccacgcgtgcacacacagctccttccacagggccctgccagggcaggcactgctggcggtgtgctcaccccctgcctcgcccgtgggctcagactctctgccctatatctcctctcagctcaacggggcatatggctgcttcgtcgtcctcctcacatgacctgcggagaattattcatagtttaaggtgctccctggctgactgttcccaccccttctgctttaccttccagcaacccagcatcttacaccacagaggaaacagctgagggggtcgttctactctgttaggggagagcattttctcttttgctggcagcagtgaaaggcctgaaatcaggccaaacagaccaactcacaccagacaagtcctccccatagatggtgctccaaagagaaatggaccatgctgggcacatggctcaattttggagtcttctcattttggtcattaccgtttggctgtgctgcatggttcctggggcctattccagaggcacaaggggttccacagggctcagtaactccatccataaataaaagaactctgtgctctactgacaaacttggg

SEQ ID NO: 18925 - DNA, 542 bp, Homo sapiens
cttacaaaaaatatttatctaaaaataagtgtccttttagtccatattgtgtccatttaacaaactaaatgttagaccttgaaaaagttctactctttttctcattgaggatgccacttttgttcatctgtgtgactcagttaatacatgattttgcacaataatatcctaattgacctgtaggcatttattatccaaaacatgtttgagttaacttgccataaactgttgcttacttaataaagaaattattgaatttttggcctggcacagtggctcacgcctgtaatcctggcactttgggaggccaaggcaggcagatcacctgaggtcaggagttcgagaccagcctggccaacatggtgaaatcctgtctttactaaaaaaatacaaaaactagctgggcatggtggcacaagcctgtaatcccagctgcccaggaggccgaggcaggagaattgctggaacccggcaggcagaggctgcagtgagacgagatcatgccactgcactccagcgtgggagacagagcgaacctccgt

SEQ ID NO: 18926 - DNA, 602 bp, Homo sapiens
tcccctattggcatcagggagccataaatagcccagccgccccagttgaatcaccagagctcgcactgtgtcagcgtttctgtataaaccggagcttgctaggggattagctcacagccataaaaaatttgctccaggctgaaacttggcctaaggaaaatctcagcccgagagtagactctgaaaagaaagccaggcgacaccacccccgagcctcctgaggacgagggtgccggtgaccaggacctcttacactgggctttgtggtcaccagcacagaagtagtcagcgatttcgtgcaccagttggggttgtcataattcaaaatttgggttgtttttatttttcaagctaaaagaaggggcattttctgctatgagaactttgaatagatctgactttgaaaatgtgtaatccaaaccctccccttttccctctgacagttaaatatcaagcaaaaagagatttgcctcagcagggagccagtgcccgtgttgttgcctgggacactgttgggacagtgggtgctgcctcccaccccaaagttttgtaagcaaggcctgggaacccaatagatcagaagggtagaataactccatata

SEQ ID NO: 18927 - DNA, 633 bp, Homo sapiens
tggcatttattttaatttgaaaggagaccctaacttctctcctaaccacccagaaactccactagggtccagggagacatccctaaaatgtcaccatctgggcctttcccacatgatcatattgaaagtttgggagagagtaaaagaatgaagaggaagaaagcaaaggaaaacccactgggagctacatttccctcccaaaacaacaacaaaaacctagtgcctggtacacagtaggttttccattaataatcttaaatggaggaataaatgatagagttaatgaaccagcaaacaaataaatgaagaactgccccataatttctccattcactcacaaggaagaaaataaataaaagctaactttggcagggcacctctgagaagtcaccaactataacagcaaactccctgcctaatccttcttactggaattgtagcactaagaatagccagtttgctttttactgactgggttcttacctgccttctttctggaatgtggtccaaaaaagggaagaattggatcttgatcatgatgaagggcacaggctatgaagtctatcatatttggattttagacccagttctgctaacatctatttgtaattgggcaaaagacttaatctcaac

SEQ ID NO: 18928 - DNA, 558 bp, Homo sapiens
ccttctgagactctaaccatgcctgatggtctgagatggaacagtttatcccgaaaccatcccccaactttggtccgtggaaaaattgacttccacaaaactggtccctcgtgccaaaaaggttggggaccactgctttatataatgtgtcttgctggcaaagagtaaagaggagcccaggcaggggggaagctctagacatataaacaaaggctttcttgctacatttttccttggagaatacagacacctgcctgattataattataggctcagttccctggcaggctgctaatccaaactgtttattctgaacatagtcctaaaattgcccagaccataacaaatatgtgaatactaggtgatttgctgagtagcccaacagtccaacttttttttttaaccatttcctacaattacggcccccctcaaaggtagatgaacagcttattcctgcattttgaaccaagtgaacctttcaagactgtcttctaaagcacaggattgcaacactcctgccctaaaagcaagctttgtgtttgacactaataatggctt

SEQ ID NO: 18929 - DNA, 517 bp, Homo sapiens
tagtgtatctccaaagtctagtttggtgcccggtacaaacattctttccccaaggtggagtccacttgaccagagtggagagttacagtgctggggaagagttggaagacatctctgcctgggggtggggggaagggcagagaaatctcttggggtttgttctggggaaactgggaattgtgggagaactgaggaggcgggaaaggggactttaagaatattattgtgggccaggcgtggtggctcacgcctgtaatcccagcactttagaggctgaggcgggcagatcacgaggtcagtagatcgagaccatcctggctaacacagtgaaaccccgtctctactaaaaatacaaaaaagtagccggccatggtggcggatgcctgtagtcccagctactcgggaggctgaggcaggagaatggcgtgaacctgggaggcggagcttgcagtgagctgaggtcgcaccactgcactccagcccgggcgacagcgagactctgtctcaaaaaaaaaaa

SEQ ID NO: 18930 - DNA, 594 bp, Homo sapiens
agtacagatcattagtaggacttatcaaagaaaaaaaagacattgaacagaatgagaagcgtggcttaaggttgacagatgttgaggatgaaagccgttaatatgattgtttagatggtcaatatgaactctagaaatgaaagaaactgaggatgaaaattattttccaaacatcacaatttttaccaatggaagaaatcctattaatgtaacattgtctcacaagtggtatttgaattgtgactttgaacacatatagatggaaaggtaattggtattcattctcgaatatgttcacaacaataatactgcaaatgttgtttattggcttcaattgtgagtcattgttcaggtcaaggaaaggcaatgttatgcttaaaggatggaatgaaagaaagaactacaaaaatataaaagtataactgatacaaaataaaatatggagaaaatttggtagagagagaagaggatttatattacataaggttaaaagtgaatcaaaagatgataaaatgattatagtttaatcattgttgtttatcttacaataattgatagaaaaaaactaaaacaattgtcaaacacagagataga

SEQ ID NO: 18931 - DNA, 477 bp, Homo sapiens
gatagatggatggaaaactatatttttttaaacctagctatggttataagggtatttggtttattttatatagtcttctatatctgttagattttacaataaaaagttttttttaaacactgagaaaaaaagagcaggttctctgatacaagacaaggatgctctcactcaccacttctattcaacatcgtgttggaagtctaagctagagcaatcagacaagagaaagaaataaagcacatccaaataggaagagaggaagtcaaactatccctgttagtagatgacatgatgctatatctagaaaactccatagtcttcagctgataaacaatttcaccaaagtttcatgacacaaaatcaatgtagtaaaatcactagcattcttatacaccaacaacagccaaactgagaactaattcaggaaggcaattccattcacaactgacaactgtaaaaaaaaaaaaaaaaaaaaaa

SEQ ID NO: 18932 - DNA, 558 bp, Homo sapiens
tctattcttttggttgttgaaaatactaaattttctccaggtcacaaacttcaaaatccatgctttctgaaccaattgtcaagatatgaccagcttcaaaaagtattagtgtgaaccactgaagagccttagctgtactaattattagacgtgcttggctaaagtagaatgctttttctcatttgaaatatttgtcccaaatgtctcaacttaatggtaagtaatccaagaacaagatgatacaccaaccctttctgtcagtaagttaaccagtaaggcatcaattatttctcttaatgagggtctgatatttaaagctatggctatataatattttgtttttcaaagatcccaggaaatatagagtgtttatattaaaccacacacatatactcataaaaggcaaatgcgcatacacaaaaggtgtaaatgatcacatttatacatatacattcacatatataactcagttatcagctaagccttatttaaattgagcccccaattatatagcttgtgaattgtattccccccaattgttaccccccaatcatagcc

SEQ ID NO: 18933 - DNA, 562 bp, Homo sapiens
tcatatctccctactgacctccacttttttctaactttgtcaccaaagaagtcacagaaataaataggaggattcaaaaagaataatttcagtacatttaaaaaattgtagaatataggattctcatctatgtttatcacgttcattcatttttcaaattttcactgtggcaccattttatgacaggcactatgctggggatgctggcgactagggtagggagttaaaatgagagtgtctacttggaaagatgaacagataaataatcaccgtgataagtgctgtgctagagatatgcagatgtcaaaagaccttagaaggtctacaatccacttggagggtagggaatatagaaggcatttcagtgaaatacggtgcctttgacaaatcattaagaatgagttctacattaaaaaggggaagagagggtgatagctgaggaggcagcataggcaagaacatccagcatgaaagaacagtgaaggacatcaggaacatctttcaggaacatcaggtaaaacagacttagggcccaagtcaaaggagctaaaataatacaccc

SEQ ID NO: 18934 - DNA, 262 bp, Homo sapiens
attgcgaagaaagaatatgatattcgtaagagctcagtgctaatattagcattggttatggtagtgaaagaccagataaatcttttagttgggaagtatgtcttgaggtatacttccttataatcattaagtaaataagtaaaactatattacatagataatgtgtaactctctgtattacatagaatgtctgcagaatgtagataggaaaaataaagtttgtcaataattttcaacatctttattgagatacagttaatct

SEQ ID NO: 18935 - DNA, 580 bp, Homo sapiens
tgtaaaacagacatttaagcaaagcactttcatagtatcattatcagaggcatatatctttgggcaagccacttccccacggcctcagttttctcatcttcaaaatgagaagactggaagagtccgtgtaagctacatggttcctcttccagttctttagtctaagtctacgaaaactgtacttcgagcaaaatctgtggctatactacatgcacaatctacaaaataaccaaaatccaacatcaatgcccagaggaggttctctaaacaagcaactctccatcccacaagtacaaattcctacaaaggccaacaggaaaggaaaggaaacaaacagcagaacaaacaggagaactaaatgcaaagggaagctgaacgggaaattactggaaataaagagcacagattcaggatatatgaaaaaaagcaaagcagaaatggaagaataagagaaccagagtataatcaaattgccttaaccacaactgaatttcactcagatcctgtgcacaaacatctgctaacttcatggccaccaaggacatacagaaaatgtaacacagcctttactaaaggccac

SEQ ID NO: 18936 - DNA, 574 bp, Homo sapiens
atacagtcacacagagctgcaagggagtctaggaaaaacagtctcaaaaagtagaggtggacagcttctcagggatctcccaagttctgatgactctctcaactctgcttctctctgggttccagactagattctctcagaaaaagtcttggaatataggatggaaaaaaaatccagctgcagcacctatagattcacagtctgagcttctcccaccaccctctcagtctttgctgatcaaattcaggagaaggttaactagcctgtcttgaacagtatgtctatctctgggataatctctgcacctgagaaaggctggcttctcagagcagatgattttgttgttgttgttgttaaactttaaaagatgaatcagatgttacaatgactcagggctgggcaggcaaagtcagagaactaggaaattgacgatggagtcagagattgaggtgctgggtgttatgtgatgaagtacagacagagaggccacatctttccatgagtgaatttatgaaagatctcagacacttaggtaaggatcctgaactattctctgcagttgatgagaagccac

SEQ ID NO: 18937 - DNA, 594 bp, Homo sapiens
ttgttaacagatacttttttacatggggcaggttttggctagagctacttttattataaaaacacaagattttcaaggaagaaacctaatgccctcattttatgttatgaattttagaaagaaataacaattaagcatcagtcaattaccttcacttaggagaggagaaagaaagcatagccctcagacagactggggaggcaggagagaattatgcaaaacaggaggtttactaaggtcctatagatacatgcctgggttcttccaaaaataccttcacccactctcagatattgggcttaggattctaaagtattgagctcagttcttgtggcaacaggacgtaagattctaaacagtcttggtttgaaatggaataagattatgtggaattgctttaacaaggcatgtgaacaagttgttcttcactgccaaccctttccctccacttttgcttcctaagatgtaaagccgtggtttcctgaaatgattttttgcataggtgtgcctaaatattgtggaacacaacagcatttgctcgttattaaatgtgtcagattcactatcttctactgtttattttcaatgctacat

SEQ ID NO: 18938 - DNA, 532 bp, Homo sapiens
aaatatcaaaacacacaagaaaaactccaggattgtcagtgttttatgagtttaaaggtaacactgaccaaaatgtttgaaagccactaaactacttttttccttgaagcaaaagcaattacagtttttatttctgtcactgttattcctagtgtagttgcaaccacttatgttaattatatcttttaatcatagtaacttctatttcataaaggaaattgggagcagggagatgggaaactgggagatgtcatacacaagcattgtctactgttttcagttacctgaagattttggaaattatcttcaagatgatgtttttcaaaacataaatactgttgaataaatgactaaatttagttgaacacagatttccgttttcatatctatacattaggaaaaacaaacccaagtagagtaagtgtattaagctttacactgataatagggagaagatgttttggttttttttaaactaaaggtattagtctcatttaccaaagttttcacttaattatgtaaacttggattc

SEQ ID NO: 18939 - DNA, 586 bp, Homo sapiens
atatgactataaaatctatcttcatctgtagggaaggtaatgaattagcataaatgccttcataatccagtctctctccctcccctcttttctaataaaaatgcagagagaacactgtgaagctcaagctgcctctaaagaaagtagagatttacagaacataacctcacaagatttgttgatgaattatgaaggaaggacatttattttgagaatcatgagcattataatatttattgaggattagaattttgttatgtggaggtgctactacctcctcatgagccacttctgcactcaatctcagtaagaagaaaatgattaatttgtaaaatattaaattatcatgattttttcacttttctgtcggttttttctgttgatgtcaggtagcttatctttagtctttatgattaaaaaatgggagaaagatatcatattaaaaatgcagaggctgggcacggtgactcacacgtgtaatcccagctttgggaggccgaggtgggcagatcacctgaggtcaggagttcaagaccagcctggccaacacagcctaacaccatctctactaaaaatacaaaaatta

SEQ ID NO: 18940 - DNA, 622 bp, Homo sapiens
aagacgtctcttctaaggctcatgggccatggaccctcaggcaccagacgggaatcagagacgctctattcagaatgaagcacacctgctttttcatggtgtctccctgcacacatgtctcggcatctcggaggagagagatgctgcgcatgctggagaggtggagaaatgctccgtcctctcacctgaacctttgctctgcctcagatgctcttgatttgtatcaaagagcaaccttgagattggggcacaaaatatttgcaaatctcatatacgtgcaaggactgctcatactcagaatacacagagttgtcaaaactccaatgggacaaacaaatgattctgttcaaaacccagccagagacttgagcagacatttcctcaaaggggatgtaaagaaccacttcaaaaagcgttcactgtccctcccctggggaaatgcacgtcaaatacaccttcaacaacaaccaagaagctctcccagaagccaccgtgacaatcactcaccatcccaagggctgcggagcatgtggagaagctggaacactctgacagtgctgcttggaatccaactgggacaacccccagggagaaagagtttcattgattcataatcaatgca

SEQ ID NO: 18941 - DNA, 624 bp, Homo sapiens
agagtctctcagtatagttccttagcaccagttcccatagcaacaaacaccattcctaatggccagcagttcaaatacaggcttctccacatctgatccatttgagtctgaccataattcagcagcttagtctgttggctcagtggattaatttactaaacactctccctctgggtgtctctctccaggaggcaaatggcttcaaaggcacactgtctcctcatgttcagcttgaaaacttcctgcctagttctagttcccattctctatcaaaagccctgactaggcatacagtcatcatattaaatataccccacacatgactttcccctcctattagatggaattagaatgctagaactcctatgcaatgaccagaattttggcagcatactgtgtcttctaaacaagacaggttaaaatggcattactacaaatatccaaagaatacataaaatgctccccaaatcagaaatactcttcaaaattataatagtgataaaactaaatgctatttctttataaaatctgaattacatactaaaacataagaataaccaccagtttttatagccaaccaccaaatttatgtcaaaggcatacctgtagggacacccatctttc

SEQ ID NO: 18942 - DNA, 426 bp, Homo sapiens
tgctttcaataatcaagattattcatcaaatttaaaaggtaatcactgagctatctatttctcagaggtgagaccattaaggaaaagaggacattacagtaatagagaatgtatggcaccttccactcacgtatcaatgcaatcagggtatatgcagcctttatcctggttcagacaatgtgatagaaaacagaaacaaataaacctaggcatagcttctgtcctcaagtaacaaactgtccagtagacagactgaaatagtaagaaaaatcttaaaactgtgaaaactaacttaatggttcaaaaataagaaataactaattaccttaaatttcagagaaagtttgaatgtatttttaacttaaaaatatgtgaataaggcttgggcgtggtggctgacacctgtaattccagacctttgggagg

SEQ ID NO: 18943 - DNA, 539 bp, Homo sapiens
aactgtaaggtggtatatacacacaacatagtagtatttagccttaaaatggaaagaaaattgtacacgtgctacagagtagaaccttggagatgttatgctaagttagatcagtcacaaaagcagaaatattgtatgattaaatttatgtgagacactaagaatagtcaaattgataaagacagaaagtagaagggtagttgccagaggttgagagggaggaaggaatgaggaattactgcgtaatggatacagagtttcagttaggaaggatgaaaaaagtttctggaggtagatggtggtgatggctgcacaacaatgtgaattttttatttgatatatattttaccatatttttaaaaactctattacaaaaaaaagaattggtctagcctagataatcttagtagccatgttttattgctattcaacttgtcactcatcaatttatataaactcaccagccttttaccacttagctgtctatactccacatcagttcttctctcagtgtttcttccagttcactgcaatttgag

SEQ ID NO: 18944 - DNA, 515 bp, Homo sapiens
atcccaaaaacagagcatcatcaagagtttaatgtgattcttttgaacataatgttacttcctaaaatagaagaaggaagcttaagtacgtaagcatgctcttatcttcctttcttaaggatgaagtgatcttccacctgccccatccaactgtatgcttgatttgtggtaggtggtgcatattagtgattgaggtatgaacatcagcgtcatgacaatctaggtttaaatacaaacgttgatatcccacagctgtgtgaacttggacccgttaacctttctaagcatcactttctcatctgacagttgagaatagtatcttccctctaaaactgcctatagatagaattccataaatgagagataacaccattttaatagtcacaggcatcaccattattgtcagcatcatctgattccctccaacacttacaaaactgttttcttatcacttttctctaagtcaactattttctcatcatatcttgctctttggttactttctgtctaaaccc

SEQ ID NO: 18945 - DNA, 591 bp, Homo sapiens
ccatgcctgttgtcccttgtaaagtctttgcataaaaccagttggaagaccattgttctctacttcatttaggtgatttgtgttttcttttatattgtccaagatccctttacttgtctgtaatatttcatcttcactgttgagacttcagcaggtacagacagttaggtgattgggatgtatttacagtttgatcacttaacctccttgggccttggtttcttaatctatataatataattctctcatgttacttttgttccaatattttatttttctaataccattctatgggctagcaagattccattatgtgttgactctcccaatttctattattcataccacagattaagttcaaaatctttgagaggaagtaagctggagtatttgaaattaaatgtttctctttcttgggggtcaggatactctataagtcttcagctaatcagaaaatagtagcttctggccagatgcagtggctccctgtaatcccagcactttgggaggctgaggcaggtggatcacctgaggtcgggagttcgagaccagcctggccaacatggtgaagccctgtctctactgaaaata

SEQ ID NO: 18946 - DNA, 158 bp, Homo sapiens
tgccgcgttgatagcacgtaacgctgctttgacagaatgtactgctgagttagttctttaagtttttaggtcacaaaattaagttagctttattttaataattaaatacatataaacacaatatgtcagtaacttggctgcagtctaataaatcctca

SEQ ID NO: 18947 - DNA, 558 bp, Homo sapiens
gaggagcctcctaggagatctttgacttgaccaggacaaaatcaggttttgccatattaggatagaggggatgagagaaacaacattgcacatagtttggataatgacgtgggtttgtaagacaactcttcaaacggtgtaaatgacaggagcacaggggccaggctggtatcagagaggggaacaaggaccagttcttagatggatttgtgtatcatttaaggaatttgaatttcacatagattggggatcccttgaagggtactcagaaggagttatattatcaggcagaaacatcactctggcggcagcatgagggatgggttgaaaaatttaaaacttgaagcggcaagtccattcaggcgactactgcaatagtcttggcatgaaatgacacattaaggcaagattgcccagggctttaacattgatattattttaaaaataaattgcctgtgctagtaatgtcctgtttctttgcttactggttgaagactcaatttttatagataatgcggaatagatttatacagccagtttagctgcaaagattaattt

SEQ ID NO: 18948 - DNA, 471 bp, Homo sapiens
aatctgcattttaacaagtgtgttatgtgattttgttgcaaatagaataacactggcctagaaatttcagactttaagcaaaattcagaagattcttaaaaaaaaaaaccaaaacagtattggatttgtttttctcaccacagaaataagaagaaaaattggtagttttatttgggaacaagaccaacattttctgatagaaaaggtaagagtaaattaaggtacttgattagcatctacagcttcaacattttctgaaagcatagcaccaatgagtcagattaagagattgatttatttattttgagacggagtctcactctgtctcccaggctggagtgtagcaacgcgatctcggctcactgcaacctttgccttctgggttcaagcgattctcctgcctcagcctcccaagtagctgggattatggggcgtgtgccaccacgcccggctaatttttttatttttagt

SEQ ID NO: 18949 - DNA, 550 bp, Homo sapiens
catgaccatcttaccaattgaggagttatgaacccctgggtaatcaattgggtcaaggtggctccaaataccaaaagacattgataggatactgagaaatgtaaaatatccatcattagaacttaagagctaagtatatccaggcctcacttaaaaacaatacagatgtgttttaatgcaacatgtttttttcctgactattgattcttggaaaataaagtttcttcccaaacacctgcatcagctccagactgattaatatgatggtcctctcaggaggtgggaatgggtattggtttaaggatgattagtccctatttcatataagccatactgatcagataaattgttggcaatagatccctctcatataattgcattaatagaaagcacatggaagagagccatttcaaggtccaacagctctgtgaggtagatatgattcttaatcctacctttcaggtaagaaaaccaagatttaagagagattggctaacttgacaagataatcttcatttcttatcttccttcattccttcctcctttctct

SEQ ID NO: 18950 - DNA, 471 bp, Homo sapiens
tcagtggcaatcttggtattggaaaaagcaactcagtttctagttcccctcatcctcaaattgaagggagcagaacataccttatttgcaaattactgggcatatctgttctaacctggttggaggttatttgaagaactgatgcgctagtctctgtctggcataatttggaatacaggcaaagaaagaggtcctcataaaagctataaggaactacaaacccacacatgcttgggataggagatcacacataatagaccatctaaggcccagagaggaagctggggtaagactctgggaaattaggacattgaatagtaactgcttacatacacacgggactttagagagtcacaagtgcatgtccagccaagactcatgctcagaaatgtcctgagaagaccttaagctttcacctcaaggtgagacctaggatcaaagcaagcctagctaaccggtgaatggctaccc

SEQ ID NO: 18951 - DNA, 601 bp, Homo sapiens
tactacaggtattctcaatttttattactaattttcttggaagcccctagtcccactttgacttgaggtaaggaaagccatagaacttcctaagtaacttcttgaaatttcttaggttgcagttgttgtcattattattattgtataggttggaaaggtggggatggggaaagcagcaacaggatgaaagttatttgctcacattattctgggtaacaatccccaaatctcaatgaacaaaggtttagttctcactcacattacttattcacattgactgtaggtcaattgtaggcctgttccacaacttctttcttttaggacctagactgggctcacccttatctgagagatcccagcctcatgacagagagaaaagaagcatgatggaaccacattatggctcttaaaattctgttcagatgtggcatataacacttgtactcacattctattggctaaagctagtcacatggccaagcctgacatcactggagcaggaagtatactcacctcaaagggaggttaaatgggctagatacagagaagcagtgaatattttgaacaaataatatgagctatcacagtcacataataaatt

SEQ ID NO: 18952 - DNA, 603 bp, Homo sapiens
tgtttaaccaactgtttaaccaagtgtacttagtaaaacagttgggtttaccaagaaatacatttttgccaagtgaagctgatgatgtgtgtaaaagtgattaaaatggttgaccatggaatttaagctgagcaatgaaggaagaaagggcatcaatggagtgtgacacaatgtgcaacaggtacgatccattgactgtgagtcctagtgaggtcaaaggattattggaatctgggtaccagagggtgtgaggtggcaaaacaaagatgatagtcatagtaggtgattagatgagggaatgagactggggagtgattgcattacttataatagtctaggaaagacctaaactatgccaatgggaatgagtatctgagatggaaaggagttcaaggaaccaaaagccagggagttgaaaggatcacctgtgagtatgctgaaatgaccaagaatgaagacagaggtaatgtcacagtgagtgaaaaagaaatgagaggaatgatgagggggttgctagatgaagactaatatttttatgagtaaagtgaaataatattcttaaactcatttttcatattttaaaattgtatagcatttgtgaca

SEQ ID NO: 18953 - DNA, 575 bp, Homo sapiens
ataggcgcctgccaccacgcctgtctaatttttgtatttttattagagacagggtttcatcatgttggccaggctggtcttgaactcctgacctcaagtgatccactcacctcggcctcccaaggtgtgggattacagacaatgagccaccacgcctggccagcatttttgtaggatagatttatagcagtagaattgttgagccaaagggtatatacagttgcaattgtgacagatattgccaaattgtccttaatgatcacagagcttaataaagaaactataatagtaccagaagaaaatataagaatttttatttttttatttttttggaggggaacttttcctaagcctgacaaagactcaaatgccacagaggaacagattgataaaatatgtccccagaaaactttttcagtttctacatagcaaaattataaatacattcaaaacataagcaaaatggagaaacaatacatgacatgatgaaggcttaatcttcttaatatataaatatgtcttataaatcaataagaaaaaaatatgattgcccaacagaatgagcacttataaaa

SEQ ID NO: 18954 - DNA, 538 bp, Homo sapiens
gctctgctttctaaccacgattttttaaagaacaaaggacaaatatattcatcaaatatgggccgggcggggaggctcaagcctgtaatcccaacactttgggacgctgtggcgggcggatcgtgaggtcaggagttcaagaccagcctggccaatatgatgaaactccatctctaccaaaaatacaaaaattagctgggcatggtgaagggtgcttgtaatcctagctactcaggaggctaaggcagagaactgcttgaactagggaggcagagaactgcttgaaccagggaggcggaggttgcagtgagccaagatcatgccactgcactccagcctgagcgacagagcaagacaccctctcgagaggaaaaagaagcaaacaacaaattcatcaaaggtaacaaataaaacatatactttggatttttccgtgtacttagcttttcttagagcatcttttagaattattgtttcacaaaaaacacttcgggaaacgttttaatttattaacaaatactggagggctagaaagaag

SEQ ID NO: 18955 - DNA, 519 bp, Homo sapiens
aaattctgaggggaatgaaggtggagaatagaccaatgtggggtacaaataaactactaaataatgacataaaaagaaaaaaagtaaatacgtttgtgtgtgcatacatgtatatgtatatacattgtatatatatttcaaacataaatgacactgcatttaaagaaattctatttttatttatgtaaattctttcttactataaaaactcccttagctttaggttaaaaccatatatgttgaaagtttcaaaaatatgtgagcctaaattattgatcattgttctccatacacacttcagaatttcttactgctatattttttgctggcactaggcctctaatctaacatagcccaacccaaatattctttatgatccaacttaaatgccatctcctccatgaaacttttttgattcttcaagtgttaagcacagggcctactgcagatggacactaaatgttattttccttacttccttcttcaactaaattataattgtattttactcatgttttc

SEQ ID NO: 18956 - DNA, 360 bp, Homo sapiens
gaattgtttaaaaccagagatgtgcctccactttaatcctgcagagaactccctgattgctttgtcttctgaattggtgtttattttcccaaaccctagccagccttttgtaatttgatcatcagggagaattctatttattgcaatatttggaaatatacttgtggatagcctcacattaggatgcagcaaccagcatgagggtccttttttcctcttcatttgcccagccaatatacttttgcttttggttagcaaaagtccttgtagaaattgtaaattacagaaagaaaacaaaatttgcccctaagcacagcacctagtaatagttattgttttttcttttttttttttgaaaag

SEQ ID NO: 18957 - DNA, 527 bp, Homo sapiens
actgctttacaagcacctacatatagcataacattaccaactcaccaagggtatctgcaccctaggcaccactgacactaccaccatgaccccagagctatagtcccttccatacgtgcctgtgcttcagacctaggctccatggccactctacaagcactactcatcagataccagtgcttccactactaggagcaagcccacaggctgcatccagtgtcagtgagtaactcactcagccacaacctcacagtaggagcaagagatcaagaagaacagtcctcactgctactgtaaacatccggaggttgatgagtgaagaccctgcactatacctgccatgcctcagacactggagccattgccatatgagctttgtcaacactaacctcagcttacagagttgcacaaagactgcatggaggtacatcttcactaataccagaactactgtacctcacccaacaagtggcttcatacaccccaccataggagaaggtctttctacagtgaaactagcccaaaat

SEQ ID NO: 18958 - DNA, 503 bp, Homo sapiens
caggtccctccctcaacatgggcattatgggatctacaattcaagatgagatttgggtagacacagccaaaccatataaaagggtaataatattatgtggtggaaacacatcggttgggagtcaacaagttcctttattggctttgcactaactggctggttggtcatgtcctttactgtctgtggacttcactttcctcttccataaagtagagatttatgttctttgagattacactctgagatgttattttgtttagctatgaaaagaataagagattccaggcccaaaagaaatcagtgtgattgcaattatttgcagatgtgtgtatgtctgtatgttcatttctcctagactgaactttttaaaaacatagataatgtgttattcatccttatattcccagtactggacacatattggatgttcagtgaatgttgaatgaacaaataaagaataaatacctctgtaactaatcagggaataggtataacacaaatta

SEQ ID NO: 18959 - DNA, 507 bp, Homo sapiens
ttacaggtaacaaaacaaccaaatcacattggcctaaactatgaggggctcaggtcaataaatagcttaggtgaggctttgtccagaaatcaagtgatggcaccaaggacttggtttctatttatctactttgttttctgaggtgttgcccttttcttcaggtcagcactgcttgtggccccaatatgccagcatctcccagggttgtacaggtccttgtacatgtcctgttggaaagagagagactggctgtgtcccagaattttcagccagtgtattaagattcactgtaattgggctgggcacagtggttcacgcctgtaatcctagcactttgggaggccgaggtgggtggatcacttgaggtcaggagttcgagaccatcctggccaacatggcaacaccctgtgtctactaaaaatacaaaaatgagctgggcgtggcagcaggcacctgtaatcccagctactcaggaggctgaagcaggataattgcttgaacctggga

SEQ ID NO: 18960 - DNA, 291 bp, Homo sapiens
cacacccagctaatttttgtattttagtagagacatagtttcaccatgttggccaggctggtctcaaactcctgacctcaggtgatccacctgcctcggcctcccaaagtgctgggattacgggcgttagccaccatccctggctactaggaatattttgattctatcttacatttaagaaagctccctcttacttcatgggagtgtaagcctttgagtctacaataatcagtttgcatacaacctcttcagaaatctgttctgagccgggcgcagtggctcatgcttgta

SEQ ID NO: 18961 - DNA, 480 bp, Homo sapiens
ggaggttgagataacagtgagctatgatcccactactgcactccagtctggggaacagagtaagaccttagagtaagaccttgtctcaaaaagagaaaaaaataaaaaattgtttcattcttttgtttttcttcagccaagtaaccttgaattggtaacactacagacagtaagtcttatctcaacaccagtagacaaatcagcagattcaaagtaggcagggaaaaaaaaaagataggcaaaagaactgagactttttcattttagggtttttaaaaatagtaacaatttgagttctgaattttctttcatgtaatttggccgtcaggtttaaagtgtgcactaaagaccaggtgcagtggctcattcatgtaatcccaacactacgggaggctgaggcaggtggatcacttgaggccaggagtttgagaccagcctggccaacgtgacaaaaccccatctctactgaaaatacaaaaa

SEQ ID NO: 18962 - DNA, 514 bp, Homo sapiens
cgggtacctgcacctctttgcctgagggcattttgggaccatgtgctttgcccagatgcaaaatggcagtccagaaagaggaaatggggaaattaatatccctgagaacccttaactgaggactaatgggacttggtgtacaaataccccagagtacttttcaaaatgcacactgaaatgtgttcttgggagaaaatcagtttgggaattcaggaatactggctgggcactgtggctcacgcctgtaatcccagcactttgggaggccaaggtgggcagatcacttgaggtcaggagttggagacctgcctggccaacatggtgaaaccctgtctctactaaaaatacaaaaattagctgggtgcagtggcaggcacctgtaatcccagctacttggaaggctcaagaacgagaatggcttgaacccaggaggcagaggttgcagtgagccaagatggtgccactgcactccctgggttaaaaatgagaagcctggtgacaaaatgagactttg

SEQ ID NO: 18963 - DNA, 591 bp, Homo sapiens
tgctgctaccaaaaacatgcacattttgggattcataatagttggatagtggagaggcttgcagatcgcagtgtacctatcatattccatgactatcagcagcaccatttcaactcctcccgtaacatggataaagaacttttgtatcatacaattatggaaggaaataactttacaatcagtaaaaagatcgtagatcaacctaggaactgtggtagatgaaaggctcaagtcaatgagcgataggttggccagcagaatatacatgtgggagtgtaagtgaggatcaaagatcactgtgaacacaatgaagaggtttcccaggataattcccacatagaataaagagaagaagagaaaaaggaaaaactgcatttccaaggattgtgcaagtccaagtaatacaaattctgttaccagagagtcatttacttggtccactgaatcagatagaagggaagtctgtgaagcaacctgaaagaaacgaaggaatcaacttagtgtgactgaaaataatgcgttaagtgctaatgatttaaaatttattattaacaaatcttttatttgatagtagattatttaaaaactagt

SEQ ID NO: 18964 - DNA, 514 bp, Homo sapiens
tctccaaagtcagtcttgttagatccctgaaaacagaatagggcaagtcctactgagcatgagccttttctcagatggaaattagccctcagagttcccaactcagaacttgcagcaagaaattacctctccagctccagccctgcttgcctttctctcctcctaaagccgaggaattgaaggggagtgagcttaacaggaatgaaggggaaggggcagggggctgtttggtcaagactttttcattaatttaaaaaaaggtggcccaagttcaatatcagtcccaaatggggtaagaggtacaggcataggatgaaatggttaaaaacatacccttttgttggccaggctggtcttgaactcctgatctcaggtgatccgcccgcctcagcctctcaaagtgctggaaccctgtctctaccaaaaatacaaaaatttagccaggcatggtggcatgtgcctataatcccagctatttgggaggctgaggcaggagaattgcttgattctggga

SEQ ID NO: 18965 - DNA, 252 bp, Homo sapiens
ctggcactgtccttctgatcgtctgaggtatttcggggggtattttctgcttctcggcgagagcgcgcgctgacacaggctaggtccaggccgccagcagccaggactcagggaagcgtgagcctgccagtgcgctgaggacagtattgctctccgcgcgacgcgtgggaagcccctggtttctagcggcctgtgcctgcctttcaatcaccattcccatacttaatatgaggtttttaaaatattttcctc

SEQ ID NO: 18966 - DNA, 358 bp, Homo sapiens
acacatgcgcatgcacacacacacgaacttacactgccaaaccaatgtttaactcctcaaagtagttatgttgaaaaataacatgtgccaataactctgtccagttaaaccacctgggtttgggtcactgctttgttgcttactagctatataaccttgggcacatttcttaacctctctctgccttaatttcctcatcagtaaactagaaatgatagagctgttgcatagactgagtgacttaatatatgaaaagtgtttagaactgtttcatcaggcacatagtaagcattcaataaatattagctttatatgacccatcttcttcatcagatttggctttgaggacagatgtgac

SEQ ID NO: 18967 - DNA, 473 bp, Homo sapiens
gaataatgagtgctgaagcccaaggaaagcatattgcatgccaggaaatacagtactgcagtatagtttaggcatagtctgtttataggaaactattaagggctgaaggactgagaaagggcttcagaatttattttgaaaaatttagaaattcatggaaagcagtaatcaggcaagaaggagaatcgatgtgtatttaagagagatcactctgtgaccactcactgtggagaatgtcctggaagtaggcatacctgaaattgagcattgtttgggattgaattccagcgtgcgggcccattcctgtcagtgctaccatagactttctgtatgaagtagtaaatgtggggtagaaagacctaggattggttcaagttctgccacgtgctaatcataggactttgagcacttttcttaatctcctaaggttcagtttcataatctggcatatggatttaataataatactcatc

SEQ ID NO: 18968 - DNA, 541 bp, Homo sapiens
gtagcattctccattctgcatctgagaacactttgcttagggcatttttttaaagcaaggattttgacaaagcagacaggagtcgttaggggagtgatcaaatttgaaatcttaaaatttaagaaactagtggaggaattggatagtacatgatttcaaaaacatgaaaactgaggacattaaatgtgcaagggttagaagtttgtcgcatgcaaaggggaaagtgaagatagcattttttcacatagtttcagagtccagttgctgaggttaatcaatgaaagttgtagcatcaaaggtttaacataaaacaacttcctaaaatcagccaggtgcagaggctcacgccggtaatcccagtgctttgggaggctgaggtgggcagatcacctgaggtcaggagttcgaaaccagcctggccaacatggtgaaactccgtctctactaaaaatacaaaaaattagctgggcatggtggcatgtgcctgtaatcccacctactcaggaggctgaggcaggagaatcacttgaacccgggaggc

SEQ ID NO: 18969 - DNA, 573 bp, Homo sapiens
atatttcacaaaaataataatcaattctgattgggtaggctttatcctgtgatgatgaggacaaagcactgaataattttataatcttgagtactgcctactgactttaagataagtgaattaagtcagacacagatagaaaatgatgcattgacctcacttctgtgtggaatctaaaaaaagtcatatagactggatgtaggctattggtattttttttcaagcaaacaaaacattaaaacacattctaaggctgcacgcagtggctcacacctgtaatcccagcactttgggaggctaacgtgggtaggtcacctgaggtcaggcattcaagaccagtctggccaacatggcgaaaccctgtctctactaaaaatacaaaaattagctgggtatggtggcacccacctgtaatctcagctactcaggaggctgaggcaggagaatcgcttgaacctgggaggcggtggttgcagtgagctgagatcgtgccattgcactccagcctgggcaacatggtaagaccccatctctacaaagaatatgaaaattagccaggcatggtggtgcatg

SEQ ID NO: 18970 - DNA, 359 bp, Homo sapiens
aggatatttttgctgactgcataattttaatgttctgtaccagagacacatggtcccttggctagaattatgcataactttgattgttttgagcacacaactgtgaggtcagtgacaacaataatgacaaataatattcaagtaacctcttgctgttaatactgggttttgtggccaggcacagtgcctcacgccttgtaatcccaacacttcatgaagccgaagtgggcagatcacctgaggtcatgagttcgagaccagcctggccaacagagtgaaaccccatctctactaaaaatacaaaataattagccaggcatggtggcacacatctctaatcctagctactcgggaggctg

SEQ ID NO: 18971 - DNA, 614 bp, Homo sapiens
tgatcttggttcactgtaacccccgcctcctgggttcaagcgattctcctgcctcagcctcccaagtagctgggattgcaggcacatgccaccaccccctgctaattttttgtatctttggtagagacggggcttcaccatgttggccaggctggtctcgaactcctgacctcatgatctgcctgcgtcgaagtttttctttatgtagctgctacccatttgtcctactggccccatccctttaggaaaccaacctaatttctcttctaaagagcatcttagctgatatctgaatctactgaccatttatttacccctatgtctccaaaggggaaaagatttgaggtgaatctaaattttccagatggtagatgattggctctatctataggagatcatcaggaatggtagaaagagcatgggttttggggtcagatgcttccaggtgtgaatctcccaaaccttagccctcttgcaagtcaatttctcagagcctccagttcccgatctgtgaaacgagaccatagcatctcccttgtagagccatagtggggattagatgagctggtgcgtgactcacaaagttactggcatggcacaagcattacaaaaat

SEQ ID NO: 18972 - DNA, 475 bp, Homo sapiens
ctagcaggtggcacataaaagctagcttcagacaacaatggtttgccaagcaatttcccaggttatttctgtcttgtatattatctattaatcttattactgttccctggtctccctgattttttggctcatcctcttggatctgaactgttagaactggtttgctggccattggctccctactctgcttctggcattgctttttctctaacatttatatcttctccagccacggaacagaccccccttcctcaaaaattatcgcaagaacatacaacaggaatataatacagtctagcctggacgcattaaggaaaagaacagataaggtagggaagagacatctgctaaaaagtgacatatcaaatgccccctgtgtggatacatttcctagcttcacttttatgtatggtgcctgtcacatgcctaaacgtggaatatgtagcgtttccatgttggcgtggcaagcatttat

SEQ ID NO: 18973 - DNA, 494 bp, Homo sapiens
agagaatcactctaaagcagtggttctcaacctggctgcacattaaaatcacctgggatgttttaagtctcagctcccaggcttcaccccaggttattatatgaaaatctggggttgaaactcaggcatcagtgtatttcaaagctcaccatgtgattccaaggtatgtgcatatttgagagcctttgccttaaaagaaggagcaggtgactcatactagcaagatagtgaacagatcaccaggccagccttgtgggtagaaataatcgtgacactctgacactgttctctactaagttaatcaacatgtttaccccatgtactacataaaaattacttaatcagcccgggcgcggtggctcatgcctgtaatccctgcactttgggaggccgaggcaggcggatcatggggtcaggagatcgaaaccatcctggctaacacggtgaaatcccgtctctactaaaaaaaaaaatacaaaaaattagctgggcct

SEQ ID NO: 18974 - DNA, 630 bp, Homo sapiens
atctaggtacttttataaaatcagattttaaaaagtggacatagtacatccagtctagtagatcataccatctactgtcatgtaatatggcaaactgtatcattgtcacttcagtagctctgtcaaaagtgctggactggaaggcaagagatccatgttcttaacctgagtctgttactaattacacacatgaccccaggcaagtcacttaaccttttatggtgtcagtttcctcatctgttaaatgaagggattagactagattatttccaggactccttccgaaaaagtacaggagagagttgtataactgaaaggcagaaagtggaataattgaggcttggaattcagggtgacttaaaaattactttaggctggacatggtggctcacacctgtaatcccagcactttgggaggctgaggtgggaggaccacttgagcccaggagtttgagacagcctaggaaacacggcaagaccttgtctctacaaaaaataattaaaaaaaaaattagcctggcatagtggcacatgcctgcagtcccagcttctcaggaggctgaggtgggaagatcacttgagcccaggattacaagactgaagttagctatgttcacaccactgcagtcc

SEQ ID NO: 18975 - DNA, 607 bp, Homo sapiens
gacgacagagggttaaattattgatgagtaaagagaaatcatcttagaggcttagggcacaagagatcctatgaaaagccactatggctattctcataagagattccattttgagcaaagttgcccagatggagatgagggagattgtcaaagtttaaaacattatacaacgttggaaaataagattaagacagctagtaactttgaagatatctgtttaataatcacattaataacagtaagtttggagacaacaagccacccaaattctcatgagatccatctatgtttgacttaaatgatcaaaatgacttgagatatatgaaattaatttgccaagtctatttctgtaatcttcaggtcatctgctacttacactgaccaggtaactctagctttgttttgaaagaaggtctgatggtgaaattaaataacaagttaggatcaaggagaccatttgagagagaaaaggatctaaattctagttctagaatggaatcccagacataacatataactgaccccaattattctttagctaaaaggtatccttttctacaacaggattgcagtcattcttttccaattgactcagcaatatataacc

SEQ ID NO: 18976 - DNA, 471 bp, Homo sapiens
ggctgccagccttgtgtgggacctggaggaggaaagggcaccattgatgccatctgctccttgggccatatgacctagccaacactgtgggaagagagcagagtggactttacttacgccccagtaggggagtcacagtgcaggaccggggtctaggcattacatccatccagcgttacatgcttcagaaaatatctttgggtgggttcctggaccctggtggaaatgggtcacatgaccatgtagtacaatgtatgcatgcatctagaaatgtccattttgagctgggtcctgtcaaacctggtaagttgcgaggcccagaagcagtccattttaagtgaaagatggaatatcccaaatgtatgcaggcagagtgcacggacacaccgcatgaaccacagaccttctaccacactgtccctagcccggctaatatctgtggacatatagggtagagttcttacacagtag

SEQ ID NO: 18977 - DNA, 476 bp, Homo sapiens
tctatggcttcctgtgtacgtggcaatatgacagatgttatgacatctgaaaatatccacattgttctgacttctaattgggtaagttgtatttaatatcagagatatcacccatatgtaactatctgacttggtttccaaattaatagacacacagaaaagccaacaagtgttcctaagttatctacgagtggtgactgacaaggcaaatgtgaatgttacgtaattcaaatcatgagcctaaaatgaatgtgttatttttttagggaaaataccagtgttgttttaatttttacttttttccttattacccattttaaccattggcatgaatacactctaattttgaattaatggtttcttatgtgagttctagaatactatttctttttctttctttctttcttttggtttgagatggagtctcactctgtcgcccaggaatgcaatggcgtgatcttggctcactgcaacct

SEQ ID NO: 18978 - DNA, 558 bp, Homo sapiens
atatattaagctcttattactatttgttgaattaatgataatgtcatatgagactcatagaatcaaagaatattcagtttgagagctacaaaatcaaaagacctttataagcaaaccggcctgtcttttgtaaaaggtacatatgttatcaacgtgccttgcatttaagaagcttattaaacactgtgatgcaaaatctctccatttccttctccatcagctgcgtatttgtatatgtgtatgtatgagattgtatttctttcttaaaagtccttgtattaggccatttttgcgttgctctaaaggaatacctgaaattgggtaacttacaaagaaaagaggtttaattggttctgggttctgcaggctgtacaggaagcatggcaccaacatctggcttctggtgaggcttcaggaagttttcaataacggtggaaggtgacagggagccagcatgtcacatgatgagagcgggagcaaaagagagagagaaagggaggggccagactctttgaaacaaccagatatcacgtgaagtcagagtgagaattcacttat

SEQ ID NO: 18979 - DNA, 579 bp, Homo sapiens
tgagtctgtttaatgtgttttcatgcatgcaagtttatctgcttagctcaaactgtttgaacttacagtcccatcatagttatttccaatatttttgaaaacaaacatatacttacacatattttaaaaaatcaccattctgcaatatttctgttgaatcagaccttacattatgttgtttaataaagtatggtaagttttggcatgtatgatttttatcatataagaagcataatttcttagccaaaaatttagcctttgactctttagtagaaagttgagttctgtacattgtgctctaaagatagacaaaaatctagagattttcttctttcaaagtaaaagcagatgaggcctttttccaccctctgaggcattaaattgctttgctcaaggttagacttttaatatatctgactaatttgataaatttatctggcaatttatgtaattcagcaatatggaattgtatcatgttatatggtgccatgaaatgctagtgaatgccacctcaagagctctggatgaaacatttaatatgtcttggttggtttgactcccattatcagtagataatgc

SEQ ID NO: 18980 - DNA, 545 bp, Homo sapiens
attttcttgatcctaggttaggattaaaataatttaagttattaaatcatttcctctcacaccaagcctggcacaaaatgcacaaagtgagaagcaaagtggcaaagtgtcccaagaatgctgccaacagtgatgcatagctccatgatgagatgttgagagcttcactggggatgcaaactccaattagagaatttgacactggaagagaattcacgacttgttctaagtcacctttcctctctgacctgggttccctcttatagaataaaaatagtgtgatccaagtaacttttgatgacagtatttagacaacatgtcctcacactaaaacttaaaaaaaaacaaaatactgaacaaatactgaactctagttaataaggtattttttcccccacaaagccatgggttagcaattctgaaactaggactgaataaataaataatataccgaggaacatgggagccagtttccccactggtagagaaaggagttacaaatacacgagaaggaaggcgagaatatgctctgtaggacatgactg

SEQ ID NO: 18981 - DNA, 556 bp, Homo sapiens
aatatatgactataaagactatgagtgataatattctgtagtgggtaaacattgagttctaatgaagtaataatccattcagcaaggggaggttggttgtaaaaggcttcctgttccccaacttctaactgcttccctctagatctaacccatatacctcctacccaaacttggcatgtctaccacatctagtaacatctgccatgccttgcctttctcttctcccagatatttttttaaaatctatactcatcaagttcccgaaggggacacacttgcttctcactggggccaatacacaaaaccatagggatttccctccccatttcctgactgcctgggaaactcatccttaaagaacctgctctagggttactactgggcaatattgatccctcaggcaaagggatcatgaccctcctttagctgtcccctagtccctgctctgccaccttcttgccatgatttgtacttttcagccctctttatagatccattttacctgtagactgtgagatctaaaggcaaccaccaggtcttagttcctttatattgc

SEQ ID NO: 18982 - DNA, 504 bp, Homo sapiens
gtttgaacattaattagcaggcggtccatatctgtgcaggtgcatatgtttgtgtatgtgaatctgtataaccaggacctaataggctgatttagaattttctaaatatagtctccatgaataaattatatataataatgtgccaatttttgtaattttaaacttgttacttgcgatttttagcacagagtaaaatttaaaacaagagatttaacagaacttgacaatagaatttattgttagctattattgttttgtgccaatagtaataaacctaagcataattcaggatagtaaatgatagtttaaaaataaaaaagataatatgtaaaattactttaaatggcaaaactcattttttctctacgatgcacaattatacatatttctaacaaaaatttttaatatggatccttcattttaaaattaaagatggtttagagacaagtttgtttccagaacagagctctcaaatacttggtcctattcacagaagtcttgtaa

SEQ ID NO: 18983 - DNA, 569 bp, Homo sapiens
ggtgaaggggaggcaggcacagtcttcatatggtggcaggagagagagagcaaaggggtagaagctacacactttcaaacaatcagatcttgtgagaactctattatgagaacagcaacggggaagtccgcccccatgactcaatcacctcccaccaagcccctcctctaacactgggcattacagttcatcatgagatttgggtggggacacagagccaaaccatattagtgtctttacccgtgaacatgaaataataagattgatgtaacaggattactgtgaagcttaaatgagatgatgcatgtaggtgcctagaactgcctgccactctcgaggacctcactaaatgcaagttctttatagtccttcctcacagttagcatctggcctggtggtgcacacactaacaggggggtttcttataaggacacaggacaatctcatgaattggcttcctgcgtgtggctcttggtttgttcttccccataatggaggcccgtctgtgacttcatcttgcgatggtgctcactccagctctgatattacatgctcttgcacctcagctc

SEQ ID NO: 18984 - DNA, 578 bp, Homo sapiens
acacatatgtatatgacatttttcactaaataactatggtattaagtgaaattgataaaaattggctcaaaagctcatgctacagccagttattagggtatatgctaggaatttatctaatgaatgaagatgttacaaattataatgtttaatcttcatatatggatttttaatttttttccttatggttgcattcagagatttacatggaaaataccagagtggataatatattatttgatattaaagtttaaaactaaagtctaaaattgtgctttaaattctgattaaaatcaggccgggcgcggtggctggcatctgtaatcccagcactttgggaggccaaggcaggcggctcacctgaggtgaggagttcaagaccagcctgaccaatatggtgaaaccctgtctctactaaatatacaaaattagctgggcatggtgacgtgcgcctgtaatcccagctacatgggagtctgaggcaggagaattgcttgaacctgggaggcagaggttgcagtgagccaagatcgtgccattacaatccactctgggcaaaaagagcaaaactccatctc

SEQ ID NO: 18985 - DNA, 589 bp, Homo sapiens
cagtgggcacaccaggacccttccaggcagatcgggtatgtggtcatccgcccattgcatagcatgtgtgggagttggggagaccagacatgggtctcgccacctctccactggcccgacctccctgcaggcccccaggacagggttagcatctgcttgctggcaggcctggccaccagagattttttcttatgtctaaggtccctgtagttgtggttcacaggatgggggctgctcctgagattcagcaccacacaggcactgcacagcactgtgccatggtggtgggcactcgctttccagatagggcccatgttgccagcaggcatgatgcatcatttaccctaccttgagtgcaatatgtggttttatagaaaaaaacttgggccaggtgtggtggctcacacctgtaatcccagcactttaggaggccaaggcgggcggatcacaaggtcaggaactcaagaccagcctggctaatatagtgaaaccttgtctctatgaaaaatacaagaattagccagatgtggtggtgggcgcctgtagtcccagctactccagaggctaaggcaggagaatcacttgaacc

SEQ ID NO: 18986 - DNA, 621 bp, Homo sapiens
tatacttttctagtatatactttttctgtctcatacgattttttgtattattttccagttatctagatacataaatataaaatatttatgtttgctattttaattaatagaatttggcatattatagtagtagatggttaattaagtttgctgaattcaattttgaatggatcttacatctatttcactgtactgaatagttgaaagaaaatagccataaaatagatattggtgcagccgaagtgaaaaacaacatctaagtctccatctttcctgtgattttctgtcctctttctagcctctccctgcctacctttccgtgtgaacaagtgcacacctatcttgtttgaggcagataatttattatcataggcaagggatattagagtgataagaaatgatgtcacccttgggccgggtgcagtggctcatgcctgtaatcccagaactttgggaggccaaagtgggtggatcacctgaggtcaagggttcaagaccagcctggccaacatggtgaaatcccgtctgtactaaaaatacaaaaattagcttgggtgtggtggcaggcaactgaaatcccagtgactcgggaggctgaagcaggagaatcacttgaacccg

SEQ ID NO: 18987 - DNA, 615 bp, Homo sapiens
aaaagaaaccaagaatagatgtgaggccaggtatcgggtactgacagcagagaggagcctcatcctgtcaatacactcagtattgttccaacccagagcagcaagctttgatgccccatagctgccagccactagtgaaagggagatacaaaatcccagacacttacagctctctgtgcataaaggggcaatcgctccagcaacccaagggtatcattctgaaaaagtgccccaggtgctagccatcaaaggtggaagcatattaaagccaagatgggagtcctaaaaatggttaaaaatgagccaatagcacagtacttgcattctctcctaccgaaggtgaggatgaatcagtcactcttcttctggaagtaacatatacttcctctgattataagatttaatatattctggccaggcacagtggctcatgcccatggtcccagcactttgggaggccaaggtagaaggattacttgaggccaggagttcaagacacgcctgggcaacatgacaagaccctgtctctacaaaaaattaaaaaattagctgggcttggttgtttgtgcctgtggtcccagctactcgggaggctgaagtgggaggatcacttga

SEQ ID NO: 18988 - DNA, 567 bp, Homo sapiens
tacaacctccacctcccaggctcaggtgatcctctggcctcagcccctcaagcagctgggaccacaagtgcatgccactacacccagctaatttttgtaatttttgtcgagacagggttttgccatattgcccaggctagtctcaaactccttgcctcaagcaatctgcctgcctcggcctcccaaagcgctgggattacaggcatgagccactgtgcctggcccccagatttttttttaacagaaaacaaagatttactacaattagttgtttctttttatttcttctaatttaattaataaacaatgtagaaaaatatcaaggatattcatgaaaatggagaatttagtcatttgagaaacctagtattaagaaactgcatctcataaataccacttaacacacagcgtttccttaagatgaggcaagttctcttaaggtcaagagatcagctcattcttcacctcagtattccaagaaacaattagagactctgaacagaagcaataaaatgttgattctgaattattcattagttcatgaatttaccatgattctacctcgac

SEQ ID NO: 18989 - DNA, 516 bp, Homo sapiens
actccaacctaagtaacaaagtgagactctgtcactaaaaaataaagtggaagacttctctacaacagtgagaatgaaacaagtgagtagttctactgtcctttcatcatttctgagcagtttgagattatcaacaaatgagctcactgattttgcagacatccttatgttttgaatatgtttcatataatttattattggtttaagaatcatttccttttaagtaatttttttggctcagctaatatcttagtggtacctacctttccatactttgtgagctttcttatttttacttgaataatatttctaaatatacttgtaaaaatgtaaatgttaggctgggcgcagtggctcacccctgcaatcccagcactctgggaggccgaggctggtggatcacgaggtcaggagattgagaccatcctggctaacacggtgaaaccccgtctctactaaaaaatacaaaaaattaagctgggcgtggtggcgggcacctgtagtcccagctacttc

SEQ ID NO: 18990 - DNA, 564 bp, Homo sapiens
gagggagaagggggagaggaagactgaagagagaggcaagcatatttgaaaatgcctaaaaagaaatcaacaacacattttggagtttgacttgaaaaggagggttgatttatatttcctaaaaattattgaattagaaggtaggagaaaaaacctctataataacagagctcagctcttctatgtttttgcacagaatgtgaaaagagaaaacagagaaacgtgtctgagaatttttaaagagagaccatgcatttgtgtatttgtgtttgggagggagattgaacaaaagagtgctgaagttattagaaaacataccactgtcctgaaagtaataatattgtacttcaccaaatcacaggcactactaattgtatcagacctgatcttttgaatgctgaaatgtgaaaacgtgatgtcttaaaattagtgagaagccacacacgtacacaccatggctgtgtgtctaatcataacaataaatagaaaaatgggaccacaagaagaatagatggtatgggagatttatgggagaaggaggagagaaaaaaataagaggagatg

SEQ ID NO: 18991 - DNA, 571 bp, Homo sapiens
tttattttactaaggccatagaaaaccccaagatatggccggggaaataagtcagtagctttgattttcctatactttatagatattgttaaagttgccattgttgagtttagacaagaacaatatcattaatgtctgatttctcactcttactttttttgtctctcgtcttcattcctctggttgaaaaggaaggactcagaatttgaaccttcactaaatcatatatttcttctatcttgggtatgtttgcccaagtcattgttggcaaaaggaatctcttctctgttcaatgtaaaacaccttgtaattggatcctttaggtttgatttgtggtctgctaagcgggaatttatctattaacatgaactaaattttttacttttaccttgttgcaaaatccaacttggatatcagaagcttaatgtaaactccacctctgtatgtaggagcagtttaagagcacaagctctgaaacgagaccactgaatttggatctccactctcacttactagatttgtaatcttgggtaagctctctatgcctcagtttatctataaaatagtaata

SEQ ID NO: 18992 - DNA, 587 bp, Homo sapiens
gacttagaatatctggttctatactcttgttctacggatgagaaaactgaggcccagagaggtgaggtgtcttactcaaggccccacggctagttagagggagaactttgaccagaagctgagtctcctgtctcttcatctgggttttcccactgcacaatgctgccaggccctggctctgaaactgaccacattaatgaactatttcaacaaatgcttgaggagactccatatgtgctagactcagtactaattgacatgatgctagtcactcagcctctagagccaacagccatcatacctgccatcaaggaactcatggtctagtgggagatgcccctggcctaagcttatttttaaagaaataggagataggctgggtgcagtggctcacgcctgtaattccagcactctgggaggccaagacgggtggatcacatgaggtcaggagttcgagaccagcctggccaacatggtgaaaccccatctctactaaaaaatacaaaaaattagccaggcgtcgtagtgggcgccagtaatcccagctactcgggaggctgaggcaggagaatcacttgaacctgcta

SEQ ID NO: 18993 - DNA, 614 bp, Homo sapiens
ggggtgtctttttgtcctgcgctgtcccgttatattctactctcgatttccctgtggaataagatttagactggagctgtggtttctgcctccttgtctcccatccttttttgttgttaagaagcccagacatcttgcatcaaagttccctcttttcctataggtttcattctcagctcagagctattcctctggagggagagccagggaggaggcattaggaaaggagaggtgggaagggggttgctagcattcccacctccacactcttggataccaacaggaaccagggtagtaaaactgcacctcccaggcctgtacctctggcctcaaccacagcaaccagaaccagcttgttggctctgctttccagcaagccaccctgcctcccctctctagcaatccctgccaactcactccaccacccaccagctccctgtcatctggaaggccagcccccattaccaggaacctttcatttgcctgtccctgtgttggatctggtgctggaagaagagtatggagagatggcagtcacaaactccagggttaccagtaatgacaggggagcatatttccttctttatcttcgtgaaataacccagtagtttaag

SEQ ID NO: 18994 - DNA, 511 bp, Homo sapiens
gggcatgagtgctttagctcatatcactcagtttccagcagttaatgaacaaaacaaacaggtgagaaatttaagtaaaatccttgcttagtatctgtggagtgggaaattggttccaggatcctccatggataccaaaatcctaggacactcaagtctcttatataaaaatggtgcagtatttgcatacaacctacataaatcctcctatattttgaatcatctctagaatatttataatatctaatgcaatgtaaaattttttattggtgtattattttttattgttttgaagtatagggtattttttaatccacagttggttgatccacagatgaggaacctatgggtagagagggccaactgtaatgatgagaaaagaaaaagatttacagaagactaaccaaggtttatattttaaaatgagaattaaactccactgttcccatcccacctacacatacacaagttttaaactgaaggtactttgcatcagttggataaacaggcc

SEQ ID NO: 18995 - DNA, 601 bp, Homo sapiens
attaaaggatcagggatatgaacactagacacagaattctgattctgtatcaccctgtgatcccagttcaacatccatgagatccaaatccagagaggtaaagaaagaaggaaaggcagaaagatggcttattagttaaatagatggaaagcaagcatgatgttgttagtcaccagtcaacaccttgtgctctggacagatctgttgctcaaatatcaaagaggaaacccacaacagccccttgtcagttctgtatccccatattagttttaatagatcagttttttataatctatcttatatcttccttctcattgtatacctgaaatgacctaaccagcagctgagagcacatacatcttattctcagagattctaaacagcaacttcctttatccaaaatatacaggaatgtaggagcttggtaaggagctcttgttcagcccaatttacagaacatcaggcatctctccctgaagagacacttggaacagggtttgaaaaatgcagcagtctagaaactagtaactacaggaatattaatactgcaaaactaacaatctaagcatgagtaccagctgtgaatgaggagtcacatcat

SEQ ID NO: 18996 - DNA, 414 bp, Homo sapiens
tggcatagtgagggaggctgggacccaggtgctagagtgactgatggctagcaggaggttgggagatgatggtgttgagggaggagtagaacggtggttggcaaggatggcatgggcatcaaaggaatggaagttttttatggaggtgaaagagcacaggttggaaagagcaataggaatgagcttggggaacgcactctgcttcttgccctgtttacttataaagaaagtatgtgtaatcccagcactttgggaggccaagttaggcagatcacgaggtcaggagatcgaggccatcctggctaacatggtgaaaccccatctctactaaaaatacaaaaaaatttagtgaggcgtggtggtgggtgcctgtagtcccagctactcggaaggctgaggcaggagaatggcgtg

SEQ ID NO: 18997 - DNA, 332 bp, Homo sapiens
gagagcctggacagctcctcctctccacctttcagagggcaagtgtttgtgaccgaggagcatctcacagtctaacagcgagaaaacactgctgacagcttacaagccacacacacactcacactcacacatacacactcacatactctcacacacactcacactcacacatacacactcacatactctcacacacactcacacatacacacatgcagacacatatacactcacatgtacacacaaacacacacgcacactcacacatacacactcacatactcatacgctcactcacccaccacattaacaacataaaaccctcattcaca

SEQ ID NO: 18998 - DNA, 353 bp, Homo sapiens
gctcattttcctgagtgccaacccttttcctgttcttgttactgttttattaggtcattggtcaaccatgcttttaataagatgctttaatatatttctttcagctctttacagagggaaggctagtttgaatcacctagtccaccactactaaaagttagaagtccttcatatgggatttgtgttgttttgtaatcattttcctgccaatatttaaaaatcaaatttcatttgaaagtccagatatcttgctccttttaaaatcagaaaacctggcaaccttgagctcacatattaacaatgcaataattaaagacagctgagcatcaccagagtgcccaccatgctctatt

SEQ ID NO: 18999 - DNA, 504 bp, Homo sapiens
ggtactgtacaaaggcatgaataccaggagtcactgggaactatgtctaaagctctttacctcaagagccccagttagtggccaaccacagcagctacctaaactgatttgatgaatggaatccatttaggagaatatctgtttaaaacaatcattcgagcttaggcatagttgatatttgataactgacaagaattaaagcaaatgtttcttaatgctactcttttcgtgaaactgaactaaaaacagagaaaatctgcctgacatctaagtaagtgagaatggtttgttaaatactgcagtgttaataagctaagtctctagcttaatatagatttttctctctctgcttttgccaaaataaaatgaaaggccaaatgaaaaatgacttaagataagtgtttataaactgttcatttacctgctaaagggaacattaggaatgaaaggatagacagcaaccctagcccatattaaagcttcaaaaagtaatacgtacagcta

SEQ ID NO: 19000 - DNA, 527 bp, Homo sapiens
catgaccatcttaccaattgaggagttatgaacccctgggtaatcaattgggtcaaggtggctccaaataccaaaagacattgataggatactgagaaatgtaaaatatccatcattagaacttaagagctaagtatatccaggcctcacttaaaaacaatacagatgtgttttaatgcaacatgtttttttcctgactattgattcttggaaaataaagtttcttcccaaacacctgcatcagctccagactgattaatatgatggtcctctcaggaggtgggaatgggtattggtttaaggatgattagtccctatttcatataagccatactgatcagataaattgttggcaatagatccctctcatataattgcattaatagaaagcacatggaagagagccatttcaaggtccaacagctctgtgaggtagatatgattcttaatcctacctttcaggtaagaaaaccaagatttaagagagattggctaacttgacaagataatcttcatttcttatcttc

SEQ ID NO: 19001 - DNA, 419 bp, Homo sapiens
atttgtgagtttttcattgtgctttaagaaattctcatagtggaattaggaggactttggtttatccacaaatgctcaataacttctaggtactacttatccttccctttcgtaatccccctttaaagaatacacatgtgcacaggctgagtgtaaatgtgctttcccaagacagatgccataagtggcacgtgggaaaactgaaatccttttgtttttcaagggacagggtgtgaaatattagttctttttctcttttatcagaagctagttttgagttgaaagtggcataagccggacgtggtggctcatgcctataatccaagcactttgggaggctgaggtgggtggatcacctgatgtcaggagttagagaccagcctggccaacgtgatgaaaccccatctctactaaaaata

SEQ ID NO: 19002 - DNA, 363 bp, Homo sapiens
agctgaatcacgaaagatgagcaggtagacacggagagtggaagcgtttggggtagagggaatcgcagaagcacagagggaggccaggcatggtggctcacgcctgtaatcccaagattttaggaggctgaggcgggtgggtcacatgagctcaggagttcgagaccagcctgggcaacatggcaaaaccccacctccataaaaaatacaaaaaatagctgggcatggtggtgtacacctgtagtcccaggtacttgggaggctggggtggaaggattgcttgagcccaggaggtagaggctgcagtgagctatgagggcaccattgtactccagcctgggtgacagagcaagaccctgtctc

SEQ ID NO: 19003 - DNA, 373 bp, Homo sapiens
ggtaaatttacttaaataatttttcttaatgtgatataaaactgtgtaatatcacaaatattaagacattggactagaccacaaagatttaaaacttacctttaacattgatgtctattcctggcgaagagagaagaagaatcaatttctccacttggttatttatgcaagctctatgcagggctggttctcctgccataaaaaattaatagattattccagagaagacaagatatcaactaaaaaaaataatcaaagggcatgaactaggagatctggccccatgccagaaatttatttattgagttcttcttttgactgggttaaacatcccctgcatttaaaaaggcgggggtggggggtgggaagggga

SEQ ID NO: 19004 - DNA, 451 bp, Homo sapiens
catgcacatggtttgatttcataagtgagaggttggcctatctgggatgggtgaggatattcccttagcccttgcacaggtcatcagtgaagctcaggcagcttgaggggataaggcaataggggaagtgcttcttaagtgatactttttccttggtgaggactctgtttatgtttagtttcttatgtgacataatgaattaggaactaaaggcaatttgaagatttgtgccctatgtgcagaacagaaatttaatgtatgaaagcaaaccacaggtcagttaggagagttgatcaatattgatattgctctttaatgaaaggaaataaccctgatggattttccttgggattgctgatgagtatgtatttgtactcaacacatggggcttttcattgatctcagtcaaattaaaattttattaacaagtcagacatccatctgtattttt

SEQ ID NO: 19005 - DNA, 137 bp, Homo sapiens
aagataaccaaacaatactccagaaatgttttgaaaaatatgataattatatgaaaaaacagaaagttcaagataatttaatgatataataaaccgtattctagagaaaactgacctagagctgtccacattgagac

SEQ ID NO: 19006 - DNA, 543 bp, Homo sapiens
aggttaagccatcactttacctttgtgtaaaactggtaatctatcctaatttcaaagtatcctgttactataacagataatagtacattatattcaagtatgaattcaaaaaaatatatatatatattttatgttcactgtatgtgccaagcctaatatgagagctatgtattatagagtttatgctacagccctaccttcaggaaacttatctactggacaaacaaaaattttcaaatatacaaaaaattctaaatcgaacattgtaattatctagcataggcaaatatagacagtaacagacaggtttacaattattaagaaagggcagccaggtgtggtggctcacacctgtaataccagcactttaggaggccaaggcgggtggatcacgaggtcaagagattgagaccatcctggccaatgtggtgaaatggtgaaaccctgtctctaccaaaattacaaaaattagctgggcttggtggtgcgcacctgtagtcccagctactcgggaggctgaggtaggagaagcgcttgaacccg

SEQ ID NO: 19007 - DNA, 367 bp, Homo sapiens
catccctttccaaagaaaatgggcaagcttgctatttaatacagctagaccttctctcactaagaattgaatgattcttcagtggaaaaaagaaaaaccatcagggctttaaatgttctgatgaaaccacattttatcatgtaccagataaagatacctggctactgagacaggtttcctaagttacctggacagtaatgacaagactcacttgtttattagagtcagaagataatctgtccttacgcattttcaaaactatcatgagaatattttcagtgaaacagattgcagaaaagatagatcttagaacgtaatcttaatatcagctgtgagcattaatagacagtcactgtaagaactggct

SEQ ID NO: 19008 - DNA, 488 bp, Homo sapiens
tggctccttgcttctaattgttgcatagtattcttgagtgtccacccattttataaattcatcccctcaatgctggtaaacaatggcctctaactcccagctactgcatgtaacattgtaataggcatcctcattcatatctcctttaaaagaggttctccttaatcatttgaagttgtcagaatctcctccacctagtataaccaaaaagatatctaatttagagaattcattatttttttaattactattatttttgattgacaaatctttatatacatttttggtgtacaatgtgatgttttgatatatgtatacaatgtggaatgatttaatcaagctaacaaacatatctattatctcatttaccaatcataaaaaagattgctaaatgagataatagatatgttcgttagcttgatttaatgatgcgttagatatttactgtctttggcagggtgcagtggctcacacctgtaattccagca

SEQ ID NO: 19009 - DNA, 556 bp, Homo sapiens
cgcgacctcagatcagacgtggcgacccagctgaatcttaagcatattagtcagcggcggagtaggaaagcagaagcaccaaagattcaagcctgggccgttgggaagcctgacgctcttacccgacctcccttgagtgctgcctcccttcctgctgcactgatcccttctcaatgtccctgcttctcctgccctcatttcaactgctcatccgtcttcccagacttttctacagacgtgcggcattgcagtactgctcttgctgcaaatgtcagatttccttggtcagatttgcttattgtgggactttctgctgagatatatcagagatgttacaactgcgagaaatgcaggcagttctctgcgatccatctgccatgcaatgacaagagatgcttaaaggctgtctggtagaactgccttctttagaaacctgagggccgggcgcagtggctcacgcctgtaatcccagcactttggaaggccaaggcaggcagatcacgaggttaggagatcgagaccatcgtggccaacacggtgaaatcccgtctctacc

SEQ ID NO: 19010 - DNA, 316 bp, Homo sapiens
tcagatggagatggtggttgacaacattgtggatgtactaaatgccactaaactgttcgctttcaaatggttgattttatgttatgtaaatttcacctcacattatttttaaaaatgatggcttttaaagaatatttactgacataggaaaattcacaccacatacctattattaaaactggacttacaatataatctcaattttgaaagattaaaaatgtacatgtgagtttgtgcatatatacatacatacagatatgcgcgcgcgcacacacacacacaccatatatatatatatatactcatcctcctcccc

SEQ ID NO: 19011 - DNA, 268 bp, Homo sapiens
caataaatgtttctcaaaaataggaagactggaagaaggaagcattacaagctaagctggctgttcttccttggagaaaatgaagattggtaaataagtaataaagacagacaaggtcaattgtagaaaacggccaagtcttgaagtgagtggagcaagagagtttctctgtccaattctttgaagacagtttaattctatttctgagcaatcaaaaatcacatccagtgccccttctaccttctcatctccttcgcagatgtggatg

SEQ ID NO: 19012 - DNA, 641 bp, Homo sapiens
attaggtgctaggtagcatgcttttacatggactttgctctttaatcctccaaaattctataagatatgtatcaccatttgacctatgaggtagaaattgacaaaaaataactacccaaagtttatgcagatagaaatgataaagttgggatttgaatggaggtaatctgacttcaaaatctacactcttaaccactatactcactataccatctctattaagcaccaaaatttcttgggggttgggtagaagagtaaaccagatttttgttaaaaagaatcatgaatactctaaggtaagacttctgaatttaaaagccactcaaggttgagcatggtggctcaggcctgtaatcccagcactttgggaggccaaggcaggaagatcgcctgagcccaggagttcaagaccagcctgggctacatggcaaaaccccatctctactaaaaatacaaaaaatcagccaggcatggtggcgcacacctgtagccccagctcctcaggaggctgagggacaagaatcacttgaacctggaaagtggagattgcaatgagacaagatcgtgctactgcactccagccgcctgggcaacagagtgaggctccacctcaaaaaaaaaaaaaaaaaaaaaaaaaaaag

SEQ ID NO: 19013 - DNA, 346 bp, Homo sapiens
cagtattttcacaggacataatttatacttcgtattactttatgagattatgcactcatatcagcttttcagaaacagaacatttctacctacaagaatatgaagtacttttgatttttttttcaaagttcagagaacattttttctcattagatgttctccaatttaactttgacatgctttcaattttctttgcatgctgagaaggatcaaagccaatctttttatcactctggtatgtgtcctgagtttctgttcctaaaaaaagtaaaattcccttaaaataaaatgtcacaatgaagttggttaaaattattgagttttaattttaaggcaactaattttc

SEQ ID NO: 19014 - DNA, 283 bp, Homo sapiens
gcatgtcagaacttagggaggtacctcattttaaaaatggctgtaaggtgatccattatatgaatgcactataattattctagtcagtttcctattaatgggtcttttaaaatgtttccagaccattactaataacaatggacacatatctttgcttatgtgttagacacatccataggagagagtccttgagatggaattgtcgggtcaaatagtatatacattgaaaaatgtgaaagatatttctaaattgtgcttcaagtggctatcccaatgtgcattc

SEQ ID NO: 19015 - DNA, 388 bp, Homo sapiens
gtgactgagcatgggtgacccgtcactgtgctgccgacagcagaatggactgacagggcttccagatggacaccgtccctgtaagagcatcttaatgcctcaggctaagtcccatgtcagagtcagggcttagctaacttaacaggtgggaagctaacttaactcacggcatgtttacaagtgtgataacatttataaattctaaaataataaagctaattgtattagtctgttctcacacttctaataaagacatacttgagactgggtaattaataaaggaaagaggtttaatggactcacaattccacatggctggggaagcttcacaatcatggtggaaggcaaaaggcacgtcttacttggcagtaggcaagagagaaggata

SEQ ID NO: 19016 - DNA, 486 bp, Homo sapiens
gcactcattatctctaaccagatgattgacttcctacaaatcctccaaagcttgggaaattcaactggatgagaaggtgaaggattggccagttctttcatgtggagggagtgagggagtttctgtaggaaccttaactgtgatgtccctggctgatgcgggcttggaagtaacaacaccttgtgcttatgcagcctcctgcttctcagcagttcaagtgcttcccagacattatctcactatttctcaccatcttcttcggaaagtggctgaaggcagctcttgttatcataccccggcacaccctgcaccagtgggttaaatggttttcccacaaccttccagtgagagtcaggaccaggacccctgccaccagatttagctttccagcctgctcattgcctcatgcagctttcaggacccattatttgcctcaaggagaagggaagttcaccatcactgttacaacaatttgagacatttgct

SEQ ID NO: 19017 - DNA, 403 bp, Homo sapiens
atcttacgtgtctgtaaaggggagataatagtagcactgtctccaagttcttgagaaaataaacacctgaggacatacctgacatgtaaaaagtgcaatgttgccagcccttccggttattctgtttttatttaaattcaaaagaccaaggccaggcacggtggctcacgcctgtaatcccagcactttgggaggccgaggtgggtggaacacctgaggtcaggagtttgagaccagcctggccaacatggttaaaccccgtctttactaaaaatacaaatattagccgggtgtggtggtgcacacctgtaatcccagctactcgggaggctgaggcaggagaatcacttgaacccaggaggcagaggttgcaatgagctgagatcatgccattgcactccag

SEQ ID NO: 19018 - DNA, 287 bp, Homo sapiens
aaccaaatcttgataaaacaatgagaaccttaaacaatgatcctaagaatttccctgaagatgacaaaatctaaaatagatatctatgctttaatagagagtaagaagctaatatcatcataaaaaagatttccaaaatagcacatctatgttctttactgacacatatattccaaaactttgttaatatagggataagaatcacccaatcaacaaaagctgttaatacacatacatgtaaaatataaaaacattcaaatgctaattccaactccaaataggaggct

SEQ ID NO: 19019 - DNA, 355 bp, Homo sapiens
gtcaaaggtcagagatcttatcctgcttgcgagccaataagttagcctgccacagttttatagacatatagatttagctatcttgacaggagaaaaaatggtttttggataagacaaataagttattatttacagcaaaaacagccagagcagcttctttccggaaagaaagacgctttctggaacaatttccccagctccagtctccatgggccaacatgattgagagtgtgatattacttgtgcatgtaacagaaatgcatccaaggagaggaattctaaacttatgaggttcagagcttatatagggactgctgtatatatgcctattttcatttccagagagaaaaagaga

SEQ ID NO: 19020 - DNA, 531 bp, Homo sapiens
acctaaacctaagagctgattgtgtggaaagtggttttagccttggcagaatactaagtcatgcaattttagtgttagagtaagaatatcagagatacaacacaagcatttaaagaacagatggagcaaaagaggccttgtgaaggaacaatcagaaaagtttcaagaaagaaagagagcaatgccacgtaaattgtcaaaggagtaatttttaggaaaaaagagtgcttaacagtgtaaaatgatacatgaaaccaagaaaggcacctggacacgtattgttattgtggttgatagtgatggtggtcatggtaatcatgactattacttagaagtatcccaggataggagacagaatttcatgttagatattaagagacctgaattcatattctagcatgttgctttctaatcttgtcacataattgtgagccgcaattttcacatttgtcaataagatgatataacctgtcttccctactttgcaaagttgcatgagaatcacatgaaagaaaatatatctgaatcact

SEQ ID NO: 19021 - DNA, 389 bp, Homo sapiens
aaaatatttttgttactcatgtaccattatcactataaataatagtataaaaagttataaggactacattatataagtaataaaatatttttagaggaaaaacttatattttaataactttgtactttttttcctgctctttgaacaaggggctccaaattttcatttttcactgggccatatttattatgtcaccaccctgctcggagggtaactattctgaggttttgcaggaaacttcagaatgggtctaagattcccatcttgccaaaggttttcggtgatttcattgagtacaagatagtctatgtatcctgtagcccagagacaaggagcattataattatagcagctctattcttactatcaacattcttaggagttttggg

SEQ ID NO: 19022 - DNA, 91 bp, Homo sapiens
tttatattcatttattttatttaagcctcacaacagctcattcttacacccatttcacagaggcaacaactgaatcacagttgttcattct

SEQ ID NO: 19023 - DNA, 343 bp, Homo sapiens
cagtgcatatatttttgtcatgtgttgattttaatagatttattctgctgccatattttcttagctgtttaaataaaatacttcttgagcccttatttttttttgttctgagccttagtgaatactgtaactatagtatttccatttacctcaagtaactaaaattgtaaattactcaatattatgtggggaaaactatatatattatgcttttatatgttctcagatacattaaaaatgcaaaatttaccaaaccaaagatttggtaaataaaaggttaggatataattttctttcattctctttctttctttcttccttccttccttcctttctttctttc

SEQ ID NO: 19024 - DNA, 387 bp, Homo sapiens
tggtaaaactcattgcagcgttgaagaacttaactgacgtttcaccagatttggacatcaggctgaagatggaagaatcccagaaggaacttgaatcatatatgatgagggctcagcatttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaac

SEQ ID NO: 19025 - DNA, 600 bp, Homo sapiens
cctgatataattatttcaggttgtgatttaatcagcatataatctagattcaagagacactaattattgcaaattaagatgttaatagcttcctaaaatgctccttaagattaacataacctaaaatccctaagtttcttttatacatgatattgttatgatccattttcctccatgctattcttataaatatggctttttagacccaactgcaatactttacttctgcccttattttagcctgtcagcttctttggagattgagaatgtcaactaccctattctccattcctcccattatcataacatctataaatctgatgttttcttaagttcacgaatagatgtctagaatagacaggagtgaaaacagagccatacgatatatcactaaaaatcacctatgagataggcatcaatgaactaattggcattcttggtctgctaacttttttaactgtactatcatctgatccacatttctacacttttcccacaataataccatcaaacagagacaaatacttgtataccttatttccctgactcacaactctaagtagaagttgatttctggctaactcaagtatacttttcatt

SEQ ID NO: 19026 - DNA, 532 bp, Homo sapiens
aattacctttgaagttcagccatctcaagactaggaacatgggcttacacacacacacacacacacacacccataccacactagtcattggctataggcccctccagggagtgttaacctcccaggcacaactgcctctctgtaaatgtggacaaatcagctcttgcagtccttgggcagtgctctaaagagagtcactggagtgtgctgtcaaaagcaaaagggcacagaagctggggggagtgtccttagaaatggtaaaaagaatccaaagagatctgagaggagaaccccaaaatttccactaccatgaccaaagagggtggttatcatagcggtgaatctttcagctcttccaagagacttccctaattaattgagcagttggtcctctggatgaggaggagaataaatgagagacacatggacaacagcagggtcaagacagtatgtctttgcatcacacctttggaattggaggtgataaggagtctttcgtgtgtgtgtgtgtgtgtgtgtgtgtgtgtgtgtg

SEQ ID NO: 19027 - DNA, 661 bp, Homo sapiens
tgagtatttatgatgttgtaacagttttaattgaatataagtcaatggatcaatttcttgattataaatcttacaattagatttcttcaatcagcaagtaacttttggcagatttcagtaacattaatgcactttctagcttaaatgaaaaatggctgataaaagtccaaaagataaagtacataagtaagaacttacttggttaaaacaaaagattatttagagtaacattttatttatttagaaaaagaaaactggaaattagtattatctaaatttttaatatcttcctgctaaagtttagtgaattttcttatgtgaagtagacaccttaatcttaaagcaataattggctgggcatggtggctcacacctgtgattttcccagcactttggaggttgaggcaggtggattacctgaggtcaggagtttgagatcagcctggtcaaaatggtgaaaccccatctctactaaaactacaaaaattagttggaaatggtggcgcacgcctataatccaagctactcaggaggccaaggcagaagaatcacttgaacccagggatggaggtttcagtgagccaagatcacaccactgcactccagcctgagcaacagagagagactgcgtctccaaaaaaaaaaaaaaaaaaaaaaaaaa

SEQ ID NO: 19028 - DNA, 475 bp, Homo sapiens
ttttgagggatttttaaagaaaaactactaaatttgatgattgataacatctgtgcagtgggctgggcttgcagggagggttatgagacatggtgaggccagagtggtcaagtgactgaatattgttgagagtgagaagtgagaagggcaggagaccagaactgaggctgagagtgcagctataatgataaagacgggccaggcacagtggcttacacctgtaatcgcactctgggaggccgaggtgggagaattgcttgagtccagtaattcaggaccagcctgggcaatatagtgagaccccatctctacaaaaaatttaaaaattagccaggcatggtgacacacgcctgtgttcctagctactcaggaggctgagtcgggaggattgcttgaggctgggaaggggaggttgcagtgagccaagaatgcagcactgcacttctgcttgggtgacagagcaagaccctgtctt

SEQ ID NO: 19029 - DNA, 532 bp, Homo sapiens
cttacgcctttagatttgagcctttaggccatgatgagacctatccccaagtctggtactttgtcctgggctactgacacataattaaaactgcttgcttcctgggcttgtcactgaacataagggttactaagagtttacattgtaagtaatttatgtaattaagactactagacataagaaaagcaattttacatccaaaggctctaaagaaaacagaatgcacttttaatttaaaaaagattgtaagaaggcaagagaatgtggtttttgttaaaggaaaattaaaatgtaagagaggttgagggagagagagtagtttttcatttacatgagagagaattctgtgtggtcgtaatataagggggaaaataaagtaaacctttgtcctaggataaaatggtaagacatgatacacataactgaaggtttaagcaagttgtagaaagtttgtgaaagagtgatcttgtgaaaataattttgtgtatgatcatgtgggctgaaattaaaaagaggtcatttagtttttcta

SEQ ID NO: 19030 - DNA, 332 bp, Homo sapiens
taaacatcggatacttagacatgatttgggtgacctcagcttaactgtgcaggtgcggcccttctagtgagaacagtgtttttttctaagctaatattaaagccttacaatacatcagtgtgttgcactggtctaaatagataggcaggccgggtgcagtggctcatgcctgtaatcccaacactttgggaggccaaggcgggcagatcacctgaggtcaggagttccagacctatctggccaacatggtgaaaccccgtctctactaaaagtacaaaaattagccaagtgtggtggcgtgtgcctgtggttccagctacttgggaggctga

SEQ ID NO: 19031 - DNA, 558 bp, Homo sapiens
cgtaagccagttcctctaataaatcccttctcatctagctagatagctctctcctgtttgttctggctatctagaaaattagggctaatatacctactcttgcagagtttacattctaattggaggagacagaaaataataaaccaataaataaatatgttataactaaatatattcatgtatctagcatgatgataaatatttatttattataatttagcatgcttaattaacataatgataaatactttgggaaaaaaatagagcaaaataaaaaaggcaggggtgggagtagcaattgcagtcatcaagaagtgacactggagccgggcgcggatcacgaggtcaggagatcgagaccatcctggctaacatggtgaaacccgtctctgctaaaaatacaaaaaaattagccagacgtggtggcaggcgcctgtagtcctagctactcgggaggctgaggcaggagaatggcgtgaacccaggagttggagcttgcagtgagccgagatcgcgccactgcactccagcctggacgacagagcaagactccatctc

SEQ ID NO: 19032 - DNA, 641 bp, Homo sapiens
caagtggcagagctgaacttgccaaaccatctatgctctgggttagtctccacatgtgatgaatgaattgacattatgagaactagtcatgaagcagtccatagtaatggaatttttaaaaatattactgctaactctaaggaaatctatttggacaatgactaatattacctattaatatttaaaactaatataaaagacgtctatgaatatttgctccaaaacacatgaaaaaaataaaaattggctgaatagagaaatatttggcttttatgtcatttcatattttaccatgtaatgaagggtataatcatttggagtgcatggttttttcttagctttaacgtaatctttaacgcaatttaatgtttatggtgaacaaatttaataaactttaaagttacaaatgtagtatcagattatttgagaatgtcagctatgtaaaaataaagatttattttcatttatgcaaaacacctgaaaaaacaaatatgaaaagtgtgagaggccgggtgcggtggctcacacctgtaatttcagcactttgggaggccaaggcaggcagatcacctgaggtcaggagtttgagaccagcctggccaacatggcaaaatcccatctctaataaaaatacaaaaatt

SEQ ID NO: 19033 - DNA, 565 bp, Homo sapiens
tgtattaccttgtgacattacttgcattgctatcttaagtgttttaggacactgggttttgtctccttttacatctttatacgttaactcccctaacaattatatgattgttgaaagtctgtgggtgctccataaaatgaatatttagacttagtcatatggatttttaagagttaaacatggatgacaagatctatgaatatatgtagaaaaatccttaggaatctacaaaaaagctactaaaactaataactaatgtagcaaagttatagaagccaagattaatgtacaaaaatcagttgtatttctatatacagtaccaatgaacaattggaaatggaatttaaaacagtttcatggtcaagcacagtggctcatatgtgtaagcccagcatactgggaggccagagtgggtggatcacttgagcccaggagttcaagaccagcctgggcaacatggcaaaaccctgtctctacaaaaaatacaaaaattagctgggtacggtggcttgtacctgtagtcccagctacttgggaggctgaggtggtaggatcaattgagcct

SEQ ID NO: 19034 - DNA, 339 bp, Homo sapiens
tgctggccacaccagccccctttcacctccagtgccacaataaacctgtacccagctgtgtcttgtgtgcccttcccctgtgcatccggaggggcagaatttgaggcacgtggcagggtggagagtaagatggttttcttgggctggccatctgggtggtcctcgtgatgcagacatggcgggctcatggttagtggaggaggtacaggcgagaccccatgtgccaggcccggtgcccacagacatgaggggagccactggtctggcctggcttggaggttagagaagggtagttaggaagggtagttagcatggtggctcatgcctgtgatcccagca

SEQ ID NO: 19035 - DNA, 391 bp, Homo sapiens
agtgcttgaagggtgtgttgcttctcacttggaaaattttgaaattgcctctattaaacatttccatttttccactagaaagatggagatgactctgggatagataggctaatctttccaagacacccatttccatatcactctcttgccaaaacatttttcagtggcatctttctcatggaatcaattagaagttcaaagttctgacattcaagatgccccatggtttggcctaaacttctcttttcagctgtgacttctacttaccccttacatgaaccttctgttctggatcatctaattcttgtcattcctgttctagaaattcttcccatttttattcttggaatcatgagaatgttttttcaaaactctaatatgatcaaggatg

SEQ ID NO: 19036 - DNA, 464 bp, Homo sapiens
tcttgactcactcactgcaacctccctctcccaggttcacatgatcctctcatctcagtctcctgaatagctgggaccaaaggcatgtgccaccatgcctggctgatttttgtatttttttgtagagatggggtctctctatgttgagagaaaaataaggtgcccacattcataaatgcaaaaaaaattggcagtatttaacaggaaataatgttacctaaaaatagtgaactaggaagtgatatatcttcatcaaattgacaaacatctgggacatgttacagaaagtcacactaaagtcagaaatgacactaaggagcttctagtctcctcttatccaacatcatcttggagggaatagccaaggaaatttaagaagaaagagcaagatgggagacaagaattgtcaattatagaggtaaaagtcattctggagcaagtgattcaatttctgtgtaatatat

SEQ ID NO: 19037 - DNA, 432 bp, Homo sapiens
ggactcacaggtttggaaaggtgaggaagagtttcccgtaggaagggaggagggaggtgcagtaccagcagaagagaaaagatgtgaggcagtgttagcagatgcccactacactatcgttcatgcagaaataatgagattgcctttacgacttgaattgtgtcccccaaaaagatacgtttaggccatgtgtggtggcttacacctgtaatcccagcactttgggaggccaaggcaggaacatcacttgagcctaggagttcgagaccagcctaggcaacatggtgagacccccgtctctacaaaaaatttaaaaatgagctgggtgtggtggcaggagcccatggtcccagctactcaggaggctaaggagggaggatcacgcattcagaaggtcgagactgcagtgagccatgattttaccactacact

SEQ ID NO: 19038 - DNA, 579 bp, Homo sapiens
atgtaacaggattacaatgtcagttacctaacattgatctgatagagtattttattattaccaagctaaaagtaccaatataggtatttatcataatcatgaacagagaattagcacattttctttgcaattgaattttttcccaaagctgcttctccttactaaaagttctattgaaattgtatgggaattcaaattcatcttaaaagctgaaacaatatactaataaataaaatatttcttattccttattcatttatttattagtttatttattcagttaacaagtaagtggctctgtttatgccaggtacaactttcttgggccctcaaaaacatattttaagctttatttggtcatggggttttctgaaattatatttactaaaagtcaaaagtaaatagccaaatggctaataagcacatgaaaagatgctcaacattatttatcactaggaaaatgcagattaaagtcacagtgaaattctactttgggaaacagttggacagttctttattctgttaaacataaaattagcatattagcagttttactacttggtatttactcaagagtaa

SEQ ID NO: 19039 - DNA, 420 bp, Homo sapiens
tttaataactttggctaaaacattcacataacccctatgagccctgcattatttggcacttgccctcagaaggttcgaagaaccaaccccatctcatgacattccctactacctcactgcttagcccctctattcaccccaccaagggccatctgcactacctgtcctttaactgcttaaacaatccatgctagatcaagcctcgagattttctctcttgctttttcttggcctggaatccctagttcacttgttttctgactgactcctccttatccttcacatcttaagttttaatatccgttacttggaaagaccttccctgacgtgtctatctaaattaagctccactgttacgttttctcagataaccctgtactttttcttcactatgaaaaccatgaagataggaagatgtct

SEQ ID NO: 19040 - DNA, 488 bp, Homo sapiens
aactccaaactcagtagaataacagaaataagcaattaggccaatggaagaaaacagagggctcagaaacaatgtaagtggcagaaaaagcatgcgtatcaatggacaaatgacaaacttcaaaaacggctctagaaaacttatcatccatgtgaggaaaaatatattccaacttctcaccatattaaaaaagagatgtggtagattaaagaccaaaatgtgaaaaacaaacttctagaagaaaagaaaaaacagtatttttatgactccaagtaggaaaggatttctaaaacaaagcgtcaataccacaagttaatgttaaacatttatattaatagaaggcactatttaaaaagtgatgacaatcctccaaattaggaaataattgagacatgtatactaacaaaggttggcatccaggatctataacaaactcacacaaactcaaagaaaagaaatgagcaataaaaatgggcaaaaaaaaatca

SEQ ID NO: 19041 - DNA, 549 bp, Homo sapiens
agtagtaaatattacagcctcatatgaggagaagtccccaggctgaaaatagttgttctttaaaacagcttaatgtgttctttaaagccactaatcagattaagcagcagtgtctttgaaggaattagctagccttgaaatccaataaataagtttgtctttcctacaaaatttgtctaagggtaatttttttctttccagagaggccctctgctgcccatccctttgttctcaaaatacaagttaaaaactataagtgaaggctgtgactatgttttagttttttctctatatacttttctattatttttaaatattctgttactttttattggatcaataacaaataaaatatcttgccctgttaccaacataatttcacatatttttaccctaatcttcatttttttcctgagaaattatcacatggattatatgtcacttgagtgaagttataaataaccataacaatttgctctggaagaatccacatgaaactgtaattctaactggtttatgaattttttattcccattaatggcaaatatc

SEQ ID NO: 19042 - DNA, 335 bp, Homo sapiens
caataccaaaaggtttttattctgaaattttactccagcaaaaatataaagctgtcctgacttggtgctgataacaacagtcagtactaagtagatgtaataatattttctgaggtgtctgggaactctggacaagttaaatattcatctcccgtcttctatgggcctctatacttgcctgttgcagctcaggagcaagaaggcttagattccaatgacatcaacagagatttgagcctgcgataaatgggcttcatgccctgtgtctgtacgtgtagaggcgatcaagttaaagcacaagaagcagctgtgatctgagaacaccagtgtttatg

SEQ ID NO: 19043 - DNA, 403 bp, Homo sapiens
ttaatataacatgacctgaagattttaaattactgaaaataattttgaaaatatgacacaggtaccctccttaatgtcttcccttagtcattctgtgagtcctgacataccaggtgcaatggtcaggatagaagaccgggctgtgaagactatatctggaggattcaacccctccccaaatagccagtaggcaacaggaaagcaggggagaagggagcatattgggcttggttctggcttgtagctgatggtctaggcactaagaacatgcctctaggccgggtgtggtggctcacacctgtaatcccagcactttgggaggccgaggtgggccgatcatgaagtcaggaggttgagatcatcctggctaacaccgtgaaaccccatctctactaaaaaatac

SEQ ID NO: 19044 - DNA, 505 bp, Homo sapiens
atttggaacactaaaacaccaagtagatgtgctcctaattattaaaacatcaacaataccatgaaacagattagacaggatagtataatatcaagagtcttagaatctaacagttttagaatcacatttggttttaaatcctcaatttcctcatttataaaaatagtactctgtatttcccaagttagctgtaagatttagatggtagtctaagtacttaacacaacgtcaagaatatattatctggctgggcacagtggctcatgcctataatcccaacactttgggaggctgctgcaggaggatcacttgaggccacaaggtcaaggccagcctggacaacatagcaaaatgccagacattaaaacaaattaaaaaaaaaattagtcaggcatggtggcatgcacctgtagtcccagctactcagggggctatggcaggaggattgcttgggcccaggagtttgaggctgcagtgagccatgattgtatcactgtactccagc

SEQ ID NO: 19045 - DNA, 437 bp, Homo sapiens
tcttagtccatatgactactttaaatgtatgatacatcacttgatgtactaagtatactatctaattaagtatgtctaattaataatagctgtctcaaagtaaactggaaaccaaaaggctactttgcccaatgtctgtttttaaaactactgacaaagaacatacagaaaggccgagcacgatggctcgcacctgtgattacagcactttgggaggccaaggcgggtggatcccttgagctcaggaatttgagaccaggctgggcaatagggtgaaaccccgtctctactaaaattacaaaaattagccaggcgtagtggtgcatgtctgtaatctcagctactctggaggctgaggcacaagaatcacttgaacccaggaggcagaggttgcaatgagccgagactgcaccactgcactccagcctgggtaacag

SEQ ID NO: 19046 - DNA, 582 bp, Homo sapiens
ctgataagggccttcaaggcgcccgacaacttgtttccgggccttgttttcagagattctccatttgatgtatcccggtcttgcagcccaggggtcagggcattggggaggggggaagcagggctgggtcgaggggcttctgggaagacttcctggaggaagggatgctggaagggagcgagggagggttagttgcagaagatggggtaggcattgcaggtggaagaacctgcatgggcagaggtttggagataagaaccttgtgacaggctgggggcaggggctcatgcctataatcccagcactttgggaggctgaggtgggaggatcgcttgagtccagaagttcaagaccagcctggccaacatggcgaaaccccatctctacaaagaaaaaaaaaaaattagccaggcagggtgcgtgcctatagtctcagctacttgggaggctgaggtgggagaattgtttgcacttgaccttgagaggtggaggttacagtgagccaggatcacaccactgcactccagcctgggtgacagagccagaccctgtcccaaaaaaaaaaaaaaaaaaaaaaaaaaa

SEQ ID NO: 19047 - DNA, 453 bp, Homo sapiens
tatgcttagagatactgtgagataataaagtctattcaaataatttaaatctaaaaggaagcctgataagttacctttaaaagtattatttaaataggtaaaagtaaatgatgacaccctcatatccatgattcagatttaacacttgttaacttttaccataagaaattactttttgcctgggcgtggtggctcacacctgtaatcccagcattttgtgaggccaaggtgggcggatcacaaggtcaggagtttgagaccagcctggccaacatggtgaaaccccgtctctagcaaaaatacaaaaaaattagctgggcgtggtagtgcacaactgtaatcccagctactcaggaggctgaggcaggagaatcatttgaacccgggaggcagaggttgcagtgagctgagatcacgccactgcactccagcctgggcaacagggcaagaccc

SEQ ID NO: 19048 - DNA, 530 bp, Homo sapiens
tatgaggacagagaagtttagtggctcatccaatgccacacctagtaaatggcactgccaggatttggtcccaaatagtctgacttcagtgctcatgttcttaaccaccctactcttaattcttcttctgatatttgaccagataaagatcactcagaaagtattctaagcctagaaagagaatttggaagcagaaatgagatgatcagaggaaagggatgttgcccatgaaaataaaaggagcagataggcctggcacggtggctcacacctgtaatctcagcactttgggaggccaaggtgggtggatcacctgaggtcaggagttcaagaccagcctggccaacatgatgaaaccctatactaaaaatacaaaaaaattagccagacatggtggctggtgcctataatcccagctttttgggaggctgaggcgggagaatcacttgaaccttggaggcagaggttgcagtgagctgagatcgtgccactgcactccagcctgggcaacaaaagcgaaactccgtcac

SEQ ID NO: 19049 - DNA, 450 bp, Homo sapiens
gaaatctgaatataaatttcaggtttatattcagcctgaaacctggatgactactgaactaattaagcttgtgtggtgaagaatccagggagcacataaaaagcatctcccagaggcataacgaaatgaacaatgttttcagctcctgctcagagacaggtttgctttatagtctgagtccagctatgttaaatcctttccattacaaaattctagccttcagaaaagcaaaagtgaatgcaatttccattatgtattagtcatattatatgatacaaagttaagaaatatgctaaacacacatagaaaaagtaaaatataacatagagggcaaataaattactagataccaacaccaatactacacagacatttcattctaaaaaggatcaatgatgaaaaggaaaatatagtcataatagctagaattttctttcagtaagtatatgc

SEQ ID NO: 19050 - DNA, 513 bp, Homo sapiens
atttaccttctgacctattataaaaagagcctgctgacctctgctcgccttacatgacatcattctagataggactctgggtaattgagttatttgtattggatttagacagaataggactgtaagtctgggaatgttatataagatgtttggccccagaggtgcattgcatcagtcattacccagtgggttactcaggagtattaaaaagtaactgttaaaaagcaacaagtatgagctgggtgccgtggctcacacctgtaatcctagcactttgggaggctgaggtgggtggatcgcttgagctcaggagttcgagaccagcctggccaacataatgaaaccctgtctctcagaaatacaaaaattagccaggtgtggcggcgcatgcctgtagtcccagctacttgggaggctgaggtgggaggatggcttgagctggggaggccgaggttgcagtgagctgagatcatgccactgtactccagcctaggcaacagagccagactctgt

SEQ ID NO: 19051 - DNA, 418 bp, Homo sapiens
caaaactctgtccttgtactgttctaattttaacatcagtaaagcatcattcttatttttgtttttaatttttagagacaacgtattgctattcaagcctctctgttgcccaggccggacttgaactcctaggcttgagcaatcgtcttacccattgtcccttgtgacagtgactttaagtgattcaaaaggcctttatagaaatgtcttttcttataaaacaagcatactaactagaaggggaaaagaatatttaaatattgacagtcattaacaggatcactcaaacactttgctctatgatgtttgactcttcttagaggagtgcagtggggtatcacacagcttctgctcaggtacaatcatgttttcaaaagaaaagggctgggcgtggtgacttatgcctgtaatcccagca

SEQ ID NO: 19052 - DNA, 114 bp, Homo sapiens
tgaacataaataattgcattatagttgaaatgtgtacaggcacgtgattcaaaatttgtttactcagataccagaactatttgattctttcaaataccatgcctacaattcaca

SEQ ID NO: 19053 - DNA, 465 bp, Homo sapiens
actataagtaatttcactgccaaaatagaccaaatgttgtcagtgcagaagtgagtagacaggagactagaatctactcttaagaatgtctcacaaagaaaggaagggggcttggagtaatgaaaaatgttgaacagaagagaaagaattagatttataggaaaaaaaagaaaagaaaaggaggggttggaagagtagtatataggagtgagacagtgagaagatatcctgatattatagtttcagaaggtatctccattctgtctcaagtgtagaaaacagaaaagagtgaatgtggttgtaaatgaccttaaacagagagagatggacttttttttatcatttgaaatgggaagccccaccctcacctctcaagtcatctgtttcccccctcctcccacatccacctgtcccttgcctctcaccaagtagaatgtgtgattaaaactttttcagcaagattag

SEQ ID NO: 19054 - DNA, 540 bp, Homo sapiens
ccggggtataaccttataagggggataatgaaacttaggcgatgtccaggaagataactctgtagtacttgaccaatgaggaactgggggaaggaattctgtgctaggagataaattacctgctgtaactgccctggttgtacctgcctaccagacacccgatcttgcaaggccaccattaaaagtcttgcttccggccaggtgcagtagctcacacctctaattccagcactttgggaggccaaggccaggagtttgagaccagcctggccaatatggtgaaacactatctgtactaaaaatacaaaaaatacaaaaatacatggacattgtccatggcaagcattcagtaaatagtcaaggagtgatttgcagttgaattggggttctaggccacaaatttccaagcatggtggtgcacacctatagtcccagctacttagaaagctgaggcaggagaatcgttttaacccgggaggcagaggttgcagcgagctgagatcacaccattacactccagcctgagcaacagagcgagat

SEQ ID NO: 19055 - DNA, 655 bp, Homo sapiens
cttcctgcctcctaatactcttcccaagaataagtgagatgcctccaatttcaccagtgagaggaaccagtcagttccttgagggaagaatagcatctagtaattcaccactatcttgtcaaaaaataacaatggcttcactgagtattaactatgctgagcactgcactaagcagttaactcgaatgacctctttcagccctcccacagcattaagggtaagtattatttagtcacccacattttacagaggaagaatgtagagtcgagagagatcaagtacctgcctatgatgacatgactagcaagtgactgagcaggaattccaacccaggccttaggactccagagactggtctcttcaccttccttccctccctggtgtccccatgcctgggacaaaataatatggaaacatagcatgtgctcagcaaatattttttgagtaaatatttatgcggatagctaagctgtcgtggcttgtggtattcccaattttataaatcaaaacaaattgattacatctagtatatcataaaacagtctgtgaattacttgcagtactagtctgtactagttctgtacaaagaataagaagggagcagcaacttaacacctcttgagtagaaaatttgagactcttctaaatgctgga

SEQ ID NO: 19056 - DNA, 395 bp, Homo sapiens
gactaagaccattttaaatagtactggggaataacttcaaggcaagaaagtgaatgaaaagctctatgtattttgaaactatgagagacctataatcccaaacctcaatctaatgtgaaagttaatatcaaattgagatgcaaagctggcagaccattattcgttgaaataagtgcatatgctgatgaatatcaagaggacaaaagctctcatttgatcccagggagataagttatagacttatggtagcagtttcctggacccagataagcatatagaaagaatgaagaggggaaggcagaatgagtcacacagatgagccatgtatgtgcaggaggaaggtattgagtgtagtattgggtgtagtaaaaggtattgggtgtagtaaactctac

SEQ ID NO: 19057 - DNA, 521 bp, Homo sapiens
gctggaggtgacaggcctatacttgattatgtcaccagctgtgatattttaatttttcataacatcttaatcctgtcattcccaggagaggatttgatcagcaggaaagagggatgagaagtttggggtggcagaagccctgggcctttcagtagcattgactcttataaaaagccttttgaccaggagtaaaagggcggagagcagtgggaaatgacggcatccaagtgagtgggggtgagagtgggtggggaggggtgagtacttccgttggcataacagggtccttggctggctttagttctgagttacttgttggtaggttttaagaattgatggagttaaataattatgagacaagatcaagtaaataagcaaagaatattgtttttcttagatctgtcaaagaagccataaggtctcctacctagacagtctttctagaaatattgaatttctctttattatttctgaagttaaacaagaataaatttgaataattaatgcattggtctctctct

SEQ ID NO: 19058 - DNA, 681 bp, Homo sapiens
acaatccgtatttgctcttacacaggagagatccacaattgcaacttgattgtaatcctcacctgggaaatctgaaatcaccacctgttttctttggatgcttgtgtgacacactccagttgctttctacagaatttagaacattcatttactccagtggatacacttggagctttactcaattcgattcattttcattaaacaactgactcaccagactcattagacctatgcaattcactatgtttcatagtcacatctttacttctaaatatatggtacaaacattgcttctagctaaaggtatattttcatataaatgctgtaattgtttgcccttcgttaaaaaagccaagatattaaatgtaagaaatagtctaatagtttgttactacgcagtcagttgtcttaagaatactggagaaacagaacatgtgaaataacatcaaccactccaaattctaatttacttcatatgagctcttctacattaaattccaaacatgttaatagaaactttattttttctattcaatattctaaaatatattgtaagaattaaagtaattttaatagacaaaacctaataatgtagacttacgattatctgcaatgtaaaatagcctattctacttttagcatttcatctcttgaaattatatgaatcatcatctgctactt

SEQ ID NO: 19059 - DNA, 536 bp, Homo sapiens
tatgtaccagagatagaaaaaatattataacagtctacaggtgttgcattagtgttgtgtgcttgtctttacaactaggcagataaataaaaacaaatatgtttttaaaattccaacatgtggtagtttgaaagtgtgtctcagcaagtggaatcataaaatctggctcaaattttagataaatttggacttaaatataaacacacacatgcttctagatgaattagtatttttattgtaatacgaacaactataaaaataaccaaaagtggtatatcagtgaccaaaacagaaattctttacccatctttttctctcagctctctgcttggaataaaattattgccaatgtagttaaagtttcacttggtgttagtaaatgaaataaattattatgccaatatctttgactaagacagttcagtgattcattaggcaatattctggatgaaacctcagacaacacagacattaaagaatgcttgccagctattaaagcctgaactaaatcctcatcatttttcccttcccgtgga

SEQ ID NO: 19060 - DNA, 490 bp, Homo sapiens
tcagacagagagtctgaagtttttccactgacagattagggcaaccagggacccacacattatgacctgtcatagtgttgcaggtcacagtacatacctgcaatatgccaggtcctacaagctttagactgacctatttaaaatcgttgtctattaatcagtaaagctcaaaaataaaataaaacaaaacaaaatagttgtctgcccaggcgcaatgtgctgtgacaaaggaccctgcctctttagttttctttagtatgagactttgagctagcctacttgggcccaggttcttcatgtgcaaaatgcgtataaagggaaattctggtgagaattaaatcaggggatgccaaagtagctttaagttttgttcctgccgcacaagtgccaaggattaaaatgattacatatacacacatttccatcagtatgtttcttaaacatcagcaatctgattcaattaacttctggcagtttaccacagggagga

SEQ ID NO: 19061 - DNA, 259 bp, Homo sapiens
  misc_feature 216: n = A,T,C or G
ggtcttccagggtgcaaccaagggggtggataaatctcctaatttttggctggccatcaatccctgttactgtacaagagcaggaagacagaggccctgagaaatgggttacaactgagtaggctgctcccatgtccattaagaacccagtatttttgcctgccgtttccagggttaccaaagactcctctatggagatggtaaggtgtccagtangagttgtagaggaccgcaggccccatcagtcctatgctttctt

SEQ ID NO: 19062 - DNA, 533 bp, Homo sapiens
catttactgagaatcaacaaaggtaaattctgtaccagataatttacatgtggtacttcacagcatctttaaatatagccttctgaggtattattatcccccattttgaggattagagtttggataacttattcaaggtcattaggattcaaagagaagcagctgtgttatacccagtttctgaacctcatgaagttcatgtgctttccactgtgcaacaaaattaagactggggtgagtaaaagataagaaaatgaaccctaaatgtagttggtttatatcacaagaaaactacagagtcaggatcttgatgctgaagctgtagcaagtagaataaagctttgtaaagtgttcttgaaatatcaccacactaggctaggcacagtggctcatgcctgtaatcccagcacttagggaggccaaggtgagaggattacttgagcctgggagggggagtttgcagtgagccaagatcacgccactgcactccagcctgggcaacagagtgagacattatcttaaaaaaaaaaaaa

SEQ ID NO: 19063 - DNA, 344 bp, Homo sapiens
tcttttacataggctggtgttgagtgcgatgagttcggtttttgtccagttggtggaattcaccaacctcagagtccatatgatgatatctaaatgctgtgctcacatcgagtaatttgtatttccaatgattgatatttttacataaatagtcaaaggagtttagcattttcaaatgcagtaaagacctgtactccgaattccctgaaagcaggaaatatttgtttctaatgccccaggagcttgcatggtgccttacacacagtaagcactcattaaatattaagtgagtgaataaaagaatgataatcgaggcgggcgaatcacaaggtcaggagatcgag

SEQ ID NO: 19064 - DNA, 429 bp, Homo sapiens
ttttccattttgtaagaagatgttaatcaaatgggaaaatttatttaacattaaggggggagcaggttgtaaaacagcgtgtacatggttatcctaattttgtttaaacattagtagggaataaaggctcaaaggataaacaaaatgttaacattgtttatcaccttcaaagtaaagggactgtgggtgacatttttctatcaggtgttttatcttcctgctttcctttctccattccccatcagaacaaactggcaatgtattttaaactatattcacaaaatctcattcctatttgacatttcgaatacagacagtccctgacttaggatgggtcaacttgattttctgactttacgatggtacccatacaaccattgtttttcatttccactacagtattcaagaaattatatgagatattcaaca

SEQ ID NO: 19065 - DNA, 78 bp, Homo sapiens
atgtgtattataaaaataaatttttgacaatgcaaatcaaggtacagaaaaccaatattcaaactgcaaatattcact

SEQ ID NO: 19066 - DNA, 539 bp, Homo sapiens
tttacatggagtcttgctctgttgcccaggctctcggctcactgcaacctctgcctcccgggttcaagaattctcctaccttgcctcctgagtagctgggattacaggcacatgccaccattcctggctaatttttgtatttttagtagagacgaggtttcaccatgttggtcaggctgctcttgaactcctgacctcgtaatccgcctgcctcagcctcccaaagtgctgcgattacaggcgcgagccaccggtgcagggcctaagtgatttcaatcacacttagtctaagtggatttacttaaagtttctatgataaagaatgtatgatatggaacaatagctggaaaaagttataatgcattcataatatgtttttcacgtattttaaacaataatgcatcacatattttggaatatttacttcagtaaatactttagtctctttgacctcaatggttagcttctagaacaaatactttaatgagatgccccaaacacttagctcttgaagaaactctgtgactatcacagggagc

SEQ ID NO: 19067 - DNA, 579 bp, Homo sapiens
gccaaacatcaagtgtaattcaatgaaacaaaatcctgaatcaacttgtgataattgtagtgtttcctgacaagacaaattggcaagtttgaaaaacaagaaaaaaaaagatgtctgattataactaatgaatgatattcatgcctttaaaaattacacacacatgcacacacacactcacaatctattatcacaagactgttctctctctgaagaatcaaccatctttctgtaagatgcttcatcaacctttcacattaactgcctttggagtaatattatatacttactttttcctagacagttgtgaaaacagggtgcagtgggtcaaaggtggtgtcaggggtttatgttcagattttgcatatttttacaaattgcagcaattaactagttcattactgtgttgatttaaattcttacaaaagcttccagacaaaaataaacactcatataaccatgaggaaaaaattcagaatagaatggagtccagaaataaggccacacacctatgaccacctgatcttggacaaagctgacaaaatcaagcaatggggaaaagacttcctattcaataaa

SEQ ID NO: 19068 - DNA, 588 bp, Homo sapiens
agatacacatctactaatgtgtaagcaatatatacactatattatttattgtgacttttttataatagaaagatattgagaagaacttaaagatccaaatagagaagattagttggataaactatgttacacttccgcaatgaaatactatgtagtactagaactaaatgacatggatctcaattcacgggattaagggcgggggttggcctaggtgaagagcagtatgtatgtttctttttgtttaagaaacaggagaataataacctatgcgtttatttttgcagaaagtaatacagaaaggataaatcaagacttaataaaaatgtgactgggcatggtgactcacgcctgtaatcccaggactttgggaggtcaaggcgggcagatcactagaggccaggagttcgagaccagcctggccaaaatggtgaaaacccgtctctactaaaaatacaaaaattagctgggcgtggtggtgcgcaccttaatcccagccacttgcttgaatctgggaggcggaggttgcaatgaactgagattttgccactgcgctccagcctagtggactgagcaagactctgtctc

SEQ ID NO: 19069 - DNA, 240 bp, Homo sapiens
ggggcaggtgtggtgggaaagaggccatcattacctgaaggtggcctgggctatggcaggccagtgaatgggactccaggcctggggcttttgtcagcatccttgtgcccatgccgtggtggcgggctggactcctcacatcttccacgccccacccagttgctgagaccttctcccaattcatctcaccaccccaagccctctcaaatatctcccaatccatttccactgtccctgcct

SEQ ID NO: 19070 - DNA, 542 bp, Homo sapiens
tctgctggatttttcattttgttttatgtcttttaaaaaatagctattttaggctggatgcagtggcacacacctgtaatcccagcactttgggaggccaaggcgggaaaattacttgaggtcagaagttcaagaccagcctggccaacatggtgaaaccgtgtctctactaaaaatacaaaaattagccgggcgtggtggcacatgcctgtagtcccagctactcgggaggctgaggcaggagaatcgcttgaacccgggaggcagaggttgcagtgagctgagatcacgccactgcactctggcctgcgtgacagagctagactctgtctcaaagaaaaaaaaagcaattttaaattctgtcaattccaatatctgcgtctcttgtaagtccactgctttcctcattttttctcttggtttttgatcttctggcatattctgtaatttttaatggaatgctggagaataaaatataaaatatattggagataatttgagggcctgaatggtatatttcctctagagaagaagtatgattc

SEQ ID NO: 19071 - DNA, 479 bp, Homo sapiens
caggagaattgcttgaacctagtaggtgaaggttacagtaagcaaagattgcaccactgtactccagcctgggcaacagagcaagactccatctaaaaaaaaaaaacaaacctaacattagaatagaaacttaaagaaaagatcagctgtgagttccagggagagatggtcttctaccttggaatggcaaactgggacctgtcttttttttttgtccgcctacccccatgtgcctccccttctcccactgggcttctgtccaaagcttgggggacacagggaatacaatttggggactggaaaaacccagcaaatcctctagtccaaaagttcttcatgttttgaacttcacagggcaataaaataaatgtgtcttaaaaggaaaacaaacagagggctgccttagttatatttttcaatataagagcaatggccacctccaaacacaaaccaacacaatcacccaccccccaaaccac

SEQ ID NO: 19072 - DNA, 550 bp, Homo sapiens
tacaggctcatgcctgtaatcccagcactttgggaggctgaggtgggccgatcacttgaacccaggagtttgagaccagcctgggcaacatggcaaaaccccatctctacagaaaatacaaaagccagatgtggtggcgcatgcctgtggtcccagctacttgggagactgaggtgggaggattgcttgagcccaggaggtggaggttacagtgaaccaagattgcaccactgcgctccagccagggtgacagggtgagaccctgtctcaaataataataataataataataacaacaacaataataatacctattgttctgattgccaatctttattgtttataatctgtttcatgtttagagacttttagaggaggctgtagagtctcctactgtcttctgccttactgtttaaccaattcatggtgaggaaactattctaacctaatctttcttgctgctaatgaaccagctcttaatctgtttattttaatcaagaatagcatgggagctgggcatggtggcactcacatgtagtcccagctactc

SEQ ID NO: 19073 - DNA, 581 bp, Homo sapiens
ggtagttcttaccctggctagttgttggtaatagagattggttctgtgctctgcccctctctgtgtgttcccttgggtagtcattccagatcaatttgctgatttataatgctgtggataataatgcttgctttcaccaagccattgtagaagatgaatgtttactgtgtgtttaagattagaaggtaaaaggtggtatgcaatcagaaatggtgtgttgaaaggttattaatgacgctcaaagctaagaggagagggacaggcaattctctttagggctcagtagcatttaatgccaggcaggagcacacttatttttagatatacatttccctgttcattgaagacaggattcataaagaaaaacaatattttgacatgtaataggattacaattttttagaaattaggttaaaatcgtcaagaaaaagaaacatccgaataaaggtcagatgcgaggctaacacctataatccaagcaatttgggaggctgaggcaggaggatctcttgagcccaggggttcaagaccagcccgggaaatatggcagaaccccatctctacaaaaatatataaaaatc

SEQ ID NO: 19074 - DNA, 551 bp, Homo sapiens
cagagcaggcttcccagacccgggtaatgtctcctgggctgataggaagccctcaaccccccaagtccttgtcagccataaaccgcctgagcacagagccagagggaccatgttggggctgggcctcccgacttcagttcctctcattctgtgcaaaggaaaaacaattcagaatctacagaggtttagacgtgtgtagatgtggacagagaagtccgggcacagtggtttactgcccaagaagacagtgagtccccggaggaatagaataatatacatcatgctaatatatgtcatcccagtactttgggaggccgaggtgggtggatcacttgaggtcaagagttcgagaccagcctggccaacatggtgaaacaccgtctctactaaaaatacagaaattagttggctgcaggggtggatgcctatgatcccagaaactcgggagacagaggcaggacgaactgcttgaacctgggaggaggaggttgcagtgagctgagatcatgccattgcactccagcctgggggacagagcaagatcccgtctc

SEQ ID NO: 19075 - DNA, 526 bp, Homo sapiens
aatgaattaaagaaaattcttttaagttcagaggattcactaattcccaggtagaagcaacagaccctaattcagccacattctcattcaaatatttttctaattccaaagataaaacaaataatgattgtgtgtgtgtattgaggagatacaacagcaataaaattcaaataaaatcagattgcctaaaagaggaaaaaattggcttgatgtgaaagctctcttttataatgctgaatggaataatgtcccatattttgagaagaagaaaatatgacagaactttataatcagtcaaactataatttgtaggagaacaacagaaatacagtcttggacatataacacgttaaagaaaaagctttaaacaaaataaatttgttaacagactttctttgagcaaagaaagattggtgaatgggcatcactcagaactggaagaggttccaagagctctgctgcaatagcataagcagtgagcttttacaggttgatgtggaagtaagagaaagaaagcctatttgat

SEQ ID NO: 19076 - DNA, 576 bp, Homo sapiens
cctgtgctcaagattaaaaatgagttgtgaaacaagacaaacaagtaaaaagttatataacaatacgagatacaaatgatattctaggacaataggacagatgacacaaggcagccaattattaattgccatctggattgcatacacaataattgccaaaaatgtccagaggagggtgaggtcttttcaggctagctcaatcacggcaggtatttatgaagaggacagaatttgatatgggtcttgaaggataattcagatgatagatttagagaggaggaggacatatttactggcaaaaattcaatgtaagaaagctaggccaggcatggtggatggcgcctgtaatcccagcactttgggaggctgaggtgggcggataatgaggtcaggagattgagaccatcctggctaacatagcgaaaccctgtctctactaaaaatacaaaaaattagccgggcgtggtggcgggtgcctgtagtctcagctatttaggaggctgaggcagaagaatggcgtgaacctgggaggcagagcttgcagtgagccaagatcatgccactgcactccagcct

SEQ ID NO: 19077 - DNA, 554 bp, Homo sapiens
ttacaccttacttttcaatatagtctttttttaaataaaaactcctcaagtatcaagttcttattataatcttccagtatacttagtacctgatacagtccctgagaacatagtagacactcaagataattctgtgaaatgaataaatgagaaaatgaatgggttattttaaaaagataacatcaattttctcctaatagtgattactgttctctttgcattcaccctttatataataaccgtggccccttcagttcagagagaatccatttaataattccacaaatatacagcaagtgtctttatgaggctctgtagggactcggctagtaataaattctatattcctcaagaatcttttatcgtagctcagcttcttctcagccatgacccctggaaggtccatggaggggcactaggaattcacacatcttttctacatgcctaagtacattatttttctggggaaaaatttcagagctttcaccagattctcactaggggacaaaattcaagaaatattggacacagtaataccaacaaatacactcacc

SEQ ID NO: 19078 - DNA, 617 bp, Homo sapiens
ggccaggctggtttcaaactcctgacctcaggcaattcacccgcctctgcctcccaaagtgctgggattacaggcgtgaaccaccacacccagcccaccccaatagtttcatgactgttatgtaagccaaaattttgaaaaaaggataatacccagtgctgacaaggacatgacaaaactatatgcacacccattaccagttatggcactggaaattggtccaatccttctggaaatcaatctggccatttggggaaaagcctagaagtgttaaaaattgatgagaattttttccgctctttgacaaaggctagacattcattacagcattgtttataaaggtggaataggagcaatctaaataccctccctcagaataaagcctgaggtctccacttaatgaaatgctatctgtaggctgggtatggtggcccatgactttaatcccagcatttcggaggctgaagcaggaggattccttgagggtagcctgggcaacagaacaagacaccatccccacaaaaaatttaaaacttagcccgggtgctaattagctcagtagtatgttctcatagtcctagctatcaggaagactaagatgggacgaatgcttgagc

SEQ ID NO: 19079 - DNA, 519 bp, Homo sapiens
agtttacagtggagttaataaacaaaattacaactgctgcccattaaaaaaaacaaaacaacaacaacaacaaaaaaacgcatgtcaaatggttggagaaggaagagtttaatacatttactgatattctgaacaactgagaattatcatagatagaataaaagggttctcaatttatcaataagtagacttaccttaactactttacatatatatatgtaaaccaaaataacaattctattcattcagaaaatgtttattgaggaccagctatatgctagtcacaaagtaactgacaaaagtcctgtcctgggcagggcacagtggctcacgcctgtaatcccaggacattgggaggctgaggcaggtggatcacttgaggtcaggagttcgagaccagcctggccaatatggtgaaaccccatctccattaaaaatacaaaaattacccaggcatggtggcacatgcctgtaatcccagctatttaggaggctggggcaggagaatggcatgaaccc

SEQ ID NO: 19080 - DNA, 509 bp, Homo sapiens
ttgccgaattcagtacgagcttcttgagaaaaaaactgtcttacttatttctcggtgctttgcactggacctgatatttaacaagcactcaatatttacagaatgaatgtgtgagactcttttaaatcagtatgtagtcttagctatgcagatttataactacagagtgaaaaaaactattatctagaaattagcttaaagaactaagagtgaaagaaattgaacatcttaatttagccttacctagaccctgtggaaacccacggccacagtatacataaaggtcctccaaaataatggacagaccattcctttttcacaaaggtcctactaaacaagcaggcaccacgtgggcctatgcttgtaatttaatcctatacaggaaggcaacggtgttctgtctcacaggtctgacatacttcacccttttgatagaaatacctcacactgggataacccaaagattccaaatttcacatgcttacagcttctgatccctttgatagagc

SEQ ID NO: 19081 - DNA, 462 bp, Homo sapiens
gagctcaaggctgcagtgagccatgccatggcactctagcctgggtgacaaagtgagaccccatctcaaaaaagaaaaaaaagaaaaaaagacacatgtctatatatcatatacatgtatcatggtagcaaaaaatcacttgtttcttcagttgtttctacaatggaaagtttcaaaaataaggaaatttagaataaattatgatatatccggctgggcgcagtggctcacacctgtaatcccagtactctgggaggccgtggggggcggatcacttgaggtcaggaatttgagaccaccttggtcaatgtggtgaaaccccgtctctactaaaaatacaaaaattagctgggcgtggtggcttgtgcctgtagtcccggctacttggggggctgaggcaggagaatcacttgagcctgggaggcaggggatgcagtgagctgagatcatgttactgtactc

SEQ ID NO: 19082 - DNA, 561 bp, Homo sapiens
tattgaaaaatgatagctaatggtagaaatacatcactaagatgtcttggattttcttttggggaggagaggtgggggaataaaatgaaaaaaatatgtatatggccaaattggtctgtgataccattaattcatgttcattaattcaaacagtgtacattgcatacctactatgtgctaggagttgggttgtactccagaaataaaaagtcaaataaaacgtgtttccctcaaggaaactatgttctccagcatctgcacatgtaaactaccaattccagtttagtatgacaaactctttggaagtattatattttgaatgtatttcatcgagaaatgaatgcgggccaggcaaggtggctcacatctgtaatcccagcacttagggaggctgaggtgggtggatcacctgaggtcaagagttccagaccagcctggccaacaaggtgaaattctgtctctactaaaaatacaaaaattagctggaggtgttggcctgagcctgtaatcccagcttctcaggaggctgaagcacaagaatcgcttgaacccggtaggcag

SEQ ID NO: 19083 - DNA, 365 bp, Homo sapiens
aaatgtgatacagtttaacaaaacccattgttctgtaactatacatagattttcaaaatgtcataaaaagtgcagttatgaattgttaacatgtcaatacacagttcctttattccagcactttgggaggccgaggcaggcagatcacctgaggtcaggagttcgagaccagcctggccaacatggtaaaaccccgtctctactaaaaatacaaaaattagccaagcacggtggtacacacctgtaagctcagcacttgggggggcctgagacaggagaattgcttgaacccaggagacaggttgcagtaagccgagatggtgccactgcactctagcctgggcaacagagtgagactccgtctc

SEQ ID NO: 19084 - DNA, 493 bp, Homo sapiens
  misc_feature 383: n = A,T,C or G
gagactggataaagaaaatgtggtacatatttactgtggaattctacacagccattgggaaggacaagatcacttcctttgcagcaatgtgagcgtagctggaagccattatcctaagcaaactaatgtaggaacggaaaaccaaataccgcatgttttcacttataagtgggagttaaacattgagtatacatggacacaaaaaagggaacagcagacactgaagcctacttgagggtggagggtgggaggagggcaaggatcaaaaaactgcctattgggtactatgtttattacctggaggacaaaataatctgtataccaagcccccatgacatgcaatttacctatataacaaacctgcccatgtatccctgacctanaacaaaagtaaataaaaaagctaacaaaaaatagagcaagataaccaaagtcagcagaagaagagaaataataaatagaagaaacaaaattgaaattgaaaaacaacgga

SEQ ID NO: 19085 - DNA, 518 bp, Homo sapiens
ttgttacaaatcacattggcatttaactgaacaagtaattcttgcctttttcacccactttgagttaaggcacaccacctgcaggaagaatgaactagcatctggcccctgaagatcactttggatcttttcctcgtttgcctacctgccttcccatgaggatcttgacaacaccttccccaacaatcaccatgtatccgttagcttttctcccctacaccagctctctctggtaccatatgaatatttttctgtatatattagtacatttcagacagaatttgaagcacagttcagctcagcacttcaaagttgacttcttcaaacacagtggaaaaagtcagctaggaagaccatgggttagttctggtctcattgcttaatgaccatacagccttgggcaagtctatatttcacttgaactcagttttctcatctgcaaaatgtgattaattcctgtgctgcttctctctaatgctttgaggatagacatacaatttgagtgttttcaaagaatt

SEQ ID NO: 19086 - DNA, 462 bp, Homo sapiens
tgataatttacttaatagccctaaagaaaaaaatctcaagggaaagttggggtcacatgaatggttattcgatgaccagtaaattcaattgtgctggatggtcaagccttggtcagcaccctttgggtagaaatggaaaaatctcttgcacacaactgcctgaaaaatctcaattttggtgtcattcgtttatatattcagttatccaaaaatacttcctaagcactttctaaattctagcattgtgctactagggaatgaccatcgcagacatgaaagaaatggccctgccctctctgaaggaaggtagctgagctgtgcctattatttgaaagaagcgaacaaatggcctagaaaacctgaggagactggatccaataggtaaacaatattgatacgaattctaagggcaattacaaaaatttaatgacattatatttctatattaaatataacgtggtc

SEQ ID NO: 19087 - DNA, 388 bp, Homo sapiens
tggtgaatctcactataaccctgtgaagtaggaactatcactctacccatttcaccgatggaaaagcctatctcctgtgaggctgtggcttgccaaaggtgaaatagccaggaagtagaacagccagggagtgaaccccaaaagccaggtgggagcccatttcccctgcccactgcacgagacccctccccggtttgaagatccgataggggcactgctgttagctccccctgcgtcctggcagcagcacagtcagcagatggtcactgtggagaaggcggagctgaccacctccattttcctataagggagctagggccaggagaggtgcgttcacctggggaagtcctgcagcatcaaactaaagctccgggccaccctctcccag

SEQ ID NO: 19088 - DNA, 642 bp, Homo sapiens
aagaggaaatggctcctttgttctttattacaaagtgttttagggaaaaatagaaaagggagaagaataagtaaaaagagaagatacaggaaatttataatcatatcttttttcttcattgattatgaaagcgaatatatcaagtagctcatagatatttgttagagggttgatccaggactggcctttattggagtaggcaagaagatgggatgtaagatcttctgatccgaagttgaacatcaggtgcttttcccacagagactctcaggggaggactgcataatggttagaagtgaggactctgactgtgacaacccaagtttgaattagttcatgtctctgtgcctgtgttccctaacctataaaatggttatgtacctctaatatgtataagataattaaacaaattactgtatttaaaagcacttaaaagggccaggcgcagtggctcacgcctgtaataccagcaccttgggaggccgaggcaggcagatcacctgaggtcaggagttcaagaccatctggccaacatggtgaaaccctgtctctaataaaagtataaaattagccaggcgaggtggtgggtgactgtaatcccagctactagggaggctgaggcaggagaatcgcttgagtctg

SEQ ID NO: 19089 - DNA, 456 bp, Homo sapiens
taaacagcatcatatagtgtataatgaattacaatttgttattatttaacggtgcaattagaactttttttccccacatattggtacctgtaagttaatatcatcctctgtaattattatatagcaatctttagataaactgatttattagttgcctatcaatttatacgtagtaccagggatggatataaagaatagaaacaggtacagctgtggagaatgcaaccatttaagagtgggacagaagttatctctgcagactgtctggagaataaagaaacaaaggaacagaagctacttggaacagaggtgttgatggaaatgaagaaatagaagtccctaaaaggggtcaggtgctgtggctcacacctgtaattccagcactttgggaggctaaggcaggtggatcacctgaggtcaggatttcgaaactagcctggctaacatggtgaaatt

SEQ ID NO: 19090 - DNA, 533 bp, Homo sapiens
gtggttagtcttatggtattacaagcaattctattgtacatcctactacacttgtctttgcacacacatattggagaacaaatatccagtaatagaatttctggatcaagtaaatgatatcttcatttcttatataaatattgctacttttctcaaaagaaactgtatgacccaatattcttttgcaccccatttatcatattctatttaatctaatgcattatttatttcagcaaatattttgaataccgactacatggagtctgctaggtgaaaatgtacatatttgtggggtgagggttttgacagaacatctggtaattgggtgttattgaagtaaattaataaatttgaagactatctatgagagtcaagcataggccatttttctgttcatgagaaggcttaatattaatgaaactagagagaaatgccaattaccagccactagaatacagataaatgaagccttttcttctttgtggtgattgtttaaaattaatgagaagaggcaaagaggtcattatttcaaa

SEQ ID NO: 19091 - DNA, 539 bp, Homo sapiens
tttagtagagacggggtttcaccatattggtcaggctggtctcttaactcctgacctcaaatgatccactgcacccagctcattgtaacttattaatgtggctactaggaagttttaaattgcatatgtggttcccatatttctgttagcaccgctttagaatattattttgaataacatccaaatttcagtattagccaaatgattatcaaccaatattgttcagtctggacttagttctatttgactaaatcaactaagtacccactggtttgttaataatttctagagtgattatgaaacaaaataaagctctgaactagaagttgtagaagaagacaaggagggcactgccaaaatcataaaatacagtcctctttctttaaaaagcttacaaccgaagcctggaaagacagagttgaaacacaacaggttatgttcaaggtcaaaacataacacaactgaattacttttcttgagaaacaatggaaagaagattaaccagctgggtgtagtggctcatgcctataatcttagca

SEQ ID NO: 19092 - DNA, 576 bp, Homo sapiens
ctgggattagaggcatgagccactgtgcttggctgtttgtttttaaatttggagtaatttcagcataaatcttccaaccccatccatccctaggtcctcagcatcattttagaaattacatgaccatgtaatgcaactttttgagaacttccaggtgctgttacaaatcaaacactttgggacttccattataatgacaaattatccaggaaaacatgaaatgaaaaaggtttctcaactagtttttgttcaacactttgcttaataattggtctcatcaatttatcaatttactgaagtaagggatgttttcggtatataagctcatttcaaagaagaccaactgagttatttaagaagcatttttaggtctggtgcagtggtgcacacctgtaatcccaactacttgggaggcagaggcaggagctcaggtttgagaacagtctgggctattaaatatagtgagaccctgactcaaacaaacaaacaaaaaaagttggttttgttttttgtttttgagatggagtctcactctgtcacccaggctggagtgcagtggcatgatctcagctcact

SEQ ID NO: 19093 - DNA, 457 bp, Homo sapiens
caaatataatagggtatacggcaaggggagagaggatggctaagaaaagcatttggccccagtgaggctcagggacctctggaggctgccagctcccacctcgtatcctctgcccatctgaatcctgctcctcaggacaaaaagtggcttatagcaacttgtagcaacttagagcaggtgggacaagtagctcatagggttagagtgtgaggggggtaggtaagagctcactgaagacggaagctagaggacatcctgaagctgtgggaagatgttagggaattttcacaaaggaatgatagaaatggatttccaaccagaagtatgtgtgggtgtcaaaggatggaccccatagttacaaagttgtggagtgttcattaacgagagctggggagggaagattgctttcagctgctggatcaggtagtaggtttgcttaaaaatattaaaaagggaa

SEQ ID NO: 19094 - DNA, 500 bp, Homo sapiens
gtgtcatctttactgcttggttcatagcttaatctgcatgaaaacccttagtaggaaaaacagtaaaaatgcagctggattagtcataaataataatcacttccatttacataacgcctttgaaaaggtccctagaaactcgctaacttttgaagtcatgcatcagattacaaaagcaaaacgttttgctaatgtgatgttgaggttacaaatttaaatacattgaggtcaccaaatgcaagaggtttggttctcattatgacatctcgtccacataaacatgctattgttcttaatattctttatttaataattcaactgctactgaaaatattttgtctatctaagtatttagcacaacaaaattgaaacattgtgggattgttgtcttctacgtgttgctttttaaaattatagcataaactcggtccaatttgaattttgattgttgcctacagttatgaatgaaatgaaaatgctgatccagaagacaaatagaa

SEQ ID NO: 19095 - DNA, 582 bp, Homo sapiens
gccaacttactgccccacttctgtttccagaagtcacacacactagagtcagtttcatttctttgtagttaccctttttgcaactacagggctattacaaagtcacctgaggccactactttaaacagaaacatagtactacaaagccctagaatctaagacagccccccaatctgagggtcatctcagtccttgacactcctttctttgttaattccacaagaagaagaaattatagagctggcaccaatggtggcttcagcaccaatagtaaagggctggaggcaattgtaaacatcacctccacaatgaaggtaaccttattactcatcacattcaaagtgcagccctaaagaaaataatcacttcttattccttttctcgtatttttttcttggccactcattttcagctgagtgaagtattctactatgtgaaaatgattactagaaggaggtgttaggagagagaatgtttataagatatcttagtaagaaatgtatacttttgcctttgggaaacaaaggacaactttgttgctgtgtcaaactacttaatactcatacaaataaaaatatggct

SEQ ID NO: 19096 - DNA, 543 bp, Homo sapiens
aattaagcaagttctcagtcaattaaaaaagtaactttcacctcaaccagctctgcaaaattcagttaaaccggagaggaaacagaagagacagctagttttgatatagtcttattaccctatagtagattagtgattctggtggcaaaaaatgcatgcctgttacgcatgtaggagaaagcaatgtttacaatggcctggacttttgtcataaattttcaatctctaaatgatctttgtattctaatttaacacactgtgattcttcaaaattatagttttgcaaagttgaagagttaagcaaatgccaaagccacaaattcaattgttacagtgaataaggcagattaatatttaacagttcattttcttgcaggtgaaaagcaaagaattcacagcaacatacctgcaagtctcacatctccagcctcaacatccttgtaagttatatttgaaaaaagaaaagtctccaatatctaaactcattttccccaaaagtcccactcttcaatctctatttgtctcaaagtgaccaaatctatc

SEQ ID NO: 19097 - DNA, 627 bp, Homo sapiens
gaggtgaaccccatcccccaggagacctaaactttggtgaggaccagccctaagggaaggaggaatacagcttgccaaagccaccccttgggtcaaaggaaacacgatcactatatcagctgctgaaaggggcacaccaaagcctgggaacagattcagagaggtggtcatctcttgtcctctgtccccttcctagtgcactgctgcagatccagcagtggtcatcctgttggggcccaaggaacgtgggctgaatgaggctgcttcttaggtttctccagcagctctgcccctgctgaagactagtacacactgggacagggcacttttggcattttgtcacttctgcacctgtcgaggacaagtacacagaggagaagaccctgcagccagctgttactcttaagcactgtctactggactgaagcctgaattacaccaccaaacaaaaatacatcaccacaccaagccaccacaggagcctatctgcaaccaaggagcttgtacagagccttggtcctctgaaagtacccagaaatgaagcaaaatgatcctatacaacatagaccacagtcatacccttaagagaaagaaagaatgaaaaaaaaaaaaaaaaaaaaaaaaaaa

SEQ ID NO: 19098 - DNA, 448 bp, Homo sapiens
cacagtgtcatgcctgtaagcccagcactttggaaggccaaagcgggcagatcgcttgagcccaggagctcaaaactagcctgggcaacatggcaaaaccccgtctctaccaaaaatgcaaaatttagccgggcgtggtggtgtgcgcccgtagtcccagctacttgggaggctgaggcaggacaatcgcccgaactcgggaggcggaggttgcagtgcgccgagattgcgccactgcactccagtctggacgacagagccaacctcgtttccaaaaaaaagtgagttgtgcactgggtcgccaagatgtcgttcccaaagtatactccttcacccctggccactatgccctcaaaccagccgaataggacatgtcttcggaaacccagcgggcgcaagccaagtgattgaccattaagagcctggctgaaacctgcttaccctaact

SEQ ID NO: 19099 - DNA, 451 bp, Homo sapiens
caccttggcttcccaaagtgctgggattacaggagtgagccaccatacccagcagccaccataaacttttaaagcatgagcagtcagaaataagctaacactgccaacaggctttcctgttagccacagcactaccactttatttctatgtcagctattgcttctggctagcatttgtaaatgtatgtactgtaggctgatgcattaaattatgaaaaggttaaattatgaaaaagaaactttccacataaggatggccatttgatatagaaagagtaacacagtttacctcaggtagaactaagtaaaaatcaggcaggatggcagtgagacgcagtgggtcataaaaagtgagagctttggagcttaaaatacctacatgtgatatcagccatctatctaagtgatattgggcaagtgactattctgaggctccttagcttcttatcag

SEQ ID NO: 19100 - DNA, 108 bp, Homo sapiens
ttgtttgacacagatgtttctcccagtaaagagaggataaggagctggaactcgtggcacagttccctacaaaataattaattgatcatgtctactaattaaaatttc

SEQ ID NO: 19101 - DNA, 373 bp, Homo sapiens
cggaccacgtgcttggcttcccatggtcctgagaatagagactatgttccttactgaggcctacaaggccctacaaggtctggcttcttcctactttgccagcttcaccttatgcgtcttcatctcccctcctcatctggaactgctacccaccctttattgttcagccagtaatcgcttcctttgagtactgatccgtgaatcactgactaggttaaatccctcctattgcatgatttttttatgtatatatatttttctcttttttacattcataaaggttgattaaactattggatgatcttatagaaccatgtccctttccaaatttgtaaaggttgtcaaagttactatttacgtttatttgagtgat

SEQ ID NO: 19102 - DNA, 554 bp, Homo sapiens
tccatccctttgtcacttttcaactcctcagactgaatctagggataaatgcacacctgagtacagattcggtgtgtggggaaagttatgttctaatagaaaaggaaatttagaactcgacagtgattacctgtaatactgttagttgtggataatcctttatatttggtagctctcacttagtttgactttatttttgtaatttcattcttctagcatttcattatttattaactttgatttttctgtatgacagccttgcctcactaaccacttggactatacagccatctggggcttagaggctattagtggcatccctaataagtaatagttgtgcagtctgtgcttgagtttcttgtttccaaggcagttcattcctgctggagatagttttatttattaagaagctcttcttggccaggtgcggtggctcacgcctataatcccagcactttgggtggctgagctgggcagatcacttgaggtcaggagttcgagaccaacctggccaacatggtgaaacctcgtctctactaaaaatacaaaaatta

SEQ ID NO: 19103 - DNA, 613 bp, Homo sapiens
gggaccacactttgaggagtgccctaggcaatgccataggacattttactcaacaactttacatacaagttgtgggaccttaaccacatttcctatcccctctgtccctcagttaacatattaaaaaaaaataggtatattacctacctcatacagttgtgggtaaagattaaatgagatgttgctaaaatatttatcaagggaattggcttatggcacgtaatattgctgtttattattatttataacaacacaatataaggcctctcccctaattgtttttaataaatgttttctggctagctgaattgtcaccaaactttcacaatcccaaaagaaagttgggtaaggctacacactcctgtccccgcctctgttcccatgtccataccctaacaatgacaggaccaagaaattgccctctggtctatcctgcctgaagcctgagcatgtgtccctctaaacccctccagaccccgctatgaaatataaagaatgtcagcaggcagcaggcctccgttgttaagaagaggaaaccggccgggcgcggtggctcacgcctgtaatcccagcactttgggaggccgaggcgggtggatcatgaggtcaggag

SEQ ID NO: 19104 - DNA, 379 bp, Homo sapiens
aaagcatttgtacaatttatattacaaagaaaatttatttctacttaaagatgtaccctatttttttctccaaaatgccacttactttcttgcttgaaagtagagaaattgattttaaagaggagccttcagtcatcccatttatgcctacagtgtgtcttttagtttgtgcataatcgttctctctctctctctcaggctctgcatacatcaagtgtagatggctcagagtctacatacatcaaatcatgtcatagacctagaaaagtaaaatttaaggttggggaggggactggtggatctgagatacagtaagtcatttaacaacgtgattagagtagccaaagttatgaagaagcacagctgagatgaagatctt

SEQ ID NO: 19105 - DNA, 315 bp, Homo sapiens
atgttaaaagtaaccagtccatttctctgtctcatagggttgtggcaggcactttagaaactttaatgtttttctaacttcatttaccgtaggtaagatgcctaacaaatggatgagctcagttgtttcaagagtttgtctcccatgagccaatgcccatcacacacacacacacacacacacacacacacacactcacacacgagcaattatccttaagaaaaataatatttatagcacttagagtgttatttaagcaacttttcctgcttaattccaaagagtgacaatacatcaaaaaaaaaaaaaaaaaaa

SEQ ID NO: 19106 - DNA, 654 bp, Homo sapiens
gttgttttgtttgctttaataaaaataaataacttcctgaatgaagtctgagtagaaaattgatagattattcagtaaaaacatgtattctgtgatattataggactttcttttgctcatttaagtctttttttgttttgtttttgcttctgattttcaggatgaaaatggtttctgtggttttctactgaacaactgatgcattaactcacaccagcagtgggtgtcttgtgcagaataaaaggttacctctccagaaagggattattacactaaccaatttttcatgtcgtggcttcagtgaccagttcgttctttagcagaactatagtgctggtcacagagtagcagtccacattacaaccttttggtcactttgaaatactcttatctgcttcagataaattagtttgggttctatttggagggataaaatgaagtttatggaatctcaagctcattcctatcttgtcattccatgataaatcatgttggttacaaagccaattgtcctttgggggcaaatataaaattgctctacaaatatatcagagccatacatctattgctcctggtaaatgtttgctttttaaactcagtctcaatgtagatacatttcagatatgtaaaacaacttggatgctggtgatagct

SEQ ID NO: 19107 - DNA, 510 bp, Homo sapiens
aagcgattcttctgcctcagcctcccaagtagctgggattacaggtgcccaccaccatgcccagctaatttttgtatttttagtagagacagggtttcaccatattggccaggctggtgtcgaactcctgacttcgtgatctgcctgcctcggcctcccaaagtgctgggattacaggtgtgagccaccacacccagcggatatgtgcttttctaatatgtatgttgtaatttaataaaaagtggacgatctacaccctggtacatatgcgacctggagaggagaccgacggacaacttgagtgcccgacagatctgtgtgcaggacgcaagcctacctctaggcacctggaccagctgcatgtatgccttgtacaggttcccccggcagactgggctggggtcattcagcaggaaggacagggcaaggacgatgccgtgctctagaaaggcgtatctagggaagggagggtggacagtgacataagtgagaccatgccctgagaggctc

SEQ ID NO: 19108 - DNA, 460 bp, Homo sapiens
tagaaagattagtgattcatcttcacagcacatttttaatcaagcagttatttcaaccagcacattcgttttgttcatattcactatagaatgatatcttgtaaataaagacattcagcacactgtgaaaatgtatttgtgcacctgctttttaaatatttctactaaaaatgaaaaaaaaaccccttagacctgtagatagtgatatcgtaatattaattgttaataaaatagtcactgccattaaaatctgcagaaaatactctttactttcctatgctaaatgtgcactgcacagaaagaaaaggagcaggtttatcttatataaaccaaggaccattctttattattattcagtacttcttttgctaccaaatttttaagaaaagggagaaatccctcataactaaaatcctaaaaaatgataagtgcttcaaggagattaaagtgtcaggtatta

SEQ ID NO: 19109 - DNA, 551 bp, Homo sapiens
agtacatgacaggaataagtcaaatcaccttcacacctctcaaattgccactgtgaaggaccacaatcagtaacggtggaccattaacacaaagtccaaaatttacaaacacacaggaaaataattcaccatgaaagagattcatagaaaatgcaaacacagaattaaacagtaaatgaattcaaaagatattgagctggattaaaatattttttaaaagtgtatcatgaaaaataaaagattgaagcaacatattataaaaacctagagccagtcagatttgggaaagaagcgaagacaatttccaaaatattaagtttttttttttaacatagcagatatgttatacaactaattgtatattgctgaagagagaattaatgatctagaagataaattcaaagaatttaattatacagaactgggcatagtggctcatgcctgtaatcccagcattttgggaggctgaggcaggtggatcacttgaggtcaggagttcaagaccagcctggccaacatggtgaaaccccatctctactaaaaaatacaaa

SEQ ID NO: 19110 - DNA, 517 bp, Homo sapiens
cccaaataggttcgctgactttcttcactaaggcacccaccaaatatttgttgagcgcttaccatgggtcaggaactgttcaaggcactggacatagggtgttgaacaagaaagaaagacatgatccttgctgtcatgaagcattcatttcagagtcatacttcttatgttcacacacaagtgaagtggtattggtatttcagagtgaatgtgttttataaccaatattgatatttttcttctctagaggctccctttatttcttagtcacaaaacaaatatttttgaaagatagcaatgaaaacttggaacttttagaaaagccatttattgctagaaatgggctaagcttacgttttcctaaaatatctgtagaatgaaaacataatccaaaaaggcacacattcgccaagagtgcagcacgctggtctttgacttacataactctaaggaaataactagttagtttctgttaatgtttgatgaactttgacaaattagcacgaagaattagatc

SEQ ID NO: 19111 - DNA, 434 bp, Homo sapiens
atatgagccttaactcagtgacccctaccctgatcctaacacttgaaattaaatattacctccagttgtcaagttcttaccagctctaaaagaggaaagaccagttaattccagactaaggagttcagtaataaaaataagacagtatatctgttttcctctctcaaaggaatagaatatgcacacagagcataaataataaaaaggtagtacaacagcattgaagcaactatggcccagttacaagataaaaaaaaatataattacagtgatggtagatatatttgttcactggggagaattagcccccaaaagccattatttgatgactaagaaaatattaactgattgttgccttctttaaaaaattattttttctcagaattttactccaatgtttaatcctcatcagtaatacagccacttctactact

SEQ ID NO: 19112 - DNA, 434 bp, Homo sapiens
gctgggattacaggcatgaactaccacatccggcctattttaccatttttaagttacagttcagtttgctttcctcttagaaagaccttgtgatcttgggacgtgggtgtctttagggggctgttattctgtctaccttccttcaagccaccagccacctcacgcccacaatcacctgtgtccctgttggatctgggctccccaagggcagggctaggcccgcctccatccctgctatgtccccagtgcctagaacaaggcctgagacacctgaattccaacatgcattagcacttactctaacttgggcatgggaaacagccattcttgtgaaaaatggtcaaacctccatttcatcgggtccgccctaacttgcatgaggcacaccacgcagaagcttacccagaggacctcgcccctccgaacaacagtct

SEQ ID NO: 19113 - DNA, 397 bp, Homo sapiens
aagaggctgttgatcgggttttttagttctacgtagcatttagagatggggacatgggatggcgaagtgttttaatactgtgggaacaacataggggaagatttagtggcaggaaaatgtaggcacatggtgggacaagggagcctttggttagcacagacaagcaatgcagggatggtgggggttttggaagatgtggagtaagttgggaagcgcttggatttcttcgctgaggataggcttagattatattcagcaggcagtgaagcactttggacaccagaatgatgcaatcagagtggtgttggagaagagaaaactggcctctggaaggggcagaagagtggtgggaattgtagaagtgggtagattgatttgaaggctatagccacagacc

SEQ ID NO: 19114 - DNA, 389 bp, Homo sapiens
tgaggattaattctgttaacatacattaagagctagaatcagtaagcttgggctatttacgttagtcccagcctgctcgtcaccggccctgtgacttaggcagctcgcccccttgacagtgaatctcctcatcagtggaagaggtatgataatacgtgcctcaacattaagaagagtattggtcgggcatggtagctcatgcctgtaatcatagcactttgggaggccgaggtgggcagatcacaaggtcaggagatagagaccatcctggccaacatggtgaaaccccgtctctactaaaaatacaaaaattagctggacatggtggcacatgcctgtaatcccagctacttgggaggctgagggaggagaatcgctggaatcagggg

SEQ ID NO: 19115 - DNA, 622 bp, Homo sapiens
gccaacttactgccccacttctgtttccagaagtcacacacactagagtcagtttcatttctttgtagttaccctttttgcaactacagggctattacaaagtcacctgaggccactactttaaacagaaacatagtactacaaagccctagaatctaagacagccccccaatctgagggtcatctcagtccttgacactcctttctttgttaattccacaagaagaagaaattatagagctggcaccaatggtggcttcagcaccaatagtaaagggctggaggcaattgtaaacatcacctccacaatgaaggtaaccttattactcatcacattcaaagtgcagccctaaagaaaataatcacttcttattccttttctcgtatttttttcttggccactcattttcagctgagtgaagtattctactatgtgaaaatgattactagaaggaggtgttaggagagagaatgtttataagatatcttagtaagaaatgtatacttttgcctttgggaaacaaaggacaactttgttgctgtgtcaaactacttaatactcatacaaataaaaatatggctaggtaccgtggctcacacctggaatcccagagtcccggga

SEQ ID NO: 19116 - DNA, 147 bp, Homo sapiens
gggaatcagggttcgattccggagagggagcctgagaaacggctaccacatccaaggaaggcagcaggcgcgcaattacccactcccgacccggggaggtagtgacaaaaaaaaaaaaaaaaaaaaaaaaaagggggggcctttttt

SEQ ID NO: 19117 - DNA, 504 bp, Homo sapiens
gggcaggactggggattagatcacacccaaatgcaagctctgtggcactcctggtatagccctgctgtccccctgtagcctggccctgggaggggggctcccagacttcacaccccctcacctctttatccaggggaccggctgtctcttcctccttcatccccagcctctgtcagggcagggtagttcctcctcgagacagaaaattaccagatggaagtccaggcatggtggctcacgcctgtaatcccagcattttgagaggccgaggtgggtggatcacctgaggtcaggagttcgagaccagcctggccaacacggcgaaaccccatctctactaaaaatacaaaattagctggacgtggtggcttgttcttgtaactccagctacgcaggaggctgaggcaggagaaccacttgaacccagtaggcagaggttgcaatgagccgagatcgcaccactgcattccagcctgggcaacaagagtgaaactcccccgcaaa

SEQ ID NO: 19118 - DNA, 373 bp, Homo sapiens
gtatgttttccccaacattctacagttccttctcttatttataatttatatgtctccttgatttaaaatttcatccaatacctccagagatttgatagtttttcaggctttagttgcatacttatctacttatcttgcattagtcaattgtctgaatgcatttcaggagcaaaagtaatacagtttcttctgctagtgggcagcttcctttcttatttgctgttaagtctttgcttgctgctctggaagaggaacatatgagagtgttgtcaatcttccaatgaggaatatttgctttaacaatgtccaatgtataaactaatgctgtatttctatgcctttctgagtacatgacatattttcattatgactt

SEQ ID NO: 19119 - DNA, 638 bp, Homo sapiens
attttaacagcaaatatctttctttcttagtgatttaaatcagttgactataccttgcttaaatccagtttctcacaaaatagaataaacagcaaatggttttatgattgtagcaaatgattcttaaaaattttccctttgataaatattgtttctacctatgtagacataatgtggcgatttggagagtgacattagcttaggatcaaataggattccatgactgagaacagaaggaagattctttctttcttttcttttttcttttcttttcttttcttttcctttctttcatggagttttacttttgttgcccaggctggagtgcagtgacatgatctcggctcactgcaacctccacctccaaggttcaagcgattctcctgcctcagcctcccaagtagctgggatttcaggtgcccgccaccatgcccggctatctttttgtatttttagtagagacagggtttcaacatattggccagactggtctcaaactcctgacctcaggtgatccgcctgcctcagcctcccgaagtgctgattacaggcatgagacactatgcccggacaaggaagatgttttcttaagtttcacactggcacttgaccttttatgaattcacggagtctcgggt

SEQ ID NO: 19120 - DNA, 629 bp, Homo sapiens
tggaggggaacaacatacacggggggcctgtccgggggtagagggcaaagagaggaagagcattaggacaaatacctaatgcatgcggggcttaaaacctagatgatgggttgataggtgcagcaaaccaccatggcacatgtatagctatataacaaacctgcacattctgcacatgtatcccggaacttaaagtaaaattaattaaataaaaaaaaatgaaaatgaaaataaatgttgttatgagaactcatagtggcatggccccaattttagaaactgagcttaatacagttaataggtaaatgttagatgaatacctcaaactgaatgttaatgccaaaattaagatcattctttggttcaaaatatagagcatgtttatatcttaattaaaagcagtcatacttaaatctctccttttcggccaggcacggtggctcatgcctgaaattccagcattttgggaagctgaggcgggtggatcacctgaggtcaggagttctagaccagcctggccaacgtggtgaaaccctgtctctactaaaaatacaaaattagctgggcatggtggcacatgcctgtaatcccagctactcaggaggctgaggcaggagaatcgcttgaac

SEQ ID NO: 19121 - DNA, 470 bp, Homo sapiens
ataatttataaaactctgttgttcagattcaggtagtactttgttaaagtacatggttaatgtgagaaattacgtaaagatgacataatcaacctcaatcctaatgctcatctcattttcaattatcagttaactaagacaagagaatatggacagaataacaaatctatcatcactataaaaaacaactctcgctgggcgtggtggctcatgcctgtaatcccagcactttgggaggctgagatggtggatcacctggggtcaggagtttgacaccagcctgtccaacatggtgaaaccccatctgtactaaaaaaaataataataataataataaaaattaaggccaggcgcagtggctcatgcctgtaatcccagcactttgggaggctgaggcgggtggatcacctgaggtcaggagttcgagaccagcctggccaacatatagtgaaacccccatttctactaat

SEQ ID NO: 19122 - DNA, 542 bp, Homo sapiens
  misc_feature 216: n = A,T,C or G
gcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttngaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgtggaagctattgaaaacaacaagtatggctggttttgggtatgccctggagggggtgatatttgcatgtatcgtcatgcac

SEQ ID NO: 19123 - DNA, 642 bp, Homo sapiens
gcaaatcttatggtcaaacggatcactatgcagctgtgacagtgatcatagctgtcctcaggcagctttggagtttgaatttaccctatctacatggtctaggaacttccaagctgagaaattaactcaatattagctccaagtttgtgatatttctaaaacagaaaaactgaaaaaccactgtagaggtgtacaccttccatcctggctgccaggattcaagagacaaagctctgttaatgaaagctcacagtcccaaagtataaaacatgtaagggaaaaatcaattcattaggagtgagaatcagaagatataaataacaggaccatacctaaaggaactttggatactagaaataagccaactaaataagtatatttaaaataataaaaactataaaggaggaactgaaaacaaaagattacaaaaagtgaggccaggtgcggtggctcatgcctataatcccagcacttcgggaggcggaggtggccggatcacttgaggtcaggagtttgagaccatcctggccaacatggtgaaaacctgtccctacaaaaaatacaaaaattagccaggcgtggtgtgcatgcctgtagtcccagctactcaagaagctgaggcagaagaatggcttgaacccg

SEQ ID NO: 19124 - DNA, 618 bp, Homo sapiens
gtggtttccctccagtcttgttcattattcaagtgactctccttggtctagcaacaggctaggaggtaactatgacattttgttcaggttaagcaggaagaagaaaacaaaatctacattctcttttttatattttaaacacaagccaacaaataatttggaaagacccatgattagacagggaggattttatgctccttcaagagtaattgagattgtttaattgtatggaggaatgagcatatctcaaggggaatcgagaaggtataatatttggatgacagaatcattaagaactggctttgcaccctggctacaccgttgcacataggaaatattagggtgcaggggtgcatgcctgtaatcccagcactttaggaggttgaggcaggtggatcacctgaggtcaggagttcaagaccagcctgacaaacgtggtgaaaccccatctctactaaatacaaaaaattagctgggtgtggtggcacatgcttctaatcccagctacttgggaggctgaggcaggagaatcacttgaacttgggaggtggaggttgcagtgagctgagatagtttcattacactccagcctgggcaacaacagtgaaattctgtcac

SEQ ID NO: 19125 - DNA, 611 bp, Homo sapiens
tgttactccttccaaactccgtactcaggacaagtcactggtcgacaacacttctgttttatgtgtctttgtctcagatgccactttccttgtataacccagtagctcacaccctggcatggacactaatctcagtgtactgaaaagcttttttaagtgccaagtctaggaatgtatttccagagattctgaatcagggaggctattggagaacccagactgtctgcatttctaatgggcatcccacatgatcctgacacaggtgccactgggactgcttttccaaaattgctgacatagacttgtgtcttgggcccatcctcagggaaggaggatgccagctatgagggatttgtgttaggactgtagaatgacctcatggcagtcaggagtcagggcacccaacagacaggagggctaagtacatcaaacaggagagctctgacttctaagaagctgatcaaagtaacgcagaccccaagttcttgaaggactaaaatcctgggagggccatttgtaaacacttttataatatatcacctcttcttctcatgtcagagccaggtataatgaccataacagatgaaggcattgacgcaggagaaacaaca

SEQ ID NO: 19126 - DNA, 558 bp, Homo sapiens
gtgatataaggttgttaaatctcttaaagatttttacttttgctatatatttttaaaatcttaatctaagtttatgtgaaaattttctagtaaattcaatagagacaggaataggaagcaggaataaaaaaagacagttgtataatgcatcaagatattgtgcaatgtaccaagaatgagtggtcatgcttaatttttacccatatatagatacaaaagcactgaatagaatcatatatcacagagtttggaagagagacttaaagagattatctaaatgctcgttctttgagaaaactaatagctacttataagcaatatgaacaaatacatttaaaaaatccagactttggccaggcgctgtggctctcgcctgtaatcccagcactttgggaggctgaggcgggcagatcacttgagttcaggagttcgagaccaacctggccaacatggtgaaatccagtctctacaaaaaatacaacagcctggccaacatgatgaagcccagtctctactgaaaagccggccatggtggtgggcgcctgtaatcccagctac

SEQ ID NO: 19127 - DNA, 559 bp, Homo sapiens
catcatgcctctggagcaaaagaggtaacagttgtgaaaatagtttgaaccatttaaaaatcaaactatgtaataatcacatgctaatatgattaatgttttattttagatcatgtttgttgggaaaaggtcaagagcaagggctctagagacagatggcttgtttcagattcccgcagtcttttctgcttcctgaccttagatcaataaaatacctaaactcttggagcctcagtttcactggctgtaaaatagaggagttgtggcaaggctgaaatgagtcattccacagaaaatttgggactcattggcacacactcaatagccaataaatattaactctgttgcgatgattcccctggagagccagggtttcagactctgtctggaacacaccagtttgctttgcaaagacaaactctgtcccttggctaaactttctgcccctcactttggctaacaccttcgaaaggcatgtttttaagggtcctcgtgagagggtacagacgaatcaactagtaaaaaatcaagaaagtcagtggcaccttgtccatatatg

SEQ ID NO: 19128 - DNA, 595 bp, Homo sapiens
gaatctcatcaacataagaggccacgctaagaagcctgggaagcctaggaagccctgtcgttgttcacgcgaatggtcaattgcttgcagttggaagctgagtgggaagtctggcaaacgtcggtattgcttgtgctccaacttcttaagtaacattttcctacaggacgccttcagcagggagcctggaaggatcagaagaagatgggagaacttccttcctgctggtcacttaggagccagaatgacctttgttacctggacttttccttttctcctcctcatcattgttccatccccactaagaccttcattattttggaaatattaagttagaaatctagtcatggccagcatgagagagggacagggatgcatacaggaatcaaactgaatacattttgtgttttcattccccgtaggtacttctgctggtgtcaatcattgggactggattatgtctaagcatcttcaacctcacaggggtaatttgaaaagttgaggaggggtttgcttttgaagagataagctcatataatgcagaatccagcctttatggggatcagggggtcactccaaccatggccttcacaaa

SEQ ID NO: 19129 - DNA, 534 bp, Homo sapiens
gaattcaaatccagctgtgcctccagccacagctcatgcttttgaccactgcgctctgagtagcagcacatacacagcagagaaggcacttgatcggatgcttttgatgccagctctaagagcatccagttctacacagatcagaaatagacacataggtcctctggttatttaactgaattcagtccatttggggcgtaatttttgtttggcttcattttactaagttcagccaaactgatttatatgaagcctccaattatcttttcagtacaccaatgccaaaaattttgttagggaaacactcttctcctttctccctctcagggagagatgattaagaaaaatcaagttctagtggcagctgggtcttagagagaaggtttttcctacctgattatccagttgttttggggatggcagttcacactgcttggagcagagtctaatttcccgaagattaataatattaaagaaagttaaatgaagcaaacagcatgccacactgtgcagagccccagtcagaaccacact

SEQ ID NO: 19130 - DNA, 511 bp, Homo sapiens
gtcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctact

SEQ ID NO: 19131 - DNA, 556 bp, Homo sapiens
ggcagctcaccctgcttgtaacccgtatgttcatttgggcagctgtgttttccttttattcctgctgttaagttggactcaatgcctcttattttacactataaatgtttcctgaatcagtgagtaacatggatttttctgaagattgtgtgggagaactagatattagggttgacaatgcatacctctcagtatttccctcagaatattctcattagttatgtctttttatttcgtatttcccttctaggctacaatcacttgtcccaatcctcagtctcctcagttggtttcctttcttacccagggcagttttcctctctcagctttttcctccagacttcttgtaactcacatcatcacttgataccgtgttgaaataagtgaaattttgaagatgtaattgtctctgtgaggccgaggtgggcagatcacctgaggtagggagttcgagaccagcttgacctatatggtgaaaccctgtctctactaaaattacaaaaattagctaggcgtggtggtgggcatctgtaatcccagctacatgggaggctga

SEQ ID NO: 19132 - DNA, 643 bp, Homo sapiens
gtcacttcctttgtaaaaccttccctgcttccttattgcattgttaatcacccccttctgcttaatttccttacctacttacagaagttactcttatttattgagtacctacaatgttccaagcactatgttaggcaccagagattcaaggaaaaataagttatggttactgcttttgaagaatttataaacaatttgagggaaaagaaaataaactggcaattgcaatgtaacataaaacattgtgtgacagagtgtacatttaaaaaaaaattccaactaatttcaaggtggcaattgacagcgggactacattttatagttataattcattaagtgatcaatgtatgtgttatgagaaacaagccacatttgcataaaccagtgagttagagaggctgagtagagaaacctctgctaagatgaggtctcagagctcagagataaatcaaatgatcatatttatttctcatatttttttagaaaaataaagtgatcgcataaaggcagaccacatttgaatcaacacaaaggaggaaagatactaccaaaaccgtgtaagacatacaaggttttaaaagtgaaatagaaatgaacataacacactgaattcaacaacacattaaaaagattattcatcaca

SEQ ID NO: 19133 - DNA, 602 bp, Homo sapiens
gtaaaaactgacaattaggaggcattacaattcctgtctttaaattctgactccttgaagtctatactagacatgcccaggaaaatgctaaaaccggcctggacagctctggccatgatgcacatagtaacggccacctattttgccatcacggatgtgttgtaggattaaaaatagacttatgcaagtgacaattacaagccatttataactataaaacttaacaaaatagctgccagtttgctgaatctgaaaaagaaacctgtcacatttactgaattagtttaaccatagaattcagatgttaaaagaaactagactaaaggaagaacttctacaagctctcctgtcataagatttttacagtttctcttgactggaaacatgtaggttgctacaaaaagttactaaaggaacttttatctcacatctgccctgttttcctgaactttacgtaaagttcttaactagcttaacttaaatttaacaaacaggttggccgggcactgtggctcacgtctgtaatcctagcactttgggaggccaaggcaggtggatcacctgaggtcaggagtttgagactggcctgggcaacatagtaa

SEQ ID NO: 19134 - DNA, 184 bp, Homo sapiens
aatttctaaaacatatgtatattatttttatcatcataaaatattaacatttctataacgaaaaatttcaaacatacattgagagaaaagtccattcaactttcacacatgcaagttcctattaacaattaagatttgccctagattgcttcatctatcccttattttattttcttttttcaat

SEQ ID NO: 19135 - DNA, 387 bp, Homo sapiens
aggacactggcttgccaaacaggagtctgggcacttagcagccagtgctctgtgcaaaccagccagtgctctgaattcagatgagagctttgtgtttgccttattggaaagcccttgattcctgggcttctagaggtatgtatcactcaaaatctctgcagttcttttagggtaagtgaacgctttacttcttcatctattagaaaattattctcagatcatgaggtcaggagttcgagaccagcctgaccaacatggtgaatccccgtctctactaaaaatacaaaaattattccgggtgtggtggcacacacctgtaatcccagctactcaggaggctgaggctggagaatcacttgaatccgggaggcggaggttgcaatgagc

SEQ ID NO: 19136 - DNA, 401 bp, Homo sapiens
gtgagtcctaatgtgattttctgctcccatctgctattgttggttggttttgctttgggactgactgcttccccatgcctcacctctggttcatgacatcatgcctcctttgtctcctcctctcaccatcctctctggataccaaccatcatgacatgccctctagggaacactttgtactgttcccttgaacatgtgcatggtttatgatccagctccatcttaactttttatttatttatttatttattttgagacggagtcttgctctgtcacccaggctggaatgcagtggtgcgatctcggctcactgcaagctccatctcccgggttcatgccattctcctgccgcagcctcccgagtagctgggactacaggcgcccaccaccacgcccggcta

SEQ ID NO: 19137 - DNA, 92 bp, Homo sapiens
taaaaagcctacattcaaaacatgcagagatgttacattggtttttcactttctggtgcagtgatactgaaaactgtgggccatgatataaa

SEQ ID NO: 19138 - DNA, 649 bp, Homo sapiens
tcatccatcctttcaacctccagccgtctacacagcatctacctctctactcaccctctgttgattctccaaccactctacctccatccacccaatcctcacgcagatcccataatccgctggaatgcctacagttttccagttatatcttgactttccaaatatgatgttattttatgagagtactcaaacactgcttcctctgaggagctttccctgatgctccttctccttcctctgaaactttgaaacaacctgtctacacctctcaggacacctagcttgtctgctatgtctgggtgcagttatttgtatcctgagggcatgtggaaaaaccaggcagggctaattcaaactcggctctcacagatggggagctatgtgtccttagtgataagatgaaaggatggattgaggatggatgcagggttgatcattgatggactggatggagatcagatgagtgacttattggaggttgatggaccattagatggatgtacagatggatgacaagcatccagaggcatagatagttggagaatatgagaaagaataattaaatggaagagtaaaggctggaacaatgaatacaaggggtggatgaatggatggaaggaaggaaggatggatggatggatagatggac

SEQ ID NO: 19139 - DNA, 554 bp, Homo sapiens
aaagggttacatttacaagttagctatgcttccctcagtatgctttctctgatttgcttgtatttgacttgaaaatcaaaagtcagtgttcagtggtactgctattcattggctgtgatatttattttatgagatactcataaagggagggagtattttgaaatagagctatttacctttagtagctctaatgcatgtgctcgttaatggcactttctcattatccaagatagggcacttgaattgataaactgatgctgcttggtttggataatcaacttctgtgaactgagtgtgcaatacacttagcaagcacagtatgggaaactagaattttgaggaatatgcctcctaggtaactagttttcaaagcagaatcactacacttccttaataaaaataagaccatagagtatgcaaaacatactaacattttagttaatgtatccttgcttcttggaaatacaaagctaaaatttacctttaaaagtcatcttgtaaagaattctgagatggaaaatctgtaaatgtttgaagggcatggagaatttgag

SEQ ID NO: 19140 - DNA, 85 bp, Homo sapiens
agaagcacatgtagaataatcttgtttataacattaataacattaaattagcatgtagtatttattgagtctttgtgctaaacat

SEQ ID NO: 19141 - DNA, 484 bp, Homo sapiens
acatcagagatggaaacaaatctatcaacctacatccagtccacctacataactgaaagagataataaacttttgctattttaagccaccattgttatacagcaatatacagtaaaaatgcgtacatgtctaatagtagttagtgatcttgtcccaatctaataaacaatggtggtaaatcagcagcaggagtgaagaaagccacaccacacagcttaagaaaggctcttaatatttaattttaaaaaaagcaatcttatagctggttcctgtgcgcctcacccaggagcctggggaccagccagactggccagtcaccaacacacactgatgcctgggcacctgaagaccaacccaccagtgccactaccagaatctgtgtagcccggcccagggatgcgagggccaatcaggaagggcctgacactgctaccactggctccccacctaggaccttaagattggctcacccaggacacacaac

SEQ ID NO: 19142 - DNA, 426 bp, Homo sapiens
gatggtggctttaacagaagcctctgagcaaagagcagatttggggagaaaagaatgggaaccacagcatgtttcagacagaacagttcaaataaccaggctatccagcttcctctcagaaatggccatctgacctcattctgtctttatctcacatttttactccacaaaagagattctaattgagtcagtttcctacattccaacacggagcagggcagccatgcgccaggctacctcctgggcccctcttgtgatcactgtatacttgtcttcttttccttggaaactgatccttggtctcaaggtacaagacatggccacttcattcagatagactgagactgtggtatggcaagaacttagagtttcaggtgtctccaatacagccagtggagcttagcagagatggtcgaggatggagga

SEQ ID NO: 19143 - DNA, 453 bp, Homo sapiens
tcactgcacaatgtgctataattcatgtctctgtagaggtcattgctctttgccacacccatgcctgccctcatgccactgttcctcttcatggaaatccctttcccatccatctctgcctacccaattctcagctccttttgggccctcgtcaaagaaaatcacatactctgagaaagctttcctgattctctttagcctaaattaatccctctctgctatcatagtccttcatatatagtatatgctttttagtatatagtatatacttttctagtatatactttttctgtctcatacgattttttgtattattttccagttatctagatacataaatataaaatatttatgtttgctattttaattaatagaatttggcatattatagtagtagatggttaattaagtttgctgaattcaattttgaatggatcttacatctatttcact

SEQ ID NO: 19144 - DNA, 499 bp, Homo sapiens
ataggatacagtctcattggctaggtacttttcttttgagggcaaatagataaggaactgcccaaagatttcagacagaggtgacagcctcagtttttataatgcacaaggactgcccacaaaatgaccaaagtgattgagacacaatatttttccctcaaaagcttaaagcctgatggaggaagcagaattcatacaatgtgcaagaacttaaatagaaacggcttagacaggtgcggtggctcacagttgtaatcccagcactttgggaggctgaggtgggtggatcacttgaggtcaggagttcgagaccagcctggccaatgtggcgaaaccccatctctactaaaaaatacacaaattagccgggtgtggtggcaggcacctgtaatcccaggtattcgggagcctaaggcaggaggatcacttgaacctggaggttgcagtgagcttagatcgtgccattgaactccagcctgggtgacagagcaagactctg

SEQ ID NO: 19145 - DNA, 407 bp, Homo sapiens
tgtggataaacttgccctaacagaaatcaagacatattatgaagccatggtaattaatgtgttttgggactaggaatagaaaaataaaccaatggaatagtatagagagcctggaaacaaggccacatatgtatatagcacttgttatgtgatacatgatgtgggggtgattggtgggcgaaaatggtctgttcaataagtgttgctaggatattaagaacaacatggttattcatgtggaaaaattgggcttgggttccctacctcacaccatagacaaacaccaattacagatgcattaaagtagaaaatagattatgacttttgagtgggaaaggatttttttatgacagagtacttaagcatttaaaaaaacctccaggtttaattacattataattatgaac

SEQ ID NO: 19146 - DNA, 485 bp, Homo sapiens
aagttaaaagtggggaaacttcaccaaaaaatttcacacacaaaagtaagaatatctggcaagtacgcccatgttgccacttcacaagaatctgctggagcttcacaacagctgctccctttggccaagctcatttgctgtgtacactcacatcactccagtgtattatctacctggctgtggcaggcactttagtttgcaacccttgcattaaggcatcaccctattaaggaagaggcagtgggcagacacacttcactttaggtgcgtaaaagagggaagggtctcaatatctcacataggtctgctaaccttccagaaataggattagtcaacaaacaaacaaacagaaaacaacccagatgagcactgaaggttacaataggaaatgtaagtagaaaaacacaattaaacatgacatgtgtactcatataagtcattcagttcgagagcagcctggtcaatatggtgaaactcgatctcta

SEQ ID NO: 19147 - DNA, 625 bp, Homo sapiens
tgcccatcctggcaaatgggaatgaagaagtaatttaataaggtttagaaaaaataaagaagtgtgatggttcttgaatcgaggtgttgagtagcaaactgttaccctctagtcccgtaggaattaagccattgtggtcagaagacaggcagtgatattggccattttgcagcgagatctccacctgatgctgtcacaatgcaaataaggcacatactctgcctattaataagttaaatgtactgttgactttgctttttacaccttcacttccctgtaaacataaatatttacatttgtgaggacatttacaaagcactttcacagatctctatgagatcagaaatcaagccaagaaaggcaataatataccttatggaaaaaaggacaagactcagagagggaagtcaaataaaatcataccaacagagctgggaaaaaaactcaggtgtcattgatccacaccctgtcactgtccacgcagacctcaaggaatttagttccaaagggatctcatgttttcccaaattgcatccttcctcttgagtttccactcttgagaatagcaccattaccccatcacccaagctggaaatttgggcatcttcctaaacatcccacactc

SEQ ID NO: 19148 - DNA, 514 bp, Homo sapiens
ctgcctcccaggttcaagcgattctcctgcttcagcctcctgagtagctgggattacaggcgcctgccaccacactcggctaactttttgtatttctagtagagacgaagtttcaccatgttggccaggctggtcttgaactcctgacctcaagttatccacccacctcagcctcccaaagtgctgggattacaggcgtgagccactgtgcctggcctctaggattatattaatagaacaatcttcaattattttatctttctttatctttcttttcatgtaggaaatgtcctaaaattttcaaaccctcaatttgaaagcacttttaaaatcatacatagtcgagcattttatataaaaacaactaaaaagtctgtgaaattttgcagtataaaaatgcaatggcagcagcaggccttattaattgagcctcttggaaatgtggctggtcctaggtccgtagcctcaaaggccctggcttgtaactgcaggagctgaccagcacagctctata

SEQ ID NO: 19149 - DNA, 579 bp, Homo sapiens
gactctcctgcctcagcctcccgcatagctgggattacaggcacacaccatcatgcccagctaattttgtatttttagtagagatgaggtttcaccatgttggccaggttgatcttgaactactgacatcaggtgatccgcccacctcagcctcccaaagagttggaattacaggcgtgagccaccacgcctggcttctaattgtttttctatgctcctaacattatttccaagaaagaacaaattcttcctttgctgcatttgcatttttaaaaattcacttttacattgtgaccactttgagtctttatcattacacaaaaaccagtcctgtcttcctctaatcttaccttaatggtctactcgattgttatttataaaatatggtatcatatagctccatttttaaatactcaataaattgttcttaaaataatattcaaacctggactggaaatctactcacctgcaatgtaatgccttcaaccttatcctctataactcttttattccaggcttgggaaaagagacaaagcaaggccatatgccatatatttaaatatttaaaagatgtaagta

SEQ ID NO: 19150 - DNA, 128 bp, Homo sapiens
aactatcattcagttatctgaagaggtcaatgctgggggtttctgaactgggggcatcaggcacagtttagggcaggagtattatactgaaaacaagaggtttaaataaacatttatacatgtgaaag

SEQ ID NO: 19151 - DNA, 597 bp, Homo sapiens
gacagaagggaaataaactcatcctgccttcttccacctgttttgacctagccacactggcagctgattggatggggcccactcccagtgagggtgggtcttcctctcccagtccaccaactcaaatgtcagtcccctctggcaacaccttcacaaacacactcagaaacaacatgttaacagccatctaggcatccttcaatcaagttgagacctaatattaaccatcacaccatgtaacttcaactttaatttgtaggcaatgattaattacaaaaaaatgtcattagcagaattaaaaacttcaagataacgatttatctgaagagattaaagcaatggttctcaatgtatgcttcatgaaccagcagcagcagtatcacctaggaatttttcggaaatgtttatactgggacatcaccacaaattctaccagacctacaaagcagagctagtaccaatcttactaaaactattccaaaaaaattgaagaaaagagagtccttcctaactcattctatgaaaccagtgaaaaccagtgtcaacctgatgccaaaatcaggcaaagacaaaacaaaaaaaaagaaaactacagac

SEQ ID NO: 19152 - DNA, 527 bp, Homo sapiens
taatttacgggcaaccagagagcataaaccaaagtagatatctatctagatagctagatacatctccacatcattgacaggatacattctggccgagtgtgagtacaacctatggatgtggttggagagaacaagtgttccacctgaatggcagatcaggattattccttctcatctgctgcaatggctcaatgtgttaaggagaggagcgagacagcaagaaccgcattcattcagtcatacagaccaaaaggaggaatgtcgcccagccctctaaactgacccagaacccagctcatgtctcaactgctacttctcctacttagaaagaagtaactccaccaaagcagggttctggacaaatatatttttattgatcatatacaaatagatgaagatggacttggatgttaagaaaaataatactatacaaaatcgagagtagacacagtcgcccctagacttaaattaagggtgtgtacattagataatttaatccaatgtatcaggtaaaaacttgaacaaac

SEQ ID NO: 19153 - DNA, 436 bp, Homo sapiens
tttaacattctcagagctgatgctatggagcacaaaagtaaacctgctataggctttacaaattgcaactgttgagacaggaaagaggactgtgatagttccttctgcctggaaatgaggaatataggaacaagaccagagtgaacctggaacccagtagatattgtcctggctgggactgtcttggttagcagggcactctgcttgaaatcagagatactttaagctccaaaagccattcaaaatgatatacaaggtatgacacaggcattaaggatgatgctgtagatcccaaagagttcacatcaatggttcagttatctctactaaaacaattacaactcatccatttttcaggtatgttattggtgcacggataatgggcataactctacagaatacttaatgttctaaaggccaaaaaaaaaaaaaaaaa

SEQ ID NO: 19154 - DNA, 173 bp, Homo sapiens
tatttatcttctatcttgaacattaagcttatttgctacttatgtgatcacaaataagacagcactgaacatactagatttttaatactttgaaggcatttatgctaagactatttttattggatgagttggtagctttactagaattaaaattagtgatatttctaaaactc

SEQ ID NO: 19155 - DNA, 582 bp, Homo sapiens
tttctcagaacataatccagttgttaagtgatgcatgaccctactcaatgtgctgaatacctcactccaaaccatttcagaaaattcagatattatcaaccctcattgcactgccttccattagaaacatgggaagttgttttggaaaagatgtacctgcccctcaaccaggcccaggcgcctgctgagcctacgacagaagttgctacccctaccccaggtgaaagtacagcaggacactctttccaagtttatcatgagaaactaagcaaaccaccatccgatacccaacccaggcccctgttctacatagaagacagataggaatattcactcagattgataagaaaagcatcctgcacatctcaggatggtcaaacctccatgattgctatgactcttgaatgacaccttcccccggagaaacagacaagaggaaatggattgaaattgatgataggccgggcatggtggctcacgcctgtaatcccagcactttgggaggcagaggcaggaggaggatcacttgaggtcaggagttcaagatcaccctggccaacattgcaaaaccccatctctact

SEQ ID NO: 19156 - DNA, 609 bp, Homo sapiens
tttatgatgaagcaaaagtgatagctttgaatagaatataaccattctgcttttcactttcagtacaatattcaacaaattacataaaatatccaatactttattataaagtgggttttgtattcaacgattttgcccaattgtctgctgatgtaagtgttctgagcacattaaaggtatgccaggctaagctgtgatattcagtaagttaggtattaaatacatttttaacttactgtattttcaatttataatcagcttatcaagacttaaccccattgtacattgaaaagcatttgtattgcattaaacatgttatataacatttttaattgaaattactggcaacttttgaaaaaatgcaatgaaataatgtgctttgctattggttaaaatgtttttgggcagggtcagtggcttacacctgtaatcccagcactttggtaggctgaactgggcagatcacttgaggtcaggagtttgagaccagcctggcaaacagggtgaaaccccatctctactaaaaatacaaaaattatctgagtgtagtggcatgtgcctgtaatcccagctactagggaggctgaggtgtgagaattgcttgaacta

SEQ ID NO: 19157 - DNA, 610 bp, Homo sapiens
aaaacagggttagagtaacttgtttaagtggcagagcttagactgtaatggaactcattcctgaatccaggttaagccaacttattccagagcctaagctcttaaaagaagcagaggaaaggaatcctgtcaattaacctaccaaagaattattaaaacccattaactcttgcctattaccttaaagttttaagaccagcttaatttgaatgaaggttacctctcacagtgaaatactccatgcttccctatacttgaccctgtcctaaagtgatgactggttttctctcatcttttattttttactcaatttgtttgtttgttcatttacatttttctaaaggaatcttctacactaacagcaagcaggtctgggctcagaaaagatagcctgtcctttgagtggaaagaattactcagggtgcttactttttgagctggattagacactgagcaaatgtgtttcctgttctgggctctaggccctgcttgccagagcagctacgaatacttattacagccttccagaggctgttcgcagagtctccgagattggttagtaattggcatagaagaaaatgccattggcttaccttactctgggcttttt

SEQ ID NO: 19158 - DNA, 618 bp, Homo sapiens
agccctcatgaataattaatgccaccataagaagctcttaaagaagtaaattcactctcttttgatcttctgctatgtgagaacgcaatgttcctccccttcagcagacacggcaacaaggtatgagtttggtgcaaaagtaattgtggtttttgtcctttcttccaatggcaaaaactgcaatcacttttgcagcaacctaataccatcttggaaccagagactgaacctgccaatggcatgatcttggacttcctagtctctagaattgtaagaaatatacttctgtcatttataaaatatccagtctcaaatattctgctatagcagcacaaaatgaactaagatgccttcccccaaatgtgctctgctctttaatatcaccaaagttttatacctactcttttttctgcataagagtttattcattattttactcaacctaccaatccctctcactctttaaaacccagctagcaggtcacctttctaggatattttttcccaaatctccagatataatcacttgtatcagtcaaggttctccaaagaaacagaaccaataggaccacatacaccacacacacacgttcccattcactcacccacacactacac

SEQ ID NO: 19159 - DNA, 375 bp, Homo sapiens
actctttttgcatttttaataacaacttgaactcctgatatgtcgtggaaaatataaccccttcaacagccctttcaatgggttgctactattttgctcaccccatcttcacctgcctaatcatgaggaggtggggtatatacaatttcagttaatttgtagttatcagtctattatagttctttccttctgaaaaccaacaagtaaataaaccagcaagcatcaccaataaactttgacagtttatggttcataacgtacgtctacaccaaactttccattcaaatgctttttcaaacctttgtttggtttctttctctattaagacaacttttgcttttggctttcaaagacattctctccattataaactct

SEQ ID NO: 19160 - DNA, 399 bp, Homo sapiens
tagagtttttaactgtcagacctatccacactgagcccccaacaatggatcaactacagtacatattttgctaacccaccatggcactggtccccatggtggtttctgccccagtaagccattcttccctctattcacttgtctatgacttccatcttgagggcagcaatttgccctgtgtcctcactgctcttaggcaaccaaaaagtgttcttaatttttcggtctgttcggtttttacttgttgttaggttggagtggcaacatctaagccccttatatacagaactggaaagtggaagttctttgcaaacgtatttattgttgctttttactgactctgacctgagcatgctgggtcctatttttctgcatgttgatgcagcaatggagaatttt

SEQ ID NO: 19161 - DNA, 433 bp, Homo sapiens
tggaccaaagggacccaacctcatctgggagaccattgaaggaaatgacatttgggctgagacctaaaaaataagtagagttttgcttggcaaaggagagaacaaagagtattccaagatagaaagacctggaggtgaaagggaagatctagtaaattttaggaactagacgttccttgtgaaaggccaggccagaaggagaaaaatgacaggcatggagttaaagagcaatcagtgcaggagcctgatcatgaaggagcttgcctatggtacagacttccagcgttttcagcagggaatttagcaaaatcaattcagctggagaagttaagcgaggtcacagagagaccagctccctgttataagccagctgggtttgtggtcttctgatgctggagctgagggccaccttccaatggaagccaccatttat

SEQ ID NO: 19162 - DNA, 431 bp, Homo sapiens
aatggagaaggcaccaacttaaatctgcataacaaacctaacccttgtttactatgcttttcctgggcatctcctcattgctgcccccttcacacacacatacacacacacacacacacacaccttctacagaacaaacttctactattttttctcttgttaatctgtcttttgttacaggggtctgtctcaactaagaaccatgaaggatagaggaaaaattatttttcctgtcctacagatgacatagagaaaaagagtaacccatacaaatccagccttcaatccatccttgccaaggtgccagacatgtgaatgaaccattggttattgcagcctgctatggtttgaatgtgtcccctccaaaatccaggggttgaaacctaataaccaatgtgatcgtattgagaggtgggtcctttagtaagtga

SEQ ID NO: 19163 - DNA, 532 bp, Homo sapiens
tctttcgaccattcctcaggatctctcagagaaggcccaatacttatgatcttacactgtctcatctctttctccatcaccgtttattcagtcatactaatctactagcagttgccctgatgtcacaagtgttctcacactccaccctagctcatgctgctctctctctacactgaatgtagtttatgataaactcctatttattcaagatttatgtcatgtgtcatctaatgctttagattgggttaggcctctttatgccttgcttccctatttccaaccataactcttagcaaaatcctttattaaaaaagagttttgttggccgggcacagtggctcacccctgtaatcccagcattttgggaggctgaggcgtgtggatcacctgaggtcaggagtttgagaccagcctggccaacataatgaaaccccatctctactaaaaatacaaaaaattagctgagcattgtggtgggcacctgtaatcccagctactcaggaggctgaggcaggagaatcgcttgaacccg

SEQ ID NO: 19164 - DNA, 396 bp, Homo sapiens
gttaatatgtcataagatggttgtgaggattatgagcaaatatactaagtatttagtagcatgattatttcattgtactacaaagcatttgctcttattttaaattagacatttagtagtagatagagaagacttcttgtcccttcatccttaagcctttttaccagcttttttttttgttttctatagtaacaacagagtcataactgatacttgaatacatcctccttttgcaatcctgaagtggttccattttcaggaagctgattccctttggcaagcacaaaattatcatttgacatttgcaggtgatgcatgtcttcggagaaagaaatgtaagcaatgtcagagttctcctgtacatcagcaaaggaaacacatgtgagccccaggctg

SEQ ID NO: 19165 - DNA, 587 bp, Homo sapiens
  misc_feature 334, 335: n = A,T,C or G
gaggttaagataggttctttggaaattgaatatgaagaacatggaccataatgtttataatcctttttgttatggcagacacataacttgaccatcctccatgcccaccatgcatgggattgcttttggctgtatttatcagagagtatgatgtaggaattcctagtaattcaaaatggttttcctattatcagtacctcaaataagaaggaaaaaagaatcagacattttaagacataaacactagttcgtttccatgccaataaggaaaatatttttctccttcatagaaaaaaagaaggcaggaaactatgcgtgatcagaaagttacatnntaaagcaagagagaaaaccaacaaacagtacgagaaagactaatgaaagactgaccgggcacagtggctcacgtctgtaatcccaacactttgggaggccaaggcagatggatcacctaaggtcatgagttcaagaccagcctggccaacatggtgaaaccccacctctattaaaaacacaaaaaattggtggcagatgcctgtaatcccagctacatgggaggctgaggcaggagaatcgcttgaacccgg

SEQ ID NO: 19166 - DNA, 630 bp, Homo sapiens
ccatgggtcctttgtgtcttgcagaacttttttcggcaggtgttgtttacatatggttcagagcttaaagaacagctgtgttccaggccagggcagaaagcacaggcctgtctgggaggggcatcatcactcctgcctgcctgcccaaccgacctgtcggtggactgaatgggccaagtgttcagaagtccttgggaagaggatagtgtcctgaatcataatgtggtattttctggttttttgtttgtttgtttgtttttggtaaaatgttaattgcagaagtatacaggttattttatttatttatttatttttttttgaggtggagtcttgctgtgttgcccaggccggagtgcagtggcatgatctcggctcactgcaacctccacctcccaggttcaagcaattcccctgcctcagcctcttgagtagctgggagtacaggtgcatcccgccacgcctggctaatttttttttgtattttagtagagatggggtttcgccttgttgcccaggctggtcgcaaactcctgagctcaggccatctgtccacctcagcctcccaaaatgctagaattacaggcgtgagccactgcgcctggcccatacaaaaaaaaaaaaaaaaaaaaa

SEQ ID NO: 19167 - DNA, 459 bp, Homo sapiens
  misc_feature 396, 397: n = A,T,C or G
taaaaccctgtctctacaaaaaatgcaaaaacagttggatgtggtggggtacacctgtagtctcagctatgcaggaggctggggtgggagggttgcttgagcccaggagattgaagctgcagggagcaatgattgtgccattgcactctagcctgggcaacagagagactccacctccaaaataaatacatagataagaaacgtaaacctaaagagtaattagaagatgcctttaaagtgaaaagcaaaggtttctcctctaattctggcagtacattttagaagaatttctttttattaacattcagagctttcaagtgaatctgagtgatattcaggtagtataaataggaaaagactagtgcatcatgctaattgctatataagcattaccannatcagtgttgcttcgtctataaaaagcatagtcatatattccttgagtgggatagataaccc

SEQ ID NO: 19168 - DNA, 558 bp, Homo sapiens
tgggaggatagattgtagcagtgagtatttaccaatttcatttgactaacaggtccccttttctacagagagcctctagaatatgcttcaaaaataccattggtggcgtatgtttttgaaaatcttaagtttgtccaaatgatatgttttcttaccatctggactcccactccttcaccccacgtctggttggttttcagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggtaagcgctaccaacatttaccgatagaagttggcttaaacaaataatctctctcctgggaaggtctctaaatctcactttcctcatagaggaaatctgggctcttctagcttcagattattacacaccattaactctgataaaaagctgtcactttactcttgaatttgttcttaacagtaaaggact

SEQ ID NO: 19169 - DNA, 547 bp, Homo sapiens
tagcatttacattgtttctaatattttgatagaataaattaatactgcatcagattcttatgcctgtgtcctttggctcttatttctaacagtagaacagctgagttaaagagtatacatgttgaattttgataggcactgccacactgctttccagaaagattgaccaattaccattctaccaacaaagattgtcctttgttcacattctcaccaacagtggacacttcagtgtttttaattttgacagaactgattggcaagagcatgctatttattttgatttatagttacctgattagtagtaagattgagctcattttcagtctctccttttactatggctacaataaaagagctgaaagtgtggtttttgatttatttcttttagatataaatgaccaatccaaatagtgatattttgaactactaatttctaagaagattcgcattggaatgttacatatctccatattaggaaaatcagtcataattgaactcccaaagtcaaattacatctgatgtttattctgggattcatataatt

SEQ ID NO: 19170 - DNA, 615 bp, Homo sapiens
agagctacagatataaaagaatgctgagaacaaagcgagagcagtcaaactggctgcatacaccctcaggaggtctggataaggctggatactgctggagaagcctggacactgttgagaagttcctgaagagccaacaacaatgccagcaagccaagtccttcatggagctgtggccagcaacatctctggctctcgagtccctacagactttgcatggaatgagatgcttgatggtgaaagattccatggtacaaaaaagcctcccaaacctaagcagacaaggagaaaaactgccagaattctcagctgtaactgaattggtacaaactgcacaaactagaaaatactaataaaaacctgcagcattttacttaaggttgaaatatgaaggtgatgcctttattttcaaagataaagctactgctccagtatctattgattagatgcattgagtcatttcttggtagtacttggtgggtttttgttgaatcatcatactcctactgagttccctgagcaaataatggtaagaatggattggcagtggtagaaagagaatttgcatcagtactctggggaagactgatgaccatttaacagtacacaatctca

SEQ ID NO: 19171 - DNA, 599 bp, Homo sapiens
acatatgtttaggggctccttgattaatgtctgtctcctactctctcctttaagatccatgaaaggaaggattgtacttatttttgtttttcattatatttccagagcccaactcagtacccagcacatggtagatattccataaatattcatcttaaaaaaaaggaatttagttagttcttagttaaaatgcccttcaccctagaaccacttccctaaacccacttctacttctcaaacactgatgggcccaggaatctaatctcattggcctcattcatagatcagttggtttacgtagctaagcagtatttccaccgggcacggtggctcatgtctgtaatcccagcactttgggaggccgagttgggtggatcacgaggtcaggagatcgataccagcctggccaacacagtgaaaccccatctctactaaaaatacaaaaattagctgggtgtggtggtgcatgtctgtaatctcagctactcaggagactgaggcagaagaatcgcttgaaccaggaagtcagatgttgcagtgagccaagatcgccccaccgcactccagcctggcgacagagcaagactccgtcccaaaaa

SEQ ID NO: 19172 - DNA, 570 bp, Homo sapiens
tatccatcttttgatctttcttcctgaaaatttggtccaaggcaaataccttataatcctatttaaagaatattcacaggctgggttcagtggtaatctcagcactttttaaggcccaaggtgggtgaatcacttgaagccagggtttgagactagtctggtcaacatgacaaaaccctatctctactaaaaatgcaaaaattagcttggtgtggtggggtacacctgtaatcccagctacttgggtgcatgaggcctgagaatcacttgagcccaagaagcagaggttgtagtgagccatgattgcaccactgcactccagcctgggtgacaaaatgagactctgtctcaaaaagcaaaaaggatactcacaaattcagtacctccatcctatttcattaaagctctgattaaacatatatgtttatgggccgggtgtggtggctcacacctgtgatcccagcactttgggaggccaaggtgggtggatcacctgatgtcaggagttcgagatcagcctggcaaacatggtgaaacctcatctctactaaaaaaaaaaaaaaaaaaaaa

SEQ ID NO: 19173 - DNA, 560 bp, Homo sapiens
gtttcctctaccactaactactctagacactctcaactttttcgcccacatcagcatctatacatgctaaagtaattccagtttgagcccccactttaagcctgccctccacacccaaagcaccttttacttctacccattatgctcttaaagtttccaaacctctcactttttttagcatcaccaacctatagctcacaggaaaaatatggcctgcctcctgttttcatacagaccataagctaattatcatttttacaattttaaagaatttgaaacaaaaatggaagaagagataatgtagaccatatgtggcactcatacaaagtctaaaatatgtattatctggtctcttacagaaaaaaagtgtcaatgcccaatttagacaaaagcaaaactggtggttgatactatttccccataaatcttagcaccttagggtggttcttacctcaggaaactggtggaagaaaacaatcaattcaatagcacatggttgcagtaaggaaactcaactgttttgctttcaacacatgtgctttaaatatcttggacatcag

SEQ ID NO: 19174 - DNA, 513 bp, Homo sapiens
tacctactgtcaggaccaactcctgccctatactactttattctaattccactccctcggctctctattgccagtcatatatgtatactccattcaccttttgcttttactttcccgtctaaatgacgacttgaaggatataaaatgaaacctggaaaaatgcaaacattttttcctatctgtgcatggtagatttttattttgtgactttgacaatttttccaaatttatttacatctttagaatgttagctggaaataagaaactcctgtctcattttcatcatgtttaaattgaactatatgaagccattttcatcaacaaagaaattgaaatatcagaaatttcatatgatctaatacaatattttgcccatgaaaaaaataaaatagtgcacagtcttgggtcacacagggtttgtgatttctattctggcttcacatgccactgtgccagctctttaacctaccactatcctcagaaataaaataacagtagctaggtgcggtggct

SEQ ID NO: 19175 - DNA, 542 bp, Homo sapiens
agccaagattcaaacctaggtcaaagctaagattcaaaatgaccttcgaagccatgcttggaaagtggagggacggttggaattgtgcatggtttatttgcgcttttttttttctccaatagcacctagcactgtgatttcacagtagtttgcatagttgaacacttttaaatgctctataaactgagttgtgtaatgatcagtgtgtatatatgtgtctgtgtctgtgcatgtgtctgggaatgtgaaagaaagcaatgaagagctgtcttcccaggaggaagagattggatattcaggttattaatctacgactatgatatactatctatgagaaaagtatcatcagaactttcaggtgtagaatttcaccaatctagcattgttcaataggtccaaaatagtcttcgataatattttttacatgtaagtacatatacttaagcaccatgtttatgcagtatatattttacttgaactaataaacgaccacccatacagctagaaatgttaactctctctttctctctctctctctctgg

SEQ ID NO: 19176 - DNA, 612 bp, Homo sapiens
atttgctttaacatcaaaatcatgtttcttctaaaactaaaggggaaattgatactctaggcgtatgtactagttgtactgtggcacttcatcatgtccccagaggggtgcacacctatcagattaactgccttttccaaaatgctctccttccatccgtgaaacacatctacaaatcaagttcctaagagttatttgtccaaggtgctgccctgaggcccaaggcaatagttaactgaaccagagaagtattcagctcagggcagccaaggagattccctgtccagagaatgtgagaaggagatgaagagtgagggtcagtctctctttggctgaacctgtagccatatgttccacaactatggtccaagaagttggaaaggcggtctttagaaaaggaaggaatgaagaagacactcagagagaagcagacaccagaggtaggatgggaatgctgcctgttcctcacagagccctgtctatggggttacgcttcctggggctgggctcccatcatttggaagctcagcttcctgagtagtcacctcagcatacacagaacactcatgtgagaaacacaagctaagtgacaaaaaaaggcaggcacaatag

SEQ ID NO: 19177 - DNA, 568 bp, Homo sapiens
tctctatttcatctgtcaatcaatcaatctaaatgtcacactgcactgacccactgctgaatgtcgtaaccctgatgcttctgatgccttattatgaagtctaggtcagtattaacctggacagaatgacttctagaggctttcctcctccctggaagctgtagccttgtttaggtgaagctatcaatttatcagaactttcaaagcttgtatgtactccacaccagagggacagagggactgtcttccttaacatctcatcaaatctctcctctcagtgatgtttgactcagtttgccccaaaacctctcactgagcacatacacttgcggtagaacctgtccttggatacagggtgaattagactcagtcatcagaattgatgagcaggtaagagaaatgagaattagtgacggaggtattcaaagggtgcagtgagaccattatcctggcctttcaggtgggtggagtgggttggacgctggtctctgtgttgggctcaggaaagccctcagataaaaaaagactggaggctgaggcgggcggatcacgaggtcaggagatcgag

SEQ ID NO: 19178 - DNA, 628 bp, Homo sapiens
atctaggtacttttataaaatcagattttaaaaagtggacatagtacatccagtctagtagatcataccatctactgtcatgtaatatggcaaactgtatcattgtcacttcagtagctctgtcaaaagtgctggactggaaggcaagagatccatgttcttaacctgagtctgttactaattacacacatgaccccaggcaagtcacttaaccttttatggtgtcagtttcctcatctgttaaatgaagggattagactagattatttccaggactccttccgaaaaagtacaggagagagttgtataactgaaaggcagaaagtggaataattgaggcttggaattcagggtgacttaaaaattactttaggctggacatggtggctcacacctgtaatcccagcactttgggaggctgaggtgggaggaccacttgagcccaggagtttgagacagcctaggaaacacggcaagaccttgtctctacaaaaaataattaaaaaaaaaattagcctggcatagtggcacatgcctgcagtcccagcttctcaggaggctgaggtgggaagatcacttgagcccaggattacaagactgaagttagctatgttcacaccactgcagt

SEQ ID NO: 19179 - DNA, 579 bp, Homo sapiens
gtaaggttccccaagctattttctatttctttcataacatagtcttatggcagggtcatcgaaagtactcagcgagaatctcttcaaaagaaaagatctgggtcttgatagcaaaaagtgctagatggagtaggagttgggaagtggtggggaagaggaggcatgagaagagagagaatagagagtgagtgaatgggaatttacaaaaacataaatacttgtcaatttattttatctaaaaaaacccataaattccaaaacccatgaagaaaactaaattaaggtagagaaccaataaaataaacattaacagttggaattttaattcaaagcagataaaataaaaatgtatagaactttggaataagtacagtttggagcttcaaagaagtaaaagaaggaaagatatccaataggtagaaatagtgaaataaaacgtgagtaagaaataaaatcaagaagaaaccttaaatgaataaatcacaaataggataaactctagaacagaagtgcttctatctttcctgcagtggaaggcttaatggcagagtggggagtgtgggcatagtggacagacag

SEQ ID NO: 19180 - DNA, 469 bp, Homo sapiens
gccaatccctggactttgcaaagggctattttcgaaggaccaccctgtggctggctgtgacaaagccacagtcctgtatgctgtgctcatacaactgagagtcccaccctgggccctgtgggtgatgcaggaagagccctgaccacagaggacatggagaagcaaaggcagctccaagggggactctgaagggaacctccctgtatgatcccctagggctgccatagcaaactaccataatctggggagcttaacacaacagaaatttattttctcacagttccagaggccagaagtacaaaatcaaggtgttggcagggttggcggcttctggaggctctgagggagaatctcttgtgtgcccctctcctggcttctggcaattgccagcaatccttggcattccctggcctgcagctgcattactcgcatctctgtctccatcatcacatggtcttcttccttggat

SEQ ID NO: 19181 - DNA, 477 bp, Homo sapiens
gactttgggcatattaccttaggcatgtttcatgtacactttcttcattcatgacatagtaataatgatgtttatattatactttgttgtatgaaataacttgagaaaaatgctaaagccaatatctgacatacagtaatgcagatttatgagcaatttgaaataattaatattctcatcaaatgaaagctaagtcaggcatggtggctcatgcctgtaatcccgacactttgggaggctgaggcaggcagatcacttgaggccaggagttggagaccagcctggccaacatgctgagactccgtatttacaaaaaacacacaaaaaattaattgggttttgtggcacacgcctgtagtcccagctacttgggaggctgaggcacgagaatcacttgagcttaggaggtggaggttgcagtgagccaagatagcaccactgcactccagcctgggtgacagagtgagactctatcac

SEQ ID NO: 19182 - DNA, 422 bp, Homo sapiens
ctgtggtattctgttatagcagctcaaatagattaagacacatagtaaaaagaaatacacatttattgacactctctatgtgctagatattttcatacattcttgtatttaatatgtgtaaaatccttgtgaggagtgcaactatgcctattttatcaatgagttcactgacgtttagaaaggtcaagtacttcagagtaaggacttcaagataaggcaaacctgatcttaagatgtaatgcaatcatttactttggacaatttacctcactttttgagcctattttctcatcttaaaattgagtaacaccaattttatagattttctgtggggaataagtaaattgacacaagttaaacagtcttacatatggttggcacagaggttgtttgcaataagttgctattattgttttcaacag

SEQ ID NO: 19183 - DNA, 595 bp, Homo sapiens
ggcaggcggatcacctgaggtcaggagttctagaacagcgtgccaacatggtgaaaccccgtctctactaaaaatacaaaaattagccagacgtggtggcgcatgtctgtagttccacttaggaggctgaggcaggagaatcgcttgaacctgggaggtgggaggttgcagtgagctgagatcccaccactgcactccagcctgggcgacagagcaggactccgtctcaaaaaaaagcaaaacaaaaaacaaaaccaaaacaaaagaggtgcaggccagaattgtccccgtggacatagttggtcaattagattgcatactttaatccagcctcagttggtgtgtctgggttttctggctaggaagaatgctgctgtggaatgtgctggaacagatccttacgtgcgctgtgttggagtctttccaggtcaggggttctcaaacggatttcaggaccctttacatcatccagaatgatccaatagccccaggagcctgtgtctgtgtggattatgtctgccggctgttagtgtgttagaagttgaggccaggcatggtagctcacacctgtaatcccagcactttgggaggctga

SEQ ID NO: 19184 - DNA, 422 bp, Homo sapiens
gtttcctctaccactaactactctagacactctcaactttttcgcccacatcagcatctatacatgctaaagtaattccagtttgagcccccactttaagcctgccctccacacccaaagcaccttttacttctacccattatgctcttaaagtttccaaacctctcactttttttagcatcaccaacctatagctcacaggaaaaatatggcctgcctcctgttttcatacagaccataagctaattatcatttttacaattttaaagaatttgaaacaaaaatggaagaagagataatgtagaccatatgtggcactcatacaaagtctaaaatatgtattatctggtctcttacagaaaaaaagtgtcaatgcccaatttagacaaaagcaaaactggtggttgatactatttccccat

SEQ ID NO: 19185 - DNA, 434 bp, Homo sapiens
acagtgactacacttagtaacaatattatgtatatgtcagagtaactagaagagaggacttgaaatgacaccacataaaaatgataagcactcatgatgatggagacttgatcattacacatcctatgcatgcagcaaactctcacatgaaccccataaatatataaaatatgacaattaaagagaaaaaaacaaatatccatatccaaggtatataaggtgtcctatttaaatgagtagctttcatttaaagtcaacagtatatcttataaataagtttcaagaattattctaccctgaaatacattcatggatatgaaccatagtgatcttgagcactgcttaaataacaggaatgggatgactcataggaaataatatcacagtataaaatactttgtaacatatcattggctaaaatctatgagttactg

SEQ ID NO: 19186 - DNA, 611 bp, Homo sapiens
ctatcacttgagcccatgagttcaagactagcctgggcaaaatagagaaaccccagtctacaaaaaatacaaaaattagccaggtgtggtggcatgcatctgtagtcccagctacttggaaggttgaggagggaggattgcttgagcctgggaggttgaggctgcagtgagccaagattgcaccactgtactctagcctgggcctcagagtgaggccctgtctcaaaataataataatgatgatttatttttttaaaggaaaaggctctaccaaatatccttataaccggaaatcccaattataagcccactttctctactaatttgatgaacatcattggatcagtctctcacctataaatcaagaatgacacccagcactttgggaggctgaggtgggtgtgtcacctgaggttgggagttcaacactagcctggccaacatggtgaaaccctgtctctactaaaaatacaaaaaaaaacaaaaacaaaaattagctggatgtggtgatgtgtgcctgtaatcccagctactcaggaggctaaggcatgagaattgcttgaacctgggaggcagaagttgcagtgagccaatatgataccactacactc

SEQ ID NO: 19187 - DNA, 599 bp, Homo sapiens
ctcgcttaaatttgaactttcaaaaccaagcataatgatggcacatggcaagttctcaaatgttggttgaattaatctatgcaaggcaatcactaaattgggtaattcaggtatttcctacaaaagaaaataagaaaatattgcctcttttaataaaatattttcttgtgtgtgtgttaattcaaatttggatgttagctaatattttgaaacaagctaagatgaaaaagacatatatagttctagcttacatccattcgtgtgcaaatctttcactactttgcactttttaagaggtgcaaatgcacaacaaatgtctgcaataaaaaaatctaaaaaagatgtgaatttactatgctatgttatttgcctgtaagtagacttaaatgcaaatctggctttattgctaaataatttgctaaaggtgagctctaaaaaaataaaataaatggtagtaaacgaaataatgaaattaatgaaaacgtaaatccttatagccatactgagatactgaaatgatgcattatatgtcaaggaagcaaattattttaaacttatatgtgcgtgcatgcaactgtattcatatttcaggatagtct

SEQ ID NO: 19188 - DNA, 446 bp, Homo sapiens
agtccactgattcttttaaagagcactactcctgtattccaggtcctatgctcactcagagtaaaaatctaagtccttacaatatgagatctgagctcatattccctctctggcctcatctctcgcctctccttgaccactctgctctactccactgacctccttactgctctcagaccccccatcctctcagctacactaccccaggacgtttgtaccagttctctcttagcctggaccatccttcctccataaagccacatgactaatgtctcttgatcctcaaacttttattcagttgtcgcaatgaggcttacccttaccacagtattttaaatcatcccccccgacacacacaccaccccgactctggtactccggtactcctcttatatttccatcattgacttactgctctacgtttgtgtaatttacttttaattatg

SEQ ID NO: 19189 - DNA, 487 bp, Homo sapiens
gaatgtaacttataaaagctttactgaatataagttataagcattttattcattagaactccaaaatagatgttcaaagttcagtccttgccatttgactgagaccacatggtgtgccccttgagtgaggctaatctttaggtctttcctatagaaaacattcttcctccatcagtagtcctttatttgatattcagaagtggaaagctttttcattctccagtagaacttttaaaaattgttacagatacctagctcttcacagatatcatgtactgtaaacagtcatgtgtcttaattttattttctctatttgagtgcataattatcctaataatcccaaagacactgacaactcaaggaacagcagtacagtactattagaagttaagtatgttgttgttatttcacatttcatttaattgtggataaatgttagacatctgttgaaataagctcatatggtggaaacgacaactatattatg

SEQ ID NO: 19190 - DNA, 536 bp, Homo sapiens
aaccgcatcacttgtacagaaagtgtatgagccacgcatgtagggaagttttaatatccgtagggaactttaccaactgcaggcctaccttgccagcaggcctttctcaggaagcagcctcagatctattcattcttttctgcacacactatgcttttagataggccagtggctttcaagctgcaaatccaggccagacccaggtcggtttcacctgccactctctattccaatttgaagtctcatcggcaccgtaagcataacacagccctgaccctggactccatccctgccttccccatcgtgcccacagctgacccctcccgagttgtagccacgaccacctggacctctgtgaccacttcctcatgggtttcaggtcctcacctctgtgtttcaaactattttcagagtgtccttacgaaactgaaatcagtgtcacctccttgcttaaagctctccccaggggctggggtgtgtggcttatgcctataatcccagtgccttgagaggcagaggcaggggaatagcttgag

SEQ ID NO: 19191 - DNA, 403 bp, Homo sapiens
atagaaatgagagctgttcaagggaaaaacttacacattttgtggatatggaaagtgaagaagatgagctacatgtgggtggtttcatcctttgaacattacaggcaggcatgtaaatacttagtaaattgaatcaaagttaaaacccaaaaaggagtggggaattggagacaaagaaccaaatttcccatcactatatcagctgaggatttcctttctatgcctgtatttctacaacaatgataatatttgaaaatctttatgcttctattcatcttgtcaccattctagtccaagccatcgttgtctctcatctgaattattgaaattgcctcaattatttactaaggagattcacaggactcagaatatagtcatactcacacctgtgatttattacagc

SEQ ID NO: 19192 - DNA, 426 bp, Homo sapiens
tccatgagcaccccggctgggtagtaattgtcctggagctgccttgtaaacacagttaagttgccattaggtctggctgcagataaagcatctaaaccacaaatattctattgattactctctgttatgggtaatgcagggttttccttcttgttcctaaatcaatgctgttgctttatataaaataaaggagaaaaaaataacagtcttgcaaacatttttatttgccaagttaagctgacctccagggacacaggcattctagcacttagaagccaactctcattgacacttgtttgccagaagtttctggagaaaactgtttaataaaagcgcccaacaaacaagacccattcaattttctccaattatacctggagagtaacttttgctcactccatagttttcctctttgcctcgggtctt

SEQ ID NO: 19193 - DNA, 563 bp, Homo sapiens
aataacctaggagtccatcttctcacagtactgttttgcagaaactatgtaagacagttgtagaatgttgtttctgcctgtctgctgtggaaggttataatatataatacgaagtctggaggagctaaaagtgggcataaaagactgaggcctatgtgactcaagcagtataaaaaacttgtgggaagttgaagttgcaatttcttgtcgtcaaccttggctctcatctttggaagccacataggccccaaaggggaaaagaagttgcttacttgggtagctgagaggcttccaagaagatgaagatactgtacctgctttatcatctgtcctgtattcttttataaaactaaggaggctgggcatggtggctcacacctataatcctagcacttcgggaggccgaggctggcagatcacttgagctctggagtttgagaccagcctgggcaacatgatgaaaccctgtctctgctaaaaatacaacaattagccaggtgtggtggcgtgtgcctgtagtcccagctactcgggaggctgaggtgggaaaactgctcgaaccc

SEQ ID NO: 19194 - DNA, 495 bp, Homo sapiens
ctggtggccattatcctaagcaaattaacacagaatcagaaaaccaaatacttcatgttctcacttataagtgggagctaaacaatgggtagtcatgccataaagatggcaacaatagacactagagactgcttgagggagaagggggacaagtgttgaagaactgttgggtactatgctcagtacctgggtgacaggatcattcataccccaaaaacctgcacatataacccctgaacccaaaataaaagttaaaaaaataacaataatatgccgagcatcagagacaatattaataataattaataattttaaactgcctttatcacattgctcttgaccattcagatttttaaaatctagagccaaaggactgacaaaggaagttgaatctctttttttcagcatcataacattaaaaaaatcatttctagcaactgagttcctggtaaataatcagctgtgtttcatcatgtacatgcaatgtgcaggaag

SEQ ID NO: 19195 - DNA, 634 bp, Homo sapiens
gcaacaggtaataaatgattcaacttctttcagaaatcaccttagttgatttgctgaaagagagcaagaaaataaaatttccttaacaacaatttgattgtaggaaaacaaggtaactacctttgaaagtagagatacaaaatattcaccaatcaaaagttaacatgaaagccttctacattactaaagaagcaaccaatagtttctgataccctctaatgacttcccattaaaatactcccagtattgaaaactaattttgaaaaacaaaaaaagaaacctcaaattcccagcaaaatacatacaaaaactaaacctggaaatatacttgtaatgcatttccttgtccaaaaacatacttgtagatcattttaatgcctgcatagtactctactgaaaggatttaccagcatttatttggctgattctccattattatttgcatgtttttaaatcttcattactgtgatatattactatgataactattcttgtatttacaaacatctttacacacgattgttttcttaaactaaattttagaagaggaattgttaggtaagggagggtgaagtgtgcttgattataaaggatttaataaatatttgattcatctctttctcatacccaacat

SEQ ID NO: 19196 - DNA, 533 bp, Homo sapiens
tccttagtcaaattgcgaatctgggaggtttatatagagttaatggagttaatggttttatagctccagctttcaaaatccctatgctctttctatagataaaactatcgttaagaagaatccaaaactcacactgatgtatgaaggtctaacaagttatatttgactggaagtctagaaaatgaggctcttctcttggctttgagatgacttactcaccaagcttcctgcctctctgaatctctcttccctcaaatataaaatgaagggactagttatcatggtgattcccaaactcaattacacataagaaatacctggagaggttttggacagacatatagatgccaaaacttcaaccacagaaactatgatttaatagaactgagttggagcctaggtaattcaaattcaaaattaaattgagaattgctggactttgcaagaagaattccaaggctccttctagtatgaaaattctagaatacaattatttaactgagaataattatccttttgaactacaatcatag

SEQ ID NO: 19197 - DNA, 592 bp, Homo sapiens
cagcctcagcctctaggtccaaaagacaagggtaaaagtcttagcgtctcattcagaatatctgtgagcaataccatgttgattataaaatgtgtcttttcaagggaaagctgcttaatatcaataataagttattttatacagcttagcttgtaatataaaatctgaaacattgagaaataaattatattttagaatttgatagaggatctacttattgatctcctattggatgggaagttaacccaataaaaagggtccactgaggtcatgtgctgaatgagagcagataaattcttctctgaaaatagttccctgctcctgatggtgaatgttttagacagaatttcctcacatgccttagagagatgatataagcaagctatgctggggagaatgatgtgtttgtgggatggtgactggtccaggttgactacagcagagaagtacttgcgtaggaaagtagacagagaaaacgacactgatggatgttacaatatgcatcctttataattataaaataacatggaaaacatgctaatgaaggaatcattggaaaattcagagaagtgaatattttaataaatcaata

SEQ ID NO: 19198 - DNA, 570 bp, Homo sapiens
cccatctcctccaaaatacaaacatcggtcatcagaaaaacaactcagctgtgtgaccagacttaatagcatactatacggataacagccttttttgttagaaaaaatatatgtaatataaaaagtctgaaaaaatatgcttatctatattttctagtttttcttcacatattatttgggaaataaaagtgtttaaataatagatttagagtgaaaaaagataaaagtaatattgcaaagtcacaaagcattatttcttagtattcacagctatagctgaacgatttatctggattcgtttgtgttcattcaccatcaaattcttgtaattcgtatgcttagaagaccttcagaccttcagaagacacactacatatgtgtcaaaaagttgagtcatgtctcgtactctgaataaactagaggcagaagaattacagagtttaagtccagttacatagttctgctttgaggatataaaagataatctatagcaatgtcattttccattatttaacaacttacttccatttcattatcatctgattcctcttccacttctacttcatatat

SEQ ID NO: 19199 - DNA, 554 bp, Homo sapiens
ccaggccatatataaatgacgtgctaatcgcttggtgcggacgattaacagggcgcctgggaaataataaagcaaaatgccaccgagcagccaggcacagggccaggtggtgccgccttggggactagagtttggctgtccggacatgaatcctcctaggagacctcaaacgagagatttctccgtgctgaacctcattcttctcatctgtaaaatggggatgtgtgtggcgcctgcatggcggatatggaaaccaaggaggagatggaataagaagctaattaggccgggctcagtggctcacgcctgtaatcccagcatttgggaggctgagcgggctgatcacctgaggtcaggagttcaagaccagcctggccaacatggtgaaacctcatctctactaaaaaatacaaaaattagctgggcgtggtggtgggcgcctgtagtctcagctacttgggaggctgaggcaggagaatcgcttgaacctgggaggcggaggttgcagtgagccaagatcacaccattgcactccagcctgggtgacccagtcc

SEQ ID NO: 19200 - DNA, 629 bp, Homo sapiens
tgataaaaggcctgtagcaaaaggtgcagcacccagaacccagcacagattattgttgtctgtgtggatcacaacagctgtgtggccccagaaaccaggatggcaccaggcactctttgctgaataaagtagaaggcataattcctaggagaaggtacaaatcttggcagatggcaccaatcttggcagacagtgcaggtctgaaaagcctgcatggctctgtgggattgggacaaagaaaacaattctggtacttttatttcactatggaaagaaaatagtggagcttgcgcctaatgtcccagcattccaacgcacagtccttgggaaaatgcaagagtggccctcaataaccagcatggctctgtgggatgggtagaaggtgcaaaattttaagatttttttccacaaggaaggaaatgagtgtaacatgcgcacatataaaaaaaaattgaggcattcccagaatctgtagtaaggctaattagtgaaggtctttccctgccaaagccagcctgcaaagaccagaagaggtggctgctttttcacatgaggagacatgtaaagctacaagaaacaagaaaatacaaggaaatataatgctaccaaaaaaaaaaaaaaaaaaaaaa

SEQ ID NO: 19201 - DNA, 533 bp, Homo sapiens
aacattcttttatgtgctctaaaggcaaggtttctatgcagttacctttgtaaatagaataagtttctatagaatcagtcttaacttttatgagtgagtttgagaactctcgatgcaggattatcatgttggaaagctggctgtgatctccaggtcagtgaactgcagttctggcctccataggagaggtgtggcaggtggtggtctatctctacttcacagatggtgaaagagggccagacaggggagaggaccttgcttgggatcatggtggtaagctaggggccagttagcagaaggatgaggccttgatttctcactctgactggtgagctctgttgtgggttgagtcgtggcctcatcaaaaaggtatgttcttggccgggtgcggtggctcacacctgtaatcccagcactttgggaggctgaggcaggtggatcacttgaggtcaggagttagagaccagcctggccaacatggtgaaaccccatctctactaaaaatacaaaaattagccgggcatagtggcaca

SEQ ID NO: 19202 - DNA, 527 bp, Homo sapiens
tcaatttctagctcttatggactaacccgtaataaggcaagaactgaaggccaaagggtactataagtaatttcacttccaaaatagaccaaatgttgtcagtgcagaagtgagtagacaggagactagaatctactcttaagaatgtctcacaaagaaaggaagggggcttggagtaatgaaaaatgttgaacagaagagaaagaattagatttataggaaaaaaaagaaaagaaaaggaggggttggaagagatagtatataggagtgagacagtgagaagatatcctgatattatagtttcagaaggtatctccattctgtctcaagtgtagaaaacagaaaagagtgaatgtggttgtaaatgaccttaaacagagagagatggactttttttttatcatttgaaatgggaagccccaccctcacctctcaagtcatctgtttcccccctcctcccacatccacctgtcccttgcctctcaccaagtagaatgtgtgattaaaactttttcagcaagattagt

SEQ ID NO: 19203 - DNA, 447 bp, Homo sapiens
catattttgcactataagttacttggacatcttgtacatattccatatttttaataaattgccacattttattagagattctataatagcacccccaatcatgagatataaaaagtctagtgaaaatatgatcatactataatgaggtatatgtttagaatactgactctatgaaaaatttttaactcgtatttttgtttttgctctggcagaacatgtaaaaataagcaaccttattaatacagcagtgaaaacattcatactaatggaagacttttttgctatcactttagataatattcatagtaaaactaaaccttttaaactaaatatttaactagctttaaaatctatccttgatcttagtgagaaaaagtaaatttctgtaattatggatgaatttaacaaattttgcatataatccaagaaactaaactaaactcacct

SEQ ID NO: 19204 - DNA, 474 bp, Homo sapiens
atatatgaggtagcatgtaggagagacctatcagttttataatatttttgaagaatgtgacaaggtgtatttgtaaagtattatttttagcatatgggacaaacaacataagttaaaatctgtttatattcttgtgatgccaggagctttatttcttttactacaaaaaataagggacaattaccgtccgggcgtggtggctgacgcctgtaatcccagcactttgggaggctgaggcaggccgatcacaaggtcaggagttcgagaccatcccggctaacacaatgaaaccccgtgtctactaaaaaaaaatacaaaaaaattagctgggcgtggtggtgggtgcctgtagtcccagctactcaggaggccgaggcaggagaatggcgtgaacccaggaggtggaacttgcagtgagccaagatcgagattgcgccactgcactccagtctgggcgacagagtaagactccgt

SEQ ID NO: 19205 - DNA, 545 bp, Homo sapiens
attttttcccaggtccttgagagaaaaatgcagcactgctaacttcttcatttaagatttctagcttcctgaaccgtaaaagaataactttatctcattttaagcgacctgatgtgaaccactttgtcacagcagatataggaaattacacctccttaaagaatgcagaatcctggcccgtgcttgcctcatacctattgaatgagaatctaagggctctagaatctgcattttgaaactaatacataatacacaaagagaactcactaagtactctacatgcacttcatcctcacaagccatgaagtagtttactattataattctcattttacatatgggaaactggagcattaaaagattaagtaatttgcctacagtcactcacataaccagaaagtggaagagctgggattcaatcccagttccagacatcctgatatcctgggttcagacaccacacacttagcaactattacacacttagcattattattattattattattttaatcaccatctccaccttcttaagcactcaaaag

SEQ ID NO: 19206 - DNA, 628 bp, Homo sapiens
cccctattgcccctgttcatcttcattggtgagtattagatgctcaccgtacattgtggcttagtcctcagacactgccagccacaaagtacattttgtttcttaaatggatggttcgtggatagaaagctttcacagtcagactcccaaaagaaagcagcccagaaaccctgtagagggtttgtgaagaattgctttagagaagaaacatttcctggtgtgcttttttcgagcaatataacttggtggggggaaacaggcttattttaggttaaaagtgaaaaacgtaattcagttgttacaagaaaccacaaacatacaaggttgtcagagatttcaaattgagaactagaaaattatttcctttccagttctctcagtccaaatacagctttcctcacaactgactttgggccctgtaggtgcggtggaatgatcccggtgcacaatattccttagttgacaaagagaagctgccaagattcccattttcaattgaccaggaaggagatatttacgtgactcagcccttggaccgagaagaaaaggatgtagtgagtaaaagagaagagtttcacaggcgacaagacaaagtcctatgcccatctacagttgagagcaaaatgga

SEQ ID NO: 19207 - DNA, 572 bp, Homo sapiens
aagacctggaactaaacatggtactggaagtgaaaacaaaagttagattacatgattcccaaaggaaagcaaatttagaccttgtgattaaccttacggtcctgacactgtatcacaggagcttttgtgacttggctccaggttgtcagaattaatgagattacatgatctttctactaataacaaatccacaatgagtgaaagtgtataatggggagtctgacagatgtcaagttacaagacatctgaatagggacataggtctcccccaaatttgtatcataacttgggccctgaatttctcagataaatatttgatacacataccaggtgtccatgtatcagtaaatagattaggaagggagaaattatgagatagactgtgaaatggaaatgtaggttaaatcatggcataataatgtacagacaggaagagaataacaagtcttcatataatctttctttccagctgtcaagaatgacaacatgaataatatataacttttgggaaaatgttagtatgttcacattatacttcttcctactttcctacagtcatttaattcatatac

SEQ ID NO: 19208 - DNA, 601 bp, Homo sapiens
agctggtaagtcgtagtccctggagttggaccagacacagtcctcgagtctgtgctctactcactcttttagctgcatttccactgctagatttttaaaacgaagcatgggcttttctatttatttctcttcaattttatctcattagagttcagtttatcgtttaagccagtcaataattttgggatgaccatttatcattatctcttttcaccaaccttccagtttcttaccccattgaaacttcactggccttccactaatattttttgctagtcattaataaaatgattagtcaggcaggcagatatgaggacaaagtcctatgacaaattaccagagatttacttccaagttgatcaatcttgatcaatcaataacaaatttaatgtaactatagcatagtccctatttatttatctcatctacagagagaagcaagaaagatatcgttagtcaccttaataagatccagtcatactacataaaagcactctctgaatctattgctctaataaataaaccaattaagaaagaaatttggtttagtgacatatatttcacttttagtgaatccatatcaactctaaatgatcatctt

SEQ ID NO: 19209 - DNA, 509 bp, Homo sapiens
aattccagacacacattatacattgactccaagaaactagtataattatggtgagaccttgggaaagatactgttttccacactgaatattccctgaaaagcgtagcagcactccacttgggaattcacgttatcaccattatcagaccaactgctagaatcaccttttctttcctatttagcttattcattcattcattccacaaatgctcattaagctcctactcttgccaggtattatgctagaaattggggatataaagatgaatttaaaacatagtctttgtatttgcccttaagaaatctacagtctagtaagaagaagacataagtaaataagaacaatgaaatacaggctctagaagagatctatatcttggaaatgtcagtgacagaggtcagtagaggacttcaaagtgttcaccaagctcaatcttgaatgaaagttggtacctatcagggagcaaagaggaaagactataatggtaagaacgagaatatgaatgaag

SEQ ID NO: 19210 - DNA, 375 bp, Homo sapiens
gaatggagaagaaggaatacaccatgctaggctcagacgtggggccttgggtgggatgtaggcagtggctccttgcacggggtgtggctataactgggacctccaggtggtggctcatggttgcactggggaagtaaactaatctaggcataaaagttgatgaagctgtagcaccaggagtccaagctgtgaaggaagttgagtccttcctccgccagcagcagactgtgagctgcagagtcaaatatgatggaaagtttccttttgagaggagaaaaaaatggtgaaaagaaaattctagcaaataaaaaatgatttgcaaggcttctcctgtacttgctaagctggagtgcaatggagtgatctcagctcact

SEQ ID NO: 19211 - DNA, 323 bp, Homo sapiens
ttactttttagccatgggcaatggatattgaatttcagttcctctgatctggtaaaaggcttgttagagaaacttctttattttccctgtgattacttgttccatatttcttagtaggtctgggtcacagactggtcaagaatctgaaatgtactaaagatgggtcattgcttactacaaatttaatgtctgttgttggttgttatcactattgcctctatagtgttattaaaaggcgatcaggagttcgaaaccagcctggtcaacatgatgaaaccctgtctctactaaaaatacacacacacacaaaattagccaggcgt

SEQ ID NO: 19212 - DNA, 305 bp, Homo sapiens
ctgggttaatggaagaaatagttctattcatcacttcctcattttccctaaatctacaatctccagatgtcactactgaattaacagccaacaattccacaacattacctgggagacactggccctttttcttcctcttcttcatcatcactttcattttctgtaaataaattcagagaagcaggtcacattaagcaattcatacttcacatatgaccaaatcactgtccagtcatagcacaaggacataactattctcagtgcaagaataaggattctgacaggaatattctagggtgccctag

SEQ ID NO: 19213 - DNA, 301 bp, Homo sapiens
gaaaaacaaaaaaacaagaaaacaatgcattctttctgttcctgtatccccctggccaccagataaatcaccaagatcagataccatcacgcctgctaagggaggagtggaatcaaaaattgaaggaactgcaagaccaggctaatacacaccagcagaaactgaaaataagcccgggaatggatactacggggcctagatcaaggggtgaggggtgagggctggggagcaaataagagagagtttatagatatgtgggcactttcctttaatacagatctcacactttgtcaaggatgct

SEQ ID NO: 19214 - DNA, 334 bp, Homo sapiens
gttagccaggatggtctcgatctcctgacctcctgatccgcctgcctcggcctcccaaagtgctggcatttcaggcgtgagccaccgcgcctggcctaatttttgtatttttagtagagacaaggtttcaccatgttggccaggctggtttcaaattcttgacctcaggtgatccacacctgcctcggcctcccaaagtgctaggattacaggcgtgagccaccatgcccagacaaaaaaatgaattatttgataaatcactttctcaggttgagaatgttcttaggatttaagtatataaatatcctaatcaaatgaaagtccttagaaaacc

SEQ ID NO: 19215 - DNA, 490 bp, Homo sapiens
tcacctcatctcaccttgagacctggcagtgagaaaaaccacaaatgataatttccatgttgaaccaagactgataccaacatggagaaaacttcctagtctcccacccgctaggaagaaatcaggcttgaaccatatatgttcttagtggtcctaggactctgatggttttttccaagcaccttaggtgtgcagtacccagatcacatatacctgtacctcttacctgttccaggaacaccgtactgtgcatatatcttgcctgtatctatttcatttgtcctttcttacgtttcctttttcacacctggccctcagataaagacccatgtagtatccatgtccccatatttacaaccaatgagactcagaaatgtagtcattgcctgctttcatgagtcctggctcagatcgaaagtattcagttctctaacatcatcaatgaaacctgatatccttagtctggtatttagcctttcatataatgact

SEQ ID NO: 19216 - DNA, 483 bp, Homo sapiens
cgctgtagtgtttaattgttaaagccatatgtgtttcaagggaaattgaatccatatgtttctgattcatttgcactgagctcatcaaattgttgttttataagagccgtttgctgtccaggaagaattccccagtgcccctccccacaccgttctatgctgtctaatatctttaaaacaggactctgttctctgcccagcaaaaccctctatcactaccgtactactgcaatcaccttctccactgtaacgttttacatgataaaagttagcctcttttcatggagtaagacaagacggtatcttacagaaaagccgcctaagtgtctcccatgaaaactgcagagtgaagattgagttaaacaaagttaagcaagtctcttcgttgatatctcaagactttacatttcaaaaaagtgaaggagccagacatagtggctcacgcctgtaatcccagtggatcacttgaggtcaggagttcta

SEQ ID NO: 19217 - DNA, 489 bp, Homo sapiens
tgggattacaggtgtaggccaccgcaccacgtctggcctgttcaaaaagtattatctcacctgcatctggaagaatatttccaactttggtttcatgggtatattaaaatcgtatgtaaaaatagtggatatttgtagttttctgtggcgccagtgcacaggtgtcctcagtgttatgaggattacatgagttattacaagtaaatcatctaggcaaatgtttggcatacagtaagcactcagaaagtgttggctattactgtgcatggctttgtaatggaggaatggttgaattgcatatattaggcactaaatacagtagtccctccttatctgaggttttgatttctgcagtttcagttacccatgatcaaccacagtctgaaaatattaagtagaaaattccagccgggtgcggtggctcatgcctgtaattccagcactttgggagaccaaggcgggcagatcacttgaggtcaggagtttgag

SEQ ID NO: 19218 - DNA, 401 bp, Homo sapiens
cagtgtgtaaaaagaccaagaagagagagaacaggccacaaaaccatgagacagaagccttctttttctaaactctgaaagaacaaaataaatagtctaactggcctccaaggattgccagatggattagttaacgtctgcaaacaatttttttgatgaaagccaccacagaaaagctaaatcttactattaccttagctgaaatactttgctaatttgtccatgctgcattaaagaatctatagaaaaaattccacacacactaacttaatgacctttgaaggaggaaattttcattcatgcacactgtggagagggccaaggagtccctgaatgtgtggtctattgacatctaaggcccatatttaacacacctgactgagatggaggcctatggggac

SEQ ID NO: 19219 - DNA, 344 bp, Homo sapiens
cttgtggctgtcccagggcactgagggctgactgggcaccagcgtcatgtggaatagtttgggaagtaggaaagagacatgctggcctgagaggtccagatggacaactatatatttctgagggggagcactgacatctggagttgagtccaggccactggatgatgaagaccttacttcctctggggactgggaagttttcatgattcactgggaactggagatctctgcggtaagacagtgcctaaaggttcccctgccaacagctgatgcagcccttcactgtccctctcccactgccctataggccctggctgttccctacagtccctttggcagagcgc

SEQ ID NO: 19220 - DNA, 216 bp, Homo sapiens
tcttttcctagaaactaatgtttttaaatgtccattcatgctcaaatctatcaagaaagagactcatgttactaattagaattctgatttaaagcttaaatagaaacagtaaaaggcaaatgcaagttgaatattggtctattttgcattactctatataccttggtacaacaaaccaggggcagggactgaatcaatggtcctttttaaagcaat

SEQ ID NO: 19221 - DNA, 269 bp, Homo sapiens
cattggctaaaaagtgaaccagatactacattacctcagggcagttgtaagtactgagtcagatgccttaggcttgtgtgatgggaagtttagggcgagaccaatgtcttgctttaacaacagtgtgaataagttaacttcttttgagattttattactcaatattccacccagaaagaaacacagatgacactcagccaatcaaaggccatctgggactgacaaacgcagagcttgttgtagatgacaaggctcagtggatggatcat

SEQ ID NO: 19222 - DNA, 472 bp, Homo sapiens
gcggtgcttactctaaattgcaaatagaaagcctttcccggggccgggcgcagtggctcacgcctgtaatcctggcactttgggaggccgaggtgggcggatcacgaggtcaggagttccagaccagcctgaccaacatggtgaaaccccgtctctactaaaaaatacaaaaattagccgggcgtggtggtgggctcctgtaatcccagctactcaggaggttaaggcaggagaatcgcttgaactcaggaggcagacgttgcagtgagccgagatcgtgccactgcactccagcctgggtgacagagcaagactccatctccagaaaagaaaagaaaagcaagaaagcctttccagggcccacagccctgcatcggccagccctgcccacctcttaaaccacctcttcccccattccccctgcccattattcactattttccagcaaaaatacgcagtgctcactccacac

SEQ ID NO: 19223 - DNA, 595 bp, Homo sapiens
cagtgttaactgtgaacacctggctgtctctcttcatgaatatttatggagataagtgttgggcattgtagtaaggcgaaaagagagatgaaaagatgaatggatgaagagacagaaagaaaactggcattgtttagtaataaataggtttaataacaaaaaaatcaatgttactcaaatttaaaaagaaaaagtaactagagaactaaagaaattgctgttcttcaagagaactatattgaacaagaggaaatccttgttttgtaatatttctctatgagtgaaagaaaagaggtaagacagttatgagagactcagtatgtttgtgtccacatgattagacattcaaccttgcttacatttcttctccctctcttttgtcctctatggactgttttttaaattgttgtaaaattatttttactttgtcaagatttacttatttaaatttttgttccggacccatatttattcctgtaactgtttttctcaatttaacatttaaattctcattataccatgtgttctacattgatcaattaaatggttccaaccaccctcttacaaggactaaaaaaaaaaaaaaaaaaaaaaa

SEQ ID NO: 19224 - DNA, 373 bp, Homo sapiens
gccacctgtaaagtattttccccacgagcaatggtatggagactgttataataaacacatgttttaggcagcaaggaattcagtggaagttgctagacacgtaggttgttcaaaactaagcaagattctcctaaacgaatgattcatccatagtaacaacactaatgcattattgactttcagtttatatctattttcattttttccaatctgttgcagtgcaatagaagtggtggtttgttgtgttgttgttttaagatgttgttttaagtacataatttcactccatttgtgccaggaaaatgcccaaacaccttcattagaaataaggcaaatctgttcaacagtactctgaacagcaggcactgtatgc

SEQ ID NO: 19225 - DNA, 471 bp, Homo sapiens
tagttctatctggactctgttgcctctgtagcacattttctctcatagacctccaccccaaagctaatcctacttttctgtcctattttgaggaattatgtcatatccaccctgttgaccaaatcaaatctgagagtgatcgtagatttttctttctctcaagattaagtgactctctcttaatcctcctcatattctctcactattcatctcccgccatcagattagtcactgagatgtgttccttctagcttctatccatctttcatattgagtgtctcttctccagtttacttgtatcccctcaatccaagccttcatcatacctccatatagcctagtgggtaagagtgtggggtctagagttagaatcctgaatttacgttctgactgtatcatttgttagctgtatgattttgggcaggttatatatctcttaatctttaatttcctactctgcaaaatggagat

SEQ ID NO: 19226 - DNA, 484 bp, Homo sapiens
gaaaggcttaaagtactataagcaaataaatgaaataaatgttaaaatgtagtaaacatctttttttctaaaaaaattaacaaaattataggaaagttagaaaaaataaaatttaatatatagaataagtaagataataataattaaggacattatttgaatgaaatgcagcaaatatttacatacaggcagaaaacatttgaaggaaaatattacagtgtcattaataaggagataatgcttactctttttgatacttttgaaacaattgtaaaggatgaacagttatttaaatcaaaacattctaggaaactgatctaaccttagtcacaaaataagacaacaacagcaagaatgaaagtcagaaagacggcagaagcagcaccaggccacagcctgcatctgtaaactgacttaacaacaatatatggatcaagttgcctttctgagaattccataagccaattaaaaaattgtagcacat

SEQ ID NO: 19227 - DNA, 294 bp, Homo sapiens
cctctctcttggaaattgtcattaactttcccacctcactacctcataccccttcacatctttcatccaactaccaactagattttttataaggttttgtgaatttcaaaaacattttataattattgttatatacccatttctatatactttattcccaatgagctatgcatgcagttggcatggtgaggcatgtggtgttacttaccatttttcacataaagtgatgcgtgatggtttaatcactatgaaaacagtggttcataggctcatgaaggagggttgacttgggct

SEQ ID NO: 19228 - DNA, 297 bp, Homo sapiens
tacggttgaaacaactggcttgagttttattgatttaactagctcttttggtgtcatgtagatacagcttttcaaactaataaagcagagtcattgtgtgtctaaaaaaacattggttaatctgaaaatcttgtacatttgatcttggcatgtgttttttacttatgtttgaacatggatgtgtctgacatcctaagagttcatttcaagcaaaatattgaatcatagaatgaaaaatctacccagatattttagcccttatgtagttttccctttttctcatgttcatgctatgac

SEQ ID NO: 19229 - DNA, 404 bp, Homo sapiens
taaaataaaaaagaaatgtacttcacctagtgcctacatattatcagctctctataaactgtagctgtattagacctcactttttaacatctgggacatgctatggggtggaggtgggaggatgacatgaaatgtaattaaactaaatggtcaaacttcaaagaggtcaaatgcttacagtagcctgcaacaatgttccataaagtgaccgtgaggactcttgtgacagcacctgagcatttctttgaatctaaccaggtgtgttggtttttactttatgctaaaaggatctcatgccatgagtattttgtgaccttccagctaatttaaatattgcttactgatttggtgttatacatctgttgtccaatacttctatccatcatccactgattccacattct

SEQ ID NO: 19230 - DNA, 402 bp, Homo sapiens
gcaactatagattctgggacattttcaatttctacctacttttttgcagtgcctgtcctgacaggcccccttgtcaaaacatttattattatccttcttcatatatcaccagttttcaaagcttttgcatccattaaaaaaatacttctacctttctaaaaagaacttgggatgaaatctggtctcgctttcactcttagggccttggcacgtccttgccatcattagtagggcttctgcttggtggagccctggtaaagagacaccctcggccaggcgcgggggctcacgcctgcaattccagcactttcggaggccaaggcgggcgcatcacgaggtcaggagatcgagaccagcctggttaacacggtgaaaccctgtctatactaaaaatacaacaaa

SEQ ID NO: 19231 - DNA, 367 bp, Homo sapiens
cagatcacctacatcaataatgctaccagcttaagcttgctctggggagacattgtgtgtgacagactttattttcagggcaaactgccattgaatgcagttgcagaatccattgctctgcccagttaagccagaactgtatttgatcaatgggccttatgggtgagtgtcagaataataaggccactaatcatttgcaaccccatggcaccattcatcaagggatctcagagaactttacctgagttaattaatactggcaacgtctctgtgaactagataagtgttattattcccattttacagatgaggagactgagtaatggagaaattaacccaatgttgctcaataaagggatgaaaactc

SEQ ID NO: 19232 - DNA, 613 bp, Homo sapiens
cagggagggtttcttggccattcagagccattcaaatattccaagtaaactcaaggatccagaaacccactcgcagtcatgaaataccagtgaatggcctctgtgagtctcttcaaggttttcaaagatgactgcctgagaaggctggccaggaagtcacccaagcccaaccttctgcaggacgttctatgacagccagggacccagggaattgccattgaacagaagggaggaacagagacggcacgcctgagcttctggaaacattctaagtgcccttgttggcccagaaaagactggtgctaccatatgagtcacatacttggcaacctacctactccaggaaccacagaaggtttaaaggttcccaggaagtcccaggaagggcagccatagccctttagagccatcagattttattctaagtctacttgggagacagtgctcttagcttcataaaaacaccagtggtggtgctaacacttgccccagtatccagtcttttctacctcatctcagagccaggcagccactatttcccaaagctgctgtgcaatgaaaggggaatattctaggtgctctcctgtgcccacgaaattctgtggctgcgctg

SEQ ID NO: 19233 - DNA, 547 bp, Homo sapiens
cctcccaagtagctgggattacaggcgtgtgccaccatgcctggttaagtttttgtatttttagtagagaccggttttatcatgttggccaggctggtttcgaactcctgacctcaagtgatctgcctgtcttggcctcccaaagtgataggattacaggcgtgagcctccgtgcccggcccctttgctacattttaatgataatgaaaatgtaatccaagtgtcagattattcagtagcttcctgtcttttggtttgtgggaagtttgatacgttattttttaatgtttcttagtcctttgtatatttcatggatagtggggaagtgagtctgtgacttgattgaaatatattgtacaatgcattcatctgcatcataggcacttggcttttaatggtaaagtggaaactaaacttctccttaggaacaatttgcactaatttatttaactgatattgatgatgctccataaagataaaaatgtcattgcatggaggcttacttgtgatgtaatttgtactttggagaagtaaatcatagtatgat

SEQ ID NO: 19234 - DNA, 600 bp, Homo sapiens
tgcttcccttcctccctgtccccttttgccttgagtcaaggtcatcctaggtttctgctgcgcctccaagataagctcagctgacaatctaaaggagacaccccaaagcaaaaggggacagggaggaagggaagcagggggaaaggcagaccttgctggcgtttctgcctctcctttaattgctattagaggagtggaaggcagaagaaggaaaataaacctgtgaagcttcggggaagcagggaggactgtggaaagccctgttctattgctgagctgtgtgaagtcatgtgacatttggagtggaagctgctgtctcccattctatgtaccaggagtccttattatcagccaggtgcaccttagatgacgttcacagccctggaggtactgagtttcctgtgacctccacttcattttaaaaaattacaagtgtttactgtaactaattcaggcaatgcagattcttatgcagtaaataaaaaagttaacctttctttccagtagtgtcagcttttagctcagcagattgtttagtttctttgcttttttccttctatcttgccttccctcctaaaaatcagcactttggggggttga

SEQ ID NO: 19235 - DNA, 565 bp, Homo sapiens
ccatgtaaggacacacaaagaaggcagccacctgcaagccaggaagagagccctcaccagggaccaaaatggccagtgccttgattttggacttcagcctccaggagagtaagaaataaatttctgtttcttaagccacctaatctgtgatattttgttatggccatttgaactgactcagacagccaggatcacttatttagttgttcattaatttattgatccattcaagaaattcaacaactctctattgagtgctttatgtaccaggcactgtttttggaggtcaggatgcatcagtgacagaagacaaaaagattcctacattgtaagcttacctgtagggacagtaaacaatcaacattagaagtaactaaatctgtggtgatgatactatacattttgtgatgtaccttaacagtacataaatgtcttttacacccattattgcatctgacctggcagaccccgggaggtatgaggaaatgaagcccactctccaggtcacatggctggtaccaattatagtagtagctaataagtatttagctgcttattatgtgct

SEQ ID NO: 19236 - DNA, 497 bp, Homo sapiens
cttgcccaaagaatgagagatgcttcagaaattagcaaatgctccaatataaatcaagtgatagatataaataattcagatatgggataaggaaaatgggtagctttctcttatttaggaactctatgtcaggcttctgtgagaaactgtttacgaagcagtctgacaatagctattggtctgaagtattagtaattagtacagaagtgccaataaaaatgtattgagggattatcatgtactatggcttggcatatactggtgaaaaacaataatgtaggattgccttaataaattttctggtcttgggaaggaacagacaatgaataaatgaataggcaaatatatatgtacttgcaaattgtgatcagggttcagaaggaaaatagggtgttgagagtcaaggaaaaaggagacactttacgtagggcaaccaactgggaataggctatctttaaaagtcacatctaactgagatcagaagtatatgaataaga

SEQ ID NO: 19237 - DNA, 574 bp, Homo sapiens
tgggtttttatcagtttcaatgtaaattataaaagcatcagtgaaccaaatcttgagaaaacaatgagaaccttaaacaatgatcctaagaatttccctgaagatgacaaaatctaaaatagatatctatgctttaatagagagtaagaagctaatatcatcataaaaaagatttccaaaatagcacatctatgttctttactgacacatatattccaaaactttgttaatatagggataagaatcacccaatcaacaaaagctgttaatacacatacatgtaaaatataaaaacattcaaatgctaattccaactccaaataggaggctaaggttaatttccctttaactttacaagttaaattccataataaaagttttataaaacaaattctaaacctcattcaacaatatttactataaccaaaatgtcaaatcaagagtttgcatttgctcttggaattcaccaaagaacaggatcattcttgaaaagcagactaaggcatggctactttaaaaggaaaatgatccacagccaggcatggtggctcacatctgtaatcccagcaattct

SEQ ID NO: 19238 - DNA, 563 bp, Homo sapiens
actaagcaaaattagaaatgtcttggtttatatatttcttcccatgctttctgtctctacaaccagaatataagcttcagaacaagagtattcaaatctggtgtgtttatccccagactcacaacactgggtccagagcaggtcctcagtagatgtttataaatatcaggatgtattacatatattaactttttatgagtagttattatttattatattccacttagatatggaattattacttcaggtggtagctgacttgtactggaaaagtgactgagcccaactctaatgctaatgttaattggatttatatgaagtttctttggttttaattgcactttgaatgaattcaagaatttcactagctataacttctatctatggtaagaagcgttgtccaagccacagaacctcaagattacaacagagatttaaattaaaactcttctaattgttattattgtaattattataattcaccaactggacaattggaacaataaactcttggaatttaaattaagtatggaatggggatggatgtttggggtgctttatag

SEQ ID NO: 19239 - DNA, 602 bp, Homo sapiens
acccaatcctttgctttagcttttaaaaattatattattatcagaaagttccctttttttctggtccaaacttcaaaattcttaaagtcccacctcaaatggcatctctttcttcaaagtcttcccaactcaacctctgtgacaaaatatctgatctctttctactcctttggacccaatattcatttttcatttagccttatccttgatttttctattgagagcccttacacgctcttcactcagtcgtaatctaaaatctcttgcaggaaaacaactcagactcattcatacgtgttcccttggtgctcggcttagtgccagagagtgaacagatactaaatgtttctgaatcaaagagactcatgcgagagtcagaccacatctctgaaatccagttttcagtgcaacaaactatgatttaattgctttgacctggcaggaaggaatatttcctttaaacctcaaacacagaagacctcaaaattaaagctcttcaaacgcataaaatgcctcagcaatataacaaactcagggtgatgagagttttatgaagagtcagaagaatcatcagaaacagagggagtagattctaacatgtg

SEQ ID NO: 19240 - DNA, 537 bp, Homo sapiens
cttgtgcctgtggtcccagctactcgggaggctgaggagggaggattttttgaggccacaagtttgaagctgcaatgagctataattgcaccactgcactctagcctgagtgacaggatgagaccctttctctcaaataaaggaaaaagaaaaaagtaataataacaaaataaaaagagtaatttaccaattactgagggagtctagaaaggttaagtataccccctctaaattggaaataacagtttaaaaaatattttattggtaaaaaataaaagccactttttatcctgagagagtatgtagaacttgaattttggtttaaagcacttattactaagcttaacgtaaatactttggcaaattgattctaacaaagatatccttctcatgacttaaaagagccactaattttacttttgaaatatgtttaatttttatattaaaagctaggatggctgggcgcagtggctcacgccagtaatcccaacactttgggaggcggaggtgggtgaatcacccgaggtcaggagttcg

SEQ ID NO: 19241 - DNA, 596 bp, Homo sapiens
aatgagagtaagagacttgagataaagtagtttactaatcgtcacacaagtagcaagataaacacatatatacatacttttgtgtataaacacatgttatatacatgtatgtatataatgtatgtatatatatgtttgtcttgctacttgtgtagcaatctctctctctctctcacacacacacacacacacaaacacatacacatatttgtttaatgcttaaaaatgccttcaccctaaatttgaaagcagggactttactgtaattcaccactgaatttataagaacctcgcaggttcatgattaacaattattcagtaaatgacttcaataaagacaaattattgtctgtgtttattgatatgaaatcatatttattgagtacaaacactgcactgtaaggtaaagtgagcattactggaaaagtagaaggcattgctaaaggattttaaagtagatttaagaaggtagcacaaatgaaaatttaatgttcaaatattctttcatttatttctcacatatatattcaatatctactctatgtgaggaaatgtacttgttgcttgatctgtaataataaactcatgtttttaaa

SEQ ID NO: 19242 - DNA, 615 bp, Homo sapiens
ggcaccagaaatgcaactcaaagaaagaaacagcagaagggaaataaaacaagaacaagaagctgggattgaagccagatgaggtggaatgagcagaggggctgagagatatagaatctaaattctacattacgctttgccacaacccacctctgagagtgttggccccatctctttcatcattcttctgcttcttaaaaaggttgatatgatgaggaaaataggaatgaggagagaggatctaaagtctcgttgcttcaaagctttagctgttcaatatcttctaagatttctgtgattctgaaacttacacgtttaaaaatttagagcctgatggactagctctgaaacaagcaaagcagaaggtagagccagtgagcataggatttgctgtccatgtgtagggggaaaggagaaaaagtagtttcagatatccttgaagtaaaccagtgcaggtcaaaaaagaaacaaagacagacatttaggacagactaatgatgttactaccatggtgaagtagaaatgattattatttagattggtagccatagttttatgtgtacatatatatgtgtgtgtgtgtgtgtgtgtgtgtgtgcatatatatacatacac

SEQ ID NO: 19243 - DNA, 541 bp, Homo sapiens
acttggtggatctaggcagtggttatttaataactgatatggaggtgtttcaacattatagcaacagatgctgtcatgctgatgcacaccagctggttataggcccctgttttttcattagtttttaattttatgtgaagtgctaagaggtctcattttgcctgaatgaattcttttcctttgattttcacttgctactctcggatctcctctggtagcaataactttgaaaactgtgtaggttttcatttttggcttctgttgtttcaacagcggtgatcctattttctttaatttgcctttggctatatgccctgtcataaagaagaatgaaaagacagaaaatcaaatagaataaattttcctagtaactgctagtgcttgaggaacattactgttgattcatttattcaagtatttattcatgtattcatcaaatttctttgacctgctgtcgcacaaagggagtagtcctttcttcagaggtgtcaagaagaaagacacaggctgggtgtggtggctcatacctgtaatccgagca

SEQ ID NO: 19244 - DNA, 341 bp, Homo sapiens
gattacaggcctgcaccaccacgcctggataattttgtggttttggtagagacagggtttctccatgttggtcaggctggtctcctactcccgacctcaggtgatctgcccgcctgggcctcccaaagtgttgagattagaggcgtgagccactgtacccggcctctgaatcatttttatttgttttatcatatgcatccacttatttaataaaaaaagctatattgataaccatttttaaaattatgggacatccataacagaatagtatatagcagttaaaaaaatgagctcctggctgggcgcagtggctcacgcctgtaatcccaacactttgggag

SEQ ID NO: 19245 - DNA, 228 bp, Homo sapiens
tccatgttggtcaggctggtctcggactcccgacctcaggtgatctgccagcctcggcctcccaaagtgctgggattacaggcgtgagccaccgtgcccagcctgagagttttttgaacaatagaataccatgcacgattaaaggataaaattttaattttgtgaaaaatcagtctggaagctggatttaggagccaaaaaaaaaaaaaaaaaaaaaaaaaaaagggg

SEQ ID NO: 19246 - DNA, 565 bp, Homo sapiens
cctgggctcaagggatacttccacctcagcctgctgagtagctgagactacaggcatgtgccaccatacctggctaaatttttttaatgtgtatttttgtagagatggggtctccctatattgcccaggcttgtctcaaacttctgtgctcaggtggtcctcccaccttggcctcccaaagttctgggattacaggcatgagccactgcacctgacctataacagcatcttttggagacctattttaatgagttattcttccagaagtatgtatattttaaagaagatggggaaagaattcagagatataactctgaatggaaagagttcaggtcttgggacacctgcatgaaaaaaagaattttaagcagggagtcctgtctgagccctttaaatcatgttgcgttgaagggtcaagtgtgcctactttaccaatcgttataagaattgggcccacccacacagtatgatcataaaggtcttaccatgagggaagctaccccagaatagcttgaggtaaacgtctggggtaggggcggtggctgaattgcaaggaaatagcatg

SEQ ID NO: 19247 - DNA, 539 bp, Homo sapiens
ccacaaaataaacattaagaacaagtcctcaactggtgaaacccctgagtttcttcaccagaagcaaatgcagagccattttgtaggaactcttccacaatcatgcccagtaaaaatgatcttgcaattttttttttaaaaaagcaaaagaccacacgagagagccattcaccaagagggagtagacacaataaattgagaattagcaccctgaaagggtgacataatataactgtgggtatcattagtgcaaacactattttcagccctttgccttctgggcacctaagattacacctcttggcccacttgagggaggagctaaatgaacaacatgtgtatgacttgtattaaaaagacaggcagcccgggcgcagtggctcacacctgtaatcccagcacttcgggaggcgaggtgggtggatcacctgaggtcaggagttcaagaccagcctgaccaacgtggtaaaaccctgtctctgctaaaaacacaaaattagccaggcgaggtggcacgtgcctgtaatcccagctactca

SEQ ID NO: 19248 - DNA, 612 bp, Homo sapiens
atccagacagcaaaaggtataaccagaattagaacttaggtctagtgatctccaaagatattttatcattttaattgcactctattctcatggatttcaaaagcagtcttagaatacagagaaataagtaaatatggcttggcatgaagaagaatatagtaacagagttctcaaaaatgggaagtgttgagctctcattcacaggaagtgtttcagcacatgttggatgatcatgtctctgtgatgttgcagaaggcatttctgcacatgttaaggaccaagatagattatctctatgatccctttttgctctcagagatgtggtggtacccagattgcatgaagaggtacttgagagacacgcccttggcttttggatcacacccagtgtcttcattatagagcaggtgctgtccaaaaaagtaggctcttaaggagagagaaaatgtggcagtgcaggatagagaaatgtgattaaaaaaaatttgatgcttggagtggtggaacatgcctgtaattccagagctttgggagactgaagcaggaggatggcttgaatttgaggctgcaggagctatgatcgtgccactacacactagtctaggaaacaga

SEQ ID NO: 19249 - DNA, 507 bp, Homo sapiens
tgcgcggcaaccagagagggtggcggggtcttctgtgttggaagatgagcccgccagaggcataccctcggccttaactcgctgcaggcgctggaagaagggctctggcgtcttgttcccgaccctccggtgaggaaccaacctcctaatactattgacctgaggctggaaaagcttagtgatgattaagtgtgctacagatgagactacccattattgaagccaaaggtccttagccagtggagtgaggcaagaaaaataaaaggattgaagattaaataggaagaaacaaaattatttttttcatagattatgtaattatgtacgtggaggccgggcgccgttggctcatgcctgtaatcccagcagtttgtgaggccaagacgggaggatcacctgaggtcgggaattcgagaccagcctggccaacatggtgaaaccccgtctctactacagatacgaacttagcagggcgaggtggcggacgcctgtaattccagcctctcg

SEQ ID NO: 19250 - DNA, 230 bp, Homo sapiens
agttgttgcatatgtagtattttgttgctgtgctgatgttgctaatctctacctgtattgtggtcagaaaatgaagtctctaccatttcttcctttttaaatatattgagcttccctctgtgagcaaatatacggataatgtttgtcaatgcttcacaggtactaggtgtagtctccattttaagggataacattcaaaatctatccatctgtacaaccttaataattat

SEQ ID NO: 19251 - DNA, 604 bp, Homo sapiens
tcagagcccttggaattttcccatctccacaacccaaagacagtactcacaccctgcacccttcccttctctgacttcaacctgatactagagctactccctttcctacagcaatccttggcctatacctgtgctagaaccgtctctacctgccatgaaaatgcaccacccagatctaattaacagcactgactcttccaccatgtttgcaccaaggccaggcttcccatgagctactctcagacagagaatgagtctgatgggtatactgaggtaggcccagttttgcaagagacagactcctctgttgtgtgactttggctcaaggagtccccactgatctggctgaaactttttcttagaactgtgtggccacctgagactcttccttgacttcctctccttccttccccctctcctggcacaggagtcagaccagcatcactgcctggcagccatccccacttcctccttcagcaccctcctcttgctattcccatcttaccttctgtttctgagaggatgtgattgacagaataggggtcccccaaagatatctacaccctaatccccagaacctgtgaatgtattaccctccatggca

SEQ ID NO: 19252 - DNA, 530 bp, Homo sapiens
gatgacttatgtaaatagccaaactgtgtttcagaattgttttatacatcaatctaattcttaccattagtaccgtggcttcctctcctctttcctggtgtccagattgtcacagctaaagggcatttcttcctatttagcaaatataaccattatcaatgtttaaaatgagattttcggccccttcccttttgtgttataggtgctccatacttgcttgcagtgcctacgtggctctggctttgggtgataacctcatggctttgaatcatgcagataaacttcttcagcagcccaagctgtcaggatctcttaagtaagtgtgacttgccctgtgtgtccctggtttctttagttttgaggtttctccttggtttgtggtttatgttgcttcttttgactcctccagtggaatatatatttgtaaggaaagcaactgtttaaaagaacgttttttaacccatgcctcggcagtgaaaatgttttcacttgtgctgtactgagcgttaggagacaaaaacctcggactc

SEQ ID NO: 19253 - DNA, 245 bp, Homo sapiens
tattgcaatattcactttgatgtagtaatctggaaccacatttacagtacccctgatgtgtatgccggtagtaagatatgccttgtcatatattaagacagatcacaaagccattttgattaaaaaaaaaaaactggcacatttcagacaataaaagaagagcctagaaataaaccacacatggaatctggtatttggtagagacagcattagaagtcaatgaagtacaaacagattgattagta

SEQ ID NO: 19254 - DNA, 521 bp, Homo sapiens
ttgggccagattacctggctggtgaagatgggcagttcatcatttcaaattttattcaaaacaaatcaagaattgccattcaatattgatttcatttattctgcactgaatccacacttactgagagaactattccaggtgtagtccttgttttcatcttccagtttgtttgtggagatggggatggatgtaggaatgaacgatgtcaacatctggcacaggtgctaaagtaataggatactacattgggggttcaaagaatgaagatgctttcaactcaatcttcaacttcacgcctgtctactaaaggagtccccaggccgggcacagcggctcacgcctgtaatcctagcactttgggaggccgaggcaggcagatcgcaaggtcaggaaatcgagaccagcctggccaacatggtgaaaccccatctctactaaaatacaaaaaattagctgggcacggtggtgcacgcctgtagtcccagctacttgggaggctgaggcaggggaattgcttgaac

SEQ ID NO: 19255 - DNA, 498 bp, Homo sapiens
acagtacccttgttggttcctgcctattttgcccttcggtgcaccatgttctataaaccatctccacagttccctgtgggtcaagcccccttggctacccttctgactttgtagtaattgtggccccccacttctggtggtgagggactgctaccagggctccattatttggggccccattctgcaaataaccattaataagtccagctttgtgagtgtctcatctacagttagccctacccagcctgctgaggacaggtatcactgaattgattagtgttctttgtgaaccttttggcagcttattcctggtggccttgttgaatgatgggttcactgagcctacccatggagcataatcttctagtgggtcttttggcctcatataatatatccattccagcatgtcttacttatgaatcttgctgtgagtctaaggtaagactaagcatagattaattcctccattgtcatttagttagcctatgcacagtgata

SEQ ID NO: 19256 - DNA, 510 bp, Homo sapiens
tcagatcagcctgtggaaatgagggctgaggagcattccaagagggacatcatatgcaaagatcctgtggccaatagatgcatggtacatacaaggaacttgcataagagaggaggagcaaagcaggacagaaggtctgagggaccaggctctacagagtctgttagctgatattaaagatgccggtctttttcttgagaacaaggagttttaagcaggggaatgagacaatcctatttgccttacaggcattttagctttataaattatggattatgatttatactttatacagcaattcaataaagaagatacaaagcagcgttatggaaatagctcggaggaagcttagcagccctataatcgttgtcagccaccccgaatgagcatacattcttatcccagacaaaaagagcagtgcacctattgtggaaatgcagcttctgcacaagcccttaagcactccatcctaacacctggctccacccatattcccctaggccccgggag

SEQ ID NO: 19257 - DNA, 586 bp, Homo sapiens
  misc_feature 302: n = A,T,C or G
gagcctggacaacaaatacaacaataactctaagaaaaggtgtaacaaaaatggggaacagataaagggatatagcagttaggaggagaatgagatggaagcattttaagggatcagatacagattcatcaaggagcgagactgcatattagatgaacttcaatgacatgtagaaggtctcctaggtagacaacaaaaaatgagtccaaggtgccttgaagaagagccaggggtatgggagaggaatatttcagacttgtcagggaagagggttcccttagaggagcatgataatgtctttntggaatgggagctatgagcttgagtctggaacacaggacccgtgagttacggtaggctaaggcacttacagttaattaggtagccagagaaacacactgaatgctttttcagcaagaagattagaacttcaaaaattaatcaggtgcaggtgcatccagattaggggttttagcattggagaaatgacaactcaggaacacagacagaaagacagagacagagactgagagagcagattaaattctgtgatgagaggacagtacagaattaagcagcagcttgg

SEQ ID NO: 19258 - DNA, 584 bp, Homo sapiens
cctttactacttcttggttttctgacactgagaaggtcatttagcttctccagatttttgttttctcatgtgcaagataaaggagttgaacaaagacagtggttttcaaactggattccgaggaaccctagggttccaagaagacatgatggtgagaagagcaaggcaaaagggaaagaagacaattgttaatgagcaggacccccacttctacccagattgctccttcttgctctgttttgtctaccatgcttccacacaatactacacttaatcaaagggttttggcagggcacagtggctcacatctctaatcccaacgctttgggaggccaaggaagatggatcacttgagctcaggagtttaagaccagcctgggcaacatggtgagacaaaaaatataaaaattagctggacgtggtggtgcatgcctatagtcccagctacttgggaggctgaggtgagaggattgcttgagcctgggaggtcgaggctgcagtgagccgagatttcaccactgcactccagcctaggtaacagagtgagaccctgtttcaaaaagaaacacacatacacgcacccc

SEQ ID NO: 19259 - DNA, 565 bp, Homo sapiens
atctgtagaagcaactgaggcttcacctatgatgaaagactttggagtcagactgcttaggtttaaatcccagttccattatttatctatttgccttatgactttggaagttacttaacttctctattcctgtttccttgtctgtaaaattaggataataattgttcccaaatcataaagttgttatggggagtaataagatagagtgtgtaaaatactccatacagagcctggaccatagttaagagtaagtactctacaaaaacttgtttttgtcattagagatacaataaaaagttatgaaccaaagtggccagtaaaaaaaatgaaagtttttatatactgagcatctataatgtgtcagtcattatgttaaccagttttcatacattatttcttttaattttttgtcttcgaattattttaaaagaattaaaagaacacagtatgatttaatgtgaaaacgaaaaagagaagattccagctgggcacggtgactcacgcctgtaatcccagcactttgggaggcctaggcagttgaatcacgtgaggtcaggagttcgag

SEQ ID NO: 19260 - DNA, 235 bp, Homo sapiens
gcagcagatgttactgaaacgtgtgggtggagcagtgagacccagcagctgagccacatgctctggatgttctaagtcaaggcttgctggattctagggtgttgggggaatgttcaaaagctgagcaattcgggagcagatgaggttaccttcttcaaccttccagagggatggaaccttctacagatgctggtcgtggtaaaggacgagaatgactttttttttttaaggctcg

SEQ ID NO: 19261 - DNA, 559 bp, Homo sapiens
tgccttgccctaagcttttagactagatataatgcaattgttgaaagacagtcttcataccattttaaagcccaagatgcggattgtttttttctcaatgcagaagcaaaatcatcttcagagaaatttttgctattaaagaaaataaaaattaaaaagttaaaccacaaatattttttaagtaactatacttaactctgcttgacaggcactcgacagtgaaagtatgaatcccaagcaagaaatctgcattctatttacataccaaaatcttttgactttcgaaatgattattattgttaaacagtatttttcttggccaggtgcggtggctcacgcctgtaatcccaacactttgggaggtcgaggcgggtggatcacgaggtcaggagattgagaccatcctggctaacacggtgaaaccccaactctactaaaaatcaaagaaaaaaattagccaggcgtggtggcgggcacctgtagtcccagctacttgggaggctgaggcaggagaatggcgtgaacccaggggcagagcttgcagtgagctgagatagcg

SEQ ID NO: 19262 - DNA, 517 bp, Homo sapiens
  misc_feature 291: n = A,T,C or G
gattgcttcagtccaggaattcaaagctgcagtgagcgatgatggtgctattgcactccagcctaggcaacagagtgagactctttctctaaacaataacaacaacaacaacaacaacaacaacacaacaacaagtgagtgaagcagacagggagggggaggaggccaagcaaaggtatgattttaggcaaagttcccagagagtagcttaagcctaatcctgcagagaaactctcaaatggaagtgatacctccaagtcgatcccagcttgagccaagggagctgggctntcctacccctgcaccagccagtcactggccaagggcttccatgtgaggtacgaacttccagggcttccagctttctgtagtcagagagcagtcttacagagagagagtagcaggtgacagcctagcagcagaagcacctataagctgggggaagcgtgcacaggaatgataaaagcagcagtatggagtatggagtggtatggagtatggagtatggagacatacc

SEQ ID NO: 19263 - DNA, 487 bp, Homo sapiens
agagagtgagacccaaatgtcatagaacagacttctgttcactgatgtgtggttcaatatccacttccaggcatagaggggattatgacccatcctcttgagggttggcaaagccatgagtcttgctatttattggcaaataaaatatcagtatttaaaaccttgtgtgtttctccatctgtccttcccccagctcaggcaaatgaagacattgcaaatggtgaaccctgggcccctgagcaaagaagggctgacacaagaccccatgccatgccattatggactactgcatgagtaagaaataaaactttgggccgggcccggtggtttacgcctgtaatcccacccctttgggaggctgaagtgggtggatcacctgaggtcaggagtttgagaccagcctgatcaacatggtgaaaccctgtctctactaaaaatacaaaaattagccgggcatggtggtgtgcacctgtaatcccagctactc

SEQ ID NO: 19264 - DNA, 186 bp, Homo sapiens
aggagatggtatttggatagaactttggaaaagcagtaaaagttcgcttgacagtaaaattgtggctggaggggtgggagatagtatctagagagagggacagtatttgaaaaccaattgacaatgatgagaaaaacatttgctttttagttagatgaacattacttttaaaaatcatattgtaga

SEQ ID NO: 19265 - DNA, 500 bp, Homo sapiens
ctggaactctgagaaggcttcaccattatggtcctattacttggtctttcttctgcctggaatgttcttccgtcttacatttccaaggttcaccctttttctagctccaggtctctgcttaaaggcacctaatcaaaaaggctttgcttaactatcttattcaaataacaagcctcttcacagcattactggatcatagtgggtgctccaaaatatttgaatgaatagtctatatttcaaggaatagtctccatcttggaaatgagtaccttgtggcttaaattgtaggagctaaagcgttaggaactaaagaagattttcaagttaatattgggatttatatccccataagataactaaggttttgaagtaaaaaagaattggattaaagtttctgctctagaatttaaaaatataaaaacagaacatttatttaaggcacaagtgggagataagtgatgagaacacattgacacatagaaggcaacaacacacgctga

SEQ ID NO: 19266 - DNA, 620 bp, Homo sapiens
cctcagaagtcatttcttttccaccaggcctgagaatcccctccttcaccaggatacttgtgggtgggagatgctggtgagggaggtgtggaggggaatctccaccacaataagtagctaggcctggaagcactcttcatccagtcagaccagagactttcttttccccacctagaaacataaagaagcctagcctagaaaaatgtgttctgtcccctcaggcatcacagtatagacccctgggagccccaccagcaccagatacacaaggcccaccaaaataagaccaaaaaatcttggaaaattaaattgtccttagaactactgcccactaaagtaggctaggacctacgatgtaaacctaacagagttactacctactaaaataagggatttaaataggacccagagtctcctaaaatgaacagagcctcagaaacccatgggacaaaaccaaaagatcccagaagttgagaaagagagtaggccctgaaggagtactgaaagacacaatagctgacaatgtcacaaattttgtgaaagagatagaccaacagattcatgaagtgaaccccaaataagataagccaaataagataaattttttaaaaaatccatgc

SEQ ID NO: 19267 - DNA, 357 bp, Homo sapiens
cctatcctataaacgaagaactaaaagtgcgcttttgtaccttgaactatatcaaagtggggctatctatattttttctgcgccccaacatcatatgatttgttatagtcttagtcctttcctgtctttatacccattcccacatgtgggatgaaagagaaatagaataatagcatatgaggtaaagagttttttttataatgataagtaagaaaatgatacaccagtttgaaatgcagcgtttcagacagtcgctttcattgttattctgaatattcaaataaaaaagaataatctcagtggattcctttggaaaaacaaataaattacaaaatgaggaatgtgtatttgcccatc

SEQ ID NO: 19268 - DNA, 523 bp, Homo sapiens
gcttcacaaaaatatccaacctactgacaaaagagttgtggagtatttcatgatacaatagtggtcgttgttctgggtctgtgagacctccttgcgtcattttaccttggtcacttcaaatcctataaacaaacatttactgagatctcatgtgcagcgggcacggtgctgggggtttgttctcaaggctaaggaggtggaggagattgggcttccaaggaacaggtgaataaatagattcattgagttgtggtggttctatttcctctttccacccaaaacccatgcgggaaacatatttcctcaaagtctgtggtgtgggttttaagttttttcgtgttcttagatctaaaagaatcaggccgggcacagtggctcatgcctgtaatcctagcactttgggaggctgaggcgggcggatcacgaggtcaggagatagagagtatccttgctaacacggtgaaaccccgtctctactaaaaatacaaaaaacaaaaacaaaaatagcccggcgtggtgatgg

SEQ ID NO: 19269 - DNA, 509 bp, Homo sapiens
gcaatattttaattaatgtatttttttatggaattacataagcaaaaagtcatagatttctgtaaatgacccgaagatgctcatagtctggttgtgacaactcttcatgaaacagaaaatgaataaaccgtattgtgtatgttcaatccaatgacttaaacatgtgataacactggcttggattttataggagatgcaaagaggaagaaaatggactccttctctcaaggaaagtgcattatgatgaagctgataggtaaagaacttgctgtaaaacaagacagaatgaaatgagtgttaaatagtgatacaagcagcatattgaggaaatacaaagatcaaaaccctgaattctgacagagggtatcaaggaagagtgtacagagtatatctcttttatgagtcgtaatagatggacagagaatgtgagaaagtattcctggttgagaaaaaaaatggcaggtaaaggcacaggagcatgaaggtgcacatgtgaaaaagtgttgagt

SEQ ID NO: 19270 - DNA, 555 bp, Homo sapiens
tcagccattattgtcacccctctagtttatgtaacaggttcttagatagcatttactgtattccaggtgttctaagctgttcatgaatattaactctgtaatcctttataacaatcctgttcagtattgctacctccattttttcccaggtggagaaacaaataggccactcagctaggtagtgctttagccactgaggtatactgctttttcatgttctttttttctgacccaactgtttctctaactttaaacattaatttttccccagctcaccattcagcattcgtaatctcttatctagcgcttccacaaaaaggattacctagctggcatgcatttctttgtctgatgtctctttgggtactacattatcatttctggccaggtgcagtggctcacacctgtaatcccagcaccttgggaggccgaggtgggtggatcacctgaggtcaggagctcaagaccagcctggccaacatggtgaaaccccatctttactgaaaatacaaaaattagccaggcatggtagtgcacgcgggtaatcccagcaac

SEQ ID NO: 19271 - DNA, 609 bp, Homo sapiens
aatctaaattatgagatagtcttaaagcctcactgtcaccaccaatgactggctctgactctagtataaatcagaaattatccagacagaggtgagaatgtaaatatacagcatgaggaagacagcctccacattggaatcagagttcataatcttatttgcattttcttctattaatacaagctttcccttataatttcactgttcagactccccttcattgtgttagggttttcagtctattcctggtttttcatatccaaattcatcatccatccttgatccattgttttcttagatcactcaaacccccatgagtagacccatggtcattaccaaatctggtcatttgggtactattgtaggtttaaccctagggcaatattctcgaagtttagttcagggatccatggggttccccaagactttctggagcacacagcttcttcaaatctactttcataatgatgctaagttatttgttttttcagtctcattgtctcattagtatatagtggcactgtccagatgctctatgctgtattgtgtcataaaagatgaatatagaaaaagaaaaaagaatctagctgtattctattaagctagaca

SEQ ID NO: 19272 - DNA, 548 bp, Homo sapiens
aatagcctggaagagctaatgttatcacttttgtggccagtttaacatcttcttagtacgatcatttttaaataagtcatcatgacccagggaaaattacttcttttggcagcagaaaagtggggatagaggagataaaaaggggatatcacaggctcagcatattttaaatattcacattaggtatcagtcatgttttcatgaacttggctaaatatatcctaatagacactgtttgtagaagtaatcttttatggattttattacctgataatcctgctgtttcctggttagatggcagcatgaaaaatgtgttgttctccatcatactgaatggacaaaatctggaaccattccccttgaaaatgggcacaaaacaaggatgccttctctcagcacctctattcaacacagtattagaatttctggccagggcaatcaggcaagagcaagaaataaggggcatccaaataggaaaagagaaagtcagactatccctgtttgcagatgacacgatactttatacagaaaccccatagtctcagccc

SEQ ID NO: 19273 - DNA, 564 bp, Homo sapiens
cattatgataggagattagtgtgaaactggcacaaaagctaaattaacataggtagagtatattcgggattatttccttacaatacattcccagagtgtcaaaggagatcagtaagagaaaatgagggctagaaagaaactctctcacatatagtaattcagaaaaccaggggaaaggtaagggttaggaattttaaagttatgtcataaaaacaaattaatgcattgagaaattcaacttaaactctcatcacaaaccatacatcaaaataaattacatggtggggtctggtggctcatgcctgtaatcccagcactttgggaggccaagataggcggatcactggaggtcaggagttcgacaccagcctaaccaacatggtgaaaccccatttctactaaaaatacaaaaattagctgggcgtggtagcacacgtctgtaatcccagctacttgggaggctgaggcagaagaatcgcttgaacctgagaggcggaggttgcagtgagccgagactgagccattgcactccagcctgggcaacaaaaccaaaactgtctcaaa

SEQ ID NO: 19274 - DNA, 169 bp, Homo sapiens
tcaaggccagcagctactcagtttcaggagcttcttctcatcatcagggccaagaaacagaattgacctgggctgagcttctcctttaagattattgcaagccggccaggctggtggctcacgcctgtaatcccagcactctgggaggccgcggtgggtggatcacctg

SEQ ID NO: 19275 - DNA, 562 bp, Homo sapiens
ctcccaaaagcatttaccctggtcgctgaagcgccgctgcttgggattggccgacacgctgcgctgtaccttgtgggatggggatggggcgctgctattggtcagatcagctgaaggccggggtttcagggtgatggtgtcgccttccagctgaaagaaacagaaaacagcttcaagggagggcagaagtcatgtggagatccctatggatggacacatttacacataccgccctctcccaacactcaaacaccccaggatcataccggacatccacttgtaagaccaatacatcccccctggaggagaccctggagacacacatgctctgacacagacactgacaaacacagtctcagaaaggaatacataagcccacacacccagagacacaaacatccgcaagaacacatgtccagactcaagtccactcccctcaacacagagcaatatgggcctataccaagtgtcaccaggtgcctcttaaggatcccaccaccagagggagagcagggcaaggaggctgggagttcatgtggggatactcagatgatgaacaaaa

SEQ ID NO: 19276 - DNA, 577 bp, Homo sapiens
cattgatttctcaatgtctgtcatacacgcctgttacgtgatcctcagctttcagccccctcgccccttagatctcacagtcaccaagccttctagggaaagaatttcaagcgcccctccatcttcttcatttattcgctggctcagttcctctctaccctgcaattgtttccttttttgcctctcctgcctcatttcttcccacttgaaaataataatttacttttctggaaataccattacctgctactcttgctataaactgacaaaggttcccattagccttaagaaaatggttagaatctttatcctgacagaggcggccttgaagaatctgttcctgagaccttcatttacagaatcctcttacagacagccctctgcccaagactgcctcttctaccacctaagtcctgcccacccctgcttcaggttgccccataatgcctcactgtcagtcaggcctttcacagcctcctccacctgcaggcaccactgcttcctccacacccctcagccatcaccacctctcatctatacatgaaacggaatatccccttccattggtggatgctgg

SEQ ID NO: 19277 - DNA, 553 bp, Homo sapiens
taagtaactttcatcctagttggaaataatcaccacatacttgcaagaaagactttatccttatcctcttgttctgtcttctgcttgaggctttggataaaggcaaagcccttttaagcccaagcaggacaaagtccaaatctgaaaattgcactatcctccaaaggtcttaccttccaatgagtcagataattttggatcattcccattaatgagtcatgctgaccaaatgtagtttttgtgtatttcttgctacaacttttaaatattcccttccttccctttctacatttgttgagtgactactgtggaaacaagactcagaaagttaacaggctcttgtataaaagtattttagtaatttaacaaactagtgttgctgggcgcggtggctcatgcctgtaatcccagcactttgggaggccaaggtgggcggatcacctgaggtcaggagttcgagaccagtctggccaacatggagaaaccccatctctactaaaaatacaaaaaattagctgggcatgctggcaggtgcctgtaatcccagctactc

SEQ ID NO: 19278 - DNA, 260 bp, Homo sapiens
aaaaataaatacataaaattaaaaaagatgcatgtcgtgactcagtaagtccagggtggagcctgagattctgtactgctaacaagttcccaggtgatgatgctggctggtgtgtccattctcaagcacttggcagttggacacttcctccctgaaattagaatctaaataagagtgttgaaaaacctggcagagctcagaccagattttcctgctcttcggctgggttcctgtctttgcccctgtgcacctgtggaatc

SEQ ID NO: 19279 - DNA, 562 bp, Homo sapiens
catcctccaggctgaacagcaaggaggaagcagccaagacccatgcccaggctctctttttcagctggcgccattttgctcatggattgtttcactgttgttctagggaaagggagaatggggaaaaaggagggaagagaaggggaaaaagggaagggaaaagggaaaaaggaggaagaaagatcctgagccttcttattctgttccagaccctaggcgttcctcttcaccctcggcatttccctgagtcctctacaaacccttgaaaaacaacccatgattatctccattgatggatgaggaaagtgaggccgggtgaggttgccccaagtttcacagctaacaaataacattaccagtatttgccccagggccatctgattcccaaattgtatatggttcaacctaatacagcagaaagaaattcccacattctttctgctgtattaggttgaactgcataaaattgctgttcccatggccaggcatggtggctcaagcctgtaatcccagcactttgggagaccaaggcaggtggatcacttgaggtcaggagttcaag

SEQ ID NO: 19280 - DNA, 507 bp, Homo sapiens
tactcattactttattcagcaaacatttattaagcatctactatttattaggccctctgctttgtactgaaatgataacaattagtaagacccaatcccagctttcagggttaaagtttagtgggaaagtcagacaaacacataattataatattaggtggtaagtacagatatagagtatctgttcagaatattttgaagacacagaatgagttaactcacgcagttaggatggaggtgagaaaggaatggggcggggaggtgattcaggtggctgtcagagggtttcctgaaggatgtaatagtaagaaaatatcgacgaaaagaaagtggaggctgggcgtcgtggctcacgcctgtaatcccagcactttgggaggccgagacaggtggatcacttgaggtcaagagttcaagaccagcctgatcaacatgataaaaccccgtctctactaaaaatacaaaaattagctaggcgttgtggtgagtgcctgtaatcccagctac

SEQ ID NO: 19281 - DNA, 584 bp, Homo sapiens
gtggtgagaatggacaatcaactaagtatccactaccaactctccattttaatgacacagggaaagtgacctgctacagggaaagaatagaagataataatttaaaatcatatttattgagcacttgccatatgccaatcatctgtctagcaacttcaatcaataaagaaactttataagaaacataccttaggatttttccttacatttgttagaaacatcatgtacaaggcatatttaaaggccatcaaggattatgataggcataggaaatagagagttgaataaaacaatgtttctgactccagaagtccccaaataaaaacagacagaaatgtagaaacgtgatcatacaacaataataggggctgctatttattatgcagatatgcataatatgcccaataggttatgtatgataacctattgggatgtttttgatatttccctgtttcacagaaaaataaactaagattcagagagtacaataaatatgaccactcattcttttaaaatcctattggcatgaataataccattttagatataaagaggtacagatatgtagataccacgctaggcct

SEQ ID NO: 19282 - DNA, 141 bp, Homo sapiens
ctaaaaataacttgttttcttccaggactggggtcagcaagagagaagtgtagctggctgagcttcctaaagtcaggggaagaagttaagatgagaagccagactcttctatgaagttatcagtatatataaaactgcatg

SEQ ID NO: 19283 - DNA, 510 bp, Homo sapiens
gtctcagcctggtcatgaattcaggtcaaccagtgccacttttatgaaaagaactgtagaagggaaatccctggaaacaaatacactgacaaatcagtccattgtgtgacttcttcagaacaaaacctgcacttggaactcagagaaaggagaaaatcacagcctttcatgtaaattatatctgagaaataaaaccttcgaatttgaaaaaaggctcactagataataccacttggaggataccaggaattagtatttttttgaccacttaagtgccaagcttcgagctaggtgctttgtatccaacatctcatctgttggtaacactaccaacaattcagctcaaagaatcacactgtcagagctggaagggtcctcagagatcatcaagtccaaactgttcatttgcatgtgaaaaacctgagaccatggcaggacacagtggctcacacctgtaatcccagcactttgggaggccaggagggcggatcatgaggtcaggagttcaag

SEQ ID NO: 19284 - DNA, 521 bp, Homo sapiens
tcttggagtttgaacccaggtttgttgcactccaaaccttgtgcaacccctcctaggcaatgtttaatacaatcccttaagttggtctaattggtatttcgggtgctttttatacatgatatatatcatcttccattaccactgccctggacagtaagtatggctcattcatgaattctgcaacaaacatttacagttcttaccagtgctacctagtggcatgcctccattcataaaaaaaatacattgtattgaatgcatcctgggccctgtactctaggtactggattggggcttaccaaggtaaattaagacagttctctgcatttaagaagttcactaccagggccaggcacggtggctcacgcctgtaatcccagcactttgggaggccgaggcaggcagatcacgaagtcaggagatcgagaccatcctggctaacacagtgaaaccccatctctactaaaaatacaaaaaattagctgggtgtggtggcgggcacctgtaatcccacctacttg

SEQ ID NO: 19285 - DNA, 554 bp, Homo sapiens
tttcatgtgttgcagcctgttctcttcagagcctaacacactgacagtagacctctgcaggacaactttgacacccagttctctccaagctgccagtgagctccctgtgcagcctcactcctcacctacagcatgagcccttgcagctctcccagcatcacaatcttgtatctcagtcctggcttctttcactgctggcgtccctccgtctctccctttttcacctacttttcttttttcaaagaattcttctctttcatctgcttatatgaaaaataatgacacctctgaaattctttcctgtagtcctgcagcatcaatgccaggaagacagacctcatcctcccagcttctttgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacct

SEQ ID NO: 19286 - DNA, 309 bp, Homo sapiens
ctctgcctcctgggttcacgccattctcctgcctcagcctccacagtagctgggactacaggcgcttgccaccatgcccagctgatttttttgtatttttagtagagacggggtttcaccgtgttagccaggatggtctcgatctcctgaccttgtgatccgccgacctcggcctcccaaagtgctgggattacaggcatgagccaccgcgtccagcctctgattgctgtaccttttgacaggactcttgagtgttggttatgttgggcataaagtttattttccttagaattttacttttgagcattc

SEQ ID NO: 19287 - DNA, 552 bp, Homo sapiens
gtgacatttaggtctagtttattctctgaacagggaaaaaaaaaaatcctagcaaggagcacagcatgcatcagtagctcaatgatttattctgcctcagtaggatggggtggacttactgggcaaccactgacttcatttaatggtaacctgcaggtgagtgcatcagatctcttccttgatcaaagcgtttagcttgtctcattgccaaccagatttctaagaaacttgttacacaaatcagaaaggcaggctgttacatcatttgcttacagtttgtaagattattcttttaataaatagttgaatgcctgctatgtgccatgtactcttctaggtgttagtgacattgtgctgaacaggacatggagcttatacatgttctcctgagtgtatgctcaagtcacctcattgatttggctgctctatttaatctttatagggagttctctgtttttcttcctaatattccaagataacttttttcttgaatttatgaagtcctgtttatatataaccctaccttatgatcatagcatttaaataattttc

SEQ ID NO: 19288 - DNA, 568 bp, Homo sapiens
aataggaaaagacagagaggattaaaagcattcggctatgattggtgagctgacatttgcagttcatttcactggaagactggggaaaacagcattatagtaggacttggcttctaaaattaaactgctgaggtttatatccaactgcctctagtccctaacatatatcctttgaaagtttcctaacctctctagacctcggcttccttatctgtcaatgggataataaatgatagctattttatacagtcatatcaaagatggtttgcgatgatgcacatgaactatttcgcacacagctttgcagagagctggtgaaagccataaggttttgtcttgtaattttctcagatacatattagcagatatgaaagtgatataaatacacaataaagtatagtttttaaaatagtatgtgttttatttcatgttcatatcactttcaccaggcaaaaattctgaaactttctgtgtgaacataatattatgggtacactctgcattatacctctaggcgtcatcagaaatttgtgcttaatattgtccactcacattccctgaacaacgc

SEQ ID NO: 19289 - DNA, 563 bp, Homo sapiens
ttctccatgaaccttctgaaatcctcttatatttagggagttctccttctctctagggagttattcagtagagccagagggtatatccaatctttaaattggtgaaaaggactcttttcttcaaaccatcatgactgtctttgagatgcttgttagccagggtacacacattcatacacaaacacacacattcacacataaatacatacacacactctaggctctctgaaggcaagtgtttctccctacgtcttgctaagcttgggcatgggacattttgccgtggctgggatgcagtggagagatttttttcaagtatttatgtgaacatgcccacctggagtatctagaaggtagccaaccttgaataggagtgaggaaatccggttctctcctttctgggtcaaaccacatctcctttttctggtgttctgagacctattcccttttaggcaatccattccctcagtgaatttatattttcaaaaacataaaagtggtaatttccccctgagggcacaaaatgcccaacttctggcactctcagcttggtcactctgtga

SEQ ID NO: 19290 - DNA, 547 bp, Homo sapiens
tggctcaagagggactgattgaatagctaccaatagtttgttgttgttgttattttatgcgacttccaaaaagtaaaaacgatatgcagaattagaatcattgaatgcagagaagagccaagatccgtgaagattatactgtattaatagttgatcacagtgttagttaattgtatttgtcaagataataacctctgctgcagaagcaacaagacaaaatcctcaatggtttactacttctcaggcacactatatgacccatgttagctggtgaagagcagagggaaaggctcagctccagtctccctgacacacagaggccctaccttcttgtggctggctatccgtaacaagtagctttctcagtcgccatgttaggggaagagaaagagacaaaattgttcatgggcttttcactacttcactgtgcaactgatgcacatgtattcacattttcctgaccaagactagttccatgaccctttttttattgcgaacacactgggaaatatggggcaattaatatagaacttggtgagcaatactc

SEQ ID NO: 19291 - DNA, 443 bp, Homo sapiens
gaatcaacaaagagtggtttaaggccattactgagaggcacagagctaccactaatgaaggtggtgcgatggcatagagaagccttctgaacaactcagctttcaacatgtgcaagaattactttgacaaaaaaattacaattttctaatttaaaaaaaaattactaagttattgggcttatctaggctctagattgggggatatgaaaatcatttcaagtaattatctcatagtatttcatcccactgactacaaggctacaagagaaacctcccttgggagaaaatgaagaaaaatatttaatagggaaacagactaatacagagagactgccagaagagtggtctcattcaggtatatgatcagaaattttaattcctaaaaggcatcttcatgaagagaatacgtgtatagacatttttaaaaataatataaaagctgg

SEQ ID NO: 19292 - DNA, 452 bp, Homo sapiens
acctgctcgggcaggagatcatcaaattctcagaaatccttctcccacccaggggccccgggcagggggtcttcagacccaaatcaccacaacacctcccccacctccctggtttcagagaacttggcaacctcctgagtgagcttgggactggctcctgagctggctgggtgtctccaccatcagagatacacggcaggaactccttttaacctaaggttggtttatccattttcctgcagcaggagtcggcccgagccagcctcgagcatctgacctcagccttttctctggagttaaaattgatggtttcggctggccggtggctcacgcctgtaatcccagcactttgggaggccgaggtgggtggatcacctgaggtcaggttgaccagcctggccaacatggtgaaaccccgtctctactaaaaatacgaaaattagccgggcatg

SEQ ID NO: 19293 - DNA, 528 bp, Homo sapiens
ctccatttttttaatggctgtattcctggaagagccacttattccttttcttttaccttgtattcaataactattgagtgttattgaatgtgccgtgtttggttgagtgcaaaagatccaatgagaatgagttctagttctttcaaagaatttataggcttgggacttgggtggactaatacacaggaaattatcaaaagggaaagagagagaagtgctatgattggctgatttaaaaacccatagaaaggacactcaacctactcttgatggcatagcagatacaatcttgatggtatagcagattaacaagactaatcttgttcatcctcaccaaatattctatattgccccctatattttccacctttctctgcagttacaatggagtcatgtgactaattctgaccaagagaccgtgagcagaagtaacacatgtcacttcctggtcaaagtcattaggagttgttctgcttcctcttcctctctcccctcttctctcttcagagagcttgaaggccacgtgtt

SEQ ID NO: 19294 - DNA, 520 bp, Homo sapiens
ccagggaagatttgagaaagggtaactttagttgggtttactatttgagggaaacttgttcctgtaaattttcttaaaaatatgagtatatggcatgtgcaattttattgaaaatggaagacaattcaagttttccactatttctagctggatttcaccaccggaagctgagttaagtagagggatgataaactagctattttggtactattctgaaaatatgtgatacaaaagatataataatatggcatacacctttttaaatgttacaccaaataactttaacagtgatgcaaaaagtatgattttaaaaaattttccagctgggtatggtggctcacgcctgtaatcccagcactttgggaggccaaggagggtgcacctggaggccacttgaggccggaagtttgagaacagcctgaccaatgcagcgaaaccccatgcctactaaaaatacaaaaattagccaggcgtggtggtgcacacctgtagtcccagctacttggaaggctgaggcaca

SEQ ID NO: 19295 - DNA, 530 bp, Homo sapiens
tattctcaaagccaatgaaacaaaaggtttataccatgatcaagtgggatttatctcaggaatgaaaggctggttcaacatataaaagtcaatcaatacaccacattgacagaataaaggacaaaaaccatatgaacatctcaagagacacagcaaaagcatttaacaaaaatccaccactaaggatccataaatggaatcctctgaagatgttaaaataatgtggtagatccctatgtattgatacaacaaaactttaaagataaactgcagagtgaaaaatcaagttgcagaacagcatatactacatgattccatttatgttttaaaaaattcataggaaggagggggaagctgggagggggaaaaaattcataggaatgaaatacaggaaaaaataaacacaaaaagctggtaagtaatatactgcctaatagtgagctaaaacattaactataaaaaaggggtaaatcttgttcataaaaatcaccactgtaacacaccctgggcatgtcataattttgatattc

SEQ ID NO: 19296 - DNA, 571 bp, Homo sapiens
agatgacctctatatgcaatggtcacctcaataacgctatttgaatgtcccataacagtcatcttaaacttaacacatttaaaacgaaatccaccatctttcccatccaaaaccactcttgtggtctcttagtgaatggtattatcattcatgccattgaccaaatcagaaacctaggcattagttttgcatcctctttggttctttcatctcttttgactccacccaaaccaccactccatcatccaatcaatcaccaagtgatgctggtagaattgtaaatctgatgtcacttgttaaaaaagaaaaattaaggaaaaacccatcacagccgagtttcatctttttctactttttatctcctttccctattctctccttagacctctaaattctacctataatgtacttctttcagttttgtgactataattccttattgctctgaagtatttgcacatgttattccttcagcctccaagtgtcttcctccactcccaactccatttgacttggttcactcactactctcttccaggccatttacattctctaactacccatcttattt

SEQ ID NO: 19297 - DNA, 581 bp, Homo sapiens
accacatggatatagggatgtttactttgtgataatttatcaagtggtcaccttctgagccatatatatactcatacacataattccatagccagagccttacataacggaagtggatggaggtggtggtggagtggggggcaggtaccagagctggtggtgaacttggcacacattattttaggcatgaagcatgaaatagttattaacttcagaaaacgtttttataaatattataacacagtaaatgactttttgtgcatggctcatatatgtttacatcatgaaaattatatgaatgttatgtcaatatcgactctaaaccaatcctgggattattctatgcatgcagtaaagagtttggttggagggaaagtgtgcatgtcggttttagaatgattgtaagaaaatcaaatccccaacttctctggtaggatggctattaatatctaatggtgacaaattaaaaattgcagtaaaagagcctttcttagatatatgacatctcaaaagaaattgctaaaatagattaagttattgtttctaggaagcaaatgaagaaaatattgatgcaaagggat

SEQ ID NO: 19298 - DNA, 517 bp, Homo sapiens
agcccctgcacctgtgatttgtgggtagcccctgcatctgtgattgtggttttggttctagaactcacttccccagtttccctccttgcagatggagtcatttctccttcctcatttactccctacaggagtggctctgagcagccgtccttgggcaagcgtgcatgagctggagcttagccctgcccaccacccaccactgcctcttggaaatgtgagccgctccaggtcaggcatttaatcaccttgcattcactgagcccacgtgtaggtagggtagaggctggggactcaaacgtgaaggcagggggctgtgcctggtggcctgcatggaggaagagctcagcagactctggggaagtggatgatcacatccatggggacttgtccctccgactggattgcatgcctctgcagtgttggacccctgcctttgctctctggttccctacattcaagaattggcaactgtgattagctatggtgcctcatgcctttaatcccatcactttgggag

SEQ ID NO: 19299 - DNA, 319 bp, Homo sapiens
gagcgcgtggtgggggaactgctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcgaaggaaaaaccaaaagcaaggcaaaggcaaaacttgtaaaaaaggcaaaaagggccc

SEQ ID NO: 19300 - DNA, 533 bp, Homo sapiens
gcttgtctctgctccacagtgtctggggctgaccttgaagtttgagagctaagatctggaatcatctgaagtcccagtcactgatatgcttcaggctgattctcattgttggctgcgggtctcagttgctcgccacaagggcctctccaaatggtctagctcagactcctttatagtatagtggctgagttccaatagaaagcattaaaagacatagggataaccatatatctatatctatctatctatatcgagagagagagagagaagctatatcggccaggcacggtagctcacgcctgtaatcccagcactttgggagactgaggcgggcagatcacaaggtcaggagatcaagaccatcctggctaacatgatgaaaccccgtctctactaaaaatacaaaaagttcgccaagcgtggtggtgggcgcttgtagtcccagctactcaggaggctgaggcaggagaatggcgtgaacccgggaggcggagcttgcagtgagccaagattgagccactgtactccagcct

SEQ ID NO: 19301 - DNA, 259 bp, Homo sapiens
gtcccaggctcatgggtgtcttcttactgcctttagcagaacaaaaatgagtaaagcaaagcttcttgcttcagaaatattcagtctagtacagtgtgtatcctacatctaatcatcgcttcattccagaagctttaattgcacaaaattcactgggaaaggcatgatatttgtctgttttttaaggataaggttggtattggctcaaacttatatttattctccgcaaagagtccctcccaggtttgtaatcctgatg

SEQ ID NO: 19302 - DNA, 565 bp, Homo sapiens
taaaatgaccatttttagagtattgcagtgaatgattcagctcttcatcattttcaggtggattcatcaaggacagatttttaaattccatgatgtgagtctgaggggacttagtatgtagcactttcctggctccgagttagtagcaagttgaaaactaagacaaaggattaacaaatgcagagagtatcatgcaaaatacttccatgtagtgctgtcagttcagtgcagaaacctccattgtgttttgtttactgtattgttgtatggttaataaaattcctacagaagccttcatacctgcctgtgagttcattgcactattccaaatttatgatgaagtagattttttgtagtaacatctttatcatccttaaagactaggatagagaatatagtgtaggatgacagccaaataggcctgttagttgaaagccagaattgagaggatttactacctaataacctacagaaaagaaaggccaactttttcgtaaaggactaatagtaaatattttaggctttccttgccatatggtgtgtattgaaactactcaactctgac

SEQ ID NO: 19303 - DNA, 600 bp, Homo sapiens
tattccattggagctgcctgatctccacctagcgatggtctagtacagtgagaactcccagatgtgccccttctggtgagaggcaagcttcctgacaacgccatgctgagtgtttgattggccggccagacctgttcataaagcatttcacaaaccgtcctttcttacgcaaactagctgggaataaacaggccccctgtgggtcttagaactaaagcaaatatgaacctcaaagaacaaaggaaaatcattactggtggcaggaatatgagagtgcttccacaatactatttcacaagtcttttctacatgggcttcagtcacaaaggtggtttgacattcactgagcagcatgggaacaattctagaacacttattctatccctgagctatttctgggataaaaatattgttaaaatacggctgggcaccgtggctcatgcctgtaatcccagcactttgagaggctgaggcaggcagatcacctgaggtcaggagcttgagaccagcctggccaacatggtgaaaccccatctctactaaaaatacaaaagttagccaggtgtggtggtgtgtgtctataatcccagctacttggga

SEQ ID NO: 19304 - DNA, 358 bp, Homo sapiens
tgtgactttctgaaaatataatacaggaaaacatttctgaagggttttttccatgtttttatgtagtatatgtatttatgagttcggaatatgtgcaatacctaagaaacatttatcaccagacaaattcagtagtatggatcatcaatatttactcatattcatcttcaatttggctcttctccgtggatatcaaaattgaaaccttactctgatctgaagccctgacaaagttgggtttattattttcatctggtagctacctgtgactcactgctcttaattactattccttcaaaatatttatattatgtttcttgtgtctcacaatcaatatttataggcttgaaatacacat

SEQ ID NO: 19305 - DNA, 445 bp, Homo sapiens
ttactataccgcactaagacaaatcctgggtacatttaaaaacaattagcaaccttggggattaaaatgaaagcaaatcttaacaaacccatatttccgatcttcccactagccctctgaagtaaatgtaatcgttcccattttacaaggaagaaactgaggttcataggctgttaagtgtcttgtcctgaggtatatggctggtaaatgattccaacttatatctgttaaactccaagatacagtcacttctatgaagtggactatgacaagtggcatttggcttgctcacaaggcaatagatatcatctccaaagaatagaatgtatgtgctccttaattaatgcttctttaattttctagaatgaatactctttttttcccccttaggtgatgaccatcagcagaacttagttacagagtaactgatgtgggaatatacatg

SEQ ID NO: 19306 - DNA, 416 bp, Homo sapiens
cccagattggtcttgaactcctggccccaagtgatctgtccacctcagcctcccaaagtgctgggattacagacatgagccaccacgcccacctggttattattgtttgaatgcctgcgaacccatataggattgagcctttattatttttcctactttgaactataaagctattaattgggattttccttttggcagataacaatagcaaagtgaagacagcatctaagctgtgttcagccctgactctttctggtcttgtggaagtgaaagaggtaggtttgtagacaactttctttgctgccctgcaggtgaggtaatcagtattgcttagaactaggaaacaagaaatgctgtgcatgtaagatacatgatgcttcaaaggacaaaacttgggagaatcggccgtgtgtggt

SEQ ID NO: 19307 - DNA, 276 bp, Homo sapiens
ggtgacaaggggaagtggtaaattgctgatgattggtgaatttagtttttctctctggcgggatacagagcatgttgaagaagccctgaacctgtcagaaatgctggattttaatcttgtaggacctcaggcaagccaccaaaccacttcaggcccccatctgatgggggacagtactcatctcatagcagtacccagagggctaagtaacagtgtctgcagcaataccaagcacatagtagggacttcatgtacacgagttgactctaaaacatg

SEQ ID NO: 19308 - DNA, 437 bp, Homo sapiens
caagtaactaagctttgtgctaccaagaaacagcaggtgaagtggaaaatgccacccaggcagtttaaataacccacagaggagcttagtactcaccacacatacctcatcctctctcgtgtgccccagtgtacccttatacatttttctgtgagtgtgtatcatgctgtccccctgaggttgcatacttttgttgcaaaaataatttaatacagcgtttgaaatgtgaataagagtcctgcttataaaaacgcaagtaatggctgggcacggtggctcacacctgtaaccccagcactttaagaggccgaagcaggtggatcaccaggtcaggagactgagaccatcctggctaacatggtgaaaccccgtctgtactaaaaaatacaaaaaattagccgggcatggtggtgggcgcctgtagtcccagctactcg

SEQ ID NO: 19309 - DNA, 518 bp, Homo sapiens
catacttcagcactgttgacattttggactggatgattctttgtcttggaaactgttctgtgtgttgcaggatatttagcagcatttatcaagagcgtctactcaccagatgccagcagcactcctctgatatgacaaccaaaaatataccaaaagtgcaaaatcaccccagttgagaacaactagactctagtagtttagttcaaatataaaatgaagcttgatggtgggatcaatttgatgacaatgagaaaaagaagttaatttggttattctagaaagattttccttcaaaaagcaatgttaactaaatagacagaactgttttttctttctaaactatatcagaggtgtattagatcattttcaccctgctgataaatatatacctggaactgggaacaaaaagaggtttaattggccttatagtaccatatggttcaggatgccttagaatcatggctagtcactggcccctttcagtcacggcaggagcagctgggacacagggcaccaag

SEQ ID NO: 19310 - DNA, 478 bp, Homo sapiens
gttgtccccagtagaggaatcggtgggtagttggctggttggttggttttagggcaggaccattaaaatcaagataggacctattggtacactaaatgtggggtattgacaaaatcctgctgctcaggctccagaagttttgcaaaatatgttaacagatccaaagaataatgtgtttaataggaggggaatttgttcctaaaggaatggttatcaggtgctctccaagcactgtctaatgcagtgtttttcacactttggtgagcatcagaatcccctagagtgtttgttaagacagattgcggccgggtgcggcggctcacgcctgtaatctcgtggatcacttgaggtcaggagttcgagaccagcctggcccacctcgtctctactaaaaatacaaaaattagctgggcatggtggcaggcgcctgtaatcccagctacttgggaagctgaggcaggagaattgcttgaatctg

SEQ ID NO: 19311 - DNA, 459 bp, Homo sapiens
gaaggggatgtaatcccagcacattgggagtccaaggtgggaggatcacttgagcccaggagtttgagaccagcctgggcaacgtcgtaggactccatttctacaaaacaaaacaaaaagcctacaacgggaagagctgcctctcggggctgagaacatccaactgcaccaatttagatcctgaaattaccctgccccacaagcaaaaaacatggtcacaaagtggtccaaaggaggcaggcctgtgattgcacactgacgctcacgacgtgtgcagctgggaagggctgtgagaggcagagcagctgccaacacgcagtcctcagccaaaacccagggcccccgccactggaactgactcctctccaggcagcactcccagcactgggcatcccctcaccttgccctggagaagccctcccacccaaggggccaatgcagtcattctcgcagataatc

SEQ ID NO: 19312 - DNA, 537 bp, Homo sapiens
ggacaagtgaataaataagaagcgttgtaatgcaaatgctcacagaaaatgagcaactagaactgagacagaggaaagatcccaaggttctgcgatattgattgcaagagctcccatttgcaaggtacccactgtttcctcaaaaggacggaggcccaggaacacccagagtgggcttgggaaagcccggtggtctaggtttcagcccagaaagggcttagggactatggacaaaaaaaaataaaaataaaaaataaaaaaagagggagagaatattctaaagcaaatgctattccaggccagagagagagagagagacagagaatattctaaagcaaatgctattccaggccaggtgtggtggctcacgcctataatcccagcactttaggagcctgtggcgggcggatcacctgaggtcaggagttctagactagactggccaacatggtaaaaccccgtctctagaaaaatacaaaaattagccaggtgtggtagcgggcaactgtaatcccagctactcgggaggctgaggca

SEQ ID NO: 19313 - DNA, 584 bp, Homo sapiens
tcccccaacaaagggcagttttgcaggaccatttcaaaatatggcaaagaaacttgcttttgggataaaattttttttactttcttctttgtcacataatgttatgccagagtcagattgcaaagtaagccatgatatatagggttaaataaaatccatctgatgagaatttatggttagtaggggatgactccccagaccccttagataggaatttgggcaaaataaaaaaatcagagcttagtcttcacaagttattgaaaaacaatgagttaccaattttatttatttatattctttcagtggtcttcaacaggtggctcatgaattcacatatttgacaattttaatgtgaaataaatttaagatatttcaacaacaatcatataggaaaagatagataaataagaaactataaaaattatactttcaaacctttccctatctaagacacagggtttatctgatctcacatagatattggacatacgatttaatttttaaaattaatttttctcactttagaaaattggcatcttgaggccgggcgcagtggctcacacctgtaatcccagcactatggg

SEQ ID NO: 19314 - DNA, 526 bp, Homo sapiens
tatctgtgatagtgggggaaatgattctgtgttcctttgactaaaagtttattctaggacaggatttggggttggtacacactgtcaattccaggaagtcttgcaggtgataatgttgcaaaacaaagcaaagaacagctgttttctagccttatcaagcagttagggctacttttatttcaagtatgtaacagagattggttttgaagttatttgctttgaagttaaaattacatttactctcatttttctaacagatactagattatttaagttccagattctgttttcacactaataagaaacaaacacaaagtgtctcatactaccaatataattatagtattgtattatttgcaaatttgaaattacatgcttttaggtggtaatttttacaccattatttgatttaccaaaaaatcctaacatcatagcattttgttccacatgtattgactagaaaggagttctgaatctatctgagagtctgtggacattattaaattagatgaaaggttatagcttt

SEQ ID NO: 19315 - DNA, 444 bp, Homo sapiens
tccatgtccaaagaaactagaaaaataagcataaaccaaagaaatgctgaggccagcatatcaaatgagaattaatcacaaatgagaaagaataaatttcatttgaaatagaaaataaaatgtgaccctatcttcctcctttttactgtcaaactctcaaacaatggcattcgttttcagtagttaaaatcctcagaagaaatttggcctaatttcacaggtaacacttgcatatatacacatgtagatttgtagctcgtggatttttctgtgacaaattaatattccacactggtttctccctgctgcctggcattcactgttgccaattccttccagtcttggctgccatgtgttaagaaataacaaataaataatagtatattgtcaagtaaaacacaagcactctgtaaacctctccaaaaaaaaaaaaaaaaaaaaaaa

SEQ ID NO: 19316 - DNA, 591 bp, Homo sapiens
accaacctggccaatatagtgagacccggtctctacaaaaataaaaaataaaaaaattagctggacttgtgacgtgtgcctataatcctagctattcaggaggctgaggtgggaggattgcttgagtccagggggttgaggctacagtgagccataatggtaccactgcactgcagcctgggcaacagagcgagaacctgtctctaaaaataataaaataataaataaataaaaatttaaaggtatttttattttacagagacttcagaattttaacactttgaaaaaaggatcaaggtgaagagtttactgaataattaatgaattgtataatgtgtaaaacttttgtgataatttttttaatgttcaaaaaatgtcagggagtgcagtttgctcagggacaaaccaatgtctcccagcctagaatagttaagaccaggagaggtccactaagaaacaatactgggagattattttcacagatggtaacttttgcaatttttcatcaaataatttatttgataatgtgttgctaagctatagtatgtatattactttaaaaataaatgcattcccggggcgcggtggctc

SEQ ID NO: 19317 - DNA, 612 bp, Homo sapiens
gaggtgctggggacatacttacaaacagaagcacgagggaacttgagattgtgaatagtttgctattgacagaacatagggcacaaggattgtaagtgatggtaatggatcctgaatgctaatctaaagaatttgcattcttagattatcaaaatctaagaatggaggcattggggatccactgaaatattttctaaactaaggggaagaaaccatgttatgaccagctataaggtccaggcaagtgtacatgaagcttcaaaagtgaacagacagcatggcattggttcaaaaacagacacatagaccaatagaacagataacccaggaataaagccacatacctacagccatctggtcttcaacaaagttgacaaaaataagcaatggggaaaagactgtctattcaatagatggtgctgggataactggcagaagaatgaaactggactccgacctatcaccatatacaaaaattaactcaagatggattgaagacttaactgtaagacctcaaactataaaaatcctagaaggaaacctaggaaatacccttctcaatgtcagccttggcaaataatttatggctacatcctcaaaagcacttgcaac

SEQ ID NO: 19318 - DNA, 487 bp, Homo sapiens
caagtaggttgagagggaagagtagatactggatttggtgataagaagcagtggtggataatgctgagagatttgggctctgtggattggggtagagtagaagagaattggggtcgggttgaagaggagtggggtggggtggagaagaatgggagggctggtacaatggattccaggcctgcaggaatgggggaatggtaaagggaaggcaaccagaaagggagactgctctttgccaaaatggagctgattatttaataataccaagtctaaccagtgatttgaggttcccgctccactttggattggagggaattcacaaaatgcactttgaaaagctggttgcctcatcagacttcactacttttcaaatttagtatctatagtcatcatcatgaaattaataatccagtcaagagaatgtcatctgcagtgaccacagccccagacagagcccaaccaaggcgaagacagggctcctggaacc

SEQ ID NO: 19319 - DNA, 472 bp, Homo sapiens
tgacacaacactgtcatttctaagtatatagttaaaaactatatttttaacttgcaatctacactaagagaaatgttcaaaaatgtttatgagaatttcttacaagaacaaaaaataatactctatcatcaggagaatggatacataaattgtgatgatttatacagtggaaccctatataacaacgaaggaactcatggacattggtcttacgcatcatcatggatggatctcgaagatataacgttgagtgaaaaaaagcaaatcagaagaatacgaattgtaagtcatttgattcaatgtacagaaagtttaaatataggtaaaactgtaatgtgttgtttacatatgattgcaaatgtggtcaaattctacagaaataaaaaaagataattcaaaaattcaggaacgtggtgatctgaattttttccctagggaggggaagggaatgggtcagagaaaggcacacaat

SEQ ID NO: 19320 - DNA, 590 bp, Homo sapiens
aggcagatttaagttcaaattctcattctacaattaacacttgcacatgacattcaatgttttagaatctccatttcctcatccagaaattaagagtaatcaaacctacagggaactgaaaaattaaatgagatagcatagcacctaatatatgccaaatactcagttaatgataagcactgcccacaatagttttgaagttaggcatgaatattattttactacttttgtctatttttagaattattcttaagatttttttatttccctggaattttacaaggaattaaatttcactgaatttgagggccaggtacaatggtttacagctgtaatcccagaactttgggaggccaaggcaggtggatcacttgaggccagaagttcgagaccagccaggccaacatggcaaaaccccatctctactaaaaatacaaaaatcagcctggcatggtggcgcatgcctgtaatcccagctacttaggaggctgaggcaggagaatcacttgaatccaggaggtgaaggttgtagtgagccaagaccatgccactgcactccggcctgggcaacggagcaaggctctgtctct

SEQ ID NO: 19321 - DNA, 474 bp, Homo sapiens
gcaggggcaagggtggcacagcatggcatggcagacagaattggattgagtccagacagtgaatggtcttacaggcctggcccagaattgtagacataatcacaaaggcaatgaggtaggaacaaattctagaagcaaaaatatcactgactgacttttttctaattttagatcacctctacgagtatataggaatgctatgttctgaggaatgtatatttgagggaacaaatgtcctctgagaaaataaatttagtagatgccaaatattatatacactttgaccactttggcagtaagaaaatctatttgcttactccaatcttcattaaatttatttaaccattgaatttttttgctccctaccccctacaaaacgcctattaaacgcttcacagttgacttatgctaataggcaataagggtgtgacccaggagaggctatatacatatgggcacatacattacatattc

SEQ ID NO: 19322 - DNA, 533 bp, Homo sapiens
tcacatttctgcccatagggttcttccctcccaccccaacaggtccctaggtatcctgtaattttaagaaacggtttgcaaacctgagtgttcctcagacagagtggcctgtaatgagccagcccaagaggctgacacccaggtgcctccaatctcatcgtgtgtggtgcctaacagcactatctgggtaaatccagaataggttactcatctgtttacatagctaaggtagaagtggacaataagacctcaagtataaggatgacagtgttaggattattagatgcatctactgatagcccgtaaaacgtgtaagacagaagcagaaaacaaacttacttgcacacactagtattaatattgtgacagctaacagccagttgtttctggcttttaagaagttggggctggacgctgtggctcatgcctgcaatcccagcactttgggaggccgaggcaggtagatcactcaaggtcaggaaatcgacaccagcctggccaacatggcgaaaccccacctctactaaaatacc

SEQ ID NO: 19323 - DNA, 458 bp, Homo sapiens
aagagtcaccctttgatcttggagaagacaacattggatgtaattacccaaagggactagaacttggaaaaacaatcacatttttcttgttacttagaacaaatgagacctcacctggctttcctgtgatctccaagtgccagcattttctttcctgcataaatacaaagcctctaagctcaccaccacatgccattcttgctctggcctagaaaaacacccatcccagatataagactaatgttttaaaactccaaacagggccgggcgcggtggctcacggtggatcatgaggtcaggagatcgagaccatcctggctaacaaggtgaaaccccgtctctactaaaaatacgaaaaattagccgggcgcggtggcgggcgcctgtagtcccagctactcgggaggctgaggcaggagaatggcgtgaacccgggaagcggagcttgcagtgagccg

SEQ ID NO: 19324 - DNA, 497 bp, Homo sapiens
caggagcctggagacacaaaagcttgtgcattattggaatcaaggtgactataacataattcagggtgattggagcataaactggaagattaaccagtcatggtataagatgaaaatagaaggctgggcctggtggctcatgcctataatcctacactttgggaggccgaggcctccctcaggtagatccctcaggtgggcctccctcaggtagatcacctgaggtcaagagtttgagaccagcctggccaaaatggtgaaactcagtctctactaaaaatacaaaaattagccgggcatggtggcagccgcctgtaatgccagctactcaggaggctgaggcaagagaatcacttgaacccgggaggcggaggttgtggtgagctgagatggcgccattgccctccagcctggacaaaagagtgaaactccgtctaaaaaaaacaaacaaaaaagagcccgcatgcggtggctcacgcctatattcccagcacctt

SEQ ID NO: 19325 - DNA, 400 bp, Homo sapiens
ggtaatgtatgcctcgagctcctatagtaaatgaccaaagaagtgccaataatattgcattattagttaataataatagtagttcaagctgagttataaggtgcatacttatattaaaagttcttccattccaaaggaagcacccaaatagttgagcaataatattgctttccctaatacatataaagaatatctttggttttcatttctccttcagttacttgatttatatattttttacttatctaggcagatggcaataaacatactgtgttttccctaacagataatttggtttcctacatagagtatactgtgtttatacgaatacatcacaatatttgtctttcacttctcacggctaaatatatttgcaatatttaaagaaatgattgataat

SEQ ID NO: 19326 - DNA, 554 bp, Homo sapiens
cgatttggatgtgtgactatgtgatgtaaaatttctcctacatttatattagtaagtcattgttatttgtaagcatgacaataatcactttattaaatatatagtattattaagcaggattctgcctgtattttatgtaaaatacgaataagttttgaaagacaactatgaaaacatatttatactaatttatgtactgatgtgtatttggtcctttcgtttataaaaaattaaacaatctttaaactgtggacttttcatttggttctggtttgagtttgtgtcctgtcacatagatggtaggttaagtacatggtagaaaagttcatttttagaaatctgaaaatcaggccaggcacagtagcttatgcctgcaatcccagcactttgggaggttgagtagggcagatcacgaggtcaggagatcgagaccagccatgaccaaaatggcacaaccccgtgtctattaaaaatacaaaaattagctgggcgtggtggcacacacctgtaatcccagctactcgggaggctgagacaggagaatcgcttgaacc

SEQ ID NO: 19327 - DNA, 505 bp, Homo sapiens
ctaccggtctaaggaaattcacacagaaccatctgatgtcaacctgattaaatgcaagagcaagggccacgagggagaccaggtctttacctgattgttagtgctttaagtaagccagatatttctgtatttatatacacatttacaaacaaattgcaaactttgtaaggactttctgtctgcgtacttttaagagagtggacactaataagctttacttccattttgctgaccctactaccttgtcattttaaacacctattttcctgttcttcacagcattactgctcactatataaccagaatgcatcacttgagttatttttcctgcctagtcccaccagagctaggactagggtgagccacaaaaggagtcgcttgctgaccttcaggtatcagccctgtgcctgcagtgggtgcctcaccctggctgccagtcacatgacagtagctcctcccaaaaagccagaggcctgaaatgacaaaggcaacctaggccccccca

SEQ ID NO: 19328 - DNA, 582 bp, Homo sapiens
cctaaatcaactctagtataaagtgatatcttcaatacatgtgaaccagttatcacatagaatgagttacttttgtcctaaaaagaattacctttcttgaaaggagatgggcaaggcaaaaatttcaacagaaaatcagcaggatggtaacagaaatcttatttttaaaaaagaaattataacaacttgagataaaaatggttggcaaatctggtgctcaatttcaataccagacttactatagattttcttttgtctgggatttagattcaatggaaaattcctgttttctctccttgctagtaataaagcataaaagtgtgcaatttaacagcagtaccagagtcaggccatttgctagataggaatgtggatggatttctggaagacgaatgcatagaccagaacaaactaagccacacattgctggtgtcttaaacatatgacttaaggaatatcatctaaacaaaaaatctattttgatttcctcctacccctttaggaatcaaatcttccccagcactaagtataaatttgtacatatcctgccgggcacaatggctcacacctgtaatcccagca

SEQ ID NO: 19329 - DNA, 422 bp, Homo sapiens
gttcacgccattctcctgcctcagccggagtagctgggactacaggcgcctgccaccacacctggctaatttctttttctatttttagtagagaccccaaagtgcagggattacaggcgtgagccactgcaaccaaccagaacagttcatcttaattaggcttttgtatttcaaactctagtagtattcttgtagtgaatttctacaagattgttccaacacaaacctaacattaatcaaattttgattgtccctttgtagcattaagattagatatttaatagcagaagctagtgaagccattagaaggataaaaggtatccttagatttgcacagctggcataaaagacagaaataatacatcagtttcttgccgtcaggttagtacacttcctagtatttcacatttgacactatattc

SEQ ID NO: 19330 - DNA, 527 bp, Homo sapiens
ttctcaatatgtttctctgtcataagaaaatgtctctcacacatacactcattactgaagagaaaataagaatcacaggaagtgagaaatcttttgccaaactatttagaaccttgactccacttaggctaaaagaaatgaattggtaaattaatttgtttctaaaagaaaactctggtgaggtgcagtggctcacacctgtaatcccagcactttggttgggaggccgaggctggctgattgagcccaggagttcaagaccaccctgggcaacacggcgaaaccccgtctctacaaataattttaaaaatgagctgggcgtggtgtgcacctacagtcccagcagcactgagatgggagaattgcttgagcgtcataggtggaggctgcagtgagctgtgatcaggttactgcactctagccttggcaacaaagtgagactctgtcccaaaaaaacggaaaaaagagaagacaagagaaaaaaaaattctggctgggtgcggtggctcaagcctgtaattccagca

SEQ ID NO: 19331 - DNA, 553 bp, Homo sapiens
ggtaaaaaaactaaatttttaaaacagttactcaaaaagctaaaactttgaaatgatagttattatactataattcctttccttctctcagctaaattttcactagtaatctttactgtatgtgggcttctaaattcaatgtcaggactaggactagcaattagtcttgtcttttaatccagtctattaactcttgcacttgattccctctaggaacaagagcaactttatcataaagtcataattcctgatatatgtggaaagtgatgctgttgaagtaccatcaataaagcagatgtttcacagtggttgtgattaatttgtgctgatcttgaaactaccttgctcttgtaaccaacatttacatttgcaagctggtagaatttgaaagaaggtttaccagtataatctgtaacaatggcaaagaaggaagctaacagagctatataaagactaaatcaaatgggaaccacacaaactgcgatataaatttgccagaaaatgcattagatgggtaatgcaaaagaacacattatcttgattccaattggaa

SEQ ID NO: 19332 - DNA, 542 bp, Homo sapiens
atgggaaacaacagacatttcacttttcatttcagcctctgagccattagtaacaaaccttggctaaacagtaaaagcatttgttacacagcaaagggaatcttgtccacaaaacttttctgcaaggcactaacatttaaaatgtgctcaaatgaaaccaagcttcataagttataatcatatttcatccttcttaaaaataactaatagcacttcaaggaatgcaatatgaatttcaaatttttatattctcaaaactcagcacttttaaacaaaattatagccacaatgtcccattctctggcttctttaataaaattataatttatctcagagttttgctttcattgtgcagcattacaattatagaacctaatttgaaatgtgttagaatcatcaacacacacttaaagagttcctttaaaaaacatctctctggctgaaaagattcatgccagcagaagctctgaattatggatcgaaccatccaaaatctgagtattttcagtattcacagagcctaacagatcaatagctacttc

SEQ ID NO: 19333 - DNA, 534 bp, Homo sapiens
gctcactgcgacctccacctcccaggttcaagcaattctcctgcctcagcctcccctagtagctgggattacaggcgtgcaccaccacgcccagctaatttttgtaattttagtagcgacggggtttcaccacgttggccaggctggtcttgaactcctgacctcaggtgatccagcctgccttggccccccaaagtgctgggattacaggtgtgagccaccgcacccggcatggtgtcttgttctgggcagaatggagaaggcattattagcaggacgggtgccacagagacaggacagggccggaagaactcagaggctgaggaaaggttaagggctggagcgtatgtcccttaaggacctagggtgcctaccacccaccacagcgagcacaacagaggcaggcctctccctcaagccaggctgctgggggaggagcgccttaagctttaaggacgtgtcctagatgaataaacaacctccagtgcaagttggtaatgactgtggtggaattagcctggcgtggtggtggcg

SEQ ID NO: 19334 - DNA, 565 bp, Homo sapiens
tattacaggctttcttggttcattgtccagaataacttatctatacactttaaaattttggattacctgttttgtttttttaagtcagaaatagcatacctggatatttggaaaactctgcctatttatcttttcctctccagtgtttctcatccaattctgtcttcttattgtagacagatagatactcccaaaacaagtcactcttctccagaggattaggaactcattggcctacttcttgcctggcattcaaggcaagctctacactggcccatgtaaactcagaattctgagacccaatgctgacaacttgcaatttagcttcatctttgttgaactgactaaacttcattcatttttaggcctgttctctctcaggttcttacatctttattcatatggtttctacatgctagcaatccatcaattcatcagtccatcaatccaaatccatccatttttcatgatttatctcaatttctatttaattgaggaatagatcgcaactccaaattattcttcctatgtattctgtaattttcaatgtcaattctactgatct

SEQ ID NO: 19335 - DNA, 477 bp, Homo sapiens
tcatgcctgtgatcagtgagtgcagccttcctcgggagctatcatcaggacctgcaagtgattttaaatgccagtgagcagagacaatgtattcaaaaaagactccagtttcagctcaaacattcccctaggaataattttggcaagagatctattctgaattcgtggtaggctgggggcaaagatgagagaaagaagaaaagggaagtctctctgaaaggagctttgaccccagggcttagaaacggagtctgtcttcaagcttttggatgctctcgtaaaaagggtttgtaaataatttagcacccccaagtagtagattctaagtggcaaacagcctgctgagaggagggctgtagaggccccagggaaaagagaactcaggacaaccagcttcacaagagcagggaccatggctgctggtcaccaccatacccccagcacctgcacagttcttgaaccatggcagatgctgct

SEQ ID NO: 19336 - DNA, 476 bp, Homo sapiens
gtgtgtgtcagccctgataattgaatctcggtgcaaagagacagccggatgcactgcaattgagttaagtggaaaatggcattttcgtattgttaggagccttctcagcccaaggccctgatcatttactccgagcacctggtggtcttgcagctctgaccccagcgcccagctgagccacgggccagctgggatcagctgtgtggggcagggaaagaaattaattttcaatccctggggactgcagttggtagctcagcagccaaggattacacagacccggagagaatagggcaccatccctctgggggagttattgaactcccaagtgctggtggggaggtggcaaaggaaagagggagaggggttggaacagtttttactgggaatcccatcactgagatttaatggacattctgttgctggagattcggtctcttgccgatttctcttcccatatttaatttcaaactcct

SEQ ID NO: 19337 - DNA, 548 bp, Homo sapiens
accttggcctcccaaagtgctgggattacaggtgtgagtcactgtgccctgtccagtaacttccttctctgtgtctcaccccatcatgtggctccaggataaagggaaaggcagatgccactttgggaaggaataggattttattccttggaggatagaaaaaggaaactaattccctgctttttccattcctatggagacagagaaggagttacagaaagtgcagcaacgaggcatgcctgtcattacctctgctcagagcagaaatattggagggagtgggtgttattagatacaattattttgccttgtgttggaaaagatcttgacacataatctatgggatgttcagttcaacgaggagctacttaaaagctgtgactgagacccaggaaggtgagagctaagatggtgtcaaaaatacgggaaggtcgccaaaaacaggaggctttcatgtcctgctctctatttggagcttggcatggtggaaaatggagaagtctgtcatgcacagcaaacttgtggcaacacagagtagcaggataagc

SEQ ID NO: 19338 - DNA, 452 bp, Homo sapiens
gctgtggcgacaggcctggaagttgacctgcagggaggtaggagagaccaaggcccctgggacggaggccggccactggatgtttgaaaggctgagaagccaagggcttcaatctggggaggccgtttggataaaggagccaaggactttctctaaaaattccggctcacagggaggtggggccatgccaatggcctgcccaggtgacaagccctttgtcccactgtcccctggcaccagtctggtaatctcaaaggaatgccagaaatctggccaggaggaagggacactaaagtaaggagtggccctctataatttgaaataactctttctggcatctgctggcttttgttaggaaaagcctcagacatttttatgggatcacagttccctgtgggaggaagaggttgcctcaaggccaggcatggtggcttatggctgtaatcccagca

SEQ ID NO: 19339 - DNA, 458 bp, Homo sapiens
agcactgaggattaccagaagtgttctcatcaccatcttggttttggtggatttgagttggtttctttactgcaacctgttttatcagcatcgtctttatgacctgtatctcatgctgacctcctacctcatcctgtgatgtagaatgcataatcatctgggaatgcagctcagtaggtctcagccttattttacccagcctctattcaagatggggttgctctggttcaaacacctctaacagtaacacatggcatataggctgattaaaatactaagcactgagtatagtatatttgatcttatatttcaatgcaagaataattatatgtgtttcagtggcttgtaccctccaattagtgatgaacataccccatgtgatttggtcatttagttaacaaatatttattgtacatcgtggtgggccagacactgttctaggtgatagagatgcagct

SEQ ID NO: 19340 - DNA, 525 bp, Homo sapiens
agtgccttacatcacatcctaacacaataacgttcaatgtccaaaggtcagaggagaaaatgtgtcttccttgtgtccattgttgacagcaaggaggaaatttccatcaactctcattggtcacaatgggtcacgtgcctattcgaaagcaatcactagacagggggtcactattactatgattagtttaggtcagtcaagattcactccttgaggctcagaagggcaacttctcctaaagcatgtgactgttcaatactttaaaaattggggttctcttagcaacggagaagagaggctctttttttgacaagcaattgtagcatctatcaaagcataagaaaagcttgtgagtgatgaggttggagactgagaaggttccagaacatgacattctggtgaagtaggcaggacccaggaatctcaaaagtgacccaatgtcacagagtctgttggtggcagaggaattgaggcatctagaggcatctaggcagagtgattgaggcatctcactttctacgcaga

SEQ ID NO: 19341 - DNA, 530 bp, Homo sapiens
aggtgccattatttcataactatgagtgtctttctggattgtctctgatagagctggtttatgaggaagaagactgattggtaagcatactattaaaaagtagagtaagacggagtgcaagatggagttcaaagtttataaagttttacttagaatgcttttataataaaatgcattcttaagtgataaaactacatacaacactggcataatttttaaaatctattaaattcagctgcagtttagggaaatgtcatttgcaaggtaactctaagctcagcataaactttaaaactaaggttcccaatcagtaaaagaaaagttgatgagacccagattgagggggaaaaaagattgttaaggcatcagaatagaactgcttaaaagtatataaatgtgtttacagatgtaaatgacagtaacatagccaaaatattttctgttttgcaaataatatttttcaagtaataatgttatttttaaacaaaaattacaattaaccacaatcctgagcctcttcttaccccagt

SEQ ID NO: 19342 - DNA, 484 bp, Homo sapiens
aaatgacaggaattgaagtaaatgagacaagcaaattcaaaatgattttctcatataactttgaaatccgcaataggattgaatcagggctcagtaaatttatcagggtctttatcgctcaaatttgcttctctgtgtgtgttgaactcattaactcttacagcaaatagccttctttaatacattcaaaataaagagtagcatcaatttccaatatacatattagcagtttatcaaacccagaaaaaagggagtaatttttctcttagaatttgtggccagacatggtagctcatgactgtaatcccagaactttgggaggcccaggtggtcagatgacttgaggtcagaagttagagaccagcctgggcaacagggtgaaaccctgtctttattaaaaatacaaaaattagctgggcatggtggcatccacctgtagttccagctctacctgtgaggttgaagcatgagaatcgcttgaacc

SEQ ID NO: 19343 - DNA, 105 bp, Homo sapiens
aagaacattatcaaacataggaatgaagcagggaatatcattaacataccctgcagaaatcaaaaggatgcctttgaaaaacctacacacacaaatttgacaact

SEQ ID NO: 19344 - DNA, 586 bp, Homo sapiens
aggactgaattgactgatgagggacagttacttctggttatttgttggtgtcttagtccatttgtgttgtaataaagagattcctgaggctgggtaatttataaagaaaagaggtttattttacccacagttctgcaggctatacaagaagcatggcgccagcatgtgcttgtggtgaggactccaggaagaatccaatcaaggcaggagacagaggggagctgacatcacatggtgagaggaaggaagcaagagagagagtggaagaggtgccaggctcttttcaacaatcagctcttgagggagctaatagagtgagaactcactcattaccttgaggatggcaccgactcattcatgagagatctacccccaggaccaaaacaccatccttcaggcaccaccttcaacattggcgatcaactttcaatatgagacttgaaggcaacaaatatccaaactatatcatttgtaatattgttactcttttttaatgctctgtatttttatggacacagaaaataagagaagccttctccctttcttcttctctaaccctcaacttagtagcttctacttttaaact

SEQ ID NO: 19345 - DNA, 578 bp, Homo sapiens
ggtgcacgtgcacccatggtgccattgccaccggcatgaatgcacccactcccctgccactgtgccaccttgccaccattgccagcgcatagactcacaccagtggccctgcccccatcccatgccacaaccaccactggtctggatgtgggcacaaaggttggcagccccacaccggccagcacccattcccccacactgaaactgccatgggtgcaaatgggcacatggaccccagttgccacgtccccccactgctagctgccactgctgctgttgccaatgactgcaaggaagctggtaatcccagacttatcagtatcccaccccaaccaatgagcatgcaccccactgcactgccattactgtaagcacattggaatgcacacagatctcactgctaccacccaatgaggtgctttggctggcaccaccctttggagttctgtggccagtggcccaggaacaccttggccccttcaagcacagcagggtcccaatgttgagggaccaatgaataaagctggaggcccagtaccagccctccagagttagagcacacagtccaggagtgctga

SEQ ID NO: 19346 - DNA, 543 bp, Homo sapiens
tcagcatcatcctgataccaaaggctggcagagacacaataaaaaaaaaagagaattttagaccaatatccctgatgaacattgatgcaaaaaccctcaataaaatactggcaaacagaatccagcagcacatcaaaaagcttatccaccacgatcgatttggcttcatccctgggatgcaaggctggttcaacatactcaaatcaataaatgtaatccatcatataaacggaaccaaagacaaaaaccttgatttttaaaatgtggatctatttgactttttatttcatgtaagaatcactgttaggaatatgaaagtatatttcagcttaaatatagtgacattctgctaccctatatttaaattgaacctaaattaaacttgtattaatcagtatctgtcacatgaactctaccagctccctttcacctaaacaaacagtcacacacaacgaaatagaaatcttttctcagccaggcgcggtggctcatgcctgtaatcccagcactttgggaggccgaggtgggcggatcacaaggcca

SEQ ID NO: 19347 - DNA, 565 bp, Homo sapiens
gccagtgggttggcatcaggtggcctgtgggtggtcaggggggaatttccagccatggtctagctcagcactgacaacaggagctggtttggcttgattgtagaaagggaagtcctgtgacacttttacaagatcttcttgaaaacacagagtaggtgactctccctcatccatccatggccttcttgttctaactctgagaacattagccatgaggagtccattttgtctgttggtaggggcatactttaacaggtatgaggatgtactgacagatgatgacactttaagaatgatttggggctgggtgtgttggctcatacctgtaatcacagcactttgggaggccgaggtgggcagataacctgaggtcaggagtatgagaccagcctggccaacatggtgaaaacctgcctctactaaaaatacagaaattagccaggtgtgtaatcccagctaattgggaggctgaggtatgagaatcacttgaatccagaaagtggaggttgcagtaagccacgatggtgccactgcactccaccctgggtgacagagtgaggctctg

SEQ ID NO: 19348 - DNA, 543 bp, Homo sapiens
ctattccctgtacacacaatgttaattcccacctttggttttgctatatgtttacctcttggaaatactttatcccatcctgttgatctactaaaatcctatacatatactggcaggtggcttaaattccagctcatctaaatatttatttactattaagtatgaatgacagcaaccttgcccttaataagttcacagtccagtagagaaaatgaataggtgaatcaacaactacaaaactctgtgaacagagctctcttgtgagagcacagaggagcatttaaaccagacatagatggtggatccgaaatggtcttctagatgaagcgaaccttcatccaggtctttatggaaaagaaatacaaagggaaacaccatagacaaaggcatgaagtatcatagtgaattcagaaaaattgaagtaattcaaggtatataaaaaattgcatgtacacttgggagaggtggcaaggtataaggttagaaatacaggccatggctagagtatgataaagtcctaagtgacaggctgaagagtttgat

SEQ ID NO: 19349 - DNA, 599 bp, Homo sapiens
caattatagcaagtagactttttgtgtgtttcagaaaaaggcacataatttaatgaatggtagatattattatgtgattagatctttttttctttaagaaaagctcattaaatacaaagctgcttagttatatcaacattgacacataaaatttttatcacttacataacactagaatataatgaaccagtgaaatttgttcgttctgtactttcttattaattgtttcctgattagttactttatggttgaggaaaaaaaggaaaattcttgcactgacatatgtaacttgtttaaaaggtgaaagttacttgaattttaaattaattgtagtaactcatatgaactctaaattctttataggaatccaatttgtgaagacagaaattattagaaaagtaatttttttaagaaaagtattgtttaggtccgggcacggtggctcatgcctgtaatcccagcactttgggaggccaaggcgggcggatcatgaggtcaggagatcgagaccatcctggctaacacggtgaaacccggtctctactaaaaatacaaaaaattagccgggtgtggtggtgggcgcctgtagtcccaggtac

SEQ ID NO: 19350 - DNA, 599 bp, Homo sapiens
taacttttccaaagacaaattcattttatgaagttgtgttactttttattgaaaaaaaattaatgtcactgaaattttttttcattctacctcttatttaatatgcaaaaacttgttagtaattgagatagaagacctgtagtttaaatgttgtattattcctgatggatgattatgaatataggacttgactatatttcaagtttatagtttataaagaatgtagtttcagtggatttaaaatagatataaatatagattaaaaaattatttatagatggtttagcatgaaagttttctgctaaacacttacaagtctgttaaatatcacttcagttaacagtgaaatagtgaatctcattcatttttttttaaatctaaaatcagattccatctgtccaatttggtattttggcactaactgttatttgtgatttcgtttgatatggttcatctggaattttagtagtgaccattcattgtgatttgatttgattatacatagctctctgtgatgcttactggaacgcagctttataaatgcaaattgtcctgtatgtctcagttactctaaaattggatttaactatttggaaatt

SEQ ID NO: 19351 - DNA, 398 bp, Homo sapiens
ttgtcttgcaatgacaagagtttttaagtctgctgggactaaaaatcatccccatgacagtctactatctgaaaattttttcctcccaccactcattttttctccctaggagatgacttagaaatctagaatacagtttggtgctggtgttaaccatttttacctaaattatgggggaaggaaacagagtcaggcactctatcaaatgcttgttcagattccactttggcatcgaggggaagaaccttggacaggtttatccctttggctcctagccatggcaggcacacagctatcaagagataaaaggccttgttttcactgctcggctgcctgaataaagtcagttatggtatccacatgtaatgaaagtggcactaatgtttataaactgcttt

SEQ ID NO: 19352 - DNA, 547 bp, Homo sapiens
cagtatacaaacagaaattaaaactttaacaaattccttctttagttactgattccaacaatcttcctactccaaaatttatgggtgctgtcaataacagttaaattgactaaccaaaattttttgctattttttttccctacaacaggggaaaaaaatgaacagtgaaatggcttagaattagcagtagaggaaagagttaaaataagaaaaacctacaatgtgaaaaccaatgctttatcctcaggtagctgaaaaatcttcactaaagctgtgatttcacttttcaggtcctaaaatctaaatgtcacattccaccccctcccccaccaaaaacagtataaattgtagaaaacattttatagcatctaaaaattccaatgatcagtaagcatatactatagtcccaacttaatttgacgttccatttacataagaaataaaggaggaggacagggaaagaagaatggcatagccaaaacaactaaatttttaacatatattttctgtaaagctagttaaaaacaaacactatagctcatgtaat

SEQ ID NO: 19353 - DNA, 538 bp, Homo sapiens
ctagttatcaagaagcagtttgctgtgcaacacaagaacctactatttgcttttctctgctctcaacacccttgattagttgtgctgcaaagctgtaggatatcgtcccaggtgaaataggtatgtttcaagcctgtctcttcccaacttcctaagctttctaagttgcctgatttgaaattgctcaaagtgatacaggtgtctacatccacccactgattttattaaaaaaaattaaaaactttcattccattgaagaacaaaatgtctcccatttttctaatatgtttgcagtgaataattttaaagagcgaatgctttctctagatctttccatgtagcaataaccatactaaatacaattttatattgttttgtttcttgagtgaagagagaatgcttcaacctacctttaggtatttatacctgataagtctagctataaagtagaaatctccctgtaactcccttcactttttcccacatgagctatttattaagctgttactatgtgctcagactgccaagcactaaatga

SEQ ID NO: 19354 - DNA, 439 bp, Homo sapiens
agatcctcaaggaacaggactggtgtcttatctttatattccatgtgcatatagttgatgaataactgaagacagcttctctgagcctgtttcctcaactgtaaaatggagataatgcctatatcaccaatatagtgaagaaagtgcccacccagcataaggtaggtacttgctgagtaaagtttccttcatcaattttccttagagtttcgttgtcaaccacgaacactcctacttttctcctgttcccacctcagcttcaggttcagctctctcttgttgtctactagggctttcgcatcactgatcagaggtcagcattcacctgggtccctttggagtggtgctgacttctctcctccaggccaggctccctttatctttccaaacccactcagaaactgctgcctcctggtggctctgtttctggtcaaaagtc

SEQ ID NO: 19355 - DNA, 551 bp, Homo sapiens
cctcctggagtgctgggattacaggtgtgagtcaccacacctggcctgaaaaggacagttttatgtgtcaccatgacttcccatttaaaatcaatataaaaactgtagcatctctgctggttaatcattaaataaaagaagcattactggtatagcaatattggtatgatgcatttttaaatcacacgctgcagataactgattaagtgctgtcattgctctaacaatgcaatgtacaaaaggatagccaggacacttcgcagtgcctcaagagcctccacctgtatttcttcctcattcctcccaagtttacttgtcgcaggtagaaaaaaacaagaggcggctgagggcggtggctcacgcctgtaatcccagcactttgggaggccgaggcagacagatcacctgaggtcaagagttcaagaccagcctggccaacatggcgaaatcccgtctctgctaaaaatacaaatattagccagttgtggtggctcacgcccgtaatcccagttacttgggaggcagaggcaggagaatcacttgaacccggg

SEQ ID NO: 19356 - DNA, 542 bp, Homo sapiens
cttccacttccaatttaaaatacatcataactttataatgactgtaagtgttccttaatgttgagattgagttataatatagtcttttacttttttcacaaatgaaaagtatttggttgttttcactaaaaatgaagattgcaccaaaatcttccatgtagccagagagttacatagaccatgtggcatgcacaagtgtgatttcaaactctcaatgcccacattttagaaaaacaactagttatggcacactttaggactgaaaactgttctaaatgttttctaagtactagctcatttaattctctaaacaatgcgagacattggtactattatcttccgactttatagatgagaaaattgagtcatggagtcagctgcccaagctcatatagctggccacaacataactcacattcctgattcctacgatgctaggagctaattaaagtgatgctagagagcaatgacaaacaaaaacacacaaaaagtaacacaatgaagttgctgaagaaatgccattactctaaagaaacagtccc

SEQ ID NO: 19357 - DNA, 361 bp, Homo sapiens
tgcgcagatgtgagttaggagctgctcaggccactatgtggaaagaattgcatgagaatgaagtaatcaaagggaagcaagcaccgagacattagagagacttatcttgtataagtgcctgtatccagctatgcctgaagtgaggtaccaccccaggccttttcagtcatgctatcagttttgttccttttttctgttttactcttggtggagttatttttttttttccttgttacttgaataagaaaaataccaaactagaaggctgggtgcagtggctcatgcctgtaatcccagtactttgggaggtcaaggcaggtggatcatgaggtcaggagtttgagatcagcctgaccaacat

SEQ ID NO: 19358 - DNA, 515 bp, Homo sapiens
gtagtcccagctacttgggaagctgaggcggaagaattgcttgaatccaggagggggaggttgcagtgagtggagatgacaccacttcactccagcctgggcgacagaatgagactccgtctaaaaataataataataatgttatatttagatataaagaatttaagggactaaagagtttccacagttttttttcaaacttttgaaatttgatatttcaaaaaataaatcttggccaggcacagtggctcatgcctgtaatcccagcgttttgggaggctgaggttagcagatcacttgaggtcaggagatcgagaccagcctgggtaacatggcgaaaccccatctctacaaaaaatacaaaacactagccgagtattgtggtgcatgcctgtagtcccagcaacttggagagagacaggaggttgaggccacagtgagccatgatcatgccactgcactccagcctgggtgacagggtgagaccctgaatcaattaatccatcttacatcag

SEQ ID NO: 19359 - DNA, 256 bp, Homo sapiens
aaagggcataacaaaaaaaaaaaggaaaacttccggcccgtttccctggtgaaccttaagggcaaaattcttaacaaaattcccgtttaaccaatcccaccggtttccaaaaagattatcccccctggtcaaaggggggggcttcccggggtggcggggtgatttaacctttggcgggcaattaagggggtccccccctttacccggatttaaaagaaaaattccctggttttttaattggcgggaaaaaattttt

SEQ ID NO: 19360 - DNA, 514 bp, Homo sapiens
gagattcaggcatgctgatacatgtaattaatgtccttaattttcactgctatatgatattccactgaatgcatctgccacattttattcatccattttttggtttttaggcatcttagttgtttatttttccttttttggctttcataaaaaaatgtttctatgaatattttagtttataacatcttttcccagtgacttttggattttcctattcacaacctatttaactgagtttactggtttgaatagagaactttgggaggcaaccaatgtgacttattttagcagacgggatggtggttgaggtgaactgatgtgcacatgaggtcaggtcagttgtgcacatgggcatagccttttctcagtgataattctgaacagcccagcacattattgctgggaagtcctttagagaccatgggtccgttttcctcttcttgaatgctgtgccaatgcattttcaaaaattactgtcatggccggacgcggtggctcacgcctgtaatcccag

SEQ ID NO: 19361 - DNA, 527 bp, Homo sapiens
tctctggacagtttgctctcctgtgactcttttctggtccccacccctggccaactaaaccaccccacaggggcttgaggcagagaccaagttctgcaggccagaccctgagacagatcacccacgccccagccagcctaaggctgataggaatgagaccagctgtcggccccctcagagccctggcaggtcatctctggggatccaatgcccctccccaacctgggacacacagtggggagtggggtgggaatgtcgctgatcctgggtgtgggctgctcttgctttgggggtgatcctgaaggtcccttccaacactgagggtggttatgagtctgggcactggttggttcacctccctgcttggacacattcctgctgggagatcatgggtctgtaattccattcatcaaggcctggtttcctcatctgtaaaatgggggatggtagtggcacctgcctcacaggacagagtgcaggttaaatgggctcacagagggcagcattcagcacccgggacgtaagtg

SEQ ID NO: 19362 - DNA, 552 bp, Homo sapiens
gacgtgcaggcagcggcggatcatattccttcatctaccatggctcagccgggaactctgaacctcaataacgaggttgtgaagatgagaaaagaagtgaagagaattcgagttttagttatccgaaaacttgtcaggagtgttggccgactgaagtcaaaaaagggtactgaagatgcactgttaaaaaaccaaagacgggcgcaaagattgcttgaagaaatccatgccatgaaggaattgaaacctgacatagtaactaaatctgctcttggtgatgatatcaactttgaaaaaatcttcaaaaagccagattctactgcaactgaaagagcaattgccagactagcagtacatcctcttctgaagaaaaagatagatgtgctaaaagctgctgtacaagcctttaaagaagcaagacaaaatgttgctgaagttgagtcatcaaagaatgcttcagaggacaatcattctgagaatactttgtattcaaatgataatggaagtaatttacagcgtgaagcaactgtcatcagtgagcaaaaagtcaaa

SEQ ID NO: 19363 - DNA, 641 bp, Homo sapiens
agacaaatatgatcagatagcaaattaagatagcaatttcaaaattggctcattagaaatggagacaagttatcattgtcaaaaatcatagatttaatatattggcaacataaacaatatatcaatgtaccttatgttttaaatacataaagcaagaatgacagaactgtggtgaaataaaggcaaatgaatagctgagctagagagtctttaaaaattgttagtttaaacagataaaaaagaaaaagcaaggacataaaagttgtaaacaagaacatttagaaggaaatctggtgctttaaatacctctaaaagaataataattaaatacattttccactgaagaagctaaggtgaaagctctttacaccaattacacaacactgatgaaagaaatcagagatgacaccaacaaatggaaaaacattccatgctcatttataagaagaatgaatattgttaaaagagctatacttcccaaagcaatttacagattcaatgctatttctatcaaattaccaatgtcattttccgcagaattagaaaaaactattctaaaatttgtgtggaaccaaaaaagagcctgaatagacaaagcaatcctaagcaaaaaggacaaagctggaggtatcaaactaaaa

SEQ ID NO: 19364 - DNA, 507 bp, Homo sapiens
actccatctgctggaaattgtaagatgtctacaatgtgactaccatgcgctgggattataaagagaatcctggtcagagatgctaagaggcacgtggtggcaatagtgaggttcttgttagaagaacctaccagggtggttccctagttcaaagctggtcccctagtcctctcagaaatgcattagcaggctgggcgtggtggctcacatctgtaatgccagcactttgggaggcagaggcaggcagatcacttgaggtcaggagttcgagaccagcctggccaacatggtgaaacccgtttctactaaaaatacaaaaattagccgggtgtggtggcacacacctgtaatcccagctattgaggaggcggatgcagatgaattgcttgaacccaggaggcagaggttgcagtgagtcaagattatgccactgtactccagcctgtgcagtgagtcaagattatgccactgtactccagcctgggcaacagagcgatactccgtctc

SEQ ID NO: 19365 - DNA, 487 bp, Homo sapiens
gagtccacacaggggagctcttggcagagccatccacagcgatgattactgtggacacagatggggaggccctgtgtgtgaggcagtgacagagccattggttgggaacacagccaactcttttggagttttgttaactatcccgaggtagaggctgagggggacacgcctacatgtcatgccacaaacttagcgtactagaacatgctagattttctctcaaagcacgcaggtctgagcctgtcatcattctgccagtataacagacaggtgaatgaagagacgggggaacttggaaatgaggggctgaaaagaagagaaagtggaccctggtactggctgtgtaagaaaagtaaatagtgacccagaagaatttgggtcacggtctgattcatacaataaattcattttgtctcatttgaaatattttaggaaaaaggcatgcttttatccaaaattacgtcaaaaattgcctcaaatgtctctc

SEQ ID NO: 19366 - DNA, 637 bp, Homo sapiens
gggactggaactgattaagttcaccagggacacttgcctggtgaacatgggcaaggctgtagcaatggaccacttttacggctctagggttctgactccaactaagttttccagaatctcctgggctcctgactcatctgctgggtctaaagacactgagtttagggatattttcctccaatacatgatcaatcctctggatccacggctatggaatatggtgacaaatgtcagtgtctctcttattccaaccccaggatcagagaagattctttacctgcagtaactgacacatttccaaggcccccagatgctgtctccaactgtgacaaccagggctcccagaggccactgaagtcccctccccaaaggttgccataggatgttgtagtacctctcagggattctctgtctactccacatatttgcctgtggccttcaccatggccagatgccatggacagcacttgtttctgatgtcccccttaggatacctcccttatagtgctatgggtccagattccatggtaatttgggcccacactggatgatgctgagaatctgactgagcctctcatttttacttctcatctggtcctctatgtctctgactctggattccactggacattgctac

SEQ ID NO: 19367 - DNA, 593 bp, Homo sapiens
ctgcatgtaaccaaaacatttatcaactgagaatgaaggaataaatttggtatgttgaaacaatggaataatactcatcaataaagaagaatgcatataaaaacatgaatgaatctcaagaacaatgtgagggatgtttgcttccatccaaacagttgttttccattattgtagcaaagaactatgatctctgagagacagatttgaaagacgtaatctctccaaattgacttggctttctgcctggaggaagttttcattctgtggtagagggatgaacttggcattttgctgagttgagaagatgagggtcagaatttgtagagaacaaaatttggctaaaatttataagtaaaatactggatagaaggtaaccacagatagtctagaaatctttagaggtgtccccttaaacttttgactgaatctatgcatgcctaagcaaaaaccccatggtgggggaaagcaaacaaaaaaacaacttccagaggaagaatgatttctgagggaaggaggagtataaactaatcagtttaactgagtggataaggatagattaaattccatagatgaaaagatcagtgaataaaacg

SEQ ID NO: 19368 - DNA, 655 bp, Homo sapiens
gacagaagggagggggtatcttgtagattaggtagcaaaattggaagtcaaagtgtccagtggcagtggtgaaaagtgttgaccaacctcggtttgatgaaggtggcgtgaaagtcaacttaaacttttcactgggaagcaggatatttctgagcctaatgcttatggagaattggcctctgtatttccctccagactttcatgaggcacccggcttggcccaaacatgagccagatgctgaatggcctgccaatgcctgccaatgtgaaaattattcagtttggttaagaaacaatttactcatattctggtttgtatttgaagcctgctaatatcaaagtacacagaattttcatttttatgtcagctacttagatgtcattttgaagctgtgccacgatgaaattaaaaacacaggccgggcacaatggcttatgcctgtaatcccaacactttggccaaggtcaggagttggagaacagcctggccaacatggcgaaatcccatctctactaaaaacataaaaattagccaggcacacttgcgggcacctggaatcccagctactcgggaggctgaggcaggacaatagctggaacccaggaggcagagcctgcagtgagctgagatcacccattgcactccagcctggga

SEQ ID NO: 19369 - DNA, 474 bp, Homo sapiens
gaaacacagatgcagacaggcacttaaaagcaccatggtgcctcatttagcacaggacacaaggcctgatgatactgaaacacttgtgtataaacattgaatattttattgtttcttcccagagacaaaaccttaggtttgtagcactatatcagtcctttcaatgtgttatattaaaactatttaggctgggcactgtggctcacgcctgtaatcccagcactttgggaggccgagacagttggatcacgaggtcaggagatcgagaccatcctggctaacatggtgaaaccccgtctctactaaaaaaatacaaaaaatcagccgggcgtggtggcgggcacctgtagtcccagctactcgggaggctgaggcaggagaatggcatgaacctgggaggcggtgcttacagtgagccaagatcacaccactgcactccaatctgggtgacagagcgagactccatttcaaaaa

SEQ ID NO: 19370 - DNA, 561 bp, Homo sapiens
aaattccctcttgcaacattctatagcttagctcaattcctttctctttgtatagatcagtgaagtgccagaagatttactatgagtaaacaactttagatataagatttgcaggactttaatatcagacacctgctggtcatataattgaaattatctacactgaagtagaaactagtttaccaattatgtttctttttatggtcccaaacctcatactcatctatatctatattactagtttgctagctagcaatttctgctactcattatttctatcctgctactttcataaaagtttggattgatttcagagcagttacaccaacaaataatgataaagtagaaatatgtgcattgggcagcttctgagattgaatgtgctcactaaatctttgtagaaatcttcctggattacctatctacccttccaattattctctattactgtgtctccccttcaatgtaagtgccataagtacaaggactctgtgtttaggtatgtgtgagctattcacaattataatggaacagtgagaataagtcactaaagatatcagt

SEQ ID NO: 19371 - DNA, 551 bp, Homo sapiens
tatgttgaccagatcattgctttctttattccaaaaactagagttgccagatttagcaaaaaaagtaaaagacatccagttaaaatcttcatttcagataggcaataaataattattcagtataagtatacctcctatggttttaggaataggcttatactactaacactttattttatctaccaccaactcaactcttcaaacaaatattgagtgccatctcagtactgagcactgtgcttggtgccagagagtcaagcatgaatcagacgcagtttttcatcttagggggttcaaaggctagtgaaggtgagattagtaaacagctgaaatatgtacaccctgatactgacaattcccccccacccacactcacccagatatacatgcacaggcacaaattataggtgaatatcattcacaaatataaacataaacataatgtgaattaataaaatgttagcacattggaaactattcaggattacagaaagaagagtaatttgcttcaaccaactaagatacaaccctagaagacacgagagaactta

SEQ ID NO: 19372 - DNA, 590 bp, Homo sapiens
cgaggcgggtggatcacctgaggtcaggagttcgacatcagcgtggccaacatggtgaaaccccgtctctactaaaaatacaaaaattagccggccgtggtggcgcgcgcctgtagtcccagctactcggggggctgaggcaggagaatcgcttgaaccctggagacggaggttgcagtgagccgacatcgtgtcactgcactccagcctggcgacagagcgagactccatctcaaaaacaaaaaacaaaacaaaaaaacaaaaaactagatgatactgtctgtctcctttgataactatgcaaactgcaaaagctcccagaagcatagggtagaataaaggctgaaccaaaaagaaaccaggccatgattaagtattttaagctttcataaaaagtagaaatggggtcgggcatggtggctcacgcctgtaatcccagcactttgggaggccgaggtgggtggatcgcctgaggtcagcagtttgagaccagcctgaccaatatggtgaaaccctgtctctactaaaaatttaaaaaattagccggccgtggtggcgcgcgcctgtagtcccagctactcggggggctg

SEQ ID NO: 19373 - DNA, 551 bp, Homo sapiens
aatagaataaacctgcttcaaacttcatcaatcattgttccctttatcattttcagatcattaaaccagcttttaatcacaaacactaatattttattgtatattttctgcttaaatctagacagtgttagcttggcattgactttcccaagtagcagaattagtgatattttgaatgatataaagggtatttatctattctttcattagcaaacattatgtaagtagttactatgtgtgtagcatagtgctgtattgtaaggtaactgtcttcaacatccaggtaggattagtttctccacttgtagataggtacatctatgctataacatatgtattatgtccttggctgggtatggtggctcacgtctgtaatcccagcacttcgggaggctgaggtgggtggatcacgaggtcaggagttcaagaccagcctggccaagatggtgaaaccccgtctctactaaaaatacaaaaattggccgagtgcggtggcgggcacctgtaagtccagctactcaggaggctgagccaggagaatcactcgaacc

SEQ ID NO: 19374 - DNA, 563 bp, Homo sapiens
ggtcctggtgggaattgattgggtcatgggggaagagttctcatgaatgagttagcaccatcccctcagtattattctcctgatggttgagtgagtgagttatcatgaaatctggttgtataaaagtgtacagcaccactcttctcactctcttggtcatgctctggccatgtaagatgcctgctcttgctttgccttctgctctgagtaaaatcttcctgaagcctccccagaagcaaaagccagcatcatgctttctttacagcctgtggaactgtgagccaatgaaaaattaaacattaatagattacccagtctcaggtatttctttatagcaatgtgagaatgggctaaactcccactttcttatttcattcgttttccctaaaatcccactccctgggattatactccctaattaatgtcctgcactcaggctcttttcaaggcaactcaggccaagtcttgaggcaaagaaaccttcatttaatggcagtgtaactttatttttatgactatgactatactattggtataatctgtatggaaaatgttggatattc

SEQ ID NO: 19375 - DNA, 584 bp, Homo sapiens
ctccaaccttattgagccataagtttaccacagttctgaagagactttcagccagaaccacccacctcacctgcttctgaattcctgatcttcataaattatggaagaaaataaatattagttaaataactaaaatactgtccaatctcttactgtccaaatcatcattgttttgcctaaggaatttttctgaagctcagtagttagatcatcgcaaaggtgaggcaagtgagatgtttgaggcaatgaatccaacaaacagatctcattcaatgagtgataaaagttgatgtaaaagatgccagtgagggccaggtgtggtggctcatgcctgtaatctcagcactttgggaggccaagaggtgggcagattacgaggtcaggatatcaagaccatcctggttaacacagtgaaaccccgtctctactaaaatacaaaaaattagccgggcttggtggcatgcacctgtaatcccagctactcggaaggctgaggcaggagaatcgcttgaaccctggaggcggatgttgcagtgagccgagattgtgccacctcactccagcctgggcgacagagtgaggct

SEQ ID NO: 19376 - DNA, 592 bp, Homo sapiens
aattcatagttgggccaccaatggttctttgccaatgtcctggctgttgctatgctgaaagcagaaggaagggtgcatgctggtagcaacgcagtgagagtacagtcttcctgcttagacaggttgtctttagagagacccttgcttagctctgctgccatggggtggaaggagggcttatctgtctgacagaggaatggattggctgtactcaggaactccagcctacggtgcttaagccaggctgatgtggggagttggaggcctatgtgcttccaggctcgtgtttccagggagcatagtctagtactttaccacacaaagtgtggatccagtggcatttggtttcacctgggaacttcctaagaatgtagacacaggccaggcacggtggcttatgcctgtaatctcagcactttgggaggtcgaggcgggcggatcacctgaggttgggagttcgagaccagcctgaccaacatggagaaacccatctctactaaaaatacaaaattagctggacgtggtggtggcgcctgtaatcctagctactcgggaggctgaggcagaagaatcgcttgaacccaggcagcag

SEQ ID NO: 19377 - DNA, 531 bp, Homo sapiens
aaatagaaacttgtatctgtgcacatgtagatgtacattagtgtagtcacaacatgagatgagaacttcctggctaaaaaaataatttgaattgctaaataacaacaaaagcattgagaactgactgatacatcccttacactatctttgcattaattcatctgcacaaatgaagatgacatttgtgcttctgcaatcacacaataatgacagcttacactcagtttatagataataaaacatttttaaaatctctttctcatggtgcaatggctcacacctgtaatcccagcagtttgggaggccgaggcaggcggatcacctgaggttgggagttcgagaccagctgggcaacatggcgaaaccctgtctctaataaaaattcaaaaattagccaggtgtggtggtggcgcctgtagtcccagctactcaggacgctgagacaggagaattgcttcaatccaggaggcagatgttgcagtgaacccctgcgccactgtccagcctgggcgaaagagcgagactccacca

SEQ ID NO: 19378 - DNA, 647 bp, Homo sapiens
tgtgctacattataatacctgtcaaggagcacttggaaagtgagaataaatcattgcgagcacattactcagtcttggttagtcagggaaggttgcacagaggagaaatctaaaccttggcacttctgaagtcacctttctgaaaacattctggtaactgttagatcccttgttgtagctattcatatgttctgtgtggttaaacaaggttcacagtgggccacctggcctttggaacttggctgaagaggctgccttcagttcatcctccccacccccgttttcaaaacatgggtttccatgtgttcgttgtaaattaggaaacataaccatgttttgaggcttcatagaaaacaaacgtctggggtcacacaggttaaaggaggaaccaaattcagcactatcactgttctattcggcaggcaattctggggccttcctgtgtcccaggttctgtactagttgtttcaggactttgggataaacacaaactatccctgccctcagggggattaaggtcaggtgtacaaatgactctaatgcgaggcaaggctggattcagtgctggaagaggagggcatacctaacgctacgggaattcaaagaggaaatgatcagaatgaggagggagagatgggtcattccgg

SEQ ID NO: 19379 - DNA, 544 bp, Homo sapiens
gaccgtctcagagggagagagattgaagaggtagatggtcaaatgcagttggtgggctttgggcgctgctaagaaaccaactgcagaaaggcacctctgagacaatcagggaaatttgaacaggggctggtatcagattatatatttataattaaaatgttcatttaggaattaaagttgataattataaatttataattaaaaattgaagtgttacaatggaaaggagtttatggggaaatattatgattagttagagatacctggtgatgtacttacagaacaaatgatagaatgtttggggatttgctttcaaataccgcagaagggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcattccagcctgggcgacagagcgagac

SEQ ID NO: 19380 - DNA, 623 bp, Homo sapiens
taataatttcacaaggaaacatttcagcaaggttcagtctctcaacctccacattattgaagcaacattcagtaaaagacatcttgtgagaaggctcagtatagaaaattagaatgtcagtctcaaagaagggaagagaaatgaattccatggttgagaaagcactctttaaaaaaaaacccacaaggaacagatgttgccagaaaagggcagaaggggaagaataattgtcatgtggtaaaaaaatttaagccaagaatttaagggaaggaaacctgggtggccatagaggagacagttgcagattttcacagataacttccaggaaagaaacatgttttcggctgggtgtggtggctcacaccttaatcccagcactttgcaagcctgaggcgggtggatcatgaggtcaggagttcaagaccagcctggccaagatggtgaaaccctgtctctactaaaaatacaaaaactagccaggcgtggtggcacatgcctgtaatcccagctactcgggaggctgaggcagaattgcttgaacctggaaggtggaggttggagtgagccgagatcgtgccactgcactccagcctgtgcgacagagtgagactccatcccaaaaa

SEQ ID NO: 19381 - DNA, 603 bp, Homo sapiens
  misc_feature 25: n = A,T,C or G
ggctaaattcagtttctttacatantgcgggatgaaagaacagtttctgaggtgatcaggcccaaaatctgcagtgccttgtgtatgcatgcagacagtcactcatgtcacagcggaggaaacggaggcccagggagccatgagaaagtttattctttgctctgagagcaagcagatgacatatgcattgtgtttaaaaagatcgctctgggtgcaacttagaggttaaagagagggaagatggggtccaggagatgagccggcgaggccgttgcagctcacatgtggcagggagtggcgcacctgagccagtgcagtccgagcatagtggggctggagctggaccctgatgctttaatgatgcggctgcctctaaaataacacacaggccgggcgcggtggctcacgccggtaatcccagcactttgggagatcgcttgaggccaggagttcaagaccagcctggcccacatagagaaaccccatctctccaaaaaaatgcaaaaattagccaggcctgggggtgtgcgcctgtaatcccagctactcaggaggctgaggcatgagaatcgcttgaacctgggaggtggaggctgcaatgag

SEQ ID NO: 19382 - DNA, 513 bp, Homo sapiens
gtaacaggcaacttaataagcagttaatatgtattattatatttaatgtataaagctttaaatacacttatacaaatttgaagaactcagggcaccctattcctctgctcacagatatctattttaaagtcgacatgagtaagtgataaattcatcaatataaaataaatgtaaaaatatttcaaagtgattcatttgtaccagaccatttaaaaagaggggataaaatagtatcaatggggaagggcatggcgggtcaaacctgtaatcccagaactttgggagaccgaggcaggcaggtcacgaggtcaagagattgagaccatcctggccaacatggtgaagccctgtctctactaaaaatacaaatattagccaggcttggtggtgggcacctgtagtcccagctactcaggaggctgagtcaggagaattgcttgaaccagggaggcacaggttgcagtgaaccgagatcgcaccactgtactccagcctggcgacagagcgaggctc

SEQ ID NO: 19383 - DNA, 573 bp, Homo sapiens
tggagaacccttgggggttacatttcaatatggggcaattattggtggctacaagtaggttcgtgcaattattggtggtaggatttgagctggcctgaaccacaatattcagacactaccccttctgtctgcccctctcactatcccaagggagaagggattccaaaatctcaacacttcactttcctgtattaagctgtgaatgcaaacaattgttctagtcattcaatgtcttctgaggaaaaacaattcagtgcagaatctaacatacaccatgtctatcatgtaaaatttatgccacagaaaattagtatgtgctgagaataaaaaacctaacttttattatttctcttttttcctttatgacctgggcaatataatttgatgaatcaaaatttggccaggcacagtggcttatgcctgtaatcccagcactttgggaggccaagtgctgacagatcacttgaggtcaggagttcaagaccagcctggccaacatggtgaaaccctttctctgctaaaaatacaaaaattaaccaggcgtggtggtaggtgcctgtaatcccagctact

SEQ ID NO: 19384 - DNA, 585 bp, Homo sapiens
ggttgagcagaagcttctttaaggtgacaccaccaaagtcagaaaaatcccaagtaataaaggctttaaaagcaggggaaaacccaagggaataggggctgggctcggtggctcacacctctaatcccagcactttgggaggctgaggtgggatgatcacctgaggtcaggagttggagacaagcttggccaacatggtgaaaccccttctctactaaagatacaaaaatcagccaagcgtggtggcatgcacctgtaatcccagctactcaggaggctgaggcaagagaatcgcttgaatccacaaggcagaggttgcagtgagccgagaagatcatgccactgcactccagcctgggtgacagagtgagactctgtctcaaacaaacaaacaaaaccaaaggaatgataaatacaaaattctgggccacgcgtggtggctcatgcctgtaatcccagcactttgggaggccgacgcgggtgtatcacaaggtcaggagatcgagaccatcctggccaacatggtgaaaccccatctctactaaaatacaaaaaattagctgggcatggtggcgcaagcctgta

SEQ ID NO: 19385 - DNA, 648 bp, Homo sapiens
atttttaactaagtttattttactacctacatttagaagtatatatcactttccaaccttaatctttgaagctattttaaattttatgttcttaatgagcttgataaagaatataaaaagtatgcataaacaaggtatacatagtcaagcaatagtatgcgtgatacaagatataagggactatgaaatccaaagaagatgcaatacaacatgaagtagaaggagaagtaatggaaatattagagtttatttctaaataatgtatctcatataggtttaatagaagggaagaaaaatataagaattctgtagttggagtactaacacactgaatgatatagaggagaaaataaatatgttttactgttggtaaaaaaaagttaatttttaaaaaggtccaaatttatcaatttttttagaggtttagtttggggagtgtgtgtatgtgcacgtctgtgtgtgtgttatttaacatagattactgtaaaccatctgagttcttgtataggagcaaaaatgatgaaaaatagtttttaaaaatataatctggtagtggtggatggtagaaagaatccggaggcagtgagctggaaagaaatatttatagttatttaagagtgagttaaaggattagagtgagggcaaaaa

SEQ ID NO: 19386 - DNA, 569 bp, Homo sapiens
tgcacccagcccatagtgttttgaagctaagatgcgttcagccctcccagaatcttagggattatatgaatcctctatttaaattctgttcccagccctgagggttgatcacagaaacagtagcttagagaaacaacatacctgtagtgtcacatgttgaaagattcctattcagagatgataaccattgttcattctttgcctctactgggaaaagtgtgcttttgcttcccataagaactcaaaatttaggcttgttttaaggaaggaggctatcattgaccaaattgtagatagacagccaggtgcggtggcttatgcctataatcccagcactttgggaggcagaggtggacagatcacttgaggccaggagtccaagaccagcctggccaacatggtgaaaccccatctctactaaaaatacaaaaattagccaggcatgatggctcatgcctgtaatctcagctacttgggaagctgagggatgagaaatgcttgaacctgggaggcagaggttgcagtaaactgagattgcactactgcactccagcctgggcaacagaaca

SEQ ID NO: 19387 - DNA, 583 bp, Homo sapiens
  misc_feature 485: n = A,T,C or G
tgcctagcttttagtttcaacatcatagttttgacattctccttaatttataactttatcatgattgtgtgtgtgtgtgtgtgtgtgtgtgtgtgtgtgttctgggaggtaggcaagttcatcataaattttattgaaaagaacaaataagtagaatataaggaaaaccctcaaaagcagatcagcggaggagggttgtagccctgctaattattgaaatatagtattaagcatttctaattaaaactctgggattggtgcttaaaagacagaccagtgcagctgagtagagaataaagaaatagatgcagttgcacatggaatttaagtatataataaaggaagacaatattagatttattctttatgttatgtgaaggataaattacaaatgaattatacacttaatgtataaaaatgaaactatgcaagtcttgaattcctctgaacccggaagtggaatacacaccctatctataactcanaatccagattataatatgggaaataaaatttgatggtaaaagtactaacttttatatggctaaaaataccagttaagtaaaaaaaaaaaaaaaaaaaa

SEQ ID NO: 19388 - DNA, 380 bp, Homo sapiens
cccaaagtgctgggattacaggcgtgagccaccgcgcccggcctgtaccaacttcttaatgcctcaactgcatctctgcttggacttttactgcaaacaaatatattatgtgatgtttaaaataaaagaaatatgatgttcagtaataactggtggaatgagagaatttggctccatcttctctaataacaaaggagttctgctcctacatctgagcaaaattataacctttttacataaaacaactgcgaagagtcccagcatgaacaccgcagtctctgtgggacggatacagtgacaatggctaaaagaatctgacattcaggttgattttatattttaaaatcaatgatgggccaggcacggtgggtcacacctgt

SEQ ID NO: 19389 - DNA, 583 bp, Homo sapiens
gaacacctagttcatcttcaactaagcactttaaagtgtggcttcactaatctttctgcaggactgtatttactgtttcaatgtaaatgtagaatttaatatctattcctttaaattttcactttgttgacactgattctagtcaaaatttactgaattctgattttgtcatatattaattatgccacgcatttttatgatatttgaaatcctgagaaactcacccatgttatctgtgctcatctaaattactgatgagacaaacagataaaggaagaggaccacaagtaaaccccaccaccacaatcctccaccttattgaacacctgataaacaacactacgtacatgtggctacttcggcccccaggcttcagacaccaaataagctgtttccaagttcaagaactgtatgtctagatatcttctagaattttcgtgtagatacccaacaagaactctaaattcagtagtccaaaactccttttttatttctatttgtccctgaaatattttcctgttactatccaacttgcttaaaggcagttttatccaaatagtctcatctagaaatgacagttctt

SEQ ID NO: 19390 - DNA, 598 bp, Homo sapiens
gattttttgaggccacaagtttgaagctgcaatgagctataattgcaccactgcactctagcctgagtgacaggatgagaccctttctctcaaataaaggaaaaagaaaaaagtaataataacaaaataaaaagagtaatttaccaattactgagggagtctagaaaggttaagtataccccctctaaattggaaataacagtttaaaaaatattttattggtaaaaaaataaaggccactttttatcctgagagagtatgtagaacttgaattttggtttaaagcacttattactaagcttaacgtaaatactttggcaaattgattctaacaaagatatccttctcatgacttaaaagagccactaattttacttttgaaatatgtttaatttttatattaaaagctaggatggctgggcgcagtggctcacgccagtaatcccaacactttgggaggcggaggtgggtgaatcacccgaggtcaggagttcgagaccagcctggccaacatggtgaaactccgtctgtactaaaaatacaaaaattagctgggcttgatggaacatgcctgtaatcccagctactcgggtggctg

SEQ ID NO: 19391 - DNA, 641 bp, Homo sapiens
tcatggaacaactgaaggactagacacttggctcccatgtgcccaagagacagaggagctctgaataggggcctaaaatgcactgtttagcaggtatgttcatgtcaaaaatgttcctccctggcctggggtcagaaatgaccctgttttagtgcctcacacatctggagtatgacctcatcttgccatgtgaccctggacaagctgaattctcctctgagcttcagtttctgtatccatatattcccaatacaaatacccacctctcaagactcatagttgaattaaatataatacaacattgacttcatgggcacttaatccatgttggttttctttctctagaatgttccatgaatgtccactccacaccccactgacagtgtgaggcagatcgtcgagacagaaaactaataaagtagttctggacttatactcaatgtttgaccaattgaacccaataggcatttacggaatatgttactcaaccacagaacatacatcttctcgtctgcacttagaacatagtctaagatcgaccacatgtttgaccataaagcaagtcttaataaattcagaaaaagcaaaataattccaagtacactcctggaccaccatgcaataaaaagagaaatcaatac

SEQ ID NO: 19392 - DNA, 641 bp, Homo sapiens
cttggaaggaggtagttgcagggttgcatgattcagtagataaagaaggccaacaaagagtcagggtcttttcatcagttcttccctgacattgtcagtgtcagccatatttgccttcatggtcacaagatggctgccacagctcttacatctgtcatcctcacaatagcattcaaaagtagaaaaaatagatccctttcctcttagccttggtcactgtcatccatctatctatcatctatctatctatctatctatctatctatctatctatctatctatcatctatctatctatcatctttaaggattctatttctgagaatctctgagctgactactgctcaggctccactggctattaggagctcacatgaattgcttagattagtcacgggccattccttggggatagagaagaggtcctctttccctccacacatcaccatcacttaccaaaacaaaagcagggttcttttaacaagggaaatgggagaagatagctgttgtataacaccatctgtgttaggaactatggccattcacgacataagtttgggatttagctattatattgtttaaaccatgggagtgaatgacaccattcagaacatctgcatgaagagaactggtccaaagaca

SEQ ID NO: 19393 - DNA, 646 bp, Homo sapiens
aactaactcatagtctgccttttaaatgtagtatttgtcagcgtcactttaaaaatctgaagacatttgtgaagcaccaacaacttcacaatgaaacctatcagaataatgttaaacaggtcagaagattgctggaggccaagcaagaaaagtcaatgtatggagtgtataatacttttaccacagaggaaagatgggcattacacccgtgctctaagtctgatcccatgtatagcatgaaaagaagaaagaatattcatgcatgtacaatctgtggcaagatgtttccatcacagtcaaaacttgataggcatgtacttattcatactggtcagaggccttttaaatgtgtcttgtgtactaaatcttttcgacagtcaactcacttaaaaatccaccaacttacacattcagaagaaagaccttttcaatgttgtttttgtcaaaaaggatttaagattcaaagcaaacttctgaagcataaacaaatccatactaggaataaggcttttcgggctcttttattaaagaagaggcgtacagaatctcgccccctgcctaataagttaaatgcaaatcagggtggttttgaaaatggtgagattggtgaatctgaggagaataatccacttgatgtccactcaat

SEQ ID NO: 19394 - DNA, 618 bp, Homo sapiens
attaattttaaaataattacatgtatattagtacagagccaaaactccagctcgaaactcccacctgctttcattacccttcctggtgggcttctctgcttccccattggattataagcttcttgtagaccaggattatgtgatacttcattgtgtgagcatgtaaatagttgatactcagtgttcttaatataattgaaatgtaaattattatgattacacagggccagcataattaataggccatacactcaactgagaatacaagagataagttgtttgcactgcagatggtattttctaaaaatgaataaagtggcatgaactgaatgcaagtttatgttatctctagttgaaaagaaaagtttctctcttaagcactattacgccttcttttggcagcagcaataattttcttcttaaattcacaaaagtcctaattcttgaaaaagtatgctaaagcaatgtggtttactcaaacaacagcaagcgctctctgcatgattccttttcgaactttctttaagctgtagtcctgtccctgtaacagctttttctcattaacagcatgtgttgaatttcaaggtctgattctcaatggacttaggtgagcagcat

SEQ ID NO: 19395 - DNA, 582 bp, Homo sapiens
  misc_feature 473: n = A,T,C or G
tgcaaccctatggaagatgatgtggactgcaaaaactgcattaagcagcagaatttggctcacggatatacaaattaggagccttttctattattcctcataaaacataaggaagaattaaaaggtgcctgagatactgaagtaattgaatggggaattcttaattaatcagctaattatttaaaagatcatttattcatttaagaaattaattgagcacctacattataccatgtgtattttattttattttaaaattctatttatttatttgagacagagtcttgctttgtcgcctaggcttgaatgcagtgccatgatctcagcttactgcaacctcctgagttcaagcaattcccctgcctcagccttctgagttcaagcaattctcctgcctcagcctccggagtagctgggattataggcgcctgccaccaggcctggctaatttttgtatttttagtagaggcggngtttcgccatgtgccaggctggtctggaactcctgacctcaggtgatccgcccgccccggcctcccaaagtgctgcgattacaggcatgagacgcttgcccggctgcat

SEQ ID NO: 19396 - DNA, 632 bp, Homo sapiens
tgttacttgattccttttctactgattaggaccttaggttttccagaagtatctgtaaattctaaatatctaccttgtcttttttctccaaacacctgggcaactgaattttcacagtggtattgatagtaaaacttttctgcacctgaacactttgtaatttcttatttatggttctgctcagcaaaagaccattgctaccttgaccagaacataagaaatcctgcacagaagtcagaatcaaatttcatcattaacatagaaatttaaaaagggggaaggccagactaacattaatggagcaccctgaatgtggcagttattaagccaattatctgtatacattatcatcataaaaactttacattagccatcataaaaactcaataatgaatgtattatcaggtggggcgcggtggctcatgcctgtaatcccagccctttgggaggccgaggcgggtggatcacctgaggtcaggagagagaccagcctggccaacctggtgaaaccccgtctctactaaaaatacaaaaattagctgggcatggtggcgggcgcctgtaatcccagcttctcgggaggcagaggcaggagaataaattgaacccaggaagcggaggttgcagtgagc

SEQ ID NO: 19397 - DNA, 497 bp, Homo sapiens
ttatggacaataatcagataatggtcagttccttgcgtaacaatacgcagcttgatctggccacctactgtctctcctgccaaatcttgccttgtgtctgcctttccactctgaacatagagttctttggacaggtcacaccctcatcctcaagcccttcccatatagagtgttttcatgcccttagactagttactcaaacttcaggtctcatctcttccaggagccttctcaatagcacagtccctgtcccttaaatataggttgtgtgacttctatatatgcattcatggtcaggcacagtggctcatgcctgtaatcccagcactttgggaggccgaggcaggcagattacctgaggtcggaagttcgagaccagcgtgaccaacatggagaaatcccgtctccactaaacatacaaaaattaactggggcgtgatggtgcacacctgtaatcccagctactcgggaggctgaggcaggagaatcacttgaac

SEQ ID NO: 19398 - DNA, 569 bp, Homo sapiens
ggcacgcatacatatgtgtagtgtgtgagtactcattagggaaagtaacatttcagagtttaatgtggtattgctctcctttataatacttatcagtgttagctaatctgaaggtgcagctacaaactacagtactcagtcattagtgtttgtgagagctcttcacgtggagggcattgaactagaatttccaacttcatggtatagacgtcctctaggtatattttatgcatttcgaacactattggcttcaatttttgaatgagaaataaattccaaaagtagtaaagtcaaaagaagtggtgtctctgggggtgagttgggtgaggatcctgtgtgagataacaaaaggagatgaaggtgaggaaatggctagcttctcatgcactgttttagccaccttatgtgaagagtacaccttaacagttaggttggcggagggacagcattaggaaaagtagctaatgcatgctgggcttaatacctgggtaatgagttgataggtgtagcaaaccacaatggcacatgtttacctatgtaacaaacctgtacatcctgcacatgtaccc

SEQ ID NO: 19399 - DNA, 486 bp, Homo sapiens
accttataatcaatgattgactcttggatttgctcatgttttctattttcatatgtgagattactatttcagagtagttcacatattttaactcttggccccattatcatatacaatttttaatatgacctaatatggtatttggctttttttccctccaagagtagtgaaatacttgtttactttcagcctgtaggtccaaaacaatctcatgccatgaaacctaaacggtaatctcctagtctatgttgttggtgttatttgtcccaacatacttacgttttctaaattttaacatgttttgaaaaattacttttccccttaagaacataatctggaagctaaagaatgatatccaccaacatgaaaccacatgaaagtttaaaacccactgccagagcaaacacacaaataagaaatagaaaggactcaaatattaccactacatgaaaccaccaaaccgcaaaaaaaaaaaaaaaaaaaaaa

SEQ ID NO: 19400 - DNA, 552 bp, Homo sapiens
ttggctctgtgattccacgctaaatggaagccaagttagactgtgtaattcacaggaaattaggaggctgaagaaagcttggcagccagtatctccctggatgtagtctgtgttctgctttcttgtttctctagtcattcttttgttttcagaaagccaaaaatgacctgcactgcttcccaaggtttggagattcagaggacctgtccctgttcccttcctaccccattgctggggctgagcaaaaatgagcccttcacctcaagcttcagtagctttcattgagtatcatcaggcaggttcactcatacattccacatttacaaagcaccactatgtgccagggtgcaagggactagaaagatgtttctacttgattattcttggaaccagagaatgtcaagatgcagcgggactctagaagcctcggagtctcagcctgactttagaactgaatttttgtccaaccaagggtgtgaataaatgcaaagacatgacttgttatttgttaaggttgtggggtgaggggggtggtcacacagagcattgtct

SEQ ID NO: 19401 - DNA, 595 bp, Homo sapiens
taggttgaagccttttaattagtcgtttgttcaaacgaaactagccaaaaccccttctatctgaagtggggcaataagaggaatagttgctccagagcaggccattcaacccttccccagcacagcagccctggaagaatccctagaaatttccagagtgccaagaaaaccacaggaatgatttacaactctatctatctgagtctacctgatgactgagattattgacctgctagttagcaacttcccacattcctaacctctgtgcttctatctaatacttctacctcaacatgaagtaagtagaaaataagtagactttcctaggaagacactgaggacctctgagctaatgaatatgttttaaatataagattggaaagttatgaggctacctattttcaaccatcagaaaccaataatcttagtttataaacaaaatatttatcttggttccttttgcttcgggttgaggatttaatcataaaaaaatctagttgcaagaaacataaaaagtaaaaaaatcatatgtgaatattaaagacaaacattattcattataattattaatgaagtgatcccatttgcccaaaaa

SEQ ID NO: 19402 - DNA, 559 bp, Homo sapiens
ttggagcttcaaagaagtaaaagaaggaaagatatccaataggtagaaatagtgaaataaaacgtgagtaagaaataaaatcaagaagaaaccttaaatgaataaatcacaaataggataaactctagaacagaagtgcttctatctttcctgcagtggaaggcttaatggcagagtggggagtgtgggcatagtggacagacagcctaggtttgaatgtgagctctgcatttttatctgcattactttttgcaaatggcataacttttctatgtcctagtttcctccactacaaaatggaagtaaaattactttttatctcgaaaagttattacaagaattaaataagttaattattttaaagtacttagaatagtgcctggtacatagtagttgcttagtaaatatgagccataattacttctttcctgtatgtttgaaatagttcatagtaaaatatttataaaaaaggaatgggccgggtgtggtggctcacgcctataatcccagcactttgggaggctgaagtgggtgaatcacctgaggtcaagagtttgag

SEQ ID NO: 19403 - DNA, 539 bp, Homo sapiens
gattactgcaatgctcctgctagcccctgggcctgggtctgagattccaagctgccattgccattccaagctgccagctgttgccagactagtatttctaaaacatcattttcatcatgggtgcaggcagcttggagaagaggaataagcacttgaggtgaggggagatcttgtgcaaacaaatccatccttctagatctgcttcctcatctaaacgcttgggatggccccttcccagctccatcattcccctggcttaagagctcataagactgtttattgtcacaaggccctgtttttctgatggccttttttggacctttacaaatagacagcatatctatctgaccttatttcccactattcctgagaactcactgccagtgtcctaactgccatctgttggaggtccctgtgaagattacccttcacctgcaatctttttcaagatcagtgatttttctgttgttcacgcctaattactgcctttaatcaccttatccctttcttattcctttttaattatactaaggacatgg

SEQ ID NO: 19404 - DNA, 494 bp, Homo sapiens
cactgccttctaatcagatacatttgtttgcaggtgcataatttggcacagactttgtgcagtttaatttaatacaattccttttaagtactgaataaatcccattaaatctgtagaacatttgatccaatatatcagcctttggtattttactaaagaagtagaaacatttttattgcaaaaatatttaatatgagtatgattcatatacaaaatttagatccttcttcaatgtaaaaatataggtgtttgtttaaaaaaattatgtatagccatataattaactaccatgcaaatataaaaacagtttttcagaaattatcttttgaaattgaaatatattaaaggtgtattatgagagaaaaatatcgatattaaaataatatgtaagataaaatataaatcacataatatatttgtttttatataataaatgtatctacaagagtatcaataacttgtcgtctctggctgagtgggattatatttattac

SEQ ID NO: 19405 - DNA, 563 bp, Homo sapiens
tacatagttaatgaaacagataggagtttccagcctatagttttccaaatctgtaagataaagtcatagcttagtctgagaaggaaaaacaccactttggagagtacatttaaaagcattttagttccctatggatctttgagttagatacattttctaaaaatgtatattccttctccatgagaaaacctgaagttaccagaaatcaatcaggcttaaaagggatcagcacacaaatgagggagagctttataagctgccagacttatcctgattcaatgtatctcaaaaataaaacaatgttaaatattgtaggtcagacctttcaaaaaccaaaacaagcatatccatgctgttaatgatatacattttttaaagaaacaaataagaactactactaaaaataacatttaatacttaagacagatccccttgatattcagagaaggctagatagggcacctggggttttcttattacctcaacgtacaaatatttctttgtgtgctgtgatgtgaaaatgcttaggaagtattaaagaccagctaggtggtgatagttca

SEQ ID NO: 19406 - DNA, 587 bp, Homo sapiens
gacagaagggtcacctcatctcaccttgagacctggcagtgagaaaaaccacaaatgataatttccatgttgaaccaagactgataccaacatggagaaaacttcctagtctcccacccgctaggaagaaatcaggcttgaaccatatatgttcttagtggtcctaggactctgatggttttttccaagcaccttaggtgtgcagtacccagatcacatatacctgtacctcttacctgttccaggaacaccgtactgtgcatatatcttgcctgtatctatttcatttgtcctttcttacgtttcctttttcacacctggccctcagataaagacccatgtagtatccatgtccccatatttacaaccaatgagactcagaaatgtagtcattgcctgctttcatgagtcctggctcagatcgaaagtattcagttctctaacatcatcaatgaaacctgatatccttagtctggtatttagcctttcatataatgactcaagccagttttcctgatatatatctcatttctcagaagaacagggtttcgtccttcccatcagcaaattcttcaacatgtagaaaa

SEQ ID NO: 19407 - DNA, 609 bp, Homo sapiens
ctttgatttctaccttttaggcatgcagaaatcttcaattacatgaattaaaacttctcacagacaaaacccatgtcagagagtaataataataataatagatgctaccacacttactgtgtcctctttttcagttcctatctcttatttctaaaataccaaaatgcctctttcatactcagtatgccatccaatttgatgtcccagtttatctctaaggctcctccctcctcttctctcctgcttatgctgggactttggtctttttgcaatcttctttcttactcatactcggtgtctccctctctattggctcctcattctttgtcttcaaacaaacacaagtctctcgcagtggctcacgcctgtaatcccagcactttgggaagctgagacgggcggatcacaaggtcaggagtctgagaccagcctggccaatatggtgaaaccctgtctctactaaagatacaaaaaattagccgggcgtggtggtgcgcgcctgtaatcccagctactcaggtggctgaggcaggagaattgcttgaacccgggaggtggaggttgctgtgaaccaagatcgcgccattgcactgcagcctggacgacagg

SEQ ID NO: 19408 - DNA, 631 bp, Homo sapiens
aacttcattttatcagagtacagtagtagtgcttaattgtctcattcaactataaaattttaacccatgttgggagttaaatatctgggagtgatagaacccatctgataaagcactggagaggtgtggccagtgaaacaggaggggacccatcagggaagaggggcagcttggtcagtggaaagcacagggcgccacggcaaactgcccgccaaatccagacaaaggcttggcaagcaggaggggaaactcagataaagcccaggtgcatttcattcaaagcgtgggcagacgataacaatgacaaatgcagggcaggcggaccacacttgaaaatgtaaagcatgtaggccaggcatggtggctcacacctgtaatcccagcactttgggaggcagacgtgggtggatcacttaaagtcaggagtttgagaccagcctggccaacatggcgaaacctggtctttactaaaaatacaaaaattagccgggcatggtggtacacacctataatcccagctacttgggaggctgaggcaggagaatcacttgaagctgggaggcggaggttacagtgagccgagattgtgccactgaattcgaacctggccagcagagtgagactcgatctc

SEQ ID NO: 19409 - DNA, 514 bp, Homo sapiens
  misc_feature 390, 391: n = A,T,C or G
gcagccctatataaggcatttagcagcatctctgtcttctacccactagatgccagcagcaccctgcctccagttgtgacaaccaaaatgtctccagacattgccaaatgtcccctggggggcaaagtcaccccattggagaatgactggaagtaacttgggaccctttggagatctgaggcccgtgtgaaatggactcactctggggtctggtcttgccagcctactggtgcccagtgcccttactttcctgtacttttcgcccttgcagagtcagagcctctttgtgccgggaggggccttaagggtcgggtctctaagtgaggccaccagccagtcctaggaactatgcagaattcctggggggacagcctgggaatctgcattttnnggatcacttgggctcaagcaatcctcctgcctcagcttcctgaggagctgggaccacaggcccgtgccactgcacccagctaattttttaaaaatttttggccgggcgcggtggctcacgcct

SEQ ID NO: 19410 - DNA, 580 bp, Homo sapiens
atgttatctatattatatgcagagtttacaaatggttatttttgagaagatcagtttgttaggagctcacccctctatacaagtatcagaaatcctctgaagtgttctttaattttggaggttgtgttatactttttctcttatcagttagaacttctttatgatatagcaaattataaaaactattatactatcatattcataaatgaaggagaggactcaaagctaaattttcaaatatctggccatgaagactaactgcttgccacacgggattaacagaacaatgagaaaatgtctagtaataattataaaatataaaaactttgttaaaatctgatttgcaagcttatgtcaaagggccacctcatacacaatcttgaagacattaaataaccccaaatagccactgtaaacttacctggcagtaaattttactatactagacaaatctacagtgagattttctgttattttaaatattttctgtatttctgtattttccaaaatgaacggtttatttagttaataagtgataccctaacttatttactgtttccagaaaataaccaagtgctca

SEQ ID NO: 19411 - DNA, 588 bp, Homo sapiens
ccttcctcctcccaaaagctggtttctctgtatggacatagcctacatatgctgagtccctggagttaggaatttttgcttgttaaaggcatccgatgcaacatgtttagaagaactctccctctgttagcgttgaagacagcataaattgagagaaaatgttcttttttttattcatcatgtaggtaaaagcatatggcctgttctgggacatgcgatctttgcaatccatttttttaaacttggtgtttaccattggcttttagcacggatgtttctgttttccacactgtccagcaaataccatttatatgtggcattgaatgagatatgaaatgttttcagaagcatgctgaaaaagggcattcaaagttatcctttggataatgatgatctaaaactttcttttattatcccatgtgctcagagtaaggggcaaatgaatcagttgtgaaatatgtgttccttgtaggacacaggcactcttgagatctatagcttcaataaaaaggtaatttatttaaattactgcctctttaatttataatgttttggggatttttaataggcatgctctgtaagggcact

SEQ ID NO: 19412 - DNA, 652 bp, Homo sapiens
caggggatcggggtggctgttttgtacctggggcacagcattgggcaccaggaatggcgtgggcattggcacagagaacccaggctccagggcgtgtgagtcgttttgctgggttagaggtgagcttggagtggttggtgggtgtcagatcagacaaggccccaaggccaccacatggagtttggacttttccccgaggctcagagtaaggatttggggagtttagttctaagagctacaggaagccattgaagggcgtaagcttgggacagtagtgacaggatccacttaccttttgcaaagaagtctcaggccaccatggagaggagggtcgtaggggtaagaacagagtcgggagctgggcgctgtggctttacgcctgtaataccaccacttgggaggccgaggcaagtggatcacttgaggtcaggagttcaagactaggctggacaacatggcaaaaccctgtctctactaaaactataaaaattaaccgggtgtggtggtgcctgcctgtaatcccagctacttgggaggctgaggcaggagaatcacttgaacctgggaggtagaggttacagtgagccaaaatcatgccactgcactccagcctgagcgacagagcgagacttcgtcccaaaaaaaaaaaaaa

SEQ ID NO: 19413 - DNA, 627 bp, Homo sapiens
cctaaatcaactctagtataaagtgatatcttcaatacatgtgaaccagttatcacatagaatgagttacttttgtcctaaaaagaattacctttcttgaaaggagatgggcaaggcaaaaatttcaacagaaaatcagcaggatggtaacagaaatcttatttttaaaaaagaaattataacaacttgagataaaaatggttggcaaatctggtgctcaatttcaataccagacttactatagattttcttttgtctgggatttagattcaatggaaaattcctgttttctctccttgctagtaataaagcataaaagtgtgcaatttaacagcagtaccagagtcaggccatttgctagataggaatgtggatggatttctggaagacgaatgcatagaccagaacaaactaagccacacattgctggtgtcttaaacatatgacttaaggaatatcatctaaacaaaaaatctattttgatttcctcctacccctttaggaatcaaatcttccccagcactaagtataaatttgtacatatcctgccgggcacaatggctcacacctgtaatcccagcactttgggagcctgagcagggcagatcatgaggtcaggagtttgag

SEQ ID NO: 19414 - DNA, 549 bp, Homo sapiens
ggagatatacctgatgttaaatgacgagttaatgggtgcagcacaccaacatggcacatgtatacatatgtaacaaatctgcacgttgtgcacatgtaccctaaaacttaaagtataattaaaaaaagaagtgcatgtgaaagaaagtccaagaaagaaaatctgttttttttaaaaagaacagataaaaagatatgtttttaaaaataatactaacatgttaattatgccataaaataccaagaaattaatgaaataaaataggcaaaactttttagactgcaagcaaaaatctattagtgaatcaggaaatcaatttaatagttatcaacagatttgttttttaatggattggagtaaaagagaaattatcagagtataacaagcttattaggtgtaggtgttattcgatgaatattctgtttcatatgtgtgtgaacatgcagttggtgcatcaggttgcaaagtaaaatgtacttcttactttgggaagtactttaataactttgtaaaacaatggtacagtagagaaacagaacagagtttggg

SEQ ID NO: 19415 - DNA, 545 bp, Homo sapiens
cacttcttgaaaagtaggactgaaaatcaaatcaacaaatatttattgctcacccatgaatctaaggtagctttttaatcgaataacatctcacttttctgagaacacttaaatctgttgaaatgtctctttaatatctaatatcttttctcaaggaaataaacaacacagaagggatggttcttacagagagaaggttttcaaagctggcaggactagaacttctgaaggttcttttacataaccttaattgtaatgaaactggatgtgtgcatccttggcctgccctggtttgagctgactttgacctgctcacaagagaaccccacctctcttcccctggggatgcctggcctgccttctgtcctcttgaaatggtccattgtatcaagctggagtggctcattggtcaagaagatgctaagcagccgggtgcggtggctcacgcctgtaatcccatcactttgggaggccgaggtgggtggatcatgaggtcaggagttcgagactagcccgaccaacatggtgaaaccctgactctacta

SEQ ID NO: 19416 - DNA, 594 bp, Homo sapiens
ttcacttggggaaacggtttagctgcctctgctcagctcttcctcaagaaggtgacacaggcatgctagctggaatggagcctttgcttctttcctctgagggaattacacctcagtgactgacccttttcacttctgccttgacattgacacccacaggctgaagtgggggatgtgagagatggtgggctggcagagccagatggaaaaatgtgtcctgtaaggatagctggcatcttcccaaggagtaaccaggcatatagcatgtagccaagacaagtcactagctggcattaagttgggaaaattgcaaggggaaagtggatgctgggaaattgtttcaagcaaatggctagacgtgtcctctctctcctgccgtctggtcggggccccctgggcattttggcatggaggacagcccatgtttccccacaggtgagagggcaggttctagcagggctaaattaaggagtgttagagttgaaagggaccccatggagcatccagctggaacctcatcatttagcagatgaggaaattgaagtcaaggtagtgcccaagctgggaatagtgcccaagactggctcacttctt

SEQ ID NO: 19417 - DNA, 611 bp, Homo sapiens
gagaagttaaaataggacacattaatagacttcaaggacaactgttagctttgattaaaaattgagtaagagtggctactacctagagaagatccaacatggttaggaaaggatttctgtaaagacaactataggcaagtaagagagacacaagttatccaggtaaattttggggttatctttaatgactcactttatctcacactttgtatctaaccaacaaatcctaccatattcccttcaaagtattttggaattcccttttcactacctccaccatcatcattctggtctaaaccactaccatctcgtgactgaatggttattctactaattgattatccatcagttatatcattgctcccttgcaatctgttttctgtgcagtagctatagtgatccttgtagactataattcagaacatgtatgtttctgctcaacatcctccattttgaggaaaattcaaagtctttaccaagtcctataaggcaatacagaattccatgtcctcccatacccattattactctcaccttatcatctgaacctctcttcccacatactctactcctgccacactggcctccttctgggaatttagcaagcacac

SEQ ID NO: 19418 - DNA, 594 bp, Homo sapiens
ccaaaactatgtgaagggaggaatgcttggggtggagagtaatggtgatatatgaagaaaaggtcattgcagaaaaaaatatacacacacacagaagtgcgtgtgtgtatcagtgtctggaactgccacagctatcttgtcaatagggcaattattataaggatcaaagttgatacactatagatggcagcacagagaaatggaaagaatctggaccaagtattatatcattgagtcaacaaattaatgcaccacgagaggtataaacttacttttaaaccattttgagtttgttttttctgagttgaagtttctgaattgaaaagaataatgttattttaaagtatatttgcacacgtaggccaggtgcagtgtctcacacctgtaatcccagcactttgggaagctcaggcaggcggatcacaaggtcaggagatcaagaccatcctggccaacatggtgaaaccctgtctctattaaaaatccaaaaattagctgggcgtggtggcacatgcctttaagcccagctactcgggaggctgaggcaggaaaatctcttgaaccagggagtcacaggttgcagtgagctgagac

SEQ ID NO: 19419 - DNA, 102 bp, Homo sapiens
tcacctgtgctttctccagggtgacctcatctggtggcacgcttgaaagaaccttcatgaatgaaggcaaaataaaaatatttttgggcatatgaagactga

SEQ ID NO: 19420 - DNA, 588 bp, Homo sapiens
ttagtcagcatgatggctgctaaggggaataacggcctggctttgtgtctgggcaggccacgggtagtcttctgtatgggtggaagcctgcaagctgcttcttccagcctccttcattctcacaagacctttgcctcactcacacagttcatcaaagggaggactgattgggctccatccaacccacctcccagactagggaaggatattcgaaactcatccccacgggctgtggctcccgctgccttttccatccatgaataagataatggggtactattcattcaacccatatttattgataactaagtaccaggcagtgtgccaggttctagaaaacagaagaagtttaccgctttagggaaaggtagatggtagataataattgaaaacttacaggttgcaataagtgctataaagggaatggactttctagcaagcaaggtgaaagaaaatgctggtgcagcggggaggggggcctctcttgtcagataagtctagggaaacctctatatggcaatggcttttaaaacgaggcctccagcctgggcaacatggcgaaacctcatctctataaaaaatacaaag

SEQ ID NO: 19421 - DNA, 598 bp, Homo sapiens
tctaggggtgcaagcttcaggagcagcagtgacttggggtgcacatgacttcttacagtgaagccaaagaaaacaagcccaaccaagcaggcccatcagaaacctttgctctgcccacagcctctagcatcctgttagtcaaagcaagtcacatggtcaaagtcaagatagggacattcacccgatagccatgaagccaggggaaggatagggaagtgtagttctataacatgaaaggagtgaagaatggggaacaataaccaacccacatgcccatgaagtagaaaaatgtaaggaatattatttgaggtggaggtacaaaaatacagaacacatggtattatctctgcctgcctaacttctcagtctctgtatttatgcagaaatgtcctctgcaactcacactgagcagaaatacacacacacaccagcaaataattgtacatctctctgaatggttattcactttaaagtcatctacatcagtcattctcaaccaacacccttttgccccctaagggatatttgaccatgtgtggagatattcttagttatcacaacttggaggtggtggcatgctattggtatctagtgggta

SEQ ID NO: 19422 - DNA, 529 bp, Homo sapiens
tctctattctttcacagttttctctctaaacaaaaaagtaatacatgtagatggcagaaaaaattagaaattaagaaaaaaaagaataaaacagtttccataattctatttctcagacagaatgttaatgctttggtctatcctttcaaactgcattctctgtgtattttgccacgagagacaatgcctcacaatctcttataacaacttgtaattttactgtgaccattttcccacaatagtctttaaaatcatcttttatcttcttttctgaaatctcttttaattcataggtaaccctcctcccttatttttcttgcaatttttttgctgaaaaacctggtcatctgctctgcaggtctgtcacacctagaatttccaagctgcaccctcatatctaacatgcttctctgtccactgtatttcctgtaaactggcaatataggcttgaatcaattcagatttgagttggggctagaacatttcttaggtagtattgtgtacttccatcagagagcacatactatct

SEQ ID NO: 19423 - DNA, 342 bp, Homo sapiens
cgcgcgccaccatgcctggctaatttttgctttttttagtagaaacaaggcttcatcatgttggccagcctggtctcgaactcctgaccttaggtgatctgcccgccttggcctcccaaagtgctgggattacaggcatgagccaccacgcccagccaaaaacttttcttatgcataattgatctaacagataacagtttgtttaaaatagagcaacagtgttttcaattatacacatacacacacgcacgcttatttatgcttaaagtgaatgaatgacaacagtcatacataggattattctgttattataaggtacttggccgggcacagtggctcacg

SEQ ID NO: 19424 - DNA, 541 bp, Homo sapiens
gacagaagggaattcaatgatattctgctgagtgaatattgtattgttttatcttttatacatatattgatgtggcatatgtatatgccattactttcaatggcaaaaaccacaattctttttgtaccaacctgataccatttatttcacctcaacctctattgacactaacttcttctctggtcatatgtagcgccccagacaaatctgtctcccaagagagtgtatgaccaccctggctggatggcaccaaattaacgagtaatgcgtgggtcagaagttggtctcttgtaagctgatacaacagttgatggctatactattcttatcaatcctagcttgtaagcctccaaaactgaggatcatatgctggtttctggtgactttatgctgataaataccatttcgtgcaggtttcatggctcgggagcactggagatttcacgatattgaattgttccttctgactgagctctgattgagctaactgatgctacatttaatttcaggatggactgaatcaaacaggcttactaataag

SEQ ID NO: 19425 - DNA, 645 bp, Homo sapiens
attttgcacatgatcctgggagtaaagagtcacaggtaaacaaggctgcaagaaaagtccaggtggtgttcacacagtagctgcaaacttctcagaacttttcagaaattcatccttgcctgtcattacattttttaatgagccactcagcattccaacgaacaacccaatacatcatttcctctattaattggtgcagttaatttgaaaactgttctcagttctatatttatatgggaaatattaagagtccatctccttgctcctttttcattaattccacacacattcatggagcatcacgctaggaactaaggacatgatgtgacccgaggttggcaggtcctaccctcgggctcgggggcaccaagggctaggtggccatgaaagagcccaggccgggcgcggtggctcacgcctgtaatcccagcactttgggaggctgaggcgggcggatcacgaggtcaggagaccgagaccatcccgggtagcacggtgaaactccgtctctactacaaatacaaaaaactagccgggcgtggtggcggacgcctgtagtcccagctactcgtgaggctgaggcaggagaatggcgtgaacccgggaggcggagactgcagtgagttgagatcgtgccactgcact

SEQ ID NO: 19426 - DNA, 617 bp, Homo sapiens
aactcctgggttcaactgatccttccaccttagcctaccaagtagctaggactacaggtgtgtgccaccatgtctggctaagttttgtttgatttgtttgcagacatggaggcctgctgtgttgcccaggctggtttcaaacacctgacctcaggtgatcctcctgcctcagcctcccaaagtgctgggatcagagacttgagccactgtggccagccggaatgtaaattccactgaatttttttgtgtgattagccttcttgccgaagccttgacactcttgcaagcctttgcgcgtacatttcttctatttcagaagactccttgctctccaagacttttttctacaaggtgtaaccagaagccaggaggcctgttgcaaaaccaatcccatttgaaagcagagaatgtgaactcacctattgtcataatgattataaaagaggctttggctcactcctgtaatcccagcactttgcaaggccaaggcaggcagatcacctgaggtcaggagttcaagaccagcctggcctacatggcgaaaccccatctccactaaaaatacaaaaattagccaggcatggtggtgcacgcctgtaatcccagccactctactc

SEQ ID NO: 19427 - DNA, 417 bp, Homo sapiens
  misc_feature 236: n = A,T,C or G
taaaagcctttgcgttcaactgtaaaaacagcaaccctcttctgggccccctctccatgacagagagctttcttctttcacttattaaactttcgctccaacctcaccctttgtgtccacacttcttaattctcttggttgtgagatgaagaactccgggtggtacttcacaatgagacactgctacattgtgatgcattggcgagactgtaacagtaagatctacattaaattanggaaattagtatgggggtctatattctgtagctttgccagtttgttcttaggattttctgttttgcctatgaattggggtgcagggagacggagttgagcaaaaaaagcaaaaagatctttccatacccgtccttccgctgagtggggcttttgtaaaagaatgagatattacaaccttat

SEQ ID NO: 19428 - DNA, 362 bp, Homo sapiens
taatttgcaaaagaacgtaggaaaaaagtaggatgattgcatcgtgccttggacacttgcaccctggagtacaatgcagctggtttaccatttagagaagacaggctctcgatggcttggatgtggatgggaggaggtgggaggcagtgaaggcatgttgagggttgccgctgatgttggacaacactacaagtcattcccttatgcttttatgatacgcctatatcctcagtgtagcctgtccgtgcagcccccagccacatttccctaggcctggagccctgctgggtgctgagcccaggcaccgctgcttcttgggggttgcctccgaagtccatgtgaaccagtgtggtcttgaacct

SEQ ID NO: 19429 - DNA, 331 bp, Homo sapiens
ttgtagaccacagctagacaagtgggtgctacaatcactgtgtcaagtatagaaaggacagctgagatcacatcgaggattccagaaagaattggcacaggatcatttgggacgcatctctcccttgcccctgttcctggctttccttacagctctcgacttcctcaaaggagtcatcaattcggagtttggcttccattcctattgaggaagctggaaagcgtttcaaaaatgctcctctgatgtgcctgtggttaagacctctgagctctgcttaaaactttttgaagctgggcgcggtggctcacgcgtgtaatcccagccctttggg

SEQ ID NO: 19430 - DNA, 514 bp, Homo sapiens
tttttttttctttttatttgagaaaagggggggttgagagtagagtgggaatggcaagaagtagtatgacagagcttcttctcttttttttcccctctttaccaggaagttaactagaagtcctcatgcatgtttttaaaacaaagttggtaattagcataacctagttagttacctttacacagagtgacagaattaaaaagttgacaagcccatcagacctcagccaggaggtactgaaaggagggagaccagtgagtctagaccaataggtgggttaggcctcctgaatgccagcctagaagtttagactgattctataggctctggggtacctacaagtttgtagtcggagccttgggaattgaatgttacataggaactttcactggttccagctagccttggctgttagcaattatttttatctactttaacaggggggacagagtaggggggcaggaaactaagctggcattatggtcacaggaaagaacagactgatttggagcct

SEQ ID NO: 19431 - DNA, 425 bp, Homo sapiens
aaatacatttgtcaattcaatattttcttccactgagtaaagaaaggtctgttttccacgttagaacacatattgaggtatccctaaatcttaaacaacttttcatgataaacagccctaatgaaattcctgggaagcttctaagataggaggatttttcattcagcttcctgtgtcccattcttgggcttgcaggcaaccgtagccaagagctatggtctctcttgagatggtagaaagctgccttgtcacattaggctgcaaaagtcgtcctgtttcctcctttctctaaaagaagaatgaagttcacctctggtggctttatctttccaggaaaaggaaactcaggtctaaagccatccatttacagatgaggacacaattataaactgggacacttgatggctttcagctcacagctcttg

SEQ ID NO: 19432 - DNA, 470 bp, Homo sapiens
agccctcccgaccaccatagctgagagcccaggacaccatctcacaccacacgctgaatgggggtgggagccagacctggtgatccccaggactatggagcagcagggatgaggtggtggaggggaagaattgaggctgaaataagatgggagtctccttcctcacacaggctcacctctgtggcacacagtccaggagagatggtttcttcactggtctataagaacctctggtcaggccgggcacagtggctcacacatgtaatcctagcactttgggaggccaaggcagggggtatcacctgaggtcaggcgttcgagaccagcctggccaacatggtgaaaccccatctctactacaaatataaaaattagctgggcgtggtggcatgcacctataatcctagctactcagggggctgagatgggagaatcacttgaaccgtggaggtggaggctgcagtgagccg

SEQ ID NO: 19433 - DNA, 447 bp, Homo sapiens
aggcccatctgtggtgaagagcaagatcttttctcctagcagtgcacggaagagcccagccaagtgcctcatgtagctgaagtcacaggctctgtagctaccatattcattctccacctgccagaggggagggaaagtggaacccagctatgggatggaggtcaaggaccccttgtaccttcttcccctgctccagtcacttcccccttgtacctgatgctaatgatgttgcccccattgtgataaagccatggatatatcttgggcagcaagaccttgaaccaggagtccactgcggcaaggaagtctaaaggaaggagcagagcttctgtgttaggtgctaccatcacacttgctcaccactaaatatgggaagcaatgactcttgtcaagaaattcccaaccctaagcaccttgtatatttgcacgccaatgaaatttgaacat

SEQ ID NO: 19434 - DNA, 381 bp, Homo sapiens
taagcacatagaataccttgcacaggacgtagcacataatcgaccacgcgtggtagccatcagttttaacgacagcattagcagaagcagtagtggtagcagccgcaggtgcatagtgatggaacacagaagtacaggcatgtaagtgggaagctatggaggggtttgcagccaaggggcagcaaactttgcaccagccatggaggtggagccacagtccagcagagtcctcactgggtgctctctggaatgcctgccaaatttattttcttctctaaattcttttttggaaagcccggctctaagccgtctgtttcttgaggtctccaggatgcatgacagttctttttaactccatttatattttcacaagaataatct

SEQ ID NO: 19435 - DNA, 406 bp, Homo sapiens
tacacagtttcaggtaaaactaaccctccctataaatctgtcttcttaagttcactggctgctaaccaaccatatggccttctttctcactctgaaatcatttagcatttatagagaagacaactgagtatctgtccatcccaatcacctgcaaaagatactcatcagattgtgatttttacctgtgattttcactatggaagattataattaggaaaggttttgcttgtttgtttgttcatttgtttgttttgattggaatgtcatttggtgttagaaaaaaatgaagtgtgagagtatttgatttgcatttaatatttagcatgtagtttgacatgctgccttttacttctaccttaactttgatcacaaccatgcggaatttattttggatacataatacaag

SEQ ID NO: 19436 - DNA, 281 bp, Homo sapiens
aactaagcttcgctcatttggcaaattttgtcataatcactcatcactatcagaaatcatcacaaacaattaggcaaacatgaatcaacaagtcgtgcagttaaaactgcaaaaaaatcttatcaataaaaaagcatgctattatagtctcaatttctatgctgtaaaacaagtgcagtaattgcatgaagaataggtttctttcattactaattttttatacaaaatcaaggattaaagtttaatataatgatatctgagagataaacacagccttaaac

SEQ ID NO: 19437 - DNA, 463 bp, Homo sapiens
gcaattacttggtttacttttgtggggcgttttaacacccttttggcatgctaaaattcttataaagatagcaaccattaattaaatcaacagaccaagagtaaaacattagtataagctctaccagttaatttgctgatttttttttaagagataggatctccctctgtcacccaggctggagtgcaatggtgccatcctagctcactataacctcaaactcctgggctcaggcaatccctctgccccagcctcctgagtagctatgactacagctgcacaccaccatcctcagctatttttttttattttttgtagaagcagattctcactatgttgcccaggctagtcttgaactcctggcctcaagtgatcctcccacctcagcctcccaaagtgctgacattacaggtgtgagccttcacgcccagtctaatttgctgattttaatgaacagcagctg

SEQ ID NO: 19438 - DNA, 426 bp, Homo sapiens
agtctccaagtcatgcttatattcttccaaacataaactcaaaccccaatgtcccccattcttcttggcactgctgttgagctccccgggtttgaaggctctgagctcagcgctcaaagcccctggtctgactccaggcccctttcctctcagaacatttccccttgattctattgatcacatctggacactcagcacagaatgggatgacaggcaactcagcagtaacgggacacggcagtaatgggagagatggcagatgacgtttctttaccatcaccatggaagcctcatgccatgtgcactgggtgtgcttttggaggtgggagggtcagacagcacgtcttgggccctgggttcatcccagctcactgggactcttagacattagggatccctgggaggcagcgatgtcattgagcccat

SEQ ID NO: 19439 - DNA, 534 bp, Homo sapiens
  misc_feature 403, 447: n = A,T,C or G
ccattttaaatagtactggggaataacttcaaggcaagaaagtgaatgaaaagctctatgtattttgaaactatgagagacctataatcccaaacctcaatctaatgtgaaagttaatatcaaattgagatgcaaagctggcagaccattattcgttgaaataagtgcatatgctgatgaatatcaagaggacaaaagctctcatttgatcccagggagataagttatagacttatggtagcagtttcctggacccagataagcatatagaaagaatgaagaggggaaggcagaatgagtcacacagatgagccatgtatgtgcaggaggaaggtattgagtgtagtattgggtgtagtaaaaggtattgggtgtagtaaactctacgggttgtgtacatccncatagcttttgatcttaattggctggggagaagtcaaagctcanagaaattgtttatacctataactctgacgcataaggagacttcttgccagcctagacactgcatacactcaacttttaattgctgat

SEQ ID NO: 19440 - DNA, 340 bp, Homo sapiens
ccacaatgactatagcaagaggaaatatcatgacttcataaatataaatatctaacactggaggtgtagaggtgggaagcggtagagacagaagggtgaccatcatgtgactttattataaggagtattttatttatgtataaaagaaatacagttgggccaggcacggtggctcacgcctgtaatcccagcagtttgggaggccagggcgggcagatcacctgaggtcaggagttcaaaaccagcctgaccaacatcatgaaacccagtttgtactaaaaatacaaaattagctgggcatggtggcgcatgcctgtaatcccagatacttgggaggctg

SEQ ID NO: 19441 - DNA, 436 bp, Homo sapiens
tacataaagtcattaaggccactggtaggagaattagtaataatctaactaataaaagcaaggagctgaaaggaataaggggcagtggagggaatgtatatgaacaaaattcctcatctcatccctggaaattgatcattaatacaacactctacatctatttcttaaagcagaggcctcaattctttggatgctggccctcaggtgtttttatttgttccagacattacttttaaaactttttagttagttgccaacctttgaaattcggaatatttcgcagataacttggtatttctggcttctcttgaaaaagatctggttatgattgtaccactgcattccagcctgggtgacagggcctgcattctgcaatagagccaccagatggcacagagtcacagccactccctttccatgccgcttgaactctcct

SEQ ID NO: 19442 - DNA, 281 bp, Homo sapiens
cacagaagaaaactaagaaataaaaaatggagaaagtgagacatcaaactagaattactagaaacccccaggaagaaggaaaaaaaaatccaagaaaacagaaaaacaatcaaaccagttaattaaaccttggtgtgaccagaagatcagggtttcctaaaggagtggaaatttattgacttgaaggcgatttattgattactgatttgaagaggaagaaaaccatgaatggtctaaagcaaaagcctagtgtctgaagaagtcagtagggtgaaaacaag

SEQ ID NO: 19443 - DNA, 553 bp, Homo sapiens
atgttaataacgcaaataaaggaatcacactttgaatagcaatgtagaaggctacttgtttccacagtattagagggatgatgaaaataaacagccctatgacatagtccagagtcactgtgacatactagacattacaacaagggactggtttgaaatttggataggaggtgtcctattccttcggcttgctattgtatatagaacacaagggcaacttttcataaaggccataaactaagcagtttataaataatagaaatgtatttctcatagatttgggggctatgaattccaagactgaggtgccagcagattcagcatgtgactagggcccactttctggttcacagatggtggcttctagctgtttcttcaaatgatggaagggaggggtaaggggaggtctctctggcacctcttttgtaagacactaatcccattcatgaggcctctgtacctatgacctaatcacctcccaaaggcctcaatttctaatcacatcaccttgagggttaggattgcaacatatgcattttaggggaccacaata

SEQ ID NO: 19444 - DNA, 195 bp, Homo sapiens
atctgatgtgatcaaacatatcatttgccatttagctttttaaaatgtgatagcttgtgcacacacaccagttactttaggtacagtcatgcatcacttaacagagatacattttgagaaatgttcaatgattttgttgtatgaacatcatagagtgtacttacataaatctagatggtgtagcctactacacac

SEQ ID NO: 19445 - DNA, 549 bp, Homo sapiens
ctgtacaatactgtagagaaactttctggccagaaagtttcctataaaagcaaaaaatggggatatcagtccatgcagactgactgttccatattttgactaccctcgcctgcttttattcaatcttcacaatcctcagatagatgttatctatattatgtgcagagtttacaaatggttatttttgagaagatcagtttgttaggagctcacccctctatacaagtatcagaaatcctctgaagtgatctttaattttggaggttgtgttatactttttctcttatcagttagaacttctttatgatatagcaaattataaaaactattatactatcatattcataaatgaaggagagaactcaaagctaaattttcaaatatctggccatgaagactaactgcttgccacacgggattaacagaacaatgagaaaatgtctagtaataattataaaatataaaaactttgttaaaatctgatttgcaagcttatgtcaaagggccacctcatacacaatcttgaagacattaaataaccccaaatag

SEQ ID NO: 19446 - DNA, 486 bp, Homo sapiens
aaatgtttctgatgtgaataaataactgaattttacgtttttctctaattttagtgaatttaaacttagttacatttggctagtacttctatcttagcctgtctcaaaaatagcactaaagatgaggaataccaaattcttctctaaaatcttccacaatttcattggctgatctccaccaaatatctcctttgtattttattttcctgtctttaaaatggtgcttacaattcatagtctctaagtaaaaacattagtgacataatatgatttaaatacaaggttattcaatataaatgtcctattgatagatttctaatctaagaggtaagatatttggaagttaatttcaacttgtattgaattactaagggtagcataattacagaaatgattatgaaaagttctgtctgctcaaaagcttaaacaaacatagaaagatagatggtgggccaggcgcggtggcttatgcctgtaatcccagca

SEQ ID NO: 19447 - DNA, 546 bp, Homo sapiens
gagccaccgtgcctggcctcaccattgttaaaattatggaaatcgtgtttgcaaagcaggttggcctgtttggaaaagggtgtcataatttctcaggtaactccaaaaagagaaagctacgaaaattaccttaatacattcattacagtctcagtataagattatagcttcctctcccaaagcgtaaccacaacctgacgcaggatgagttggtttgaaaataccgcatacaatatcctcttgagtagaatcataatttagaactctaaaaatgaccggaaacaaaactgtccaagtttgtttaacgtaatgtgtttcaacttatttgactagaaaacccttcattcgtgcaacacttataaatatcccatggcaaatctagttttctacgaataatgaacgaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatag

SEQ ID NO: 19448 - DNA, 147 bp, Homo sapiens
tacttattcattattcactaaaccaaaaatatgtattaacagtttactgtgcaccattcccacttttagtgctaaaacatctttgaaaattaaactattgataggctagcaatgaaaaatgagaaattgaaatttaataagtaccac

SEQ ID NO: 19449 - DNA, 413 bp, Homo sapiens
  misc_feature 166: n = A,T,C or G
tgagcaagctcacaggttaattgagtttcccagtttatggctgcttagaggagatgatggctgcttagtggggagagagttcaggtggttagatttggatcctggctgtgttcatttatagtccaaaactttcagaagagggtgattttatctttttctttctcangaatgtattagtggttcagaaaatatcacagacatggtgttaatttactgttttcctgctggggatataggatagtgtaagagaggatggaggaagggaaaaggagcacgttttctagaactcagctgtcgtgagagacaagtgtaagcctgtgggtaggagcagctttccttgttgagcgtaggcatttggctcaggagttcgagcactgatagtggtggctcttggtggttattgtctgtgggca

SEQ ID NO: 19450 - DNA, 321 bp, Homo sapiens
aactaatccctgctcaacttttcatctcagcaggaggcccattctctttggcaatcctctggcctccagcccatttattatatgctcacatgtcaacatgtacttcgtacagcatgtaacacaattgcacttttatattttaacaaattatatttcccatattgaactgtaagtctcctgaaagcaggaattttattcttgctcatcatcaactttttttaatattcctttaaattaggatggcaaagatcgtatatagaaaattggttaagttgcggtccattcatgtttgctcccaattaaggagcacagctatgaaaa

SEQ ID NO: 19451 - DNA, 519 bp, Homo sapiens
accacatagcttttgccattgtggctgctggtagagtggtagtgtccgcttatgccaacccaggaactccctcaggacgaagtgataccattattcccagctccaggcacaaggcttggcaagtaggtgctcaataaatgtccttgaataaatggggagatgggagactacacgtggcaaaactattatctgctccacggtctggccccagtcccagcgaaggtgtcaaaggagaagcaagttcttttcaaaggtatgaaactgaaacaacccttaagaaaaattccttaagttcctagggggaaagagacttggatacggctggtgttctggccctgggggtgcactggggctgactctggccctgcagcccaggagagtttgcggtgcctggaagctcaggcctcagctggggctctgcagacccggtgggctgcactcccattgccctggagaggctgcccagaccagagaggatggcatggaattctgtgaggccaagtcatgatcccccaactc

SEQ ID NO: 19452 - DNA, 437 bp, Homo sapiens
tacaaacataaataatacttgatgctttctctcccaaggtgctttactacatagaaatatagaaagtaccgaagaaatagataatttccatttttagcttttccatttttttccctaaatttctaagttaagggcatcatcttcatatgtagttctccagtttttgagctgattctgttccagatgttctttggtaagtcacattttatcatacaagcattttagtttctgcgataaaccctatcacaggctccttaacactgtgctgaatgagcagcacaggaatcatgctgtttgcagtaaaagttagccatctctctctggactcagcagagtgggtatcccatcccttttctctgaaggcctagtatggatgtggggattcttgtgataaatattggcaatgctaacaccacagaaaagagaatctgggatgt

SEQ ID NO: 19453 - DNA, 352 bp, Homo sapiens
tttagactaatataaaaatattaaacactttgaccactttggcagtaagaaaatctatttgcttactccaatcttcattaaatttatttaaccattgaatttttttgctccctaccccctacaaaacgcctattaaacgcttcacagttgacttatgctaataggcaataagggtgtgacccaggagaggctatatacatatgggcacatacattacatattcagaaaagcattcagaagaaaacgctcatagaattttagaaattataattccttggctgggcacggtagctcatgcctgtaatctcagcactttgggaggccgaggtgggctgaccatttgaggtcagga

SEQ ID NO: 19454 - DNA, 545 bp, Homo sapiens
gactgctgtagtattatggtttacagtgtttaccattttgtttaacaatattctactctagaaactgaaacattttagatgttaataaaacatctaaaatcatactatgatttacttctccaaaatacaaattacatcacaagtaagcctccatgcaatgacatttttatctttatggagtgtcatcaatatcagttaaataaatcagtgcaattgttcctaaggagaagtttagcttccacttcaccactaaaagccaagtgcctatgatgcagatgaatgcattgtacaatatatttcaatcaagtcacagactcacttccccactatccatgaaatataacaaagggctaagaaacattaaaaaatgatgtatcaaacttcccacaaaccaaaagacaggaagctattgaataatctgacacttggattacatttttattatcattaaaatgtagcaaaggggccgggtgtggtggctcatgcctgtaatcctatcactttgggaggccaagacaggcagatcacttgaggtcaggagttcg

SEQ ID NO: 19455 - DNA, 485 bp, Homo sapiens
tctctctctctccctctctctcgctttctctgtctctgcgtgtgtttgtatacacattcatgcatgtgtataggtgtgctgtgggagggcgtagaaaaaagtgagagaaaggagggaggaatccaaaatggttaaggttttgagtctaactgaaacaatggtggaaccattaatagagttagagaattctttattagtctagcacttgctacaaatagttggtactggatttgtgttttgttgattgatgactatttgaatatgtggcttgagacaggatgagaagatgcaaggaatgcaatgaattcagcctttggggttgttgggtgtctgggacttatgggccctccagatagtgaatgctaactataggaggtttgaagttctggaggatattagagctagaaaaagaatgaaaagtcatatatgcacagaggcaatagttgaagttgtgagagtgaatgaagtcactgaagggagagaat

SEQ ID NO: 19456 - DNA, 312 bp, Homo sapiens
agctggtaagtcgtagtccctggagttggaccagacacagtcctcgagtctgtgctctactcactcttttagctgcatttccactgctagatttttaaaacgaagcatgggcttttctatttatttctcttcaattttatctcattagagttcagtttatcgtttaagccagtcaataattttgggatgaccatttatcattatctcttttcaccaaccttccagtttcttaccccattgaaacttcactggccttccactaatattttttgctagtcattaataaaatgattagtcaggcaggcagatatg

SEQ ID NO: 19457 - DNA, 549 bp, Homo sapiens
atgcgaattcacttggtcgagggtgggtccccaagtttctaacgcgtgtccgtgatattctgctgctccccacctgcctgcggatctgcgaggacctttgacttacaaagggtccaacatgcagataatacaaaagtttatttttcctatgtattttggtttaccatcccccgaacttgaatgtgagttccaccaggatagagctctggtctgttttgtttgctgctatattctctgtacctggaacaggcctggcacatagtaggagcactatgttatttccagaaggaagcagtgaatgaaatacaaaccagaaaagacagcagaggtgataaacctaacattatacaaagtgaaagtcaaggtgcaaattatgaacgaaacaaaggttttacactcatttttaaaagggagaaataacagtcacaagcccttaggtcctaaagtaaaaactgtctccccaaaaaaggaaaattgcaaatactacattgattttagaaaggttaactcccatcttggtcacatctcagaagcaaaaagtgacgtaaa

SEQ ID NO: 19458 - DNA, 306 bp, Homo sapiens
gtactcttgtgacctaacatcactgtattacagcagagtagtacacattaataatgatggctataaatcatcaaaagaagtcagtgtcactgtattattgcaaaaggtaaagagtgagagatctatttttgaaagatcaacctccaaaaagagtaaaaataaaacaatgtgagtgcttaaaaggttaatatttcatctgtatgaaaaaagtatgccctaagaattctgcattgcttaaggttcattaatataatgagatttattagctaaaattctatataaagggtaattaatagaaaaaaaaaa

SEQ ID NO: 19459 - DNA, 509 bp, Homo sapiens
gtactcttgtgacctaacatcactgtattacagcagagtagtacacattaataatgatggctataaatcatcaaaagaagtcagtgtcactgtattattgcaaaaggtaaagagtgagagatctatttttgaaagatcaacctccaaaaagagtaaaaataaaacaatgtgagtgcttaaaaggttaatatttcatctgtatgaaaaaagtatgccctaagaattctgcattgcttaagggtcattaatataatgagatttattagctaaaattctatataaagggtaattaatagaaaaaaaaaacactattctcaactgcccactctatgccactcactccttccaccccacctcctatgataagagttcatgtcaaaatcttgaggaagtgtaatttgagaatatttttaaattactattaattgtggctgggtgcggtggcttacacctgtaatcccagcactttgggaggccgaggcaggcggatcacctgaggtcgggagttc

SEQ ID NO: 19460 - DNA, 551 bp, Homo sapiens
ataaaccatgaaatgtccaacgacagaacaaacctattaaattagactcatttctaattaaattcaaaccagagatatgctagaagtgaagccgtccgcacggttgtgtcaggtttatcatcaaccatggaagtaactagtaactagatgagtcacctttcctctctgtgtcaatttcctcatcttgagaatgagaatcagaatgcatttcccaccaatatttggtaaggattaaagcggtgtaaattgttgtgaaatatttaggataacaatgggctagataagtgtaaggcagtgtacactcagcattttaaaaattggttttgtgtaggccaggcatagtggctcatgcctgtaatcccagcactttgggaggccgaggtgggtggatcacttgaggtcaggaatctgagaccagccaggccaaatggcgaaaccccatctctattaaaaatacaaaaattagtctggtgtggtggcgcatgcctgtaatcccagctactcgggaggctgaggcaggagaatcacttgagcccaggatacagaagttg

SEQ ID NO: 19461 - DNA, 532 bp, Homo sapiens
agctgtgggttcggttcttaagagaattatacaaaataagatgaatgttcacaaaggtcattcattaaattcaatgaatattttttgagcatgtaccatatgccaggcagtgcagtgggcactggaggtataacggtgaacaaaacaaaggcccttcctcgtggaacttatgttctagtgagaggagacaggcaatcagtaagtgagccttcggctgatgacaacaatttgcagaataacaaagagggaaaaggagtgagggaagggtcagtgttactgtgttaaatagaatagtcagggatgatcaccctactaaggtgacattgggccatggggatagctggggaagagggtgtcaggcagagggaacaactgtgcaaagtggagaagtagccagaataaacattcaaaaaatatttactgagtccctactaagtaagcgccccgtagagtcatgtgctaaatgatcagtaagattaattaggccgggcacagtggctcacgtctgtaattctagcactttgggaggctg

SEQ ID NO: 19462 - DNA, 540 bp, Homo sapiens
cctagccgacagattcacacatggtgttcacttctgctgttgagtagcacgtgggtcctggtgctagtgtttcttttcctgctcagaggacctcttctctcttactgatttacagtgacgtccagatggtggagtttgctacaaagcagcccactgtatgaaagacatgacattgtattcacctggactctaggttgactctaaagaaggcaagggtcctttggtcacagggagaactgttgtgttccttcacaaggtagcagagactttgtgttctagagacttgagaccacctctataaatataaccagagcacaggcttcctgtgtggacccctcaatacacatttttgaatgttagcctcaagcaccttcatttttgatgtataaaaaaatggcattttatggctgggcgcggtggcgcatgcctgtaatcccagcacttgtggaggccaaggagggtggatcacgaggtcaggagatcaagaccatcctggccaacatggtgaaatcctgtctctactaaaaatacaaaaaatta

SEQ ID NO: 19463 - DNA, 516 bp, Homo sapiens
gagggacaaggaaacaaagctctcttacacatacctagaacaacatccactgccttgccacaggctcctgtgagactgagacttgagtggactacactctccatagcttcttccccatgctgttcacctgaggtgggagggcctacccattctggtcaccagcccacagctggcaccattctgagagtttaacactgagttttgccctactttcgggccaaatttgaggtgatgtggttgcagccaccacccagcagtaggagggacagggaaaccaagctctcctaaggacaatacccactgccctgctacatgcagctgtgagactggggactagtctgctgaacgcattgctgcttccaggaacaccaacacagactgtttaagtcccagtaggttgctccaccactgctactgccatcacccacacaacaccaacagcccagggacctgagaacccacccacactcctggcccactgctgccactaatagcttctaagaaaaccaccggaat

SEQ ID NO: 19464 - DNA, 535 bp, Homo sapiens
gagtgagtgtccaattaaatagtggctcactaggacttgtgtaatagtaacatctgttaccttaattaaacaagttactatataaaggcactttcatagctcactttgttagagtaggttctgacctagaaactctaggaaggtttgttctctttgtgggattttgttggcggtagcgttcccagttggccccattaaactatagacctgacaagctctgtgatctacaaacctacaatacgttcaagcctacagagcctagaggaaggagggaactgaagtttgtgatgcaaagtggaacaaataaaatagtaaaagtgctgggtaggagtgcttcgtactcattttgatgaacttgggtgttgtgactgagaggcaagtggtggtggtaacagagaaaggagagtgaacaagtatttattgaccctccattgcatgttaggctcgcaggaaaatctgtatctgcaggcataggtctacaatcctgtatccatatctttgaaatccaaaaagctctgaaaaaaaaaaaaaaaaa

SEQ ID NO: 19465 - DNA, 487 bp, Homo sapiens
taaccgacacctctcacattaatttaatgatttttcacagtgcttccctctcccactctatagcccctaagtacatgcttagtgtcagtattccacattatactccagaagctggatgccatttctagaaggtcacatttcgaaagccaagccatgccacccactctgggaaagcactttctgttcaggctcttctgtggctattagtaaagcctagttgactttacttggctatcatgaagtaggttatactggaggacaggagatgggttgacagaggcaagagcttgtggtgacagaatcagagctactgctaacagatgttgtgtcctatttgaatgccatggaaaaatacattgctcttttgcgggcatatagggtcttctggtgcgtagctatgaaggcaaacctaaagagcttgtggtcaggaaaatcaggcccagctctaagcctgtgcttaaccaggacttctagtgtaaaacaacta

SEQ ID NO: 19466 - DNA, 270 bp, Homo sapiens
ggagaggtaataagctgggaatcccatcagctcatctttcttcaggcctatatttgtcattgtcacttgtagaagcaggacagccctggcattgggattggtagtaacagagagtatcaaagggaaaactgaacttcactaatttttggaaaacagcagattggaaacagatgggctccaacgttttccatatgtgaggtcattgtcccaggtagccttgctcaggacatttcttgtctgcaaaacagaagtcaaacgatatttctacct

SEQ ID NO: 19467 - DNA, 517 bp, Homo sapiens
gctaagtgtaagggtgattattttttaaatgtctctcctagaaagctaaaaagaacggaaacaaagtcacaaaaataactgtttataaactgtgtacttaaaaggaaatttgattctggcctttggcctggctgggaataaactgggaagctgttactccatcctaacaacaagtgaaaagctgaatgaactgaaaatcaacagccttctttgcctaaaagtggagaaacagacaaacaggtaatgagaatcacagcatagcaaaacagaaatctctgtaggaaacagtaccaggtacttcacgttatactttcaacaaaaaattacaaggcatactaaaaagcaaaacatacagcttgaaaagacagaacaagcatcagaaccagattcagatatggcagggatgtgggaattataagattaggaatatgaaagaataatgttaaaggctttgttggaaaaagtaggcaacacccaagaacagatgggcaacgtaagcagacagctggacattcta

SEQ ID NO: 19468 - DNA, 152 bp, Homo sapiens
agcaagggcttgacattcctaagtttcttatgtaactgagataattgtttaaaagcagaaggttccacagaagtgtactttttaaaaatttatctgaaaacatagcagtatagtagcactattaagttgaaacatcctcttgtcatggtaat

SEQ ID NO: 19469 - DNA, 319 bp, Homo sapiens
tggccaggctggtctcaaactcctgacctcaggtgatccacccgccttggcctcccaaagtgctaggattacaggcatgagccactgggcctggccgaagataatttaaaacagtgtttcccacactcttttggtaagacttatctgaagtacttgctaaaaccataactaccaggcctcatacccagctcggtgcatcaggattaccaacggcctgacagctgtcatttatcaaccacccaggtgctctgctccttctcacagggaggcttgggaaataccgttttcaaagaccagtggattagtagcctgaaaactc

SEQ ID NO: 19470 - DNA, 530 bp, Homo sapiens
tccaatatgaaattaaaaattactacatgtgtggtgaaataaaaatgtgaccattagtcaacatatccgaggatgacaaagatggtggaataagaaaaggattttaaagcagctattataaatattcaaacactttaagaaaaagacagtcaaaatgaatgaacaaatggaggctcttaagacagaaaaccatttaaaaaaagaaaattctagcactgacaagcacaatatctgaaatgaaaatttcactggataagcttaacaatggactggagcagcagaagaaatggtaagtaaaactgaacacacatcaatataaaattattcaatattaaagcacaaaaaataatgaaaaaattaatagtttcagctacctgttagatagcattaaatggtctaaatgcatgtaatgagagtaccaaaagtatttaagagaaaaaaaactggcaaaaattctgtagatccaatgaactcggcagtctctaagtaggagagaactacaaagcaaacctcatcaatgcaccaatagt

SEQ ID NO: 19471 - DNA, 261 bp, Homo sapiens
tgctgcagccacttgggctgacgattctcagtgttcaataggcactttgtcccaggcaaccgtaagtgatgatttaagtgatttaatgtccctgcacaccaaggcatactacaatctcactgtccctggccatgaggttctcactgtgtttacctaatcaagtcaaacagcccacccccaaatcccattattgaaggtttgtttcctggtagcacagctgataccaagtgctatatcattcaaggttcatttaaaaaaaac

SEQ ID NO: 19472 - DNA, 511 bp, Homo sapiens
ctgttcttgtccccaattcctcgtcatcacaatcaaaactaccagctggtcattgtcctggggcaccttccccctggctcagtggggcagggagatgccatgctctctgacgagggcacttttgactattaacccacccggccttcccaccctcctgtcctggcttgagaagaaattgcaatccgtcaccaccgtgaagcacttgctgaagctggggagaagaaggccccaagcttgggggccccaaacctctcctggcgcccctcctaactacgggacatccactgcttggattctgagggcccctggtggccccagactgcccctaactaagaggagagacatggcccacacttggacagagctgggtttctctcataccagctcctgggggcagctcagactctgccaggaaaacgcccatctttggccgtgcacggtggctcatacctgtaatcccagcactttgggaggccgagacaggtggatcacctgaggtcaggagttcgag

SEQ ID NO: 19473 - DNA, 552 bp, Homo sapiens
acttggattaccacgcccagttcctcaaaaggtttttgaatctcaagaacccaaataggctgtaaaattagttgcagaaaatacctctgaagcttcaatgtttatggagctgaaaagtggtgatctgattgacactctgtatgttaattaacactctcaagatttccaccaacaacccccactagagatataattgcttctcatccacagtggtctatgacaaaaatttactatatgcaaaagatgtgcctaagaaaatgtagaatttggaaaatcaaaaacaactgtgttaggcaaaggtgacagtaagcaatatctgcatactgaatggttggacattgcaccagctgatttcatcttcctgattcccatggtgagggaatctaactgggacagtgaggcatctaactgggaaaataaggtcttagaataaatacaaggaaaaaacaataaagtagagaaaattagtgaatcatcagaaaacctaaaagcacactgctctctacaaaaacatcaggaagtctccatgtcccatggtgcagtgtgcaaaac

SEQ ID NO: 19474 - DNA, 549 bp, Homo sapiens
gttgcccaaactggtcttgaactcctgtcctcaagtgatcctctcactttggcctcccaaaatgctgggattacaggcatagccaccacaccaggttcagccatttttggaaagatgccttttaacctgcaagaaacgagacagcagagtccctcaggcaagtggcagggtttcatctcttctcgatcctcctgagcaaccaaccactcctgatttcagctgtcacagacactatcatcttgccactctgcttgtcaaactagaggctgaaaaagggactggcattctcatgcagccagtaggctgtctgtcacttgacactcaggccatgtccacttcctaaacagcatcccaggccaagaatcatgaataagaaggtgagatacctgccttaccaatagcaaaacatacagtcatcaaaatagtaacacactggctcagggtcaggtgtggtggctcacacctgtaatcccagcactttgggaggctgaggcaggtggatcacctgaggtcaggagttcaagaccagcctggccaacatagcgaaac

SEQ ID NO: 19475 - DNA, 542 bp, Homo sapiens
ataaaccatgggcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggctgaggcgggcggatca

SEQ ID NO: 19476 - DNA, 485 bp, Homo sapiens
ttgggctgacgattctcagtgttcaataggcactttgtcccaggcaaccgtaagtgatgatttaagtgatttaatgtccctgcacaccaaggcatactacaatctcactgtccctggccatgaggttctcactgtgtttacctaatcaagtcaaacagcccacccccaaatcccattattgaaggtttgtttcctggtagcacagctgataccaagtgctatatcattcagggttcatttagaaaaaacaggaagtacgctagaaattgtaaacagaggggagtgaatgcagggagctgattatgaaagtggtgaacaggctgaaagggcaaaagaaaaagataggaaggcccggcgtggtggcgcacacctgtaatcccagcactttgggaggctgaggcagacagatcacttcaggtcaggagttcgagaccagcctggccaacatggcgaaaccttatctctattataaatacaaaaattag

SEQ ID NO: 19477 - DNA, 124 bp, Homo sapiens
aaaacaaacaaacgaaaaacaaaaaaaccccacaaaaaaaccccaaaaattgggacagtaggacagcagaaataagctaggattgtgctggtgaggccggaatatatgttatatggctgacatg

SEQ ID NO: 19478 - DNA, 380 bp, Homo sapiens
tctagtctatttttgatatgtcacttttgctcttggtgtcatatttaagaaaatgttgcaaaatccaaggtcacacatatttatatctgtgtttcttttaacacattatagttttattactttttacatgtagattccctgctgttccacacaatttgtttaggagactattctttcccaactgatttatacttccatccttacaccagtgccaaactgttttgattattttagatttttaatcattttgaaatcaagaaatgtgaatccccagctttatttttattattaaagaaatagactaataaaccgatggaaaagaatagaagcccacagataaaactgtgcatatataatcaaaaatcttcacaagggcatga

SEQ ID NO: 19479 - DNA, 439 bp, Homo sapiens
ttcatttatcagactaacagattttaacattaaactgttggtaaaggtataggaaataggcatcattaggaagacaagttgcagtgtttgtgaacagttttgcaaatatgttaaagtttgcatatttcttaacccacaaatactacttttacacatttaaactaaaaagaagtcatcacttgtgcaactgtacttgtaaaaaacacattatataaagcaaaaaaatcaaaccagaacaaaaaggacctaccaaaatgctcatcattgtttaaataaggtactatgtgatcccttcgtataagggaatgctccaaaaccactaaaaaggatcctatataagccgggcgcggtggctcacccagatcacttgaggttgggagttcaagaccagcctgaccaacatggagaaaccccgtctctactaaaaaatataaaatta

SEQ ID NO: 19480 - DNA, 382 bp, Homo sapiens
  misc_feature 158: n = A,T,C or G
aaattatacctcaagtgccacccatatcagatttagatgatatttagatgagactttggagtttagactttaaggttgatgctgtaatgagttaacacttttgaggctattgagatggaatgaatgtattttgcatgtgagaaggacataaatgtggngggaccaggagtagaatcctataaactagatgtgtgagtactcaccaaaattcatatgttgaacagactaagatagcactttttaatataagttttttttctgctatgacagccattaagatcaaatgtcaaaccaaatctagtgctgctacatgacaatatattgaaccaaggttaaaaaagaaaaggagctggctgagcatggtggctcatgcctataatcc

SEQ ID NO: 19481 - DNA, 564 bp, Homo sapiens
ctataaaagatggatagcatatgcaaaaaaaactgttttcaagaatcaaaactgatgatggtagtattaatattgttattctgagattattattatatgtttaatgcaaactaaagcaaattagtaaattgggatattctaatttcatcctcccttttgtccttgagaaccagaattctctacatgaaagaaaagaggtcctaatgtaatatatgttaagtaaaaactacagtcctgaaattaaattggaaataatataaactgatgaaaatattatgaagaataatatttctctagaatataaaaaaatgaagtattctttagtagctctgtctattgaaaaggcctagaaacagttaccaacctagtaacaatgaatactcctagtgctcatattgttatcttaaaatttcaacaaaagaaactagagcttctggccaggcggggtggctcatgcctgtaatcccagcactttgggaggccgaggtgggcagatcacgaggtcaagagattgagactatcctggccaacatgatgaaaccccgtctctactaaaaatacaaa

SEQ ID NO: 19482 - DNA, 405 bp, Homo sapiens
aactgcctttgcgcaggggtcacgtataatttcactggcctttatgtagtcacgtgactctactaactgcaggaaaaatgagaacatgaccttcctgtgtgtccaggaaaaggaaacaggttacagaacacaaagcattgcttccgttacattcctcctgttgtggggctggcgtgcatgcgtgcatgcgtgcgtgcgtgtgtatgtgtgtctgtgtctgtatgtgtggtgggagttggaggggcatgtgtgttaagcagagaattaacatctataaagaatcaacagtggtgcatgcctgtaatcccactactctgggaagctgaggcaggaggatcgcttgagctcaggaggttgaggctacactgaaccgagatcatgccattgcactctagcctgggtgac

SEQ ID NO: 19483 - DNA, 513 bp, Homo sapiens
gaaccaatgggtaaccactgttacttggcagaatatgacggattaatcaagagaaagtcatccactgggaagtagagtttgagataaaatttggctctatagaactagtgttggcttcttcagtttcctaggctgacagagaactgtgaacttacctacagggctatcatagtgggctttaattttcctgtatgtctaagtaatattgcaacgaaaaggagacacattgaagtttgacaacaatagaagtgtcttttcagcaatataattttaactatacttctataagcttaaataagttcccctcaagctacagtaacctctcataatctttgttatatggtattaaagaagctagagtgaaaagacatttgccatctgttaagtgacctcaaagctacctgaattatttggaatccatgagatcatggggcgatcactgagactacagacataaaacacgtactaactagataatgttccaaacctaagaggctgggggcacatgaaatc

SEQ ID NO: 19484 - DNA, 319 bp, Homo sapiens
gatttacctcccagctttctgttcatctcatttgtgggtagcccctgcacctgtgatttgtgggtagcccctgcatctgtgattgtggttttggttctagaactcacttccccagtttccctccttgcagatggagtcatttctccttcctcatttactccctacaggagtggctctgagcagccgtccttgggcaagcgtgcatgagctggagcttagccctgcccaccacccaccactgcctcttggaaatgtgagccgctccaggtcaggcatttaatcaccttgcattcactgagcccacgtgtaggtagggtag

SEQ ID NO: 19485 - DNA, 540 bp, Homo sapiens
taaagggacatgaaaatcaatactacgtgtgttgctcgataatagactaaaataagaagtaattttgtcttgttttgatttgtttttgccataaaggacattattaggaaatttggaggatttggtagcgttatatccatgttaatcttgatgctgatggttgtgcttggtcctttaggaaagtatttaagggttatgccgcaccatgtatttaacttaactctcaaatgattcaggaaaaatatgtatatgtgtgtgtatgtgtgtaggtatacatttttatatgtgtacaatctgtatatctatatatgggtatatacatgtatctctatgtgtgtatatatatgtgtatatatttattataaatatgtatatagatgaagatagaaagagagaagagagagagggaaagacagagagagacagaatgataaagcaaatatagtaaaatgttaacatcagggaagctgggtgaagggttacagaaattctttttactattcctgcatcttttccatagcattgaaattacttctagcc

SEQ ID NO: 19486 - DNA, 300 bp, Homo sapiens
tatttttagtagagatgggttttgtcatgttcgccaggctggtcttgaactcctgacctcagatgattcacttgcctcggcttcccaaagtgctgggattacaggcgtgagtcactgtgtttggtctaattttattacactatgatcagagatcatggttcatcatcttgctcttttgatatactgagacttggttagggctagcatgtggttaattttcataaatattccatttgtgattaaacatgttttttctaattttgggaaattagagtttaaaatcttctgctttgtggattt

SEQ ID NO: 19487 - DNA, 305 bp, Homo sapiens
tactgtaacggcagacattaggtcacttcacccagtactctccaaggtagatgttgtatttctactttacaggtaggaaaatggaggctaagaaaagttaatttgtccgagggccctctgatgatagtgaaactgggatggaacctctgcctgcttgcttctgaggtctgggctcctaactactgctctactgcctcgagccaagagatttacgccctattaagcaatttgttgtgcgataaattggaagacacagcagataagcaaacaactcaagcaaccaggtcagttcctggagtttctga

SEQ ID NO: 19488 - DNA, 253 bp, Homo sapiens
aaatgtttctgatgtgaataaataactgaattttacgtttttctctaattttagtgaatttaaacttagttacatttggctagtacttctatcttagcctgtctcaaaaatagcactaaagatgaggaataccaaattcttctctaaaatcttccacaatttcattggctgatctccaccaaatatctcctttgtattttattttcctgtctttaaaatggtgcttacaattcatagtctctaagtaaaaaca

SEQ ID NO: 19489 - DNA, 562 bp, Homo sapiens
gatctcactcccgccacagcttgggatcggtctctgctgttttacgtcctccacctcgggagcccccggtgactgtcacagcctcttgccctgtgatctgcaggttctgggagacgcacagctaagatgccaggacatcctggaagctgggaaaagatggagtttcactcttgttgcccaggctggagtgcattatcccaatctcggcttactacaacctccgcctcccaggttcaagtgattctcctacctcagcctcctgagtagctgggattacaagcacctgccaccacacccggctaattttttgtattttagtagagatggggtttcatcatgttggccaggctggtctcgaactcctgacctcaggcgatccacccacttcccaaagtgcagggattacaggtgtgagccaccacgcccggcctctcaacctatcaacctaatttttattcttagtagacacgttggtggtgagccaatcagatgttgttattgatgagaaaaagcagaaatgatttctgttgattcttgaaataaaattttttccaaaggaaaa

SEQ ID NO: 19490 - DNA, 210 bp, Homo sapiens
ggtattacatattcatagcatgccgcagaaatcattttaagtctatcaaaaacaactatattgtgcattttcaaataagcacatataaaagatgagctataagaagagagaaggatgctaaaataaataagtgaaagagaaaaatggctgggcacggtggctcaagcctgtaatcccagcacttttgggggccgagaggtcaggagttca

SEQ ID NO: 19491 - DNA, 298 bp, Homo sapiens
caagcagaccctcaggaaaagaaatactaaagattattcttcaggtagaagagccatgatccctgatgaaagtttgcagttagaagaactattttttaatgaaagaaataaacatagagataaatttaattggatattgactgtataacagaatgctatctcataaagtttaaaatgcatcttccatacaacagcagaagcatataagttgtgagttggataaattaattttaaaatattgtcaagtattttttttctccaaatagacatatgtaccaattatattagactctgaatt

SEQ ID NO: 19492 - DNA, 462 bp, Homo sapiens
aaatgacacaattctccaacctactctattgtctatgtgtacaagttttttttctattttacatactaactaaatttatacaaatgcccatatttgatatctagttagcaagccagacaagcttacatttcagtccttattaaatgtaaaactttaggcttacttagcctctatgagcctagtttcttcatttgtaaagtggttatagtatctctcaagggtaagaacaatcgaagtatgcaaaacccctatagcaaaagagcaggctaaatacatgacagttctttcctccatgtgggaaaaaggcacatgttttgaaaatgtagcccccatgaaatattacactttacagtacctaatccaatttcctaaaagggaacaagtctaacttttttcttcatgggatgtatttcaggtcaggggttgacaaactttcggtaaagagccaggttataaatattt

SEQ ID NO: 19493 - DNA, 327 bp, Homo sapiens
aatttcctcagtgcacagattccacgtgtctcctcccagtgaagaagatttgagttttaaaacgatctcatgctttctactgctatgccttcttctctcttgccacctctgccttttctgtctcttccactaactagctgtgggactagagctagtgaggtcatctttccaagctttcctttcttcatctactaaatctggtagtcactggttctcaaagtgtgaccctgagatgaggagcatcagcatcacctgcgagcatgtcagaaatgcagattctcaagccctacccagacccactgaatgagaaactccggggtggggctc

SEQ ID NO: 19494 - DNA, 110 bp, Homo sapiens
gctgtgccccacctccaccccaaaagcaaagtttcagataaatcctactaaaaggggggatttaaataaaatgcagagcttcataacacaacacttaaaatgcaaaggat

SEQ ID NO: 19495 - DNA, 434 bp, Homo sapiens
ttcagttgcgcgacctcggctcactgaaacgtccacctcccaggttcaaccgatttccctgcttcagccttccaagtagctgggattacagatgtgtgccaccacacccagctaaattttgtatttttagtagaggtggggtttcaccatgttggccagcctggtctccaactccagacctcaggtgatccgtccacctcagcctcccaaagtgctgggattacaggcgtgagcaccacgcctggcctacagtgtatatttaacatcgtattttggattaacaattccatttatttctttagagacacttacctaagacagtatgtggaagtcaaaggaaaatatattgagcaatattatttcgaaatgttactaatacattgtttgaaaataaattagtcctatgtttctgactttttgaacacctatgaagt

SEQ ID NO: 19496 - DNA, 503 bp, Homo sapiens
cctcccgaagtgttgggattacaggcataagccactgccccggccccagctgcatttcagattgcttacattcactgacctcaaagacctaattgctccccaaaactgtgtctgacccggtaatggacacatactgtcttctcactcagatagctcaggaggatataagactgttcctcagtgtcctcattcttctttgtaaacagctggtggaggatcctcttaatcacagggtaagtagcagtaccttccagagccaagcactgagctgcagcccagctatccacactgttacctgccacagttgggtgaaaaagagttcagaatggtgatgtgttttccccctagagaacagcctttggattgatacccaaggctgctacccacctgatatctcacttccttgtgccccactcagtctagaaatacaatttcttgtttaaaccatattgagaagaatcatattggctgggcgcggtggctaacacctgtagtcctcacat

SEQ ID NO: 19497 - DNA, 549 bp, Homo sapiens
gagtcacttattaaattcccaattctgctcaaggaggaaatttaggtcagtggttatgagccaagacagacctggtgtctaaggtcttccttaaaattagggagaccttggatctgttacttaatctctctaaactcatttcccttcatttcagatgtactgaaactagtatgtaaagcattttaatagtgtctggcacatagtaagcactctaaaaatgttggctatcacttctctattcaagattgatttcttagaacacagaggatataccttgattttaggaccacctatttcaatttgagatctgtattactaaggaaatagttttggttcagtccacaacatggtttttagttaatttgttgaataaaccccaacttgaggaagactaggcaatggaaattgtgtttctagcctgccacacttacttgggtacccctggcttggaagctcattagagcctcagaaagaaaaagaatttattaaatcaattattgcgcacagatgaaagggcacatcacttgctaattacagcagtggctagca

SEQ ID NO: 19498 - DNA, 519 bp, Homo sapiens
  misc_feature 284: n = A,T,C or G
agagactgtctggctgatgagagcaaaatatttactatctgattctttgcagaaaaactttgccgacgaatgtctagtctagtgctttacataatcattatttaacaccaacaataattaacattatttgctatagctaaaggaaggacatcaccttgcatgtgcactggtgggattgtgaggagtgggaaaagacaaccctggggtaattgtatctaccctccaaagcgtggtttttactctctatggaagggaaagttgtgttcaatttacatatatgactntgattcatgaaagatgatagtgatagttaaacctaggattctgttgggaaatcaaaaatgtttattttgtgaacattggtgtggttaattcgaacacattttcatttatgtcttggcagtgatgacttttaatatggcaaaaaggctcactaactttttttttccgacaaatgtcatgctaagtgacccctaattgatgtaataattattctctccaccaggggcaggtttttga

SEQ ID NO: 19499 - DNA, 526 bp, Homo sapiens
catttttgtatgtgtgtgtgtgtgtatgtctgtgtgtctgtgtctgtgtgtttatatgtaccttttggaagcactaacaagtgagaataggcaaaaataagaaaatattatcaaggggtacagttttatcaagcatatttcgatttttttagagtgaataattaagaacttattaaatggatagaagtgtacatccttagaagaaaagggaaagcacttttgtctaaagtgtggggtacttagtgggtgggatagtggcatgtaggctagaaaagtagatcatgaaagaaaatggaacatcttaaaggcaaaactgaatgggttgagctacactccttaggtgatgattgctttccttcttgcttggaatctgcaatcaggccaggaaatgaggaataatcaaagaattggcattgtctagccttgacaaaattcatgcatatcagcatgtggaaataattggctcttcacagtttctcagttggaactgagaaactagaaactggaatgaaaggccaatacagtc

SEQ ID NO: 19500 - DNA, 483 bp, Homo sapiens
accaatcagttaatgagcagatgtcacttctgcctactcattgtcaggttctgtgctcagacaagggtgagggtgacaggtcctgccttacagagttcaggttagtgggccagccaggtccaccaacaatccatcacatgagagctgaagagactggggccaaagtagtggccatggagttggaggagggagggatatgagagggacaagcagtctggaattaatcagacttttcttcattaaatgcatccgctttttccctaagtgtcattttctatcttacttcctacatgataaacaatccattgtctagttttgaactttaggggaaagagtgtgcgttcacccacatttgagtcataatttcttacaaaattagaaatgatataattttaagccttcagaaaacacttttattatgtatcttatgaagattacggcatagatgtggtagctggctccttgctgcatcagaatattttt

SEQ ID NO: 19501 - DNA, 556 bp, Homo sapiens
tcggcggttcagaatcttgaggaggccattgtggcaaaacaatggaataccttcacaagttatttttatttctcaatcacttctaatcatctccagctcaccccacactaaaaccctcatctatgtttgcatagagcatctaactagaacatcttcaagtgcaaagaggaatggatactaaaaatccttaagacatactgttggggaaacaatgcctacgatatagaaagaatcttaagaaacatgtctggcaaatatataggagcagaaaaaaaagggcattttcctccagtgagaaatctgtgaggctttgttgagccgccactgttctaagagttgtagagaatacaaatgtgattaaggtacatgccctgtcctccacgaggttatgggtgaaggaaaataagatagtgcacaataaccaaaattccaagtgaccgtgataagtcctatagaaagatacaaactgctatgtgatcacagaggagcaagggaggacctccggctgaggttggagaaggctcctagaagcagctgatcatcgtcctgtacttct

SEQ ID NO: 19502 - DNA, 477 bp, Homo sapiens
gagcctggggactttccacaccccctctatctagattcaaaacataacagtctattagtcttacatcctcagagaagactggaagactctagttggaagatcatgatcagcccaaaggaatagaccagtggatatgtcatgaggagcttttctgggaaaacttctcgacctgattgccctgtctggaagccacagttgacaattattacctaagaacctgaagcttactggaaacgtttattgtattgctcttgaacacaaacagataaccaacaatcacgagattctaggtacagccaataacaaacacagaaacaaaaaataaacaaaacaactgaaagtaaacagagtctatacagtgtgggaaaaaagtaattattaatttcctcagagagggaagataatacaacaagaacaaggtgtgatataaaatggatattcaaaaaaatagaattcttaaaaattaagaaatttatt

SEQ ID NO: 19503 - DNA, 342 bp, Homo sapiens
tacttaaatctccaacacctctcccaatctcattttcagatgtatatttcagtgataaaattgagccaaataaaagagaaccttcagcaacttatccgcctaagccatttggtgcaaggaggtctgctcttcctggttttcttaaacatttgcatatgttagggctgtgctttcttccactcagcttggactggagaagggataagggagaagcacagtggataatctccggcaaacagggttgataggaagagacatattaaaacacttctgtagttgaaggatgaagaaaaacactgaatgatgtgctgcaatgtcaaatattagatacagagaatctgc

SEQ ID NO: 19504 - DNA, 509 bp, Homo sapiens
tgaatataaattgaagtgaattaaatggattctcgagagaaaggcaaattcagagttcttgaaccatgaacataagattccagtgggaaggtaccaataaacttgtaggcttagttgtttagcaagagcgctggttatcagcttaattagtcagacctagtccaccttatcctaacgagcagtggctgttatagggaaaattgttattgtttttgcaaacagttggcctgaatttcacacttagccctgtccttactgcctgtgtgacatcaggcaagtcacttgaacctcttgaaactcaatactctaccatctataaaatgtacttagtgactcaggctgttgtaatcaaataggacactggttgtaaagctgctttgtaaactctaaatgtcgatcacgaggtcaggagatggagaccatcctggctaacgcggtgaaaccccatctctactaaaaatacaaaaaaattatccgggagtggtggcaggcacctgtagactcagcta

SEQ ID NO: 19505 - DNA, 504 bp, Homo sapiens
agaagctgattattttttatctaagttaaaaaagagagagagagaaagaaaaactcagggcaagaagtggagaataactgggtaggcaagtggtggcatcatccacaccaggtgttctgatgctacatcatttatgttttacatcccaccaaattgctcaccatacacacatggaggtgtctatccttgattggactgccctttatgttaatcactgaggtctctttggatatgtgaattgaacccaggatcaatgtgaagtcaccttcaatttaatggaagccggtagcaaaggaaggataaatttgctgggcattactttttcttttctgactcctgatgggctaagtagagaaacttttcattttaagctgatggaagcagcaaaaaatgaaaataaggatgaggtgtgaggggagggggcgggcattggtaaatgttcggatagctggtatattatatgggccaaatgatttttcaaaacttgtttgaattatttattat

SEQ ID NO: 19506 - DNA, 490 bp, Homo sapiens
catctgtattggtgagtatagttgtaatttcttttcattggggtatactattccattgtgtggatatgcaatgatgtattttatcactgaggcacagtcgagaagtttctagtttttggttattgtagtactgcaaagaatatcctactccatgtctttggggaaagttgcatagttcctgggtcctaaggtagcacatgctaccaaagacagctttccaaagcagtatgaattgatacccgcaacatcagcatttgaaagttccaggtgctccaagttctcagtggcacttggcattttctgtcttttccatcgtaatcattctggtgggaataacgtgtgaggtctgtttactaaggtcagttatttagtatgggggtgttgaggtttcaaaacatgaccctggcctacctgagacatcaaagaaatgcagcatttgaaaaaagaaagcagacgtgaaagaagcaatgcctagaacttaaaacattta

SEQ ID NO: 19507 - DNA, 550 bp, Homo sapiens
gaaaatcgtggagacagtataaacaatacacttgatcttagccaaaaagctgagaagcgataaagagtatgaacaataagcagcaaggaagatcacatactgctgctcctgatattttttactttggagtatttcctaggaaatctgcagaaaaagaataagtaattgtcccacggaaaaacagcaaatgactcagtgatcttgcacgtctgttccagattgtaattcctagctaaaggctttatccgcagattgatgcatcagagaagcctgaggatctaactttcaatcttgcctcttctgctcagatacctattaagaaggaagattacatctcggctgttataatggcactggaaattatggaattagagttttttggcactaaaaaattacttgtatggaagcaattatacatactgcacctacaaatcttccaaacctttaatacctgaaaagttacatagcttccagagagcggtttagaacttagttatggtgtttgatataaacacctcccaacacccactttgcatatcatatggcgagt

SEQ ID NO: 19508 - DNA, 553 bp, Homo sapiens
accctctgcttttgtgacatttcttgcattgagctcattctccccttctttgataatttgcttgttatgtccccttcacccagagtttcttcttttctttgataatatgaacttttcattgttttttaaagcttagcttaacttttcttcctccttaaagctttccctaccctcacccagaactctctttttattcattaaattctaggagcaatgtcagggcaattagcacttggtcagtttctagtgtttcaataacattaataacaacaaacagcagttttcactaagtgcttactgagtaccaatgttataaccaccggacatgcatgtactattattatctttattttatagataagaacattgcaatccagaggactttagtagcttaataaaggccccacagctggcaagtagtggatctgggtaaacccagaccattagatcctagagcctgagctattatccattggcatttctgaatgtgtggtcttctgaccatgtacattagaatcaccaacatggatactgttaaaaatgcagattactg

SEQ ID NO: 19509 - DNA, 558 bp, Homo sapiens
ctgagatgtgtgagcagagaagatgggggagaggcaacatgtgactatgacagagaggagagacaggtggataaactgtcttcaacacagacaatcagcttttgctcacaggtagagccaattagcccagagttaatgaagtcacttaatgaagacctggtctaacattctacttgcatttccttttccttcttttgtttttctgtttttttttaaacagagtttcactctgtcgcccacgctggagtgcagtgtcagcgatctcagctcactgcaacctccacctgccgggttcaagtgattctctctcctcagcctcccaagtagctgggactacaggcatgtgccaccatttttgtacatttttggtagagacgggttttcaccatgttggccaggctggtctcaaattcctgacctcccgaagtgctggaattacgggcgtgagccacggcgcccagcctctacatgcattttctatggcaatatttgttatggacttttaacacgttatggacttaaaaaaattgatcacccacttcgcaggttatcattttt

SEQ ID NO: 19510 - DNA, 450 bp, Homo sapiens
gcagctttggaggactcagaagatcttccccacacccaggccttggccggtatcaggtagacatgtttcccagttaactcacaacccaacagccacatatcactagcagagtgtgatgtgcatctctcgatttctagatgcaattttgttttatccacaaggtatttctttaattctccagcagtgcctttactgagtgagatctactggcaagtcttctgtagctttggggtagcatttgggaaagtaaagcaattggatactgtccttttaaaatatcattcaattaggtcttttgtaatacatacaacataacgagatagccttaccaactctaaagaaatttctagtgcatttcatcaaaggcacaataatggaaacatcgattcactcctcaccacaaacatctccctttgatgctgcagttaccttaatactagcacttttcat

SEQ ID NO: 19511 - DNA, 508 bp, Homo sapiens
atgtgtttaaaaaatatctttctggtttactagggtattcttcaaaaaaagagaaaagattaaagctgcacagacatgatgatgtaaaagctagtagcttctcaagctgtgaaaggtctgtggtgcagagaatagctccctgtgagctgaattttgtttgctgtggtgcagcatgggtttagatcctacctggttagtgaaagagataatgtgaagtcattgcatttgcatttgtcaaaatcctagttttccacttacctaatagttttttggttgtttgtttgtttcattttgtttttaaagacaggatcttacagccggggcctgtaatcctagcactctgggaggctgaggcgagttgattacctggggtcaggagttcgagacacacctggccaacatggtgaaaccctgtctctactaaagatacaaaaattagccaggcgtggtggcacgtgcctgtaatcccagctactggggaggctgaggcaggagaatcacttgaacc

SEQ ID NO: 19512 - DNA, 499 bp, Homo sapiens
gaagttaggtatggccatgtgacttgttttgaccaatggcgtatgagcataagtggcatgtatctcttcctggtagcagctttaagagccagcctgtgattggttccattccctctgtcacagagactccaatgctccatgtgtgtcaatctgagtcccaaggggagggtcatgagtaccaaaacccccagacaatccatgatggaaatggagcatgagtgaaaaatacatcgttttattttcaatcaccgtgagcctgggatcgcttgttattagagcatagcctattctatcctgatacaggaaaggaaatcacagaggctaaattagcttctcaaggtcacattactaagtgaaagaaccaaggtttgggctctgacattctgtctccggagtccacctgtctctcacattagtacatagcatacctagctagtggctccaaattggagcttaaggagaagaatcaaaagctctctctaaaattctgagtgtgttt

SEQ ID NO: 19513 - DNA, 551 bp, Homo sapiens
acctgaggcaggccagggactagggaaggtggcagctggacaaaggtatgaaggaaggacgagatgaggcacaggtcctggtattggaaagaggcagaggtacctcggaagcatgccatagaggttagacgggacctaagagggcatctggtccaaccggattcgtgttaccagcgagtaaactgaggccaggagagagactgctacgagctgctccagcctatcacctataaagactacagtccctttgtaaaataccatacagctctcggagaactcccagttggcgctgcaggataaaatccaaacttgttggcatagcattccagccacttgttcacttacctttcccatttgagctcctaggaataaacagaaaaacatttcattttctaaatatcaccagataacttcacttttggtaacttgaattattaaaaaagtcctaccgtccctcatctcttgccacttccccaacattactggaggctctggctacaaataatttgttttccttgactactcaactttctttggattatttacttttt

SEQ ID NO: 19514 - DNA, 558 bp, Homo sapiens
aacgggcggtgccccgtgtgtttacggtagtgcctggtcagttcatgtgagcgggcgaatttccatccacagccgtcccagtcacagtggtaaggtttctcacctgtaaaggtaaaagaaaaaaaaaattgacgctattgctatatcaaagaatcgccccttttaaaaactgaaggccagatagtaaaccaactctgaccctatcctaaagaaatccaggaatgtctttataccactgaaggggtgtattgaattccatatcataaacagaaatacattccgtgcttaagtatttggtcttggttttagggggtcaagttaagcacccaacccccacctacacctatactaatgtttcaccaaaaacacacaaacaccacctaaacctatactaatgtttcatttgagtcaaggcatctcagtggtggaaatgaaatttggaaattgtgattggtagtgtgcccaaaccatgcaatcttattcctactacgactggggataaaaagccacaggtggctactttttttttctttacctttacgttactggatgctgcac

SEQ ID NO: 19515 - DNA, 489 bp, Homo sapiens
  misc_feature 276: n = A,T,C or G
tttacttgcaaaattatattactcttattttctaattttaggataattgggaaatacaagacaattattataaattccatgtaatatagtttttgcacccaaagtaactctgatgattcctcttttctccaattttttttgccttccttctacagaattaaaatatcagaatttatattttaaattagtaacaacttctgtttaatttagaagtcaaacatctgtctcaaaggttagtcagaatcaccaggtaagttttatttctttaacagagantgtttaaatgttcaagaaaatgtcaagatttgtctgactcagttatcagtaagcaattcgagatctttaatttattcacagaaaatgtgagtttccaaatacaagtaaaaaattagatgcctgaaaataaggaggatgtaaggaaaagaacgcttaaatttaatttaaatttgaaggagatggtttgaagagatttttgaaatggtgggattt

SEQ ID NO: 19516 - DNA, 548 bp, Homo sapiens
ggtgagctattcaatcaacttctttttcactcatgcataatttgatctgatttaaaattgattgtcatctaattaatcagacctagatagtgattcgagttcattcataaaccaacgctgctgagttcacctatttggattccatatatccagggattactcaaatggcttgagtatgataatttaatttgctgatgctaagactagaaaattgttcccagtaagctgaagtcagggtttgttttgttttattttgtttttctcatagctcccttatgaattattttttccaatttcccagtcaaaaggctgaacccacttattacagtgaatgtctaaaccaggcgtgtccaatcttttggcatccctgggccacactggaagaagaattttgttgggccccacataaaatacactaacactaatgatagcagatgagctaaaaaaaatcataagaaaatctcataatgctggctgggcgtggtgactcatacctgtaatcccagcactttggaaggccgaggcaggtggatcacctgaggtcagga

SEQ ID NO: 19517 - DNA, 312 bp, Homo sapiens
tacttaaatctccaacacctctcccaatctcattttcagatgtatatttcagtgataaaattgagccaaataaaagagaaccttcagcaacttatccgcctaagccatttggtgcaaggaggtctgctcttcctggttttcttaaacatttgcatatgttagggctgtgctttcttccactcagcttggactggagaagggataagggagaagcacagtggataatctccggcaaacagggttgataggaagagacatattaaaacacttctgtagttgaaggatgaagaaaaacactgaatgatgtgctgc

SEQ ID NO: 19518 - DNA, 548 bp, Homo sapiens
tgtgtatgtgtgaacagaagagcaaaccgaatataaattttactaagcatccagatgtttttagaaatttgccaccacatacttgattgaaagacattttcactcaacacctgtttttgttgttgttgttgttgttgtaccaactcagggtaagacaaatcaaatttatagaactggaagggaatattttggttcaaacatttgagtcaatccacaattatgtgccacagtcaggcaagggaaagaaataaaagagatccaaataagaaggcaggaagtcaaactatccctgtttgcagacaaaatgattctatatctagaaaaccccatagtattggcccaaaacctccttcagctgataaacaacttcagcaaatttcaggataaaaaatcaatgtacaaaaattactagcattcctagacaacaatagcagccaaattgagaaccaaatcagcaatgcaatctcatgcacaattaccaaagaagcataaaatacctaggaatactttcaaccagggaggtgaacgatctctacaatgagaatgac

SEQ ID NO: 19519 - DNA, 465 bp, Homo sapiens
caggtcctgggtggacataactgtgtacaggtaaggagttgacctgtggggagggtgagcagtcagcagcccactggggtcctgagaaagttttctggaaggaggaggccgaggggatggaaacttaaagaagcgacctcacttccttggcaacagaccctaacagaactaagaattctggtaaccaggccaggcacgttggctcacacctgtaatcccagcactttgggaggctgaggcaggaggatcatgaaatcagaagatcgagaccagcctgaccaacatggtaaaaccacatgtctactaaaaatacaaaaaacaaacaaggtcagcaaatcgagtccatcctggctaacacagtgaaaccccgcctctactaaaaatacaaaaattatctgggcatagtggtgggtgccagtagtcccagctactcaggaggctgaggcaggagaatggcatgaactc

SEQ ID NO: 19520 - DNA, 516 bp, Homo sapiens
atgagccacgagtggaagtgaaatatattccctcttgagccaaggcatctgagagctggtgcctaacgcttctgtgctgttttcctccagtgcagcaaatgttaaaccgtgcattgcagatggtaccgttgtgagatataaaagccccaatctctgaactgttattgcaaggataccattgaatgcagtttagtttcataaggcagtggtcttgtatataaaacatcactttctatttgttagcactgatactctagggattgtttgtactgatgttccacagcataacatacccatccaaccaatcgatgcaggtattacccagattgacacatttcttgaggtgggggggtgggagctctgtaaaatcactaaaagattaaaaaagatttctgtcataatacaaagaaaattcgggccggacatggtggctcactcctgtaagttcagcactttgaaaggctgagttgggaggattgcctgagtctaggagttcaagatcagcctgggcaacat

SEQ ID NO: 19521 - DNA, 551 bp, Homo sapiens
tccaattcttgataaatttgctttgaggtagcaccaatatagtcaatttatgactctgctttctacatattttaaatcacagattaaattgataacttaattaaataggctgacaggcagaaaatgtaataattctccagtcttctgactcagtgaacattctggcgtgtcacttgctttggaaattaatttattctaactggaggaaaagaattagaagcagcaccaaaagcctctcttcgtaagtctacatgaaacttgaagataggttacaaatgctgaaacattagaattgagaaattatctagataacctagtagaaatgctatatactttcaaatttaggccacttaaaaaaaatctaaagttttatgatgacttccaaaaccaaacctacaggtttccttataggcaatactgtatccaacagagcaatcaggctcttttcctctgaaatcagagaactgggcgggatcttttgaaggtcccttccaattgggcaagtaattcatttctctacatttacacacacacacatacacacccccaaa

SEQ ID NO: 19522 - DNA, 555 bp, Homo sapiens
ttactagtatagtcggagaacgcattaaccaatactacattgtataaaaagcactacctaaaacaccaataaatatcacactagggcatgagaaaaaaaatgttaaagaaagattatttatttttgttgcttacttaacctctgaagggttaaaagccactgatatccaaaaaggaaacttctgtattctaatttatgcctatctatgtctcaactgtcagtaggaatgcagaaggtcaactcaggctgcaccaataggtgtttcataagctaaatggtgataaagaattagatcagccaaaaagccaacctagaactgggaatgaatacgcactttcagcaggccattcctcacaggatataaattagaaccactccaagatatagtaggtgttcactcaagtttctctgtgggttttcatagcccttagactgttgcatttgaagtgaaagctaataaaagtccagaaacaaatttgaaaaggtattggtaccaagagattaattcaagagtttttagaggaagtaccctccaccttgaatgcctttggaatg

SEQ ID NO: 19523 - DNA, 235 bp, Homo sapiens
gagctggttccagtatacaactgacactactctagtaagaacttttctgcctcctctctccatctttctgtcctccccatactccaatactagaagggtcagactttgtgattagctaaaaggagaagaaccaggaaagaagaaataatatgtagaataagttttagcagtctcagttctctgagagccctacttgaaggagagtgagttagtccttcattcaacaatatagaca

SEQ ID NO: 19524 - DNA, 561 bp, Homo sapiens
tgctgccatgtctgtgttaagagtagctaaacttcccccaaatgctttgtgtgtatgtgttgtatgtcaaaccatttgagtccccttcaggcaggtagttcagttcagagttggtttatcaagcttatgttgcaaaccgtgtttctggagagactaaatgaaggcagtgaatgaaaacctctgttaatgtttagtgagatacaagaataaaaatcacatttataggaaatggccattgctggttatggaacatttttcactagaaagttaattccataaatgtaagagctgacttgtgttagcacctagagtacttttcgtatatgcaatgtggtcaaactattttttactgtaacctacagtaagatacatatttatttcaaaatcatgcctgtctcccctgacacacatatatgaaatatatgcatatgcctatattgataaaggaaaccagagtttcacaaaacaatgtttactcactctgtgcagtctaatagtttttattctattaagatctgatttctggctgggtgtggtggctcacacctgtaatcccagcac

SEQ ID NO: 19525 - DNA, 513 bp, Homo sapiens
tgaatataaattgaagtgaattaaatggattctcgagagaaaggcaaattcagagttcttgaaccatgaacataagattccagtgggaaggtaccaataaacttgtaggcttagttgtttagcaagagcgctggttatcagcttaattagtcagacctagtccaccttatcctaacgagcagtggctgttatagggaaaattgttattgtttttgcaaacagttggcctgaatttcacacttagccctgtccttactgcctgtgtgacatcaggcaagtcacttgaacctcttgaaactcaatactctaccatctataaaatgtacttagtgactcaggctgttgtaatcaaataggacactggttgtaaagctgctttgtaaactctaaatgtcgatcacgaggtcaggagatggagaccatcctggctaacgcggtgaaaccccatctctactaaaaatacaaaaaaattatccgggagtggtggcaggcacctgtagactcagctactct

SEQ ID NO: 19526 - DNA, 486 bp, Homo sapiens
tttttaattggaagtattaaatttatctatgtaactgcattatttcctaaaaggtcacattttaaaaaaattttaaaaaacattagaagattgagtcattataatttatttcttaaattttaattatatgtatatctatgaataatttatgtataaacatatatatttaatgtcaaaccttaggaaaatgtatacaccttaaggaattatcacaaaacaaatacctccacaactaccactcagaataacatgtttttttttgcaaaatagattactacttcatttgtcttcaaagatacccactatttggagtttacttttcttaatgttttgatatttatatacccactctgttgtaggccaataatgcctctgaaatgcatgtccatgtcttaatccatggagcctgaccttatttgaagtagggcatttgcagatgtatttaagacatttgaggctgggcacagtggctcatgtctgtaatcc

SEQ ID NO: 19527 - DNA, 558 bp, Homo sapiens
ttacttgtataaggaggattttaaatgattgtgtcattctttacttaaaattagagaagatccatttagaaaatatattaattactttatcctgaacacataaaagtatgttcaagacagaaacttttaaaatagaggaaaactagggagccctctttgtgtagccctctttgtgtagccgcagtttgtcggtctcataaaatagaagaaaactcataaaatagaagaaaactagaaaaagacaaaactcattgggaggatagtttaacttcctctgtttctatttgcatgtcctttatctctttctcttgcctgattgccctggccagaactttccaacactatgttgaataggagtggtgagagagggcatccttttcttgtgccagttttcagggggaatgcttccagctttcgcccatacagtatgatgttggctgtgggtttgtcatatatgactcttactactttgagatatgtttcttcaatacctagtttattgagggttttagcaaaaagggatgttgaatttatcagaagacttttctgcatctattg

SEQ ID NO: 19528 - DNA, 544 bp, Homo sapiens
gtttctacgtatgagaacgaaaaagggaatcgccaaagacttgtgcctttttcccatcgaagatgaggcattgtcttcagcagaggctcagatctgggagcaaagggagtggaaacctgtctgtaaggaacctcaacccacaggacacctgagcacgtggggactttaaaactcctactagtcagagttttcaaacgtctaaataaataatcaggaaaatattagtttttatactattaaagaaaactttaaaaaaaataacccaataaattttattcatttcataagctaagtaaattttacttagaaataaaataatcataatctagagaaacctctttatgcctcagcaatgagatgtacagaattctacatatttgattaaactggacaaacttttacctgtaacaaaaactagcgtaactgtatatattgaaagtaatactcgtttaaatggctggcttcaagagatatcagagatataatttcaataagtctctctctctcactcacacacacacacacacacacacacacgtgctga

SEQ ID NO: 19529 - DNA, 562 bp, Homo sapiens
gtatttatatacacacacgtatatatgtatgtatatatatacgtacgtgtatgtgtgtgtgtgtgcgtgtgtgtgtgtgtgatgcctcagcataatgtttaacaccatggctgaaattgattaagttttagcttataattataattattttagtttcttttttcatttttattgctcttacaataaacaaatacttcttgtttaagagattcaagtaataaagtatacagacaaaatgtaaatgctccctcagtcacccccgccccaccattttttttagctgttgaaaaccattgtgggcagggcacagtggctcacgcctgtaatcccagcactttgggaggccaaggcaggtggatcacttgaggtcaggagtttgagaccagcctagccaacatggcaaaacctcacctctactaaaaatacaaaaattagctggacatgttggcatgtgcctgtaaccctagctactcaggaggctgaggcaggagaatcgcttgaacctgggaggtggaggttgcagtgagctgagatcatgccactgcactccatcctgagtgac

SEQ ID NO: 19530 - DNA, 535 bp, Homo sapiens
gaatgtaactgggtgaagagtgttgggaggagggaatgaaggccacaaatgataaatcgactccatcattcttaccttcttaagcctttagatctgctcttccacattttactagggatgttacagcatcttaatctcattaaatgtagattgtcaaagagtccaagtgtcactcaaccaaagtaaactgttggaaccatttccagctaacacattgaatatgaaaacactcataagtgcttcatcaatatattttacccttttctgaattattttgcagcctgcttggtctaacacccttagaatccattcgcagtgttcctcattttcactctgtgagtgttccagtgtacttagagaatcctctccacactgcagtctttgttgtcatctttattcccatagtgctgaagagcagcagctgcttgatctcctcaggacctgcgtcagttggcatttcaccacaatcaactccaaataatacttgattaatcataagccagtgcatgattaatccatttctcattgacaagta

SEQ ID NO: 19531 - DNA, 534 bp, Homo sapiens
ggaagatcttggtttggatcctgacttctcaattttactagttgtgtgtcctccagcaaatatgttaagtttttcatctttaggaatgagtgttctcatctgtaggatgggacaatgattgcgtccacctcattgcgttattttgaggattaatgagaaaatgcatgtgaagtatcaggcagtgtctatgcatattaagccctcagtaagtgcaaactggtgttattctacaagcatcagatcccttagctataaaatttgacaatgttgtactgacttcagagtaattttattaaatgagcttaagtatttacagtactgatcacagcacctggtaaaaatgcgacaggtgatagctgttattaatattagtggtagtgttttgcaataagattatgaagatgaatattatgtgaatcattggtctaaatttgtcttttatctaattgatttgatataatggtttcgctaacttaactgattacctccagtactaggccttttttgaaaaatgaactgatttattaattataa

SEQ ID NO: 19532 - DNA, 538 bp, Homo sapiens
aggattataggcgtgagccacctcgcccagccttaaagcctattttcaaaagaaacaaaaatccttaacaaatagggatgattataaccagaaaatgtgcttccaccagaagacatctgtcaccagcaccagtgctttatgagatcagtgagacaaacccaggtcttaaggcactttcctaagcaccacagaggaagccccaatgacattgctcaaggtaaacagaggcctggactgattccacatgggcaggtgaggctctccctcttcctgaggagccaaacagacacaatcagaaccaggaatatcctctgaatctcccaatttcctatcaaaatcactgtagcattcttccttaaagtgaatgacaaagccacaatcttttggcatgtgttcagaaagcaaaaggctttttcagaaaatctgtattcctaacaaaagacatctgaaaaatctgctaactacaaatgggtacttaaaagtcccttatgaacttaagctactttaaggacaggacattggtgaaaaagtattctgg

SEQ ID NO: 19533 - DNA, 479 bp, Homo sapiens
ctgagtagctgggattaccagcaagtgacaccatgtccagctaatttttgtatttttagttagagaaggagtttcgccatgttggccagactggtcttgaactcctggcctcaagcaatctactggccttggcctccgaaagtgctaggattacaggtgtgagctactgcgcccggccagacttagcattcttaatcacaaaattcttatttccatttcctggcagaattatgttttagttaatgtattattggggataatttcatttgtatgtgatggaaactcagtttaaaccagcttatgcaaaaaagaacattgactcatatactatgaaattcagaagtaggctgggcgcggtggctcatgcctgtaatcccagcactttgggaggctgaggtgggtggatcacctgaggtcgggagtttgagaccagcctgacgaacatggagaaaccctgtccctattaaaaataaaaaatt

SEQ ID NO: 19534 - DNA, 461 bp, Homo sapiens
ggaagtttttcaagtgcactgtgttaatttgcatacttaaattaactgtgaagtttaagtgatgcaatcttaaaaagcaactgcatactacactgggcacactgcccatagggtagccctaaaggcaactatagaatgtcattgtataaagggatatcagtgaactcgctggaagctggggcttctttgtcttggactgtttgcataacaaacacatttttttccttattctatttatttatttatttttgaaatgggggtcttgctatgttgcccaggctggtccctaactcctggcttcaagcaatcctcctgtctcagcctcctagactactgggagccattgcacccagactacttttctttaaattgtaaatttacttgggtcaggtggggtagaccatgccagtaatcccaacactttgagaagtcaaggcaggaagattacttgaaggcaggta

SEQ ID NO: 19535 - DNA, 406 bp, Homo sapiens
caggctactaaagacaaatgaaaattttaaaagcaatcagtgtaaaacctagattatttacaaaagaaacaactagacgaatagaaaaattctcattagctatactagagtccagaaaacaataaaataatgcctttaagcattagaagaaaatagttaccaacctgggaagttttctctagctaaattattattcttgagtaacggtaaaataaagacaatttcaaatgaatcaaacctgagagtttatgactcatggtctttccatcactgaaagaactacaaaaggtgtacattagtaagaagaaaatcaaacccagaagaaacagaatgcaaaaaatatgctgtagttttccattctactccatgtctcataattcttcatattttctatttcttttttcct

SEQ ID NO: 19536 - DNA, 515 bp, Homo sapiens
gctcatcaccctgctctgattaagcctagctttcctcaaacattagcatctagcgcgtcacacacactagtttttccatgtaacttcattttatcagaatacattagtagtgcttaattgtctcattcaactataaaattttaacccatgttgggagttaaatatctgggagtgatagaacccatctgataaagcactggagaggtgtggccagtgaaacaggaggggacccatcagggaagaggggcagcttggtcagtggaaagcacagggcgccacggcaaactgcccgccaaatccagacaaaggcttggcaagcaggaggggaaactcagataaagcccaggtgcatttcattcaaagcgtgggcagacgataacaatgacaaatgcagggcaggcggaccacacttgaaaatgtaaagcatgtaggccaggcatggtggctcacacctgtaatcccagcactttgggaggcagacgtgggtggatcacttaaagtcaggagtttgagac

SEQ ID NO: 19537 - DNA, 540 bp, Homo sapiens
aaagacaatataatgaaaagtagaattccaaaaaaaagaccatagactttcttgtgctgaatatttttattttctgaaactacaaaaagctaattattaaagaaacattaattgtaaatagtaaattagtttacaaaatattaccaagttaaaaatacaaacacacacacacaaaaaaaaacacaaacaagagcagccaaatatactacataactaaaaagctgacccaactctgattactgtattgaatactatcatcacaaaacaactctcattttttccacctggccctaaggaaagatccctgatgaccacacaccatagtttaggaaaaaatgagtgaagtggttcattcaaataagagtagaactaaataaaaaacaagaaaaaagttgtaaatgttgatcatatgcattaatgctacacatgtaagaaaaaagacataaaaataagtttttggctaaatagcacctttattttccctaacaaatcttagttcaattctgaagcctcttatttttatcataaaagctcaaaaat

SEQ ID NO: 19538 - DNA, 492 bp, Homo sapiens
agggaggtaaatcctgctaacagcagagcagaggaagttgaaatgttgtagctgtctacaggaaaatgaagttaaaaaaaagatttttgtcgtccttgtttgtttgtttgagacagagtctctgtcacccaggctggagcgcagtggcgtgatattggcttactgcaacctccgcctaccaggttcaagtgattctcatgcctcagcctcccaagtagctgggattacaggcatgcaccaccacacccggctatatttttagtacagacagggtttcactgtgttggccaggctgctctcgaagtcctgacctcaagtgatccatctgccttggcctcccaaagcacttggattaccacgcccagttcctcaaaaggtttttgaatctcaagaacccaaataggctgtaaaattagttgcagaaaatacctctgaagcttcaatgtttatggagctgaaaagtggtgatctgattgacactctgtatgttaa

SEQ ID NO: 19539 - DNA, 470 bp, Homo sapiens
  misc_feature 370: n = A,T,C or G
tattcctcactacatttcacgacagttacttgaaatatgcactaaacacatatgtgtaaaatgtacttaaatggcaaaccaaagaattaacacctgattctaaatctgacaaattaataaagtaatatttacttatacggttataaaaggttagtgttataataaaaaatgtcctcatttgtcctggtcaagggtgtgaatggatatgaaataagaaaatatgaaaaagtagtattgataggaaaagtattttccaacattgcaattgttatgattttcccacaatattatttacagaagtagatttacaattttgccatttgaaaaatattgtaactgtgaaatagttaacattcagtttaaagtttgngatttaaaatgagcctaaattgacgaaacagactgccttacctttaatttatatgatggaacttgttttcaggacagaatataagatatacagattgagc

SEQ ID NO: 19540 - DNA, 534 bp, Homo sapiens
taagagcttctagcttctctgaggctaataatggactaaatgaccaacatttagttcattatttttcccacccatctatgttttggggtgcattgtttgaaacccctcaaatccaattcccaaggcccctaatcccccactccccatagcattctcagactagtagccacaaagggcatgtgtgaataaatacacaagatcaccttgggtattatacctcttgaacactgccccttgctagatatacatcttgggaaaataacctcagagacttgagctgctccaaacaacctggcacaaacattgaggtttgaaatgagactaagaaacagactctgtaagtattattaaatgttataagcacccccgctagagaacaagtatagaaaggaatatgagcctataaatattccagaggtagacaaaccatgtatgtatatcacgtatattttaaaacaaaaaaatggtacgctggttttaggtcaaaaaggcagatgaactaaaagaaaatacactccttcagcagcaattcct

SEQ ID NO: 19541 - DNA, 563 bp, Homo sapiens
aaggtgagggattggccagttctttcatgtggagggagtgagggagtttctgtaggaaccttaactgtgatgtccctggctgatgcgggcttggaagtaacaacaccttgtgcttatgcagcctcctgcttctcagcagttcaagtgcttcccagacattatctcactatttctcaccatcttcttcggaaagtggctgaaggcagctcttgttatcataccccggcacaccctgcaccagtgggttaaatggttttcccacaaccttccagtgagagtcaggaccaggacccctgtcaccagatttagctttccagcctgctcattgcctcatgcagctttcaggacccattatttgcctcaaggagaagggaagttcaccatcactgttacaacaatttgagacatttgctggggagccctgggaaaggagaatcctctttccttctccaggcatgtgcagttgatgatgtatataaactgattatagagaaaaatgttaagtatgtgtggctcatcctatggaggaatctgccaatacattcgacatttatggatgtcag

SEQ ID NO: 19542 - DNA, 567 bp, Homo sapiens
aagacaaaaattaattttaagatcaacttctaaatattaaaaagacaatataatgaaaagtagaattccaaaaaaaaagaccatagactttcttgtgctgaatatttttattttctgaaactacaaaaagctaattattaaagaaacattaattgtaaatagtaaattagtttacaaaatattaccaagttaaaaatacaaacacacacacacaaaaaaaaacacaaacaagagcagccaaatatactacataactaaaaagctgacccaactctgattactgtattgaatactatcatcacaaaacaactctcattttttccacctggccctaaggaaagatccctgatgaccacacaccatagtttaggaaaaaatgagtgaagtggttcattcaaataagagtagaactaaataaaaaacaagaaaaaagttgtaaatgttgatcatatgcattaatgctacacatgtaagaaaaaagacataaaaataagtttttggctaaatagcacctttattttccctaacaaatcttagttcaattctgaagcctcttatttttatcat

SEQ ID NO: 19543 - DNA, 560 bp, Homo sapiens
gagagatgggagaaagatgctagaagagaagggctgtgggggtagaggcaggagtagggacacagacggaggtctggggagatcggggctcgaatgtgcccttgaatggcaaacactttggcaggagtctagctggtgaagatggaagatagtaactgcctgctctcttagcattttggactaagttcttctactctcttatcttcttaatttcgcagcaaacaatggactattgactaagctttcagagctgtgggtgttctcagagggaggccagccagaacaccagcatctccggcttttcttccaactcccaagttggagctccatctatcagaaatatgaaaccctggaatcttcctcctcctcacttctctgccttaaggtgcgggcagctggggaagagaacattgtgcccagggagagtatattgtgtgagtgtgtgcacttattcatgagtgtgtgcatgtgtatgagtgtgcacaaatgagcgtatacatgcgtgtatgagtacatgtgtgcatgcctgggagtgtgtgtgctggcagtggtggtgtggt

SEQ ID NO: 19544 - DNA, 354 bp, Homo sapiens
ggtcatgagagtttgagatgcactgtcttaaggcctgggtgaaatagtcacaaatcctggcttgtcctggggtaaggctgaggccagtctagctcagcaccttgatttttgtgggacctgataattcttatctatttagtaccctgggcctttaatagcaccttggttacaacccagataaggaacataggctcttcttgacccaccattttgcatgtgatttgagggcacattgaggggaggaatgtcacagaactgcaaaccgataatttaaaatgtaatattcccctttcctgtccctcagtcatttctaacaactgaagcccccggtgatgtttctaggcttcctctctc

SEQ ID NO: 19545 - DNA, 522 bp, Homo sapiens
tggtatatgtagagtgcattattcccccaaactgcaaagtagaagggagtattatttgtgttcttagagaaatttaagaggtcctcactcaagtactaattctgtttcttaactaattttaacttgctttttaaaaagcaaatgtttatataagggttattataagctagtcactgttatgagtactttataaatattaactaacttaacatatatctttataataaccttggaaaagttacttcagcactttcgttctttttcctggtctttaaacagagacagttggaccagatgatctccaaagcccactccagctctgcaatgttaaggctttctaactaacacataacacatagttatgtgttaagaaaagttagataaggtcagcttttcctagtgggaacagagatgagagtggagccccaaagacagtgcacagtagaacaggaagtattaaaagtgcagagtctgtatgtagcacagtgtcagtttgggagggaaggaaggcagcatcaaatc

SEQ ID NO: 19546 - DNA, 354 bp, Homo sapiens
tatctagcagatttgcataaattaattaatgtcaacagctacaacaagctgcagcatagcagcacctgggaaaatctttactcccaatgaaataaggtagtgagcctgcagggcagagagatattctatctccaaatacatgccaaggtcaccgtttacataacacaagtgacaacacccagccaaatcacagtaatgcatgggtgtgtaggaggggtacatccaggaaaatatggtgaatataaagctgtttagtgaaatccttaatggcttttcaggtgtttatattttagcattgcattgagatttctgtttctttgcactacattactgaaaataagtattaaaatttat

SEQ ID NO: 19547 - DNA, 395 bp, Homo sapiens
aaagggaggatataaatatatttaggtaggcaatagcagtctttattacagggtcccatttctggttaacaggaagtctgtgaagagtgactagagaaaatggataggaggaaattactcagaattcatataaggaaaatatatttccagatggatggactgctaaggatcaagcataatgaacaagaaaggatcccaccaaggcccatccttataagatttcagattactggacacaaagagaagatccaggctaagttcacaagcagtggatcagggctaaggatggcaagggactctcagcagcacccctgggaactagaagatagtggaacagcaccgttaaaattctcaggaacggccaggtgctgtggctcacacctgtaatcccagca

SEQ ID NO: 19548 - DNA, 366 bp, Homo sapiens
ctgcaacctccaactccggggttcacgcaattctcctgcctcaactcctgagtagctgggattacaagcgcgtgccaccacaaccggctaatttttgtatttttttttttggggagacggagtttcatcgggttggcaagtatggtcttgatctcctgaccttgggatctgccagcctcggccttccaaagtgctgagattacaggcgtgagccaccgcacccggccacttaaattgattattaatttgcaagtttgtaatgctttcaatggttcaacccgtttgatgttagttctgagttcagacttgtgagtgacagacacacaaaggcagctacgagactatcaaattcactcagcttaattt

SEQ ID NO: 19549 - DNA, 504 bp, Homo sapiens
gatgattactgctatgctggtctccctagctaaactgagtcactcagggtcaggaacagagtcttatttaataatcatagctctgttttctagcacagggcccggcccaagaatatatggattgttgctaaagtatataaaatgagtggttgtcaatttactctttttgattattattgttttgcagtgattttcttttcaccacacaaaaatgtgtatttccagtgcttcgcaatgcttggcatgtactagatccttaatgcacttttgtattaacaaacacatgaacaaacttaggaatgtgatactacttattgtactgtttatagtatgtctatttacctattgatcttactttttttcttatgcaactatttctctcattagtatgctatagtgaaatagtttgcaaatgttttcattggctctaatgaccaaaaggaataaaaagaaacaagattggccgggcgcggtggctcacgcctgtaatcccagcactttggg

SEQ ID NO: 19550 - DNA, 559 bp, Homo sapiens
agaggtatgagccaccatacctggcccaaacccttatttttatgtgtcattagccagaattgtattacatggccactttttccaatgagatagatactttctcacccctagtcaggaagctagggattatagatattagggaggcaaatttttcactttgagacactacaacattggtggtggcttatgtgacttcagttagaagctcctgattgggatgttgtcaggagcacgcacaaggctgttggggttggaagagtagattcctggaatgaaatttcctagtaatttcctttctttatttagtcaacaccaaggagtagtctgcttctcccctttctgttgctaccacttctctctaatcaaactgtttcttctctgactcattgcagaaaagaacattgtctttccttcagcctttttcttactctcctcatttctaaaggaaatgcctgctcagcccatctttctgttttgaaggtttttatagaagattaaaatttcccccactctgttctttgtagtgaaaagagcaacttctgagattttatttttctcc

SEQ ID NO: 19551 - DNA, 450 bp, Homo sapiens
gtagctgggactacaggcacccaccaccatgcccagctaattattgtatttttagtagagaccaggtttcaccacgttgaccaggatggtctccatctcttgaccccgtgatccccctgccttggcctcccaaagtgctgggattacaggcatgagctactgcgcccggcaagactgtgtgtttttaaaacaagaatgactacgcatatttgaccagtgacttgttaagcaggaaagaaagaaacagctggtcagtttgcaaaatcatgagttcaagctctgttttatatcacttatcaactgatttattcaaccaacttttatcaagtttctaaaatgtatcaagtactgtgcaaggcagtgatgaaaagataaataaggcatggtttcagacttcaaggaattccttagctataaaaatggaccagccgggcgtggtggctcacacct

SEQ ID NO: 19552 - DNA, 532 bp, Homo sapiens
tttgttatgacaaccttagaaatctaacatagatagcaagatgttctagtcaagctctagtattggaaccctgcctcaaacccagccatctgtgttgtcctctggatagctggcctagattctgtctgttttttcagggatgctagactgtcttccttctaccttcagctgttaggtagggttctgttgcaacatagacgggatgcatttatcttatctttgggtattgtcctttcaactgtaagctccacaagggaagggatctttgtttattttttttcccacaatattttcagcacctagaagagtacccagcatacactaagttttaaatatttagttgaatgaatgaataaatacataaatgaagattatttctgctaagtccttccttttgacattaccaaactcctcttcctcctgccacatacacttttgatattagtgataatcttggtaataatcaaattcactcttcttcctgggtgaatcatatttagattgctggttactatttacctggaaggggcac

SEQ ID NO: 19553 - DNA, 535 bp, Homo sapiens
tagtattcttgtcttagttagcaatggaaaaagaaaagaagcaacttgggaggaagaaaggaaggaaggaaggaaggaaggacagggcaggccagggagtccaaaatatccagatgatggtgtaagcaggtacttaagttaggagaggtgaaggaacaattgaatatagctcaaggtagtgacactaaaagagagaattctaataaacatttccaaatagaaaatatagttaaacattgcgaaaactctgcacactctgaaaaaaaagaagattcttatagaatctctacctaagagaaacacacacacacacacacacgcacacacacacacacacacagtctcatccaaaggacaagaaaatagaaaagattctcagattttcaaaaacaaacctcactcctgaaaggcaatgaagcttacgtttaaagcttggaacagtggcttccaatctggaattctatacttatccagcgtactgatttattttgagggtacaataaacacttaaaggtctatacaattttacttccta

SEQ ID NO: 19554 - DNA, 489 bp, Homo sapiens
ggcacacgcttcctggggccattccacattcctgatgtcccatgtcagaatgacacatatactgctaattcccctatgcgagctctgatgctccagctctctgccctcccctccccgctcccggcagcatggcagcagctggggcctggcctccctggtctgcctgggttctagcctgtgacaggggcccatagaaaaagcactgaggccgggccaggcacagtggctcacgcctgtaatcccagcactttgggaggctgaggtggatggatcacgaggtcaggagatcgagaccatcccggctaacatggtgaaaccccgtctctactaaaaatacaaaaaattagccgggcatggtgggtgcctgtagtcccagctacttgggaggctgaggcaggagaatggcatgaacccaggaggcggagcttgcagtgagcggagatggcaccactgcactccagcctgggcgacagagcaagactccggctc

SEQ ID NO: 19555 - DNA, 524 bp, Homo sapiens
attacatatattttagctttctagttattctattttacattcacagtaaccttgcaaaggaagtagtgaaacttttagcattcccatttcaaggcaaggtaactaagggacatcaaaattaaatgatttatccagtgtcattcagtttgtcagcactgctgaattataggtagccatgtcccctgcacactctctgtgttaaggattttactgtctagggattctgaatgttcaagatcttctttgctattattaaaggagagattaagctcaattaaaaattaccaaaaaaatcagctgtattgtcattagagggttaatcgaaattttaatgttatagatcatattaaccttttctaaataagagcaccttcatctgagtttatccttgtcagacttgccccttataacattaggcagaccatgactcctcttcaatcctaataggtgaagaagacatcaggacagcatggaagtgtgtccacaattactctgggttgtcacaaagatcttgactgttatct

SEQ ID NO: 19556 - DNA, 81 bp, Homo sapiens
atcagaagttcactatttaatgtttgatcctgtatcccaattttttaagtttgctatattataacccccatttataaaaat

SEQ ID NO: 19557 - DNA, 411 bp, Homo sapiens
gctaccgtgtcaccacttacagctctgtcattatcactagttgtccttcccaatgtcccttaactaccttttcagtcgtatctcctgctactccccttctcattgtctaccctctccctgcccctcaacacacacctgtgttttaaccagatagaactacctggaagcttcttagaaggtaaaacctctagccctatcttcagacctatgaattgcactttatgagtatcccagggtattaaatatgcacattgaagtttaagaagcactggtctggctgggcgcagtggctcatgcctataatcccagcagtttgtgaggctgaggtgggtggattgcttgaggccaggagttcgagaccagcctggccaacatggcaaaacctcgtctctaccaatatataaataaata

SEQ ID NO: 19558 - DNA, 504 bp, Homo sapiens
cttactaaccccttttcctacttatatgctttctctacattattctgtcagttacagtacaaataagatatcagttgctaatgtattaacatacagaagaactgatgtgaaggggcaatacttcgtcttcaccagaagcagaaactctattgatgtaaaggaaaattacatatgcagcttatagacagctaattgttaataaggcagccaataatgatttcctataactctactcaagcgtgccaataaatcgttcaatgccatcatcaaacatttattaaatacccacaatgtggcaaatccagaagatagaaggaagtgccattctcacctcaggaagcttacaatttatttggagaaatataatcacaaaattgtagttccagaaggacacttgaagtcaactctttgacaaaggaggtaatacaggcacagtgaggtcaaatggcttgtcaaaggccgtacagctagctggtagcaaagccggtaccagaaagcatgtct

SEQ ID NO: 19559 - DNA, 427 bp, Homo sapiens
ttatctattgctgggtaagaaattactacaaaacatagtgactttaaacacttgatcttagccaaaggccgagaagtgatatagtggcttaaaaaaatatgtacatatgaacttagtatatttttacccagagcactaaaggtgaccctaattgattttaaatccctgaaacaaggtgtcctgtattccaggccatctattgtctgtagatttgcaaatctttggattcatttctaagtgtaccagtttcttcacactttaaatgttcacacttttaaatgttcatgctttaggctgggcgaggtggctcatgcctgtaatcccagcaatttgggaggccgaggcaggcggatcacctgaggtcaggggttccagaccagcctggccaacagggagaaacccagtctctactaaaaatacaaaaatt

SEQ ID NO: 19560 - DNA, 534 bp, Homo sapiens
agagtggacgaagtgcaagaagggtgcaaggagccttctgcaggtggaactaaaggataggtgggacacttctaatatgagaaattgaacctaacagccctagcatacctctagagaataataggtgagacatttctatatacttctttgtacctggaaatcccaaagtgctgggattacagatgtgaggcaccatgcccagccaaatcttttattatttttaatataacttggaaatgctgttcgagacagaaagccaattttcacctttgcattagtacactattgatgtcaaccaattcttaataaaaccttatagacaaatctatccaattttagtttgatcataagataagattcttataaaccttgcatataaccctttacacctttttttgttgtagttgttaaaaagcagatcagtgctctaagaaaagcctgttgtgcttttattccaatgttcaatttatggaaaaatggaataatacacctttaactttagccgatatgttcacacacagaatttcttttaca

SEQ ID NO: 19561 - DNA, 467 bp, Homo sapiens
gcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaat

SEQ ID NO: 19562 - DNA, 406 bp, Homo sapiens
ggtcatgagagtttgagatgcactgtcttaaggcctgggtgaaatagtcacaaatcctggcttgtcctggggtaaggctgaggccagtctagctcagcaccttgatttttgtgggacctgataattcttatctatttagtaccctgggcctttaatagcaccttggttacaacccagataaggaacataggctcttcttgacccaccattttgcatgtgatttgagggcacattgaggggaggaatgtcacagaactgcaaaccgataatttaaaatgtaatattcccctttcctgtccctcagtcatttctaacaactgaagcccccggtgatgtttctaggcttcctctctccttcctgccttttcctcttctctacatttccatttccatgcatttattagct

SEQ ID NO: 19563 - DNA, 459 bp, Homo sapiens
ccatggtcagaactcctttttccccagccccaactcatacccacacttcaacttccacagctccacaccctgaagagtgaagcctctgggcttttgcacatactcttctgccacctagaactcttctgccacctagaactctgtccaacacccacttatcctttaaattcaatctcagcatttcctattcaaggatagcttcctagctcctagcccctgtctggtgaggtcctcctttggactctcacattgcccagtgcttggctctaggctgtgcttgccacagggctctggttatgtttctgtgactgttcccttactggactgagcagcggctgtgagaactgtggcttccacgttacatatccctagtagacatccataggatggaatgatgggtggatggaaggatggtggatggatggatggatggatggatggatggatggatggatggat

SEQ ID NO: 19564 - DNA, 507 bp, Homo sapiens
gataaaatataaatgtataaacctaaaactacatagaatactaaagaggagatgacagtgggtgagaagtgtaacaagttttccagagacagaaagaaggatgaggggtaattacctatagcatagagaaagctgagagttaagtgcctgcataggaggatgacatgaagaagcaagatgtctgtgcaacagaaacccactggatgtttcctggaatagaaatgccaagtacctcaagaagatgggattaagatttagttgttaacattttactgaaggaggagttattatccaaataccctttccaaaccatatagatatatgaatatcccttcttggaaaggtgattgaggaatgttgttctcagcaaaaattgagttaaagtaatcctagtttcaagaacactggagatagcagtgttgagtgctgagggcgagagtgagggcaaaaactgtcgtgaccatcagaaaggacataaaactacacattatatattacagctctgac

SEQ ID NO: 19565 - DNA, 506 bp, Homo sapiens
tcttagagcacactgacttccttgtttccactagcaatttatttttttcttccacaatattctacatattagtccttgtatacttcttgacttttccaggtttgtctatttatgtaaactgcattgccttacaaattattattttaaatttattttaactttatatcttcatctaaaccataattcattgcattctaaaaaatatcagaactggtcactaatcattttcatgaaatagtgtccaactacatgccagatagtaattctaatccaaatatttctgcaacacagaaatttttattttcacttgacagattaaaaactgaggctaggccaggcacagtggctcatgcctgtaatcccagcattttgggaggtggaggtgggcggatcacctgaggttgggagtttgagaccaacctgaccaacatggagaaaccctgtctctactaaaaatacaaaaattagccaggcgtggtggcacatgcctgtaatcccagctactc

SEQ ID NO: 19566 - DNA, 518 bp, Homo sapiens
caggccatggaagtggtttctcccctgagaccatcatttcaagacctatttgccctttgaggctacccacgtgtgaccctgggagatgtgtgtggctatatttcacctcaaaccctaacctcagcagctgtgctgtttggttgctcagccgcggagcagcaggtggccttctgctgttacccatgaaggggtcaagctaggccaggcctgctgggagcccagtgaagatttactggcagtgatgcctccaacacttctttctccagagcgagagcaacagcaggtgaggcatccatgaccagcctgtcactttcctcggggaaagagaaaggaagccatatgctgacctttcgtgtgcagaagtagcacagtcagagcatatgtccaggagctgcagagacgccatacgcatagcacagcctttgtccaaacacttttccaagaataaaaagacttcattaatgcaatgcactccctcacaccccccagacgccagctagcctcttgatgatttcacc

SEQ ID NO: 19567 - DNA, 510 bp, Homo sapiens
taactaatataaagttaatttgggacggcagagtggaggggaagttggtgtcatttgcttttaagagtatagaagaaaactacttccttctaattggagaagaggaagttataagtgctacatgttctcagcttatagttaagatgccccatgtagatctttttctgtgccacatggaaagtgagaacaagaactaactctgacaacaggttccaacatagacaaccctaaagatgattccctaaaccagtacccacagccagcaactgtaaaaaactataaagctcctaatgtcaagccagcatgtgatcttgaatcacacactaacatgagaaagaaataagaaaggcacattctattcaaagtctggagattagagtgacctgatttggctgtgattaataaaattaagaataaaaatatgttaatgaccttaaaatgcttgctcagaatccgtaaagcataagatctgctttctacatttatctgttttaacagtttttaagacta

SEQ ID NO: 19568 - DNA, 543 bp, Homo sapiens
tgcttctcttgtcagcatttttgttttgtgattattttctccagtacaatccctttctgaaatgttttccttcttaagtgaattcctcttgggtatatcctggttatttttcactatttgatattctttgaaatgtgtatccttgcattgttgccaaagcacctccctctggaacaactacagaataaataacagcagtatatatagtaaattctttccttgtgctcacataaagttttgcacaacttcagttaacatgaacaagatattagatgttctgttacatattaaaatctaggaagtaataagagaaaaaaaaaagcttttaaggctttgctttcatagctatggtagggcatgtttaagaattactcagattctataatgtttgcttgtgttacttcaccaagccacttgtttagtgttaactgaatgatgcaagcatttgtgtgatgcttcctgtccttgaaaggattcatctgaatgacagctaagccatcatgagaaagacagtcatctttggagatagactcacaaatccca

SEQ ID NO: 19569 - DNA, 519 bp, Homo sapiens
ctcacaatgcttgaaaatctttgtatctcacatgaaagttagacaagatgatgttaatgaatgtcagctggcatctctcttccactccctactacttgcccaggaatggaggctgtgcatggaccaaacatcatgggctcctgctcaccagtgctgatctatctgttatcattgctgaatgcccaatttgtcaacagcacagactgatgttgagtcctcaatatggcaccattccttgagaagaccaacctggtggcaggtggattatattgagccccttccacatgggaaagaacattggtctatccctgctgaagttgatacacattgcggacttgggtattctgcctggcttgcagagcttttgttggaaatcctgagcaaaggcttataaaatgcctgatctactgaaagttaaccgaaaacattgtctcacaccaagcgacccattttattgcaaaggaagtacgacaatgacctggggctaactaatctttgccatccccagagtcaatctga

SEQ ID NO: 19570 - DNA, 487 bp, Homo sapiens
atttgtgtgattatcttagagtctttaaaagtaaccacaaataaaaagcataaaataagatggtttaaatgcatactagtgtacaaataatcataataaatacgagtaaactctgttcatttaaaaaccagatattagattttatcatattggatttttaaagaagctatagcttgtttacaaaagataaaatataagcactcggtgaagttgaaactaaaagaatagaaaatatttaccaagtaaatacaaatcaaaagaaagcagatatagctgtattatgtcagacaaagatgaaaagcattgttagggataaacttgaactctatctaatgctgagataaactcactagaaagatctcactacacttgtgtgtatcatcagattgtttaaaagatcacaaggtcagaagatcgagaccatcctggctaacacaggtgaaaccccgtctctactaaaaatacaaaaaatattagccaggcatgg

SEQ ID NO: 19571 - DNA, 533 bp, Homo sapiens
gaaagatttttcaaggggttattttatcctaagacctaagagaaaaaatagaagctgatataattgggccaactactttatcttctttagagaatcagcaaacaaagttaatacgtgatagcattactctggcagtgttcagtaggctgccacaaaaatcttttttaattcattggcatacctgccaagtcaccattaaaagtactggacctctaagattaggaacaagacaaggatgcccacacacactacttgtatttaacatagtactggaagttcctagccagagcaattagacaaaagaaagagattaaagacatccaaattggaaagaaagatgttaaattgtccctgtttgcagacaacatgatcttctatatagaaaaccacaaatactctatcaaaacacctgtaagaacaaataaaataagtcaacaaagtttcaggatataaaattaatatacaaaaaccagaggcatttctatacactagtaataagcaatccaaaaaataaatcaagaaaacaacctcat

SEQ ID NO: 19572 - DNA, 468 bp, Homo sapiens
agtaagcaaagagaatggtttcaagttagagccacaaactgtctttactgctttttgcctgtcttcgtagcttacttagactttatcaaaatttacttctaaaaatatgcatctgaaactgaataaataatggaagttaagaaactctagaggccaaatatgagccatttcatttatacttgcagaaatcaaaaagcattttggcatttaacaacatttttttagggtacagtgcttttaagacattatataattacccttactgagagtacagtttttagctttgtcagggtctctattggaattataattccatgctgagcaacgagttctatcaaacctctattatcatattaaaacacttgagtaggccaggtgcagtagctcacatctgtgtggatcacctgaggtcaggagtttgagaccagcctggccagcgtggcgaaacctagtcaccactaaaaatac

SEQ ID NO: 19573 - DNA, 525 bp, Homo sapiens
ggtactcacaagttaacaaacttcaaaatgctatttgaaagggaaactaataacattaaaaagaggtcacagtactgtttgaaaatctacaaaggagtcatgatctttgttcaaggaagtaaaatattaaggaaatttgtgttagttgagttcttgactgaacatgtgctatgaatttctgattgtggaagctgcttcctattcgaaaataaaataaaactctcttggtatgcaaatgataagaatatgttttggtatctaacaatatctaaaagcaaactctctgcaaagtatcccagaatggtttacttaagaacatcctggctgaacttcaaagtagagcctactggaaaatatttacccagactatttgaaaagagatttgaaaagagagtttcattgatttccattgtccagctttatttcatggatttctatcatttgactgtattttttattatcagtatcattgccacaagaaagtattacagtcaagagatgataaataataatgatgatagtaat

SEQ ID NO: 19574 - DNA, 498 bp, Homo sapiens
gacacaatcaagttcatgatggaagcccttatgaggtagagagggagtgcatctcagctctttcgattaattaaatgattgtttgaattggagaaggtgtgggtattttgtgttgtttgggtgagtacattggaatggttttctagcattcctttgagattttccacagtataagttaaggtaaaagaacatttttacttgtttcagaaagcatactgaggaagctttaatgttactattaagtaggtagggaaatgaccaatattataaacgcagatttccagcctctccttttaatgctttcagaatgattccacaagaaccttgaaaatgttgagtatttatatttattttatgcccttttattgtgatttttttaataaataacatttttttcaggaaagcaattttgaacactcaactagtgagcccatataaaactacataacagcacagaatatagtaaaataataatataatgaactgggagacaaacta

SEQ ID NO: 19575 - DNA, 531 bp, Homo sapiens
gttctcatgatggttttgcaccatccccgcttggtactgtatagtcagtgacttctcatgagatctggttgtttaaagtgtgtggcacctccccactcccacccctacctcctgttccagccacgtgaagtgctggctcctcctccgccttctgctgtaattgtaggtttcctgaggcctccccaggagctgatgccaccatgcttcctggacagcctgcagaactgtgagccaattaaacctcttttctcctaagttaccaagtctcaggtatttccttatagcaattcaagaatgaacaaatacaatcacacatttaatagaatcagccacccacccaaatctgcgtttcaacttcctatagtttgtatcttcttcaattcatacttaatcacttcgttgttcttatttgttctgtaggcactatgtgataataaactcacttagcgttcacaacaactctattattctcacttcagaggagcaaactgaggcaaagcaaggttaaataacttgtccaaggtcaagagc

SEQ ID NO: 19576 - DNA, 533 bp, Homo sapiens
gaggcggaagttgcaatgagccaagatcacaccactgcactccagaccgggtgacagagcgagattccatcttatatgtatgtatacacacacacacacaatgaaaggttacccttagggcaataatagggtaatgattccagatatggaagttgtagacattaaatatctgtgagaaatatttgtgaaagtatattatggaaaaaatggaatatgcatgtaaacttaggctatgttgagtaaaataaaactaatgttttaaatatgaagaaatgaacagttgctcaatgcttgtttctctacacatgtgcaggaagtatataattcagtgctgtacacatatcacattggagcattaatcacagctgtgtcccactttacccaaacatggccacatagtctcttaatccaagcatttgggaaactactagcaatcatttagagtggaagcataatttgacaccggtttagcattccatttgtttgctacatccctctttatgacaagaaagggaaaaatcatgtaatactat

SEQ ID NO: 19577 - DNA, 535 bp, Homo sapiens
gattacaggcctgagccactgcgccgtcaaaaattggcttctttaaaagaacataaaacaggcagatctctgacaataatgataaagaaaggaaaatagaaggcacacgtaaacactactaaaatgaaaaaaggtcacttaactatagatacagtagaatttttaaaaaatcatagtatggtaactttgtgccaatatattttaaaatatgaaatgaaaaatttcctagaaaaatgtgaactaccaaaaataacttgagaaaaaataacaaacttaaaacaatattattagataatttgaaatggtagtcaaaaatatctctctgtcttttaaacacacacacacagacacacactcacatactctaatatgccagaggggagaaggcctcaggccttttataggcaagttttaccaaccttaacaggtcagttaattctttttatactattccataggggaaaaaaagaggaaaagcttatcaactgattttatggagctattgtaactttgctaccaaaaaaaaaaaaaaaaa

SEQ ID NO: 19578 - DNA, 502 bp, Homo sapiens
gggaagctccccagaccctagcaaatacatttctgttgggcctgccctgcttctgcactgtggactgcagaagaccacagttccagtgaggactcccccacatgctcttacacatagctattttttgtaagctatgtgtaagcttctgtttttcaaacattaacaactgcctatccaatggttccttcaggtatacatgcactatcataaagaattattcaggcggtggctcatgcctgtaatcccagcactttaggaggctgaggtgggcgtatcatgaggtcagaagatcgagaccatcttggctaacatggtgaaatcccatctctactaaaaatacaaaaaattagctgggcatggtggtgggtgcctttagtcccagctactcaggaggccggggcaggagaatggcatgaacctgggaggtggaggttgtagtgagccaagatcgtgccactgcactccagcctgggtgacagagagagactccatctcaaaaaaa

SEQ ID NO: 19579 - DNA, 102 bp, Homo sapiens
aataatataaacacttaactgctaatggcaatgattataaaatcaaagcagtatttcatgagatttagtgcgatgcctacaaaatgggggttatgttttctc

SEQ ID NO: 19580 - DNA, 530 bp, Homo sapiens
ccataacccagagatgagtaaccaagataaaaaagtaaaacacatacatttaaaaagacacaaaagtacattttgatacccactgaccacagtctatcagaagaaaaaaaaagtacacacaaaaagcatcaaggagatcattcaatgtagaaaaagagaagaaaacatctttaatatctgagttgaggagaaaaaggatacaggcagttttagaaaaaaggaaaggggcagagagatgtgtgacgatttaaagactttgaagaagagatctagacatctttgctgacttaatgtcaacaaaatgaaagagatacaaaaccatgtagagaaaagcaatgacagaaaaatgttgattctaatcagaaaaccaaattaagtgctcagtaaataaatagaaaagtagctgtgttcagggcttcaaagacagattccattgttttaaaaaaaatctgtgatcaaaacatgaatgttcattttactttttctttaagttatacatatatttttatatatatgaaatttatttatgt

SEQ ID NO: 19581 - DNA, 372 bp, Homo sapiens
cctgagcgcaggcaatcctcccacctcagcctccagagtagctgggaccacaggtacacaccaccacgcccagctaatttttgtactttttgtagagatggggtttagctatgttgcccagtctgctctcaaactactgggctcaagcaatctgcccacctcaacctcccaaagtgttggtattacaggcatgagccactgcgcccggcccatctggtcttattaaatacttcattctctgcaaatgcagacgttttctcagctctgattattttttctaaagtaatgaccccccacctggctagatgaatgcttctagcaaaggaaaagaccagaatgtgaaaattgtactgcaatagaacataaagcccg

SEQ ID NO: 19582 - DNA, 401 bp, Homo sapiens
gtgctaactggggtttcatttcttttgaaaggaaatttctgttctaaaacctttaaaaatgtgtaaattgccatattttctcaggaagtttcgtgtctattggcatatttaatattgcgctttagtagaaacgcatgtggttttgttagtgtctggctgtatttccaggaatttgtttaaatgtgtgatttaagtggggcatttctggagtagcaaattgaagggaacaagagatactgaaattcatgaagacaagatattgtgtcagttgtgggtttgacaacctagtaattttagcaaaatgatagtttcactctaacatcggcagctgaaattacttgaaactgtgtttaagacagtgtcaacggttgaaaaacctctgtctccttctttctctttct

SEQ ID NO: 19583 - DNA, 491 bp, Homo sapiens
gaggtgagcagaggctggtcgggaagtttcccggaggctcgccccgggaaccccgccccgccgccctggaagcccctgtctgctcgctggcttacccctaggacgggcagctcaccacttctcccggtcagttctgtttaagagaagctcctttctgcctgtaagcaatgaagtggaatgatcaccacaaagtggtgtaagaaaagaaaagtagacccgcagcggggtgtattcgtgctactgtttgtgtaaaacacagaaaaaagaaaggggtggtctgatgtatagtcatacacaccagtggttttggagggagtttttgtggatataccacattctctccatttatcagggattttgccctgacatccctccaccaccacgacatttggcaatctctgaagacatttttggttgtcataactggggaagtggagaggcgatactggcatctagtgagtagaggcctggaatgctgctaaacattctgc

SEQ ID NO: 19584 - DNA, 534 bp, Homo sapiens
catttaacattaatctaaataaaattgaaataaaaaagcagaccaaacttgtgttttccgttattggttgttatgatgaatgtaaatgaattatttctaggagggaaatcactcagtgtcaattgtatttatcaagaaacattcactcctattcaagttattcttttatgtcacatcaaactcctattatcttttatcacagtcattttctgacagttatatgtgataaagctatggtagctggtgaaatagataaaacaaaacaaaaaggtagtaaaatgggccgggcatggtggctcacgcctgtaatcccagcactttgggaggctgaggtgggcggatcacgaggtcaggagatcgagaccatcctggctaacacggtgaaaccccatctctactaaaaatacaaaagaattagctgggtgtggtggcgggcgcctatagtctcagctactcgggaggctgaggcaggagaatggcatgaacccgggaggcggagcttgcagtgagtcgagatcatgccactgcactcca

SEQ ID NO: 19585 - DNA, 535 bp, Homo sapiens
gccactgcgcctggcccttgcttaattatttcaatagcactgtaacaaagatactattactatcccattttatagctaaggaaactggtactcagaggcctcagaactggtaagtcactaaatccagacctggctgactctgatgcccatgccctgaacatagcacttcatataataaggccagcagagataccagagaggagacctcgatctgggagtcatttacacagagggatagagtgtcaaaaatagaggggcagggctgggcatggtgactcatgcctataatcccagcactttgagaggctgaggcaggtggatcacctgaggtcaggagtttgagaccagcctgaccaacatggagaaaccccatctgtactaaaaatataaaattagctgggtgtggtggtgcatgcctgtaatcccagctactcgggaggctgaggaaggagaatcgctcgaacctgggaggcagaggttgcggtgagccaagatcacaccattccactccagcctgggcaacaaaagtgaaact

SEQ ID NO: 19586 - DNA, 559 bp, Homo sapiens
cacccaggctggagtgcacgggcacaatcatggctcactgcagatccaagctcctgggctcaagtgatcctctcacctctgcctttcaagtagctgggactacaagtgccagccatcccacttggctaattttgtttcaagagatggggtctctcaatgctgcccaggctagtctggaactactggccttgagtgatcctcctgcctcgggctcccaaagtgctgagattataagcttgagtcatcatgccaggccagatggtgcacagtttttaaatgaaatatttaaatcatataaaaactcatggggaataatataacgaatataatacgatacaatgcatacaatgaacaacacaatggcctaatatatgacaagtcacctttattatctatggacctctttttacccctccagctctccccaccaatgaaaaccattatcaggccaggcacagaggctcacacctatgatcccagcactttgggaggctgaggcgggcagatcacctgaggtcgggagttggagaccagcctgaccaacacggagaaacctgtc

SEQ ID NO: 19587 - DNA, 510 bp, Homo sapiens
atgtgactcacagacgctgcatgcagcaaatgtgactaacacacatggtaaataacacacggctcacagacgctgcacacagcacacgactcacacagacgccgcacacagcgcacgacactcacacagacgctgcacacagcacacaactcacagacgctacacacagcagagtcacacagacccgcacatagcacacgtcactcagacgccgcacacagcacacaactcagatgccgcacacagcacacgacactcacagaccctccacacagcacacaactcaggtgccgcacacagcacatgacactcacacagacgctccacacggcacacaactcagacgccacacacagcacacaacactcatacacagcacacagcacatgactcacacagatgccgcacacagcacatgacacacagacgctgcacacagcacacaacacacagacactgcacacagcacacgagttatagacactgcacgctgcacacatgtaactggct

SEQ ID NO: 19588 - DNA, 488 bp, Homo sapiens
ggcacacgcttcctggggccattccacattcctgatgtcccatgtcagaatgacacatatactgctaattcccctatgcgagctctgatgctccagctctctgccctcccctccccgctcccggcagcatggcagcagctggggcctggcctccctggtctgcctgggttctagcctgtgacaggggcccatagaaaaagcactgaggccgggccaggcacagtggctcacgcctgtaatcccagcactttgggaggctgaggtggatggatcacgaggtcaggagatcgagaccatcccggctaacatggtgaaaccccgtctctactaaaaatacaaaaaattagccgggcatggtgggtgcctgtagtcccagctacttgggaggctgaggcaggagaatggcatgaacccaggaggcggagcttgcagtgagcggagatggcaccactgcactccagcctgggcgacagagcaagactccggct

SEQ ID NO: 19589 - DNA, 409 bp, Homo sapiens
aagaagaggagagtggatatcgatgggtaggtctgcaggggataccaaagacctcagttgggcttaacccaagatgtggatacaacagtcatagaggaagacatgtgaaccttaatccttactgcctacttgactacttcaccctcttgttatcatgggagccaaggagcctcctgggaatacttcataccagcctgaaactgaacttcagacatacaccacctggcatgtcacatggcctgggcagagttaggaaaacaggtcctcaaaagtctgttagaaaaagtcagggttgggccaggcacggtggctcgtgcctgtaatcctagcactttgggaggtcaaggcgggtggatcatctgaggtcaggagtttgagaccagcctggccaacatggtgaaaccccgtc

SEQ ID NO: 19590 - DNA, 532 bp, Homo sapiens
gggttggataccctaattgccctgaagtaattattatgcattgcatgcctgtatcaaaatacctcatatatcacataaatatatacatccactatatacccacaaaggttaaaaataaaaacattttcaagccaaaatattaaataatagatatcatactaaaagcaatattttagtaataatgaacataatctaattatttctattataaattcaataaaaattggatgggaaattcaatgagaaagaggaggtttaaagcaaatgaaggtagatgttttgcacattataaatataaaaaatcatgtgtgttttttgattatctgttgttaaattctagataaattgaattaggacataaaactttaaatgaaaaataaatgcagttagcatgagacagtaaaggaaatatgaaataaggtaacagaagtgagaacaaatacagttctgataataatgcttaactacaatttaaagaaaaacagcacccagaatgagtcaaaaataaatatacatatcagttggataaatg

SEQ ID NO: 19591 - DNA, 557 bp, Homo sapiens
ttacaggcatgtaccaccacacccagctaattttgtatttgaagtagagacagggtttttccatgtcagtcagactgctctcgaactcccgacctcaggtgatccacccaccgcggtcttccaaagtgttgggattacaagcgtgagccactgcgcctggatgcctccaggtttttaaacaagttagtgctattagatggcttcacacattgcagcttttatatgacaggctgtaaactgcctttgtgtaataagagttgtcagccttcagcaatgttgatgatgacatgctccttttcctgtctccgtcatttcactgtcctgtcagaaacggcgtagactggctggccatggtggctcacacctctaatcccagcactttgggaggctgatgggggtagattgcttgaggtgaggagtttgagaccagtcagtccaacatgctgaatccttgaatctactgaacaaaaaaaaatggccgggtgcggtggctcaagcctgtaatcccagtactttgggcggccgagacgggcagatcacctgaggtcaggacttcg

SEQ ID NO: 19592 - DNA, 497 bp, Homo sapiens
ttatctattgctgggtaagaaattactacaaaacatagtgactttaaacacttgatcttagccaaaggccgagaagtgatatagtggcttaaaaaaatatgtacatatgaacttagtatatttttacccagagcactaaaggtgaccctaattgattttaaatccctgaaacaaggtgtcctgtattccaggccatctattgtctgtagatttgcaaatctttggattcatttctaagtgtaccagtttcttcacactttaaatgttcacacttttaaatgttcatgctttaggctgggcgaggtggctcatgcctgtaatcccagcaatttgggaggccgaggcaggcggatcacctgaggtcaggggttccagaccagcctggccaacagggagaaacccagtctctactaaaaatacaaaaattagccgggtgtgatggcgggtgtctgtaattccagctactcgggaggctaaggcaggagaatcgcttgaac

SEQ ID NO: 19593 - DNA, 478 bp, Homo sapiens
taccaagggtatttccacctgcctcttttaatgtgaaagtatctaatacattactgggaaaagtagtctgtttttttaagactgacagtaataagtactcactgaattaggcacattatctccattgtcataacaataacctattctttgtgactttttatgcagatatgttttatacatttcaatgaattacatttaatatttacaattctgccaggaagatattgttatccaactcaaacagttataagaattcaggacttgaagaattaaagaattatatgacagagtcacagtgtgaactcatgtctctgggtcttcaaaccccaggctctttaacctgtgtctccttatctgaaatgaaaaacacaaaaggcagtaaattccaaacaacaacaaatacacacacagacacacacacacatacacacacacacacaggaatttccagggatattcatcaaaagcatttacttgc

SEQ ID NO: 19594 - DNA, 516 bp, Homo sapiens
gaaactgaagatgtgttagcattttcatgcagctctctttatgcctatccttttccaaatattattttagacagaaatgtcttgattaagagaggtgaagagaggtcaatgaaaagtacatggattgctttttcaatctagtgaaataaaaaaaaaagggagatttatctcttacagttattttcattgtcacattaaaccaaaatgacagctgtaattatttatttcaataatctggaataatggggcatttgagtgatcaaaaatatatatactatactgagggaaataaagactcccctcatctcagattaagagcaatctcggccagacgcggtggctcatgtctgtaatcccagcactttgggaggccaaggcaggcgggtcatgaggtcaggagatcgagaccatcctggccaacgtggtgaaaccccgtctctactaaaaatacaaaaagaagttacccgggcgtggtggcaggcgcctgtagtcccagctacttgggaggctgaggca

SEQ ID NO: 19595 - DNA, 510 bp, Homo sapiens
catatggtttcaagttttgatgcaaatctgaaggtgaggcattcaatttgaataaaagaagaacaaagtttgtttaaattaggccaattcaaacttgttctgtgaaatgaatgtactgtctttattgtttcttttcctttatgttgtccatagctttttgcatattctcttagaatcacagaactttgaacttgagaggatctatacaaattatgcatttgactcttctcacacagggggcttcttaaaactatagacttctgaacctcttttgcaaaaattataattcagctcatgaggaatggtcccaataatctgaattttaaaaaatgactcagggctgggtgcagtggctcatgactgtaaacccagcactttgagagcccgaggcaggtgaatcacgaggtcaggagttcgagaccagcctgaccaacatggtgaaaccccatctctactaaaagtacaaaaattagctgggcgaggtgtcacacctgtaatcccagctactca

SEQ ID NO: 19596 - DNA, 559 bp, Homo sapiens
caagatggtatttggccatcctaagacaaggttgactgaatcctaaaaacactgtggtatttcaaaactactccccatttaaccagagtcaactcttgattattggtactgatggcgaagaaaacagctttgaccatcttaaagaagctaatcagccagataacatttctatggaattttggaacattttttctgaatgtggcagaatcttatgttctgggaatttatttcaaacaacatgatgaagcagaactggaaagacttgactcgggtgaatctgggaatccatccagtttcccaagcctgcccctctgttcaaatctttccgttaacagtctcaatgctgggaatagactcttcatccatcggattaatgtaaagcatcacccagagcagagctgcccttactgaaatctttcttaaagttggaaatatcattaagtatttcatttccacagggcttccctgttgggacacaggatttatataaaatcagagcaatatgcagttgaggtcacaatgaaggaaagagaaaaatagcaaattgaaagcagaaaag

SEQ ID NO: 19597 - DNA, 457 bp, Homo sapiens
ctttccttctttccttctttctttctttcttcctttttgacggagtctcgctctgtcacccaggttggagtccagcggcatgatctcagctcactgcaatctctgcctcccagtttcaagcaactctcctgcctcagcctcccgagcagctgggattacaggcatgtgccaccacgcccagctaagtttattattattattattatttaatagagatgaggtttcactatgttgcccaggctggtcttgaactcctgaccttgtgatctgcctgccttggcttcccaaagtgctgggattacaagcatgagccaccacgcctggcctgccttataatttcactgaggttataaaacaacattgctgaactttaaatcctagcattcatgaccctgagcattttcttcttccttttttgtcattctcttctttgaagaccaagtcacctgttccttca

SEQ ID NO: 19598 - DNA, 505 bp, Homo sapiens
tgaggagcatccctggcagacatgtccccaggccaggtgagcaatcacacatggtacccctgactagaataatagcctcatggttccaaccccagtgagccagacatcaagttggccagtccgctgtgtacatgcatgcacccttaatctgagaaacagaccaataagtccacccccagcaaagccataccaccactgccacactcttttcagcatgggccactgagacacctgtaaatgtcactaacatgggttacagctaaagaaactacacagagaccacactactacatccacctagaaccaaagccaatgcaccttacagaatcaacatcccaagacccacctaaacaaataaatatttctctataaaacctatttcataaaattggaagtggtgactgtttcatcggatgcatagttatcaacataggaataggtaaaatgtgaaaaaaggacacatgacacttccaaagtaacgtacaattctccaataacagacccc

SEQ ID NO: 19599 - DNA, 423 bp, Homo sapiens
gaggctagtggaggtgagaagcctcacaatccatgtttttttaatgcatccgagttattccaaagcaaagggtatttctttccccttttgctctctaattgatgcagctgttgcctagcctcatctgcattaagctaaatattatgtttttgtaacgtttttgatctttattaattatagcgcaggaaagctgacaaaagcaacctgtctctttaatataaacaagattaattgcacagttcctgcagaaaatgaactaccagcagtttaacaaaaaatgtttgtctttaagcagccctttggattaaaaaaaaatcaaaactgttacaggaagtgccaaagctgccaaattaccatgcccgtgagcctcaccctcattatcagactaaacgaacgcacacacccctgcactttcatcctcct

SEQ ID NO: 19600 - DNA, 413 bp, Homo sapiens
agctaagatgtctagtgactgatttaagagcagatgcagaggaagccctttacaaaatgggacacgctcatggctgcctttctagatcagtgatgttgaacttttaaatatgtttattggcttttgtatttcttctttgtaagtttccaaaggaaatattaggagaatttctgaaccagagcccatgctatggctatttgactttgcagtagacagaagctcttgttaaaacaggtgcgcctgaggaactgcgtttatgcgtgaagaacactctccatttgcccctgacgtctgcctcactcttcccagattgaacctttattatcccatgctgggctgggacctcattatggaaggcctcgaaagccagcctgcggaggttgaacaagggagtaggatgatgagagttctgc

SEQ ID NO: 19601 - DNA, 172 bp, Homo sapiens
tgaaatctagagtaaaaccaagctggcccaaggtgtcctgcaggctgtaatgcagtttaatcagagtgccattttttttttgttcaaatgattttaattattggaatgcacaatttttttaatatgcaaataaaaagtttaaaaactcaaaaaaaaaaaaaaaaaaaaaaaa

SEQ ID NO: 19602 - DNA, 531 bp, Homo sapiens
  misc_feature 85: n = A,T,C or G
cttattttcatgatcgatttggaacaagccccatgtattaatgaatatatacttgtgaaaactatctgagcaaaaagataatgtnaacatttaattggcaaaaagacgggtggtccaaagagacagctgtaattcactccgcctccctctgcatgcttcactctgtccaggggcagcttttacctcctgctgggctatcacattccatggatagaagggccattccccctgggcaggagacacagacaccgcaatcagcatttaaagttctggtaaataaacattatcacttctaagagtgactggcttcaggaataccactcggcagaaggctaggtttcagcttcagctcggataatgtatcatagaatgatgcattctaatgcattcttcggtgttaacacgacagttccctaagtaaactgaactctagtaaatatactcttcaaagcaattttttgacttcttttccagcagcaaggtacttcttttaaaaggaaagaaataagcaaaacaacacaaaaaccccat

SEQ ID NO: 19603 - DNA, 76 bp, Homo sapiens
taaagagtgttttagatcaccccctccccaataaagctaaaactcacctgagttgtaaaaaaactccagttgacac

SEQ ID NO: 19604 - DNA, 385 bp, Homo sapiens
gataagcatgggaataaaagaaagttttgaggaagaggggacagtttttgtttacttaatgattattccaaagatgttaagtaaacattctatagaatgcaacatatagtggaatacagcattgaaacaatttaataatgtagtcaatgaatccagtttttagaaatgggatccattttctaaaactgagcatacagatacttcatgagatgctttatcactcatcctaaaccaaaccaactccttcccttgactgtcttgcagtgcatagggcatctctacactctaggaaaggaattatcaatctgtttatatgccacttataaaatcatacttaatgtacgattaggcataaatttacttgcatttttaaattttgtaaaat

SEQ ID NO: 19605 - DNA, 288 bp, Homo sapiens
  misc_feature 158: n = A,T,C or G
cttttgaggggataaggaagttgtgattagtctcagtaaatgttgcaagaagttactggggaagattcgctctcacactaatctttacgtagctcatggacgttcatcattcagtcatgacacactgaccaagcacctaccatgtgctggacttcggngatacaaatgatggatgagtacctgacagtaaaggcagttaatggtggggatcgcaggccaacagatcaccctgacacagtgcagcaactgcaatcctaaagaaatgtacagctgtaatcccagcacttc

SEQ ID NO: 19606 - DNA, 242 bp, Homo sapiens
gtgttggggctattgtgcccggcccttggtctttttatcatcaatgcataggggttcttcatatattaggagaatcagccctttgtttatgagctgcagataatttccccagcatgttgtcctttgaccttgactttgggttgttgctcagtgaacctatttttctatagtcaaatttatcaatctttgcttttgtggttgctaaattttgtctcttgcacagaaaggagcaggaaccaata

SEQ ID NO: 19607 - DNA, 411 bp, Homo sapiens
aaaagccccttataaaaccgtcagctctcttgagaactcactcactatcaggagaacagcatgaggataaccgcccccatgatccatttacctctcactgggtccctcccaagacacatggggataatggaaactacaattcaagatgaaatttgggtgaggacacaccatgttactatgcttgtcccagaaaattgtttactcttaaaatgatttcaaatcataccaagtactgggacttgttcatacacagaaagtcaaggcacagagatctgatgcaaactacttaaaagcaggatggtaggcagctgtatattgactggctttttctagcctatccctggccaactgccctggcaacaattacctggactcaaacaattccatgttcagcctttgccaacttggaga

SEQ ID NO: 19608 - DNA, 489 bp, Homo sapiens
tgcaagacctctagataaaaacatatctttatatctatgtttatatctatacctagatatacctgtctgtgtctatgtctatatacctacatctatatctataaccaataaataatcaaaattcagattgggccaagacttttcttctcagaaacatttgcaagaaaatctagggcaatatttacatagtttgagggtggggaggatataaccaaacattgtctcaggccaaattgattatcatgtataaaggcaataaaaattcacgcttatatttggaaggactcataaagtacatcacccatttatttatcattcttcagcaacttgaagaaacacatccaatgatatagcaataaaaggaaattaagcttatgagcaaagaaataatgtttttgaagtaagggcatagtacacgaaagctaattttaaaaaatgaattattttaatgtggatgcacagctcaatcaaaattgcaaaagtattaat

SEQ ID NO: 19609 - DNA, 371 bp, Homo sapiens
tatggaggacatcaattaaaatgatatagatgtgcctttgatggagtcagaccttggagtctggcaaatttccttggcaagatctgaccattttattcagtaaaggcctggcaatgaataaaagatgtttgtttgtttgttttttttccacagtatttaagtagctaaatttttccttccatgctaaggttctgattaagttacctcctagtaatattagttttgatttccaaaataatgtcgaacattattttccatttccgttaggctagccaaccttttgggttagacaaaagattctctagctgcttttaccaggtgcacgcataaattaactcatcctcacgaaaagtcactctttaaccatatgc

SEQ ID NO: 19610 - DNA, 250 bp, Homo sapiens
cacgatcgatttggcttcatccctgggatgcaaggctggttcaacatactcaaatcaataaatgtaatccatcatataaacggaaccaaagacaaaaaccttgatttttaaaatgtggatctatttgactttttatttcatgtaagaatcactgttaggaatatgaaagtatatttcagcttaaatatagtgacattctgctaccctatatttaaattgaacctaaattaaacttgtattaatcagtatc

SEQ ID NO: 19611 - DNA, 524 bp, Homo sapiens
gcattcttttaaatgtatggataagttcacaaaaaagaaaatccaagtcatcaggtcacaaattaagaaggaactgaaagccatatataaactgcagctgctgcagctgggaggctgacagatgatgttggtctcggtaactaaggggcttggattttaaaacccacagaaagccagaaagcaaggtcttgggccccatgtgaaacaggaaaatgaaatccatgctccatgcccaacctcacctgcacaaacctgggaccctcaaaggtctggtatcttaaacaaaaggtgaatcgggaaaaaagaccaagaaatatctcagtggtgtttttatcttccctgcgagatagcaggaagcttggtcatgtctgcctgggtttggaatagggacagagcactttgtagaaattggtgccccagagaatttttaacaatgggcctgcacctcaaattcctactacccacataaagaacccctatgacaagaaaacaaaaaatttgtccaagtcagtgatacctactct

SEQ ID NO: 19612 - DNA, 515 bp, Homo sapiens
cgatttggatgtgtgactatgtgatgtaaaatttctcctacatttatattagtaagtcattgttatttgtaagcatgacaataatcactttattaaatatatagtattattaagcaggattctgcctgtattttatgtaaaatacgaataagttttgaaagacaactatgaaaacatatttatactaatttatgtactgatgtgtatttggtcctttcgtttataaaaaattaaacaatctttaaactgtggacttttcatttggttctggtttgagtttgtgtcctgtcacatagatggtaggttaagtacatggtagaaaagttcatttttagaaatctgaaaatcaggccaggcacagtagcttatgcctgcaatcccagcactttgggaggttgagtagggcagatcacgaggtcaggagatcgagaccagccatgaccaaaatggcacaaccccgtgtctattaaaaatacaaaaattagctgggcgtggtggcacacacctgtaatccc

SEQ ID NO: 19613 - DNA, 424 bp, Homo sapiens
gggaagtttttgataggtctcctttatcctatgtaatgctgacaaaggaaatttgagtgactgatattagataaaaaataaataaataaaagaagcttaaaaagttacaaacttcacagaaacactacaattcaagactggaagaacttacaaataggcttatttgatacatatggccttgtcaatgattctacaaaatcattaagcttccaaaaattgtaattaacacatgcaagttacactgattctttctacatttattaatgcaaatctctcatgtgacccttagctttttctatattctccaaaggaaaagagtgttaatgtaagttgatttttttaaattctagaatataaaactaagtgcattgaagaaaccatggaaaacacaaagacgtctataaaagaattttttaatcataat

SEQ ID NO: 19614 - DNA, 119 bp, Homo sapiens
agatcacctcaaggaactagacaagcaaaaacaaacaacactcataattcagataaagtatctatctgaacaatacaaaagattgaagtagcaaaaattgcatttttgaaataataaat

SEQ ID NO: 19615 - DNA, 268 bp, Homo sapiens
tttcaccatgttggccaggctggtctcaaactcttgacttcaggcgatacacctgcctcggcctcccaaagtgctgggattacaggcacgagccaccgtgcccggccagcagcaactatttttaaatagcccaagagtttaggcaaagttctacccttccttccatttcctctaagttactgaatcttgtcaatcctaatgaacacagcagacattggataggccataaagcttaaggcagcagaaaaaaattaggagtaaagagttt

SEQ ID NO: 19616 - DNA, 260 bp, Homo sapiens
cctgaaattgcccctgcccttagacactctgggtaggccaatggtcaaggtttttctaggcagggctgtgaggggccctggaactcccgtagtgtggctctggggttctcagcagttgcagttcccaggggctgatttacctcactcccagctggcttgatgggggagctgtaatcggcccttctgtacaaggatctgttcagacacccccagaacctgcccacagcagcaccaggcacttccagggtcatttaccccac

SEQ ID NO: 19617 - DNA, 323 bp, Homo sapiens
atgaaagctcccacgcgccgggtgatagtttactggattgtaacccacagaataaaaagccacgagcccacagtgacgcacacgaacaattcgctgagtgaagagtcggtgtacacggagctgccctttctccttcctggccctggtgggagaatttttatcacaagtgggtgatgggttttgtccagtgcttttccatgtccgccgggatggaataaacgtgacgtttgtctgtggccctgtcagtgtacagcacgtcacggatcatctgcatgtgtgcccaggaccggggcagtcacccagcagatacgcacgtgggaccc

SEQ ID NO: 19618 - DNA, 316 bp, Homo sapiens
gaagagtgtgtccctttaaagccccaccagggaatttctgagagactaaagaaactgaaaggaagcaggaaaaaaaaggttagggggaagtggaggggaactgtgattcaaacaattttctgtttattttatttaagtttttatttttcaataaggagattgtcccttaggcctccttaaatcatttattggttaaaatttaatctgatcattagtgcattcttacattagtagcattttaaaattgttgattctttttcttggaagttattctaccattaactagcattttgtttcacagattttagtcatcatc

SEQ ID NO: 19619 - DNA, 387 bp, Homo sapiens
ccatggcacagtgctgagaggggccaggaggaagattactgtcacatctcctactatatgtatctttccttaagaagcactggttggccgggcgtggtggctcccacctgtaatcccagcactttgggaggccgagacaggtggctgacttgaggtcaggagtttgagaccaacatggcgaaaccctgtttctactaaaaatacaaaaattagccgggtgtggtggctcatgcctgtaatccaagcactttgggaggccaaggcaggcggctcacttgaggtcaggagtttgagaccaacatggcgaaaccccgtttctactaaaaatacagaaattagccgggtatggtggcacatgcctgtaatcccagccacttgggagtctga

SEQ ID NO: 19620 - DNA, 369 bp, Homo sapiens
cataatggcagggctgggctccatcctgtccactgctgaccttagccatttaaaggatgaatgagataataaaataagcttgacataaagatgagatttccagtcatcagagctgcttacagatggaataaactgtcccaaaaaaatgtgatatagaagcagaaacaagctaactgatgtattccaggtcttgactttaatccaggaacttctggatatttaactttatcattgactgagctccagtgagctaaatatttttgcatgcattatctcactaaatccttatatctacaccatgaagtaggtaaaattatctttattttacaaataatgaactaaagctcaaagaggccacaatcaggggaa

SEQ ID NO: 19621 - DNA, 513 bp, Homo sapiens
atggagagtcttgcactgccacctgggctggagtgcaatggtatggtctcgggtgcctgcaacctctgcctcccgggttcaagcgattctcctgcctcagcctcctgaatagctgggattacaggtgcccaccagcatacctggctaatattttgtatttttagtagaatcagggtttccctatgttggccaggctagtctcgaactcctgactcttgatctgcccacctcggtctcccaaagtgctgggattacaggcatgagccaccgcgcctggccaaggatttgtgaatcttaaaaaagcaagattttactaaccttgttcataattagttttaaatgttttattcttacgtttgcattgagatggcctaaatcacaaatcatgttaggaaataacatgaaaattagaggctggtgtgtttgcgtagcaccagcctacacaatggagtagccacacaaccattcagcgtggatggcatctgcttttctgcatcacttgctacctgacaa

SEQ ID NO: 19622 - DNA, 332 bp, Homo sapiens
tgatgtccaccttgggtggatgtccacctggggacagatgttcacttgtggcttgagtgtccatctcgtgtctaatgtctacctggggcctggtgtttgcctgaggccttatatccacctggggcctgggcatccatttgaggcctgatgtctacctaagacctggtgtttaactggggcacagacttcttcctggagcctgacgttcatctggagcctgaagttcacctgtgcctgttgtctacctgaggcctatgtgtcaacctagtgcctgatgaccaccctgagttcagtgttcacctggggcctgacatctgtctggagtctgggtg

SEQ ID NO: 19623 - DNA, 534 bp, Homo sapiens
atcctcattgccctgtgaactctcaacccaggaatttggctcccctccctaactctctaagtacttcccttacccactcagtgtggtgatggcacctccctgaatctcctggcaaatgcgaacaggaactcctattcatcagagccaacttgataactgagaagattcctctctcatttatcagcctttgattatctttttgtgtctcttactatttgcgcttagcaagaaaaataaagaggtttgaacaattaagaagtaacaaagagctcatagttcacaaagagcaagtcaaaggatgtctggaatatttgaacatacaactgcctttggcatgaggtggcctacatacattctcaggggcaggataggctggagagctgatcaagctgccgggaagctgaagcaaaggcagggtggtggaatcaaatgtctcttcaactgaagactttaaaacttgggctttagctgggcgcagtagctcacacctgtaatcccagcactttgggaggtcatgtcgggtagatcacttga

SEQ ID NO: 19624 - DNA, 345 bp, Homo sapiens
tacttaaatcatctttactacctgagacttacaaatgacattctggacttaagtgatgttgctttaacttagacatatgcccaggagtgctgtttatccttccatgatggtgggagtagaatagatgatagtagacagttaatctacatttatatttagctgttaagtctttggcagaaagtggggaagacatgacaaagactagattcaaattcactctctgggtaaacagttctaggaagaactgatttcacagtgcatacttttttttcccccccccgagacggagtcttgctctgtcgcccaggctggaatgcagtggcatgatctcggctcactgcaccc

SEQ ID NO: 19625 - DNA, 456 bp, Homo sapiens
agaagcacagcaatatacattcataatatacgtacaactgactagatttgtttgagacaagagtggtgggatcagagccatgtggagagctcatggcctgtctaaattgttgtcatgtggaaatggggcagagtgttgccaattttctgattttttgtgtggaaaaaaatctccaaattgtagtttttaaatttggggaatgcaaatatatatatatatacacacacacacacacacatacacatacaatccatatacatatggagtatgtaagttggcaataacagtatacatcaaaaaatttacaaacactgcaagacaaataaaatccaagccatccatttgtgaccacagtcataagcattcacttagccaggggcttttagataattgtctgtgaagtctgagaaaagactaagataaccaagatgaacataatgtcaaaggacgaaatca

SEQ ID NO: 19626 - DNA, 380 bp, Homo sapiens
aagctctctgagatcacaagatgaaaggcctgatggcagttcaaagccttccttttgattattattctagtcaacatattttggggggagaaaataggcttaagatcacagtggagtaaatttcataaagagcagagtacaagcacaccacagaaatggacccaaacagagagtcatgttgccctgctaatggaagcactcaggtcttacgggggtagggagtgcgggtgtgttaagaatcaggccacctggagagtgatatttgctgtcttggattagtaaaataaaaatgcccattagtcttccacagctaccaaaagccagtgtgagtccaccttggccagttagttagggccagtgaccaagcacacctgcagcag

SEQ ID NO: 19627 - DNA, 127 bp, Homo sapiens
ggccctgcagtgtacgttctcacctcttatgcttagttggaactaagcagtttgtaaactttcatccttttttttgtaaattcacaaagctttggaaggagaagcaataaatttttgttttcaaatg

SEQ ID NO: 19628 - DNA, 304 bp, Homo sapiens
aaaaattttcagacatggttattatgatggctagatcatttcatcacatggcctgtaccacactttctttaaaggttcgcccggtgtcaaacatttagattctgtcaagtttttgttatcagaaatgactcttgggtgaacattcactatgacaatcttacatttttttcctcaggctggaatccctaggattgggcataaacagtttttaaagttcttagaacattttcttacattcctttttctcaaagttataccaattacactcctgccaagtggacattaagatgcctgctactattat

SEQ ID NO: 19629 - DNA, 327 bp, Homo sapiens
  misc_feature 141: n = A,T,C or G
gcaaacccaggcaactgcaaaagagccacaagaggaagaatggggaggagcaggaaccggcatagcgggaatcggatgcgggctgcactcctcgttaaaagaccacccgactgggctgaaaacacgttgcatgcgatttanagaagcgtgattatgggccggtgataaggcttcgaataaagtgatgccggctgggctcagtggctcacacctgtaatcccagcgctctgggaggccaaggcgggcggatcacgaggtcaggagattgagaccagcctggccaacatggtgaaaccacgtctctattaaaaatacaaaaattagcta

SEQ ID NO: 19630 - DNA, 365 bp, Homo sapiens
atatcaaccttttgaaaaagatttttagggtagaaaatcagttttcttaggtcaatctgacagaagtttaatctaaaaaaaatcaactgggcaatatttttaaacatacaattataataaaagtatactttgtaaatatatatatatatgaaaaagatagattcacttatttttagaagctaggtctttcaagtgctgtaagctgccaacattctcattcgtgttaaatacttacaggcttcaagggacttgttttagcaaacaaacaaacaaaaaagtaggccgagcatggtagctcatgcttgtaatcccaacactttgggaggccgaggtgggcagatggcttgagctcaggagttcgagac

SEQ ID NO: 19631 - DNA, 459 bp, Homo sapiens
acccacctttgactgatggggaaagtgacgtttgaagcggtttatgcaaggtcctatagctcaggattcaaacccaggctctcttgctttaaagcccacctgggcttttaatactacaccaaagcctcctgttatctcgtttgtccttgaaccccccacagagaagctggaaaaataaaaaaaacaaggacgacacacaagcagaaagtgatgacctgctgtttgtagttgatcaaatgccatcgatgctgcttatgtgacgtggtgtccatgcaccatccatttttatttttcaggtcttagttacagtcctatgtaatgttcgcatgtcagcatttgaaggatgtgtgggtgctcactgcctggaatgtgatagtgaggactgggggagcccacccagtgcagtgacatcttggcagggatgaatgactgatgtcatttattataaacttgaacctg

SEQ ID NO: 19632 - DNA, 497 bp, Homo sapiens
tcaaaatctctcagttgaaaaaccttatttttgagactgctacagtgtgaagcatctcaagagcaggtactgagccctcggtaatagcctttgttctgtagggtattgaagttgtatatattggagatactagacatttaagataaatgtgcatttatagagtaaatgtaagtattctgctataacagaatacttgaggctaggcatttataaagaaaagaaatgtatttggctcatatttctggaggctggagagttcaaggagatggcagtagtgtctggcaagggcttttgtgctgcatcataacatgctggaaagtgaaagggaaatttagcatgtgcaaaaaagacaaagcacaagggagggggttctcgctttataacaacgtgctcttatggtaatgaatccaagcctacaagaatgagaactcattccctgaagaattaatgaagaccctctagaaaggcattatacctcttaatgacctaatcatttc

SEQ ID NO: 19633 - DNA, 233 bp, Homo sapiens
gatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatac

SEQ ID NO: 19634 - DNA, 316 bp, Homo sapiens
cctagattcaaggactggaagaatagatatctcttaagcgttctactgaaaattggaaatgcctgatcactgccttccaaactatgcataaaacatttccatcaacccagaaatttctcctgtgttctctgttgattccttttctcaccacctcctatttcttcaggagaccaccttctgattcctaacactgtaagtgttggtatatttttggatacacaaaatcaaaaattcatttctgtctcttttctttaatatcatgtgtttcagaataatccatactgttgcatgcatacatgttcttttaagtttattg

SEQ ID NO: 19635 - DNA, 379 bp, Homo sapiens
gacccaggctggagtgcaatggcgtgatctcggctcactgcaacctccgcttcccaagttccagcgattctcctgcctcagcctcccaagtagctgcctgaacgctggtgccagttaggccaacagtcatgtggcaatggctatgaattgcaagcattgctgattgttatctgctgctactgcctttgagctggagcggaacagatcaacatgggccaaacaagagcctctttggagatttctctactgcttcaagcacacagattccaagtttagaagctcaagagaaggttgaaaataaaatacatttagtttttgtcatctacctgggattacttcactattgaaaaaaaaaaaaaaaaaaaaaaaatttttgggg

SEQ ID NO: 19636 - DNA, 360 bp, Homo sapiens
tacatagttgctacaatatattatctgaaatatcaagttttccaccaaaaattactagacatgtaaagaagtaggaaagcatggctcttaagaaaagtacagtaagaaattgagagagatatttagcaaagacttaaaaaagcagctgttataaatatgttcaaagaattaaagtaggctgggcgtggtggctcactttgggaggcccaagagggtggatcgctggagctcaggagttcaagaccagtctgtgcaacatggtgaaaccccatctctacaaaaacatacaaaaaaattagccaggcatggtggcatgtgcctgtagtccctggaggctgaggtgggaggattgcttgagcc

SEQ ID NO: 19637 - DNA, 91 bp, Homo sapiens
tttctcacatgccactcttttaaaataggtatctatgtatgtgtcaacaacctttgaataagccagagcaactaggcaagaaaaaaaaaaa

SEQ ID NO: 19638 - DNA, 409 bp, Homo sapiens
ttagctgctagttttacagaaactttgttctgaaacaagattgcattttctggcccttcactgcacttttatttcttcaactttaatattttggtagatggtttttcctgattttggccatgctttttgtatatgctgaaattatgaaaatctctgacttagcagggctgcagcattgacagaacaatggaatagttttcattcaggctttggcattgtggctaagcggagtgggtgtcaacttgtgtactagaactttgaaatatcaggaagattcctttgttctcttatgggtcctcccagctagcaagaatgtgcctaatttctttctttggcttaagcctttgatccctagtaaaatacttatacaccatgagtaatcatctacttcatgtcattgatatgattc

SEQ ID NO: 19639 - DNA, 659 bp, Homo sapiens
  misc_feature 574: n = A,T,C or G
tttaattaccaggatgtgcttcttgctattcctggaactctgagaaggcttcaccattatggtcctattacttggtctttcttctgcctggaatgttcttccgtcttacatttccaaggttcaccctttttctagctccaggtctctgcttaaaggcacctaatcaaaaaggctttgcttaactatcttattcaaataacaagcctcttcacagcattactggatcatagtgggtgctccaaaatatttgaatgaatagtcaatatttcaaggaatagtctccatcttggaaatgagtaccttgtggcttaaattgtaggagctaaagcgttaggaactaaagaagattttcaagataatattgggatttatatccccataagataactaaggttttgaagtaaaaaaagaattggattaaagtttctgctctagaatttaaaaatataaaaacagaacatttatttaaggcacaagtgggagataagtgatgagaacacattgacacatagaaggcaacaacacacgctgaggcctttcagaggttggaaggtgggaggaaggagaggatcangaaaaataactaatggatactaggcttcatacctgggtgatgaaataatctatacaacaaaccctcaacacaagtttacctgtgt

SEQ ID NO: 19640 - DNA, 528 bp, Homo sapiens
gttcacgccattctcctgcctcagcctcctgaatagctgggactacaggcgcctgccaccacgcccggctaatttttgtatttttagtagagacggggtttcaccatgttagccaggatggtctcgatctcctgacctcatgatccgcccgactcagcctcccaaagtgctgtgattacaggcgtgagccaccatgcccggcctatcttcactttattaaaaaaggaaacgagtgaggattacagccccaaatggacattttttcctgggtgctatgaaaaggaacaatggaaaggaaagggaatatttgtcttcttttgttttattgggtcgtgtttgtttgtttgtttgtttgtttgtttgtttgacagggtctcgctctgtcgcccaggctagagtgcagtggtgccatcatagctcactgcagcctccacctcctgggctcaagcgatcctccagcctcagcctcttgagtagctgggactacaggcacatgccacaacacccggctaatttttcctttttttt

SEQ ID NO: 19641 - DNA, 664 bp, Homo sapiens
gtgctcttattcaggtcaagattattcacatttggaatactgcaataatatcctaaaaggtcagcctacctctggtcttgtattcctcaaagcacttaccatgataaccattttaaaccctgctaagcaaacctatcacttccctgcttaaaatcttctagtgactataaaatggatgaaggtcaagcttctccactaaacatagactatctggcctggtccttattctcatcactcacagttttatattctgaattttgcggctccaggagccctgaattgcttgcattctaccctctttcctttacgtaccatcctctcccatgctttctcctctgcctaaaaaggtctccctcacttcttcacttcagctggctaactcctacacatctaaaactctaccactcatagctggtaatcttagtggtctttcccacagagcccagaagcagcatgagaatcttccagacactaactacccatcaattgactggagttggcaacacagataaaacacacttgtctttcctgatctaaattattgctcttcttcatttatatgatgtactagcaaaggcttgcttccaacaagtttgttaaaaagaactaaggatacttaaatgctggattgaataactgagctgatttgatcattaatctttgc

SEQ ID NO: 19642 - DNA, 582 bp, Homo sapiens
ggtgaagcatgtgctcatatcctttgcttctttttaaattgtaggggaatttatatcctcagattttttattctgttgaaaagcaattctactcttcagtattggtaacaaatagtcctgatgtttcagtggctactagcataagtctatttctctctcgtgctgcctgtctatcatgggtcacctgagatctgttcctgatcccttagtacaggcttctcactgtgaaacctagcctggcaccttgccccatctggagtgttgttgattggcatggcaaaagtaagccatgctctaattaacatttctacccatgagaaatacatataactttgtcttatatttaattagccaagcaggccatttggcatgccttaacttcagaggtggggatgtccaatctttccatgtccctaggagaagaatgtagccatagtgacaacagcaacattgtcactaataataaggtatctaggcagttctcatgtatgtcatattctcttaccgtttcttttcaattaaatttctaaaatatacctgtaatctcagcactttgggaggctgaggtagtcagatcacttg

SEQ ID NO: 19643 - DNA, 550 bp, Homo sapiens
catataaacccatcgtaaggaacccacactaaacatatccttagctcaatttctctttacatgatgtcctaaataccatttaacacgaggaaacatttgagggatgatgaatatgttgattatcttgattgcattttatgggtatatacatatgtcaaaacatcaaattgtatactttaaatatgtgcagttttttgtttgttaattacacttcaataatttttttcggaagtaatgtgtcagttggagtctaattaagaggcagaaaatacacagtaatttgaaaagagaaggttttatataaagaataattaaccgtaatttggggtcatgataaagacatacaaaaaactctaatgaaaaacgtaagttttaggaaaaacactcaaaaaggagcaaacttggaaaggggtgccctcctcaaggctgaattacggcttcattggaaagctgtgctcgcagcccactgcatggcagagaagttcactggattgcctgaaccagagttgccccacagatgttggccaaacaggaaaaacagacaaacaga

SEQ ID NO: 19644 - DNA, 582 bp, Homo sapiens
tgtcctggcgatggagatggctcccctggggccggccgcactgctggctgttgtccgcttcctgaagagggtggtggccctcggggctggggacccagagctgttgttgacaggcccctgggagcagctgagccaaggcgttgtatctgtggccagcctggtcctggaggagcaggtggctgacacatggctctccctccgtgaagtgaggctggcagggctgggtggggcaggggcctgggctatggttccagcctagccaccagctggttgtgtagctgtgggggagtcagcatctagctatgggctccatctctgcgtctatcctgaaaagcttctcttttgtctatttgataagttgaacttccacaaacaattgcacttgaggctgggcatggtggctcagcccataatcccagcactttgggaggttgaggcgggtgatcacttgaggtcaggagttcgagactagcctggccaacataatgaaaccctgtctctactaaaaatacaaaattagccaggcctggtagcgggcacctgtaatcccagctactcaagaggctgatgcaggagaatcac

SEQ ID NO: 19645 - DNA, 455 bp, Homo sapiens
cgacagaagggatatccaatatcctcagaacagttaggaaactgcttaactagagcaagaaggaaaattatccaagccccaaacctgggaaacatcaatgcctacgaaatgaactgaagaggaagaaacaatagaggcacaagaggaaggaccaacagaagtaatggacacacaatgttctactgagtctatggatgacctgttgagcagatcatccatacttctctaggggttctgaaagacactctcctcttgttgggaagacaaaaagccccactctgctactaggtgcctgagtctaggtgcttctcctccctgtcctttcactcccagctctgtcttctctacctgtccctagaaggttcctgtctttgtcacctcagatattcaagattcagctccaagatgccatctgtcttcgaagcatcagagctttgctgaccctcccgcattag

SEQ ID NO: 19646 - DNA, 504 bp, Homo sapiens
taggactaaaaaggcattattccccgttcctcttatcaggaacctcattgacagaggcatttactttctatgaatacaaatgactatggctattgtgattagaagcagaagaaaaccagctcatgaaccagaccctgaacacaatatctgggggcatgacagatatcccagtcactcctggagcaggggagagagctgaagaggcatcacgttaagaagacgcaccagtgctgggcacatttggtgaatctaattaacaggggcaacttgtcggctgggcgccgtagctcacgcctgtaatcccagcagatcgcaaggtcaggagatcgagaccatcctggctaacatgatgaaaccccgtctctactaaaaatacaaaaaaattagccaggcatggtggcgggctcctgtagtctcagttactcgggaggctgaggcaggagaatcacttgaactagggaggcggaggttgcagtgagccgagatcacaccgctgcactccag

SEQ ID NO: 19647 - DNA, 587 bp, Homo sapiens
ggaggctccaagcagagaggagaagagggaacgggagggcatggggcatgagtcagctgggggagtgagggccacatccagaggatcgcatggccagggcggtccgaggccatgaatcttaggtggatctcaggggccacagagcattcagaggctaccagtcctggagtcaggaatcaagagggggtcacagctcatgaaccaggaggccaggagccatagaaaaacccaggctactggtcaaagtgagaattcccaggtcaccagcgagtaaaggaagcgggaagaccaaagggattgagatgggaaaatggaaaatcaggggtcagaggtaggtcactgaggatactaagggctctgggaggtcaaggagaaggcagaggctggtgccgtggctgacacctgtaatcccagcactttgggagtctgaagtgggcagatcacttggggtcaggagttcaaaaccagcctggccaacatggtaaaaccccatctctactaaaaatacaaaaattagccgggcgtggtggtgggcacctgtaatcccagttacttgcgaggctgaggcaggagaattgcttgtaccc

SEQ ID NO: 19648 - DNA, 650 bp, Homo sapiens
gacgttcagcggacgcgggagcaagatggcgattccgggcaggcagtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctgctgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggta

SEQ ID NO: 19649 - DNA, 580 bp, Homo sapiens
cttttctaatttttaagtttatgtgctgtgtgtgtgtatgtgtgtgtgtgtgtgtgtgtgtgtgttatcagaaactcagattgctgctgtcttttttcacaagaaagccctgtttatccttaataagacaactttgcatgcaaaaattttgcaactaaaatgacctagaaggacacgtgctttttagcatactaattgcttttgccatgacgagaaaataatatcttgtagctggctttgcatttcctaagctacatatgtagacatccacatccaggaggaaaattcattttaatgtgctttgtaattttcataaatgattgcctagtggacctgcaggtcccactgggccttgggtacggtacagcacatggatttgcagctgtgatattattatagatgtgtgacagctcaattgaaaaataatggcaaaagggaggagaagtcaagtttaatggccattgcaagctaaaatgttaatctagttattgttttagtgtttaattaataataattggtttcttaaaacatctaggtaaaaattatagatgccaagtcctcattaaaatgatgagcatgc

SEQ ID NO: 19650 - DNA, 610 bp, Homo sapiens
gctgcatgagatgggctcagttcagtgtctcctcgtggtaaaagactcagtgagtgctattattattagctatgatttatttatttattattattttttttaggtggagtcttgctctgtcgcccaggccggagtgcagaggtgcgacctcaactcactgcaacctctgcctcctgggttcaagcgattcttgtgcctcagcctctccagtagctgggattacaacgcctggctaatatatatttttatttttatttttagtagagacaggatttcaccatgttggccgggctggtcttgaactcctgacctcaaatgatccacccgcctcggcctcccaaagtgctgggattacaggcatgagccaccacgcccggcctatttactggtttttaaaattccctatctattccaaaaatatctgaggcagcttataaaactaaaacaacacaggctgggtgtggtagctcacacctctaattccagctatttgggagactgaggtgggaggattgcttgagcccaagggttggaggctgcagtgagctatgattacaccactgcacttccagcctgggtaatagagtgagaccctatctcaacaaacaaa

SEQ ID NO: 19651 - DNA, 621 bp, Homo sapiens
aaagtagttaatacagatgggatgcagccagacccgcctcatgcagtgatttcagcagatgcagatctgcctccaagctctcatgggcagaaagagccgcaagagaacagtgtccttgatgagcaattaactcatttacctaagtatctggtgcactaaatagattcacatcctgttctgtatgaatgaatggaaaacatcaaggatggcctttgtatgagtacaagtgtccaatgtgaaatctgtgtacaaagcacatgccattggaagcttggtcatcaggaaggcagaaaggaaattggctctttatagaatctttatagtacagaaacatatagaggtacatttccttcctctgagagtgccgttccataccacctggagagaatgccaggtggtaacaatgtacagcaggtttaatcaagacccagcatcctaaatcatgcgcagagtgccaggcgcgcaaggtggctcacgcctgtaatcctagcactttgggaggccgagacgggcggatcacctgaggtcagaagttcgagacatagcctggtcaacatggtgaaaccctgtctctactaaaaatacaaaaattagctgggatggtggtgcacgcctgtagtc

SEQ ID NO: 19652 - DNA, 622 bp, Homo sapiens
gagtccccaagtggccatgttacatgtgatctgtgacatatacgatcagatgttacctgcatcctagggtcgcctggcatgcccatgagtgacgcttaggaccgtgcctggtgctggtgtgtggacaatgctgggccagtttgcccagggctatgcctgccacctctacttttatttcaccctctggaggcggacgcattggaaagcatgtggggcaggaggtgaggaaggaaattcagacaagctgagcagagcggccaggactggaatcttgggtgccaacccgcaaggtggggaaactgatttccatttcccagtaattacaggtcaataccacacctgagaaggcaggcaggaatggaacccagactgactccagggctttgttgcttcctgtatcagaaccaaaccccgggtgacctcctgttgcatgccccttgtcccaactttatagattaggacactgcagctccatcttgctacccaagagttaagactttttctggaggacctggctccccgggtttggaaatagtaccattgtttcctaactgggtgaccccgagcaagttgcttaccctctcttggcttcaacgatctcatctataaaatgggatcactt

SEQ ID NO: 19653 - DNA, 623 bp, Homo sapiens
gacccaaggaaattcctaagtgttttagttacatgtccttgaagttgtttctttacacattttgttcactgagggcctctttactggcttgggtgcaggaactcagtctcatgtttgccatcccaaagttctgccttacactgtgttggtcttatcatggccattgtttttccacatggtagcaagatggccaccaggagccaccagctctatcatatcctcccagcaactccattggtaataggtataaaaatgaattccagcattgcctctcatttaactaattcagggcaagggcttttccgtgcatcagtcactgtgacggaacacagtgattggacagacctggtctagagtccagccccggagccctgggaaccacacggcaacacacagaagacagcatgcttggtaaacaggactaacacttgtcagatctcgggggaaaggatgttgcatagttcagtaccacaggtgtcactgtaggtgaagggaaaaaaaaatgacacatagacattctaaaagctgcatttcatattaaatcagccaggctttgatgcatatggagaagaacttttagatgaatgctatttcagaaagcccttgtcccagtgaatattact

SEQ ID NO: 19654 - DNA, 622 bp, Homo sapiens
gggcgcacgggtgcagtggcaccaggcagtggtggcagcaccgggtgggcagccatgattaatagagtgctgagggcacccctttccacaggtgcatggctcctgcccctgcttccatagatcatggacttagcctcaacatatctgactgaaattgaatttggcttctctctcagctgttcagttcctatattatacaaggttagatccctttctctatgagcagaagaaccaaaccatctgcagcttcggaggagaaaatgtgctttcaattatgcacctggcctgaatgttgagccgcagttcgatgggtccctaattgagccatcatggtgcgaacatacagggagacactgtgtgcatcaggcctgtgggttttgccctaagataatgacagtacagcagccacatcaccacggtgaccaccacagctgccaccactgtcacctccaccaccgcagaaggcccaagagcctgcagacatacatgctgggtgagaaggaagttacccagcaagggtccagggcagcaggctgtgttagggtccctggaaagcctccctgtatcctccagccagaatgcatcatcctgtccccagagtgcctggcctgctccacagtca

SEQ ID NO: 19655 - DNA, 641 bp, Homo sapiens
caagtcttacccacttcctccctctcctcagggcattgtacagggtttcttactctggcctagaggtcctagatgttttctcaggctgcctaggccctcatcttcaaggttgtacaatgggggaccggacctaggggccttcttaggttcctcttgcatcagagtttttgggagttgacctgggctgatgcctaggggctccagtcccccacccctaccttagtccactgggggccgtcagcctcccataggaactccggagaccaccagctcagggccttgcctagagccactgctctacacgctacagagtctggccactgcctgtctctggttctttttacatgttgtagagacggggtgtcagtatgttgcccaggctggacttgaactcctgggctcaagagatcctcctgcctcagcctcttgagtaactgggactacaggcatgtgctaccttaccgggtccctttactttttgcctgcatgtggctttgagcctgggaagagttgaggggagggaatgtgctgaagttttccctttcttcttcagccctggggagccacaggcaggtgctgagtggctggagctacagttagtattggcagcccagccaataggtggggcccaccagtcccca

SEQ ID NO: 19656 - DNA, 644 bp, Homo sapiens
gaccaaaaataatcaaataagtcaataaaaagaaaaggtcaagtaataaaaagcattgtgaaaaagttaaaacaaggtgaactgacagaaaatgactaacggtgtggcaaagattgggttgtctgtgtaggtttcatataagttgagacctgaatgtcaagaaggaggtgcacatctgaaggtctaagaaacatgagataaactccacaggatatttgagtaatatcaagatgcaagttgggcatcttgactgtttacttccttaggtttactttcttctctagaactggacactgctttttttattctttctctcattttacttattcattattcactaaaccaaaaatatgtattaacagtttactgtgcaccattcccacttttagtgctaaaacatctttgaaaattaaactattgataggctagcaatgaaaaatgagaaattgaaatttaataagtaccactacaagaatataaaatacatataaatcttacaaaatatattcaggatctacatgctgagaacaataacatactgatgaatgaaatcaaagacctaaataaaagataagccatattcatgtactggaagacccaattttgttcagatcttaattcttcccaaattgatctatagagtc

SEQ ID NO: 19657 - DNA, 626 bp, Homo sapiens
gaaggcccatccccagagaaaaggcttcataagtgcttgcagcattgacttgtctaagccccacccaaagagagacccatctgtacaggccgatgggacacagcctggagcctttgtaaagccctgccttggaggaagctgatgctctttacttgctatcttgactcagcgggtggaggatgaggctctgggccctgtgcctaaatatcataaggagctgggagttagtgcagacactgctgattatctgccccaatctatccctctcttcttcctcttctacaagctctgcttttggccccaatttcaggtgtcccccctcctccttcagccacaaggggagccaggcctgactgatctgatcatcatgcttgtggtaattaggtcaggccaggcacggtggctcacacctgtaatctcagcactctgggaggctgaggcgggcagatcacttgagatcaggagatcgagaccagcctggccaacacggtgaaaccccgtctctaccaaaaaaacacacaaaaattagctgggcatggttgtgcatgcctgtaatcccagctacttgggaggctgaggcgggagaatcacttgaactcaggaggcggaggtcacagtgaggtgag

SEQ ID NO: 19658 - DNA, 590 bp, Homo sapiens
tcttatcaagttccctggtagacctgtctttccttaacccagtggaaatgttatgagtgcatggagggagaaacattcctgaggacaggcagagacaaaaaagagaggcaggactaccaacctcttagacatggaaactcttctccgtaactcagccaaaaattgacctcaaatcagagtagttgcttagcaacagcatgctgtaggacgtaagttctttaggtatactgggaacaagcccttaggcagtgttctcacacttccaggataatccatttggaacccccatcacttgggacaggcagagctctaatcattcacatgagctgaggtaaacctgggcttaacatgtcacctagaactaaagtgaatgcagtgacttttcggtaaagattttctaagcaaatatattccattaaaaaaagacagaaaaaaatggaacaaataatccttcaatgcaaaggcatgcatatattcacaagaaacaacagagaacagggaaccaggacctctccaaaaggacaatgcaaaaatctagtgattgacactaataagataatccaatttctgagctctctgacccagaatac

SEQ ID NO: 19659 - DNA, 603 bp, Homo sapiens
ccagcatgtgcttgtggtgaggactccaggaagaatccaatcaaggcaggagacagaggggagctgacatcacatggtgagaggaaggaagcaagagagagagtggaagaggtgccaggctcttttcaacaatcagctcttgagggagctaatagagtgagaactcactcattaccttgaggatggcaccgactcattcatgagagatctacccccaggaccaaaacaccatccttcaggcaccaccttcaacattggcgatcaactttcaatatgagacttgaaggcaacaaatatccaaactatatcatttgtaatattgttactcttttttaatgctctgtatttttatggacacagaaaataagagaagccttctccctttcttcttctctaaccctcaacttagtagcttctacttttaaactgtagtgaggccaggcacggtggctcatgcctgtaatcccagcactttgggaggccgaggaaggtgaatcatgaggtcaggagtttgagaccagtctggctaagatggtgaaaccacatctctactaaaaatacaaaaattagccaagcacagtgacgggcacctgtaatcccagc

SEQ ID NO: 19660 - DNA, 554 bp, Homo sapiens
aggcagctgctcatgagtggggtggtccgggcttgggccttggaagacagaccaggatgccccagtagctgggccctgccctatccagagcatgcatgcctgctgagggacccaaggagagaggctttctgccaacgcaggaagcttccttcacaaagggcaatggtagtatccagggttctttctcaacctggccccatgtgtcccatgtcctgaccgagaatgctgttctgtcggccccttgacacccagcggcccctcaggcagaggaggccttggtaagggctggaattcctggctgggggcagagtttccgggccacgctgctggctggggtctggggtgccttccatgtgtctactggctctcggggctctcctgggactccaggcgtgtccccactgagcagagagtccacctgctcctgtccgtaaggctgagtcagcaaggcctttactgagcatccaggagttttctcgaacattatctcaaggtgccgggccattttggtgggtaaaggcctggaagtgcatcaagcctgtgcttcctccctc

SEQ ID NO: 19661 - DNA, 655 bp, Homo sapiens
tgctaatatatgtaggtatgttgttactactatttaacatacatctgtttaggaagtattgataggtacttatgtccatctgatatggtttggccgtgtccccacttaaatctcatcttgaattgtagtttccataatccccacgtgttgtgggagggacgtggtgagaggtaatttaatcatggggacagttaccctcatgctagtgagtgagttctcaggacatctgatgcttttataaagatttcccccttttgctcagcacttctccttgttgctgccatgtgaagaaggacatgtttacttccccttctgccatgagtatttgtttcctgaaaccttcagccatgctgaactgtaagtcaattaaacctctttcctttataaattacccagtctcaggtatgtctttattagcagcctgagaacagactaatacaccatccaaacacagggaactataagtacagttctgatgaaagtagcagtcaggaagggaattgagcttggattcagcatcagtgaatacacaaaataaccaaagagaataggggcttgacagtgtgctcaagatgataaattagccaaatgagctaaaagacaggtaatggctgagactcggttgttccagtctctcgggagacaccacctctag

SEQ ID NO: 19662 - DNA, 635 bp, Homo sapiens
tgatacaaatattctgctgttgtaatatgatagcagccatgccacagacaatatgcaatgttgtaggctacattccaatgaagccttatttataaaaacactgtagaccagattcggccttcatgccaacttctgatatagataaacagaatgcaagctagatgacacacatctataaagatgaaaattgaaagcaagagttctaaacctaagttcaatgaatggacttactaatcataaattgtcctttccaagacacacttgtaacaacaatagagatgaaatggctttcatcagaaactcactggacaatgaaatgaagaaaaccaggaagcagggcagtggacaaggagcctcagagtgcactggaggctgcgggctgtatcctgtaaggtgtttgactgctgtctctcaggcccagggtatgtgtttgccttagactgtgggcccaaagaactcctgcaggcaggccgggcacgcctgtaatcccagcactttgggaggctgagatgggcggatcatctgaggtcagtatttcaagaccagcctggccaacatggtaaaacccagtctctactaaaaaatacaaaaattagcctggtatagtggtatgcgcctgtggtcccagctactcg

SEQ ID NO: 19663 - DNA, 547 bp, Homo sapiens
catataaattgttccagcaccatttgttggaaatcctttcttattcctctgttgtatcgctagggatgtctgtttaaaatcaattgactatatatgtatgagtctatttctcaattctattcttctgtgaacaatgcactcttttgactactttactgttattataaaaattgaagtcggattaatttctccaaatttgttcttcttcaagattgtttggctatttcatgtccatcacatttccatatgaattataaagtcatcttgttaatttctatttttaaaaaatttgctaggattcaccttacctggtcattttccatttctattacctttcattttctaacaagaagagaaacaacaaaaagtaaaacaagaattacttttacttatatctaaatttaaggaaattttttttcaatgtgtcctaagacctttgagtaaagtcttctttaagtttttcaaattttatacagtggtaggaacacatattggttggaaaatgtgaaggtatcatagaaagtctaaatatcactggcagtcatct

SEQ ID NO: 19664 - DNA, 461 bp, Homo sapiens
caagcaaatgataatacaaatatatttaatatacatcaactattccctaaacacagaggatactgaaggaagaataataacagctacatttgttgtgcgataattcacagtgcaattatatgagacacgtactattgtcctcattttattgacactgacactctgaaaagataaataaattgcccaaagccacaaagctaataagttctggagctggaactacaagtcctctgattattaaataatgatttgcctgtttcacggcattgcttagaagtagtcctggcaatcttcaaagaaaatccaagtgaaaccattggactagacaaagttctggagattttactcttaaataaaattctttgtcaaagaatgttccactgcactgccttccttcctgcttccctgtagccactgaatatattcccaaatattttaaagtaagcatctctaaatccctc

SEQ ID NO: 19665 - DNA, 633 bp, Homo sapiens
tccttcatctatacctgctgcttcaaactctctctgtctctgaattcactttcttgtggtttcgtctaagccaaagtgcttggtgtgtcccttcctcactcaaaatgcctccctcttaccttgactcccccctcttttggtagaaccacaagcacccttcctccaggaagtctctctggatttacctcccagctttctgttcatctcatttgtgggtagcccctgcacctgtgatttgtgggtagcccctgcatctgtgattgtggttttggttctagaactcacttccccagtttccctccttgcagatggagtcatttctccttcctcatttactccctacaggagtggctctgagcagccgtccttgggcaagcgtgcatgagctggagcttagccctgcccaccacccaccactgcctcttggaaatgtgagccgctccaggtcaggcatttaatcaccttgcattcactgagcccacgtgtaggtagggtagaggctggggactcaaacgtgaaggcagggggctgtgcctggtggcctgcatggaggaagagctcagcagactctggggaagtggatgatcacatccatggggacttgtccctccgactggattgcatgcctctgca

SEQ ID NO: 19666 - DNA, 637 bp, Homo sapiens
atgataaaagtgtttaaatgagggaggattattcaattaattgaattgaagccaaagaaaaaatattcatctggggggaaaagtgagatccatatttcataccttaccctaggataaattccacatggatcaaggatttaaatgcaaaacgaaaccatgaaagtgttagacaaaaccatggaagggattttttttctgttatgtctgaatgtggaaaccgtttctaaacatgatacaaaggcaaagagtcacaaaagactgaaaaattaaccagaaaaaaaaatttgcatggcaaaaacctttatgtgggaagtttaaagataaagaacaggccgggcacggtggctcacgcctataatcccagcactttgggaggccgagacgggaggatcacgaggtcaggagatcgagaccatcctggataacacagtgaaaccccgtctctactaaaaatacaaaaaaattagccgggcacggtggcgggcgcctgtagtcccagctactcgggaggctgaggcaggacaatggcgtgaacctgggcggcagagcttgcggtaagccgagatcacgccacagcactccagcctgggcgacagagcgagactcagtctcaaaaaaaaaaaaaaaaaaaaaaaaa

SEQ ID NO: 19667 - DNA, 543 bp, Homo sapiens
cctcaacaatatcccaaggtctcctccatgtgctcgatgagactcaagaggtaattaaaatatgactcttccttgcaagttgctgagagcctggctaagaagctgggtatttaggcactgctcgggtgagcatatggtgtagtagtggtttagagcccaggttccaagatcaaatcctgcctgcttcaaaccctgccttcagtttactcactggggaggctgggcacatggggcagcctctctgagctgcaaaagtcgcttcacagttacaaaggcaggcataaaagtgtggttagaaaggccaggcgaggtggctcacgcctgtaatcccagcactttgggaggccgaggtgggtggatcacgaggtcagaagttcaagaccagcctggccaagatggtaaaaccctatctgtactaaaaatacaaaaaattagccgggcgctgtggcagccacctgtagtcctagctactcaggaggctgaggaaggagaatcatttgaacccggagggtggaggttgcagtgagctgagatcataccact

SEQ ID NO: 19668 - DNA, 481 bp, Homo sapiens
atcactagagataacacgtaagatgacaacaatcagaaattataactttggtaatatcaaaggagattgggaaaaaaagtcttaaattgacttttaggagataggaagtaaccagattacaaagtaaataactagggatctacttggagttgagaatcttcatggacaaatatgatttaaaaaaaggtcaaactgagctgggtgcggtggcttacgcctgtaatcccagcacttcgggaagccgaggaggtgggtggatcacgaggtcaggagatcgagaccattctggctaacacggtgaaaacccgtctgtattaaaaatacaaaaaaaaactagccgggtggggtggcgggcgcctgtagtcccagctaccggggaggctgaggcaggagaatggcatgaaccccggaggcggagcttgcaatgagcggagacagcgccactgcactcctgcctgggtgacagagtgagactccgtct

SEQ ID NO: 19669 - DNA, 553 bp, Homo sapiens
gctccctctcttgccatgtgatgcgcctgcccctactttgccttccaccatgagtaaaagcttcctgaggctccccctagaagctgagcagatgttggtgccatgcttgtacagcctgcagaaccatgagccaattaaacctcttttctttatgaattacccagtctcaggtattcctttctagtaacatagaaatggactaatgtagttatatattttttaaaggtattgtattttaaaaacagcagcaatagtgataggaagcttggacttccctggacaatctgagattaagtgtaggggatcttgatctcctcatcatctgactatagcttcccaggaagctctgatttccatctgtgcgtccagtgaccccataggtgttggccccaccccagttttaggaagagagcatgcaatccacaccaagccaatcagtgggctgctgccttggccacaggaattggttaaaatggcaggacctaatctaagcaaagtgaagttcagggctcgtgtttagaaatgtgggacaaaggcattctctgtcttcttc

SEQ ID NO: 19670 - DNA, 608 bp, Homo sapiens
ccagcatgtgcttgtggtgaggactccaggaagaatccaatcaaggcaggagacagaggggagctgacatcacatggtgagaggaaggaagcaagagagagagtggaagaggtgccaggctcttttcaacaatcagctcttgagggagctaatagagtgagaactcactcattaccttgaggatggcaccgactcattcatgagagatctacccccaggaccaaaacaccatccttcaggcaccaccttcaacattggcgatcaactttcaatatgagacttgaaggcaacaaatatccaaactatatcatttgtaatattgttactcttttttaatgctctgtatttttatggacacagaaaataagagaagccttctccctttcttcttctctaaccctcaacttagtagcttctacttttaaactgtagtgaggccaggcacggtggctcatgcctgtaatcccagcactttgggaggccgaggaaggtgaatcatgaggtcaggagtttgagaccagtctggctaagatggtgaaaccacatctctactaaaaatacaaaaattagccaagcacagtgacgggcacctgtaatcccagctactc

SEQ ID NO: 19671 - DNA, 528 bp, Homo sapiens
gtgactacatgtaacattcagcccaggatactgtgttctctgagaatattgttgttatcaaaagacgggagaggcatggcccagaagcaccacgtttgataaagaagcagaagagaagtcttcaatgaaagcaaggttagtgtgaaatgatattttttaaaaccaaagtaaccttaggttgtctaaatagaagtagatttgtacaagggagacaatcaccattttaactcaatattaagcctcaacaatatcccaaggtctcctccatgtgctcgatgagactcaagaggtaattaaaatatgactcttccttgcaagttgctgagagcctggctaagaagctgggtatttaggcactgctcgggtgagcatatggtgtagtagtggtttagagcccaggttccaagatcaaatcctgcctgcttcaaaccctgccttcagtttactcactggggaggctgggcacatggggcagcctctctgagctgcaaaagtcgcttcacagttacaaaggcaggcataaaagtg

SEQ ID NO: 19672 - DNA, 627 bp, Homo sapiens
ctcaatcggaattagagaatctactgtagaaaatgtgtttggagtgagtcttatgtgtaatattcagtcctgagtcatcatatttttttgatatgtgtataatgcaagagtgtttaaaaatttttctctattaaaacactgtaacacagttcgcaaaagtgtggtccaaggacattgaggagtacccaaaaccctttcagtggatcggcagagtacaaatcatgcatgtgtgtagaatatacactccatgtgtaagatagaccactgtgctttaatgtaacaaagaatgaaaagtttattgatcggatttaagattccacattgcacaaaaccttaaaaactttaacaaacttttctgggctgggcacagtgcctcacacctgtaatctcagcactttgggaacccaaggtgggcagatcatgcgaggtcaggagtttgagaccagtctggccaacatcgtgaaaccctgtctctactaaaaatacaaatagccgggcatggtggcacgcgcctatagtcccagctactctggaggctgaggcatgagaatcgctttaacctgtgtggtggaggttgcagtgagccaagatcttgccactacactgcagcctcggtgacagagtgag

SEQ ID NO: 19673 - DNA, 638 bp, Homo sapiens
gtggagtacagtggcacgatctcagcttactgcaacctccgccttctaggttcaagagattctcctgcctcagcctcccgagtagctggaattacaggcacccaccaccacacccgtctaatttttgtaatttttagtagagacggggttttcaccgtgttggccaggctggtctcgaactcctgacttcaagtgatctgcctgcctcggcctcccaaagtgctgggattacagacatgagctaccatgcctggcctaaaagtcactgctgaaaaaggtgtttcaggctcatgcttctgtgagatcccccccaagcacctaggactttttatctactcattcatttgctcttactgtcctcctgcctgctagactgtaaccaccatgagggcacagactgggcttgtcttgttcagctctgtgaccccaatacctgatgcaaaaggaacacctgataattacaaaaacctccatatttcaggaatggcaaatacttaaacaggtgagaaaaaacattatttgttcctgatcttaggttgtataaacctatttatcataataagcaattcccagtactcatgaagaccagcgaggaggcataagaaacagggcaggggctgggtgcagtgactcacacc

SEQ ID NO: 19674 - DNA, 584 bp, Homo sapiens
caacctccgccttccgggttcaagtgattctcctgcctcagcctcccgagtagctgggattacaggtgcctgccacttaatttttgtatttttagtagagatggggtttcaacatgttggccaggctggtctcaaactcctgaactgaggccatccacctgcctcggcctcccaaagtgctgagattacaggcgtcagctactgcacccggccccttattcttctgttcataaaatagatactgctctctagtgtatataatcattaaatggcaaaagataaactcatgaatcagagaaatctatatttatgtagttatggaggaaataaaaattgtgcaaaaatgctttaaccgaacatagattgttttgcagagtgaaaaacaaagcaaaacaaaacgaagactctaagcaccctctgcttgcccagtcatacaaagcatcacatcagtactctaattacttgttttctgtctagtctaagtttttctactcaaagtgtggtcctcagaacagcagcatcagcgtcgcttgaaagtttttagaaatacattatcttgggccgggcgcagtgtaattccagca

SEQ ID NO: 19675 - DNA, 633 bp, Homo sapiens
cccacaatggggtcctcattgctagatgagtgccaaatgacccagcctgaaagcccatcttaccaccagtataggtcacccaggaggtaaatgctgagacagagccaggaatgcacgacgttaactgggaggtaacacttgtgaaagatacagggcaagaaagtgggattagacagggaaagctttcagacttttagatgtactctgaaagtgtgtgagaaaatgggaggaagcaaattggagagcctcagactgccatgcagacctaaccaattcttggccaacccaatgggaagtttccaatcaaagattgcccatagaggagcacagcattgggcagaaatatcaggccctagaaccctgccatgctcagtcgtgaggatggggctgtgcaggaagagtgtggtctgagctagggtgctgtgtggatcctgaagtcactgcagatggagattagccaattgcaatctgagtgtcacacttccatagctgccacagttgtttaatgaacaaatgtttatttctcacttcaaaaaacagtaatggggttgggcttggtggctcacgcctataatcccagcactttgggaggctgatgtggtggatcgctaaaggtcaggagttcgagaacag

SEQ ID NO: 19676 - DNA, 576 bp, Homo sapiens
aagggaagggctactttttttataaaagaaaggatgaagatggtttagtgaaaataagattgtgaatttggcaataggagcatgaggaaattgagttgtaatggcttctttttcttcagaatagagaaaaaaaattgtgagaggtttgaagagaaagaaatcattaagtaatcttctcatagaacaaaaaagcatggccactagtggataggcttgcaggacaaaattgattactaaattctgatgtgagattgttaaagtgaaagcagtttactcagttatatgattttctgcagaaaactcatgcgtatggatggtcttggacagcattaaagtgtaaggttgctgtccccagcttataaaaaacacttataccaattcaagcctttattactcattaaattgtgtcaaatattgggaaactattattctgcaagccttcattccacataggaccattagggaggaagtcaggttgcctacttgctttacaagacaataaaggattggtttgtgtgtgtgtgtgtgtgtgtgtgtgtgtgtgtgtatacacacattcttttatagaggagaaat

SEQ ID NO: 19677 - DNA, 451 bp, Homo sapiens
aaatgatctaaaacatgttgagcacttagagtagtatgtggcatctaataagtggtcaataaattaattattgttattacaacaacaacaatttgttttaaattgaaaacttcaatattcaaatattccaaaaatgtataccctacaatgcctagatgaaaaggaatcaagcctagcatggtggttgatgcctgtaatcccagcactttgggaggccgaggcaggcagattacttgaggtcaggagtttgagaccagtctggccaacatgacgaaaccccatctctactaaaaatacaaaaattagccagacgtggtggtgcacaactgtagtaccagctaccagggaggctgaggcgggagaatcgcttcaacttgggaggcagaggttgcagtgagctgagatcatgccactgcactccagcctgggtgacagagcaaaactctgtctc

SEQ ID NO: 19678 - DNA, 566 bp, Homo sapiens
atttgcttcaggtatctgtaggtctttttgtttcaaacagacacagacaatcaaccaagacatattgttccaaagaagaaataagctaaaccatcttcttaccaaggccagagatagactgttctgatctatttccactctgtaactacttaaagcaattcactttcatttcccacaagaggagatttggaagtgcatcaaagacaaacttgaaattgggttaacccctttgttctcagtttttgccacttggcatcaactagctctctaaagaaaggagaaacttggagtgcctcttatgatctgatttcaaaggctataactgaaactctttgggaaataagtggtcatttttgttcaattatttcttgtatttttttctaattaaattagtggaaaccgtttttgcttctaggcactagttaaggtcttgttaaaccagttcattggaatcgtattttaatttatatactttttaacttcaaaaggagcagtcatttttatttcatctccattgccttgccatccactgcttcaatttaatttcaaatttattttaaattatg

SEQ ID NO: 19679 - DNA, 652 bp, Homo sapiens
cctccaccccatgtcattgagagcaaagcccaaagcccttaccgtggccaacaagactccatgtgttttcactctgcctagcccacctctttgccctcatctactactttctccaggctctctcatctccagcctctggtctctctgcagctccccagaccttccaggaatgtccctactctggggcctttgccctggctgcccgctttgctgaaagcatccttctgcagacatccacacacatgccccctcaactcctcccggaacatccacacacatgcccctcacctcctcctggtacatccacatgtgtacccctcactttctccctcacctcctcccagtacatccacacacatgcccctcacctcctcccggtacgtccacacacgtgcccctcacctcctcctggcacatccactttgggaggccaaagtgggtggattacctgaggtcaggagtttgccagccagcctggccaacatggtgaaaacccgtctctattgaaaatacaaaaattagctaggcatggtggcacatgcctatgatcccagctactcaggaggctgaggcaggagaatcacttgaacccgggaggcggaggttgcagtgagctgagattgcgccactgcactccagcctgggctacaga

SEQ ID NO: 19680 - DNA, 582 bp, Homo sapiens
ttgttattatggctttttctcctagacaaagtccaaaatgacattttctggcctgggggcgatagcagggcgacatttggccacagtatctgggagggaagtttccacatccgcggcagctgtctagacttctgatccccagtggggaaacacaggctctgaataggagtgtgaaggcgtcagaccctcccaggaaggtggtcacagagccaaggagatagggaaggtagccactgaagcccctgagattttgtctgacatttgggaaaactggggccctgagagactgggatttcaccctggctctcctgaatcttttatgtagtattgtcaccaaccttgcattttaatagcctccactcccaggtagggcagcaattcttgctatttaccaggcccagctattgacaataagagagatctgtcctctcaaaagcagttcaaaatgtctcctgtctaaactagattagcaaaacccagaaggtcttctggactcaggattagagatgagaatgggccacgtgtgtcagaacaggcaatttggccgggcacagtggctcacacctgtaatcccagcacttt

SEQ ID NO: 19681 - DNA, 559 bp, Homo sapiens
tagtattgcttgtttccctctccccagccctccgagggccaagtcctgagcatatgaaacaaattctgaattgaatcggaattacattctcaggaaatagtctctagtctgcttgcttatttggagggggagctcgttcctaatcttaatgagagtcaaagcagaacagtagcactaatgacctatgtattcacccaaaatgccaatatttattgatcatttactggttgcctggcacgttggaactgtaatgacaaccagagagcttattgccaattggtaaagacttcgccaggcacagtgactgatgtctgtaatcctagcactttgggaggccaaggtgggacgatcacttaagcaggagtttgagaccagcctgggcaacatagtgagaccccatctctactaaaaatacaaaatttaatgatttttaactaatgatttttgtataattaataattcaaaaaataattttaggcagggcatggtttctcatccctgtaatcccagcactttgggaggctgaggcaggtggatcacttgaggtcaggagttcgag

SEQ ID NO: 19682 - DNA, 647 bp, Homo sapiens
cctctcttcagactgcctccttagctctcttctggatcactataacagcctaacaattgtatcaccttcagttttgctcttccttccatatgactaaataaatgaaaaatttgatcagacattaacgagtagggagagtgaattggtaataaaaggtccacttattttgtcttacagtgagagtggcttgctattatctcccattattgatgcatttctatctttgtcttcctgcatcccctgcagtttttgcttcataagaatgtttgcagtgttatttggtaccatacatattcatgttaggtctttattgtgaattacagattttagaattaaaaaggagatttgggccgggcacagtggctcacgcctgtaatcccaacactttgggaggccgaggtgggcagatcacctgaagtcaggagtttgagaccagcctgcccagcatggtgaaaccctgtctctactaaaaaaaaaataccaaaaattagccaagtgtggtgtcaggcgccataaccccagctactcaggaggttaaggcaggagaatcacttgaacctgagagacggaggttgtggtaagccaagatcgccccattgtactttagcctggacaacaagaacgactctgtcccccaaaaaaaaaaa

SEQ ID NO: 19683 - DNA, 568 bp, Homo sapiens
gacttttaacctttttctttacctcagccaatgtttatcaatattacaggtgaaacagaaatttgtaattacctgtgaattttatttttacacttatgccagtataatacaaaaatgagggctgggcgcagtggttcacacatgtaatcccagcactttgggaggctgaggtgggtggatcacctgaggtcaggagttcgagaccagtctggaaaccccatctctactaaaaaatacaaaaattagctgggcatggtggtgggcacctgtaatcccatctactcagggggctgaggctgggagaattgcctgaactcgggaggtggaagttgcagtcagccgagatcacaccactgcactccagcctaggcaacacagtgagactctgtctcggcatgggggaagaaaaaatgagggttgactctactgctgtgtcctttttcttctccctactccttttagagaaaaggaatttttcactttccatttcttattagtttgaaagtgccttgactgaagtcatcaaaatatatttgtaccctcccctctgaaactgtggagtaaagga

SEQ ID NO: 19684 - DNA, 586 bp, Homo sapiens
ctcctaacagttttcttgataagcgggtcactttatcaactcttatcatcacacaagaatttggataattaattctaccaacatgacccctggccatagtaggattcatttcaatgctagcagaaactaactgagccccatttgacttaacacaaaacaaatcagaactagtcttggccttcaatgtctactatccctatttttcatagcagaatacactattataataaatgccctaactgctactattgtcctaggaacattacctatcttcacgctagaaatatacacatggtcaggcatggtggctctcacctgtaatcccagcactttgggagaccgaggtgggcagatcacttgaggccaggagttcaagaccagcctggccaaaatggagaaacctcatcactactaaaaatataaaaattagccaggcgtagtggcatgcacttgtagttccagctatccgagaggctgaggcaggaaaatcgcttgaacccaggaggctccgaggttgcagtgagctgagattgcaccactgtactccagcctgggcaacagagcgagactccattttcaaacaaaa

SEQ ID NO: 19685 - DNA, 630 bp, Homo sapiens
cattcactcgctcattaattcgttcattgagggcatggtggttgacagtctggagtctgggattgcgctgcctgattctgccacttccagttacacatttctatcgcttcatccctttgttctcagttttctgctccataaagtaggggtagtaacactaactcctggagaatttgggtggatttaacaaggtgcgtaagtatcagaacaccgtcaggcacggagtatgcacctatacatcctagctactatcacttagtttttcataagcagcggccctgtgctacatgctgagaatgtagaaataatgccctcaaggggctttcaggcaggtacagtagataggcaggtgagccaatgagtgtggtccagtgtggcaaggcccagaaaaatgacaggtgagccaatgagtgtggtccagtgtggcagggcccggaacaatgacaggaaataaagacagaggggatgcagaagctggcactggagccagatggctctagggagttatttgttggggaaaatgggagtatctcagaaactcccctggatgttaaagaggctgagaggccgagcacggtggctcacgcctgcaatcccagcatttttggaggccgaggcaggtggatcatg

SEQ ID NO: 19686 - DNA, 425 bp, Homo sapiens
atttgtgtgtatatatatatttgtgtgtatatatatatttgtgtgtatatatatacatacacacaaacacacacatatatatacacacacatgcatatatatatttacacacacacacacacacacagatatatatgtatatattctctattttcttgataaaccacctttaagccagtacttgatgttttagacattgactttttctgaaaagttaaacaaaacaatttagacagttttgcaaaaacttttgtttgactactgttcttgtcttagttataaggcttagttttggtggacccagagtcttaattctaatttaaaattaaaaataaaaagtaaaaagaaaagctctcaagataatctctttaatccagcagcgtaatctgatgaaatcaccaataaatattagttagccacaaggc

SEQ ID NO: 19687 - DNA, 651 bp, Homo sapiens
aaataacattcttgcctaaaagataccatttgcaaaaataaatttcaggtgaattgaagaagtaaatgaaaaatgtggataagatttttatctagaatataataataaacaccttcaaatcaataagacaaagatgatcaacacaatagcaagataggcaaagaataaaagccaacagttcacggaataagaaacccaaatggccaataagtctaaaaatctattcaattttaccactaattaaccatgagctctcaccttcatctatcgattttcaaaatgtaattttttttaaaaaaatcaagtattggcaataaaaatgttaaatttgactctgctcaagacattatatgtaactttcaggttatagtaaatacaaagcaaagaacatgttaaatgacagcttgatgaaacaatcagacaaatccagaatgcaagacggtctacaaggcaacctgatgtctttaaaagtcaatgtcctggggtggaaaatgtgggagtattgttgtggcataagattctaaagagacataacaaaatgcaatgaattacacagaagatcaagttgacataagaagaaattataaatctgaacacacttatataaaaatatcgaattaacaattaaaaaaaagcccaggacaagaagtc

SEQ ID NO: 19688 - DNA, 647 bp, Homo sapiens
atcctttttaccttcttcctcccagtcaacctctctctttttcacgtactctaccaacatccccacccaatctccccttatgcctccaaaattagtcctatcctgattgtggagtttggggttttctttgattcaatggatgataccagtcacaccatttgaaaaaagcatatgacagtgttgttcagtgttggtgaacaggaattcttgatatttatttttaaggattccatttaattgctaattacagatctttgttaaattaagccgaccttcactcacatttaaaaaatttaactttgttttggttttcatgagacaaatatctctctttaagtgaacaagcttttaaaagaattagcttcttcagtatggaaagcaagatgcaattcgcagctggtgcaatggcttacaccagtatgtaatcccagcactatgggaggccgagggggaagaatcccttgaacccaggagttcaagcccgggctgagcgacacagtgagacatctttacaacaacaacaacaaaaacaaaataacaataacaacaaataattacctcagcctctcgagtatactgtaggtacaaagccaccacgtgtacctgtagtcccagctactcgagaggctgaatagagggattgcttg

SEQ ID NO: 19689 - DNA, 629 bp, Homo sapiens
agcttcaggttcagctctctcttgttgtctactagggctttcgcatcactgatcagaggtcagcattcacctgggtccctttggagtggtgctgacttctctcctccaggccaggctccctttatctttccaaacccactcagaaactgctgcctcctggtggctctgtttctggtcaaaagtcagattccctagactgccttgtagttcatctgtagcaatgcagatattctcaggccaatagtctatactggctcatagtacaaatgtgtttacatttacattcattcatataccagtcttgctaattgtaggcatccacctgttcctataaaaataccaatccgggacaggcgcagtggctcatgcctgtaacaccagcactttgggaggctgaggtgggcggatcacctgaggccgggagctcaagaccagcctgaccaacatggagaaaccccatctgtactaaaaatacaaaattagctgggcatggtggtgcatgcctgtaatcccagctactcaggaggctgaggcaggagaatcacttgaacaggggaggcggagattgcggtgagaagagaccgtgccattgcactccagcctaggcaacaggagcaaaactccatctc

SEQ ID NO: 19690 - DNA, 573 bp, Homo sapiens
gcttcccctagccactctccactcactccatgcaatcattatccaaatcctttgggtttcacctctgcccattccagcatttcactttcacccctccactctagttgaggccttctttacccttctccctctttctttcttttaattcaaacaccaagtctgatgttgatgccagtgggaatgcatttgacctctgtctacagcgtggccaggatcagctgcactggctgtttcaagaactgccacatcgcacctctgctccactctggatcctcagccaaccccgactggaccctctgaacaggcgggatctctgtacccagtatctttacatctcaaggtaagctggaaatccccgaaacttcatggactctcacaaaagataaggttccttaaaggtaaacatcgtgaacctgcctctcaccttacctgttaacctcattgggacacaaggaggcagaattgggaggagactggacaggaaaccatactatgaggaactacaaaacatttatgatgttaaaatgcttaggatcggcccggtgtgctggctcatgcctgtaatcccaggac

SEQ ID NO: 19691 - DNA, 412 bp, Homo sapiens
tacagtaacatgagggccccagagcccagtaagagggacatggaaaggaaggcaaggaaacctacccatttcattttacctagggctagaagaggacctggaaataactggtataaaaaccaaagggtggggctaggcgtcacggcccatgcctgtaatcccagcactttgggaggccgagacaggtggatcacttaaggtcaggagttcaagaccagcctggccaacatggtgaaaacccgtctctactaaaaatacaaaaattagcctggcatggtggtgcatgcctgtaatcccatctactcggaaggctgaggcaggagaatggcctgaacccgtgaggcagaggtcacagtgagccaagattgtgccactgcactctagcctgggcgatagagtgacactttgtctc

SEQ ID NO: 19692 - DNA, 604 bp, Homo sapiens
aatactcccatcagttaactgtctcaggtatcaaaatatcccttcctgtatgtatcaaaactcatgctgaacaatgagttctgggttgcaaaagaggatttatttgttgcacctatccataagtctttgtccacaagttaaacaaaaacatacataagtgcagcgtgtgctctttttaagtacattagtagacatactactgagaggccacactgcacggggttaggtaagtggactctggagccagattgctagttcaaagatgtgcccttccatttactaagtgactttaggcaaactccttctcttggtgtctcagtatcctcagctgtgaaatggggatgacattaagaccgatttcggccgggcatggtggctcaagcctgtagtcccagcactttgggaggccgaggcgggtggatcacgaggtcgggagattgagaccatcctgccgaacacggtgaaaccctgtctctactaaaaaacaagaacttagccgggcgtggtggcgggcacctgtagtcccaactacttgggaggctgaggcaggagaatgacgtgaacccgggaggcggagcttgcagtgagccgagatcacgccact

SEQ ID NO: 19693 - DNA, 495 bp, Homo sapiens
tatccaattacacaatgagtaccccagcctcactcaacatgtcttagagaaagctcagcattttctcctgcagacctgagttccttatcttagttaacggtattacaatattctcaattgcataaattataatattttacatagtaaacaagtcctttccagtgggaacagtagacaccaggtactactggagagaagagggaggaaaaggggcaaggactgaaagaccacctattgggtactatgctcactacctgagtgacaagatcagtcataccctaggcaatatacacacacaacatacctgcacatgtacccccgaacctaaaataaaagtggaaataaaaataaatgaataaaaataagtcatttcctttgtataactgcaattcctagtaccttaagtttttatgcttctggtaacctacgtcttatgattgatggcttacatcccatccctgagtaagaatcgtatcttgagtccctcatatctta

SEQ ID NO: 19694 - DNA, 601 bp, Homo sapiens
aaatcccaaaacaattcctgccagccgactaatacatacgttccttatagaggctatggcgttattaagcttaccacctgtaggggcacacaataaagaaaaattcacaaagaaatattttcacatacactacacatcagaaaagcaaatctaggtggctcatgaagaaaagtaagcattttatagaacaaatatatgcaaatggtctttttatagtgacatgtatgaaaacacgtagatctatttagtacattaaatatatactctcaaataatttaatatatacacacaactcagaaatgtccattatataaataggccagaaaacaaagacttaacaagcacaagatgctccccttacatagccaatttaaaagacagagtggggtagtccaggcgcagtggctcatgtctgtaatcccagcactttgggaggttgaggagggtggattacttgaggtcaggagttcaagaccagcatggccaacataatgaagccccatccctaataaaaatacaaaaattttgtgggcatggtggcacacaactgtagtcccaggtactcaggaggctgagggaggagaatcacttgtacctggga

SEQ ID NO: 19695 - DNA, 416 bp, Homo sapiens
attagtcagtacttatccatgttcaagtttgtcatggcttagaaaaaaagattaagcaaggtcaaaaggcaacataaagaacttaagaaagtagtgctcttcccaccttcccaagggctgagtaggacttactgggccaggtgttaaattagttagcaggtaacaattaaaggagctggaaaataattatcataaaataatataaaattggaagtaattcttctcaagagctaggtattgaaaggcagtggccttaagaactcaacaagtagggtagcttttactgtctaaaaactttaggctgggtgtggtggctcatgcctgtagtcccagcactttgggaggctgaggcaggcggatcccttgaggtcaggagtttgagaccagcctagccaacatggcaaaattccatctct

SEQ ID NO: 19696 - DNA, 549 bp, Homo sapiens
actgaaaactcacaactaaggggagggcagaagtgatcatagagtgacagagtttgccaggggtgtttagagtcagtcctaggaggcaacctttaaacatctgtgagagtgcctagaaaacagggctcaattaaaggagactcaacaaagaaataaattacataatgaaatcccagggatttgcataaatttctatactaaatgatatacagaggtcccttacttaacctgtgatttaatgacctgaagtgtacctctctaacaaattaatctcgcataaggactgtttattattgtttgctacaaaataacttctaggcctgtagatcacctgaggtcgggagtccaagaccagcctgaccaacatggagaaaccccatctctactaaaaaaacaaaattagccgggcgtggtggtgcatgcctgtaatcccagctgctagagaggctgaggcaggagaattgcttgaacccaggaggtggaggttgtggtgagccgagatggcgccattgcactacagcctgggcaacaagagcaaaattccgtctc

SEQ ID NO: 19697 - DNA, 635 bp, Homo sapiens
gactgccgggtggaggggcaaggcgagtgtgtgtccttatcctagcaattggggcgcgggcctgtgagccagttggagttgcggcggcgggaacgattgggctgagcagaggacgacatgttgcttttcgtggagcatttatggggttaagtggcatgggatttctgtttctgatagtaaatagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacag

SEQ ID NO: 19698 - DNA, 523 bp, Homo sapiens
gggatagagataacaggaagaatttatactgtaaacttccttaaacttgttagcgtgacccatgtgagtgtactaattatcccccaaaataagttcaaaattcaataacttatcattacctttaggataaaatcctaacatcttttcatgagcttcaaggccatgcttgatcctacctctgcctttgctacctcatctttcccccactgtctccctatgcagcatgatgctatcacataagtcaggtttttaatttttttaatttttaaattttatttatttatttttgtagttgtttttttcccagttcctagaattttgcaaattcttttttcctcaaggattttatacctaatccttactctgcaggcatgtatattgctctgaaattcacatgggtggctttttcttgtccttcagctcttagagaaatattttgctaaagctctttgatagggccgggcacagtggctcacacctgtaatcccagtactttgggaggctgagttgggtggatcacttc

SEQ ID NO: 19699 - DNA, 603 bp, Homo sapiens
gagttacttttgtccgaaaaaagaattacctttcttgaaaggagatgggcaaggcaaaaatttcaacagaaaatcagcaggatggtaacagaaatcttatttttaaaaaagaaattataacaacttgagataaaaatggttggcaaatctggtgctcaatttcaataccagacttactatagattttcttttgtctgggatttagattcaatggaaaattcctgttttctctccttgctagtaataaagcataaaagtgtgcaatttaacagcagtaccagagtcaggccatttgctagataggaatgtggatggatttctggaagacgaatgcatagaccagaacaaactaagccacacattactggtgtcttaaacatatgacttaaggaatatcatctaaacaaaaaatctattttgatttcctcctacccctttaggaatcaaatcttccccagcactaagtataaatttgtacatatactgccgggcacaatggctcacacctgtaatcccagcactttgggagtctgagcagggcagatcatgaggtcaggagtttgagaccagcctgagccaacatggtgaaaccctgtctctact

SEQ ID NO: 19700 - DNA, 584 bp, Homo sapiens
ggtatcccaatttttaatctatcctactgcaataaaaatatagtagataaggagaaacacacaaatgcacacatgcacgcatattcagtgcttcattaattttagtggaaaacaaatgacattagtatagtccttaggaccataaataggggaatgttatatattacaatacatccatatgaatgttatatattacaatatatccatgtatgattgggtacatccaatacatctaattctatgctttgattaagagaatgtgtggggcccatctgtatttacagagaaagatgtctctcatctcttgttaaataacaaagataaatgaccaagtatgatataaatacatttttgtaagaattgtgtgtggatatacacacacaaatgtgcaagcagttatatgagaagaggggcagggaacctatctgagcatctcttctgcacctaaagcaactggctttgcactgggccttgtcccctgggagcatcagaagggcccagctcacagcaacactcacccgcatgccgacctcacccggcagccccggctctcccagctctcctggctccccctgaaaaaaaaa

SEQ ID NO: 19701 - DNA, 655 bp, Homo sapiens
aaagtagttaatacagatgggatgcagccagacccgcctcatgcagtgatttcagcagatgcagatctgcctccaagctctcatgggcagaaagagccgcaagagaacagtgtccttgatgagcaattaactcatttacctaagtatctggtgcactaaatagattcacatcctgttctgtatgaatgaatggaaaacatcaaggatggcctttgtatgagtacaagtgtccaatgtgaaatctgtgtacaaagcacatgccattggaagcttggtcatcaggaaggcagaaaggaaattggctctttatagaatctttatagtacagaaacatatagaggtacatttccttcctctgagagtgccgttccataccacctggagagaatgccaggtggtaacaatgtacagcaggtttaatcaagacccagcatcctaaatcatgcgcagagtgccaggcgcgcaaggtggctcacgcctgtaatcctagcactttgggaggccgagacgggcggatcacctgaggtcagaagttcgagacatagcctggtcaacatggtgaaaccctgtctctactaaaaatacaaaaattagctgggatggtggtgcacgcctgtagtcccagctacccaggatgctgaggcaggagaatctc

SEQ ID NO: 19702 - DNA, 577 bp, Homo sapiens
ctaccctacagattgatatttgatgatgcaaaacaattaaacaaaagactctctttgctgacctgtgaaatctgaagtttttacggtgaaaagtgctaatacattttcaaagttgacatagtatatttatcactttacacctaacggtctttctatgacgaattgacttaagcgctttgtactggagaatcagcacaaattaccttttttaaataaggggaaggctgaagtgacaagcttgtctcccctggagttaacaaatacagttctcttttagaatagggcgctttaaagttggagaagttctgagagcttgagggtcattcaaactgcaaggtaccctgttcaccgagtaattcaggttcagaaaagtcaagcagagatatatgcagtgatgtgtgcaaggcttcacagctgggaggttgtactacatccccacaatgataagcctttgctgccttcttgatcacttttgctacatctgaattttgttcagtatcatggcaggaccttggagtatctttgtaatcactgaagggtgcaccaaatatgtagagagaagccgtgcttagaaaag

SEQ ID NO: 19703 - DNA, 604 bp, Homo sapiens
tatacttctttgggagctgccccatagatttctataatctgcattaaccatcctgcttactttccagtttcttcgtggttttgaaaagagctttgtctctattctgcaaatgttttccctgctgaatcaccacctcatgctccccttgaccttcagattactgtgctttgtactgcttgcttagacaaatttttagcaggtacttctctccaggcaccaatctgatcagtatcagcatgatcattaaatgctccctccattatctgataatttgttaccggaagagactgcccagtgcaacaattttgatgatgatacttaccatacatttaacacctatttggccaggggtgtgacatttattctcccaattaatccctataaaccctctgaggtaggtactggtattatctcaattttatagccagaaactaacacttattcagcatttgcatgataccaggtactgtgtatattctgtctgggctgctataaaaaataccataggctgagtggcttataaacaacagaaggctgggtgcagtggctcacacttgtaatcccatcaatttgggaggcagaggtgggaggattgcttgaacct

SEQ ID NO: 19704 - DNA, 592 bp, Homo sapiens
cactttgctgcccaggctggactgcagtggcccaataataactcactgcagcctcgaactcctgggttcaagtgatcctcctgcctcagactcccaagcagctcagactacaggtatgcactaccatgcctgtttgttttttgtttttgtttttgtagagacaggggtcttgctgtattgcccagcctgatcttgaactcctgggctcacgtgatcctcctgcctcagtctcccaaagcactggaattacaggcatgagcctgtgttctcccctctcttccaataatgtgtattcaacaaggccttcaggtgatgctgatgctgtctgaaagccactgctctccagcatgtggtctctgaaactttacttaggggtatgcatattaaaatatatatataacttaacactatgctactacaaagggcaaaataattcactttattgtactttattttagaataattaagacaaggataggcttcaatgaaattttgctttgatgttacatggtctgactgacactggatttcttcataagaaaaataaatgtgaaagctattccaagtaagcaaatggtggcaaaaacaatct

SEQ ID NO: 19705 - DNA, 647 bp, Homo sapiens
atctatttcttcccaaagaaaattcagacacagtacaatcactcagaagacttgtgaaccagtgcccacaaaatggctctgatataactgcatgcaaagtataccatatatataacagactcattaaatttaagcagtattttatatggtcctaaatgtggtcctgatataattatttcaggttgtgatttaatcagcatataatctagattcaagagacactaattattgcaaattaagatgttaatagcttcctaaaatgctccttaagattaacataacctaaaatccctaagtttcttttatacatgatattgttatgatccattttcctccatgctattcttataaatatggctttttagacccaactgcaatactttacttctgcccttattttagcctgtcagcttctttggagattgagaatgtcaactaccctattctccattcctcccattatcataacatctataaatctgatgttttcttaagttcacgaatagatgtctagaatagacaggagtgaaaacagagccatacgatatatcactaaaaatcacctatgagataggcatcaatgaactaattggcattcttggtctgctaacttttttaactgtactatcatctgatccacatttcta

SEQ ID NO: 19706 - DNA, 580 bp, Homo sapiens
gagagagtcaaattatataaagcaaaaatatcagaaagtaagtagaaatggataagcccccaaatattatagacatttcaaacacacatctttgagtaatagataaaagaaaaaattaaaagagtaagttttaaaagaagctagtggattttaaaaagggcaaatattatataaggaacatgaatattataattcatgttattttcatgttcatacagaatacttacaaaaattaacattttctagaccatgccacaaattcaaacaattttcacggaaataacgtgacacagaatatatttcctaaacaaacagcaatgaaggcagatatcaatacaaaaatgaaagctagaaacataagtctaataatattggttggaagctattttaatgaatattgaaatattttaaaggtgaatagtcaatacaaataaaccaaacacttttgtaagaccactaagatgcatgtgtaatgtgtaatgcctccttttataaggagtaaatctgtaacatcacctgggctatttgacaactgcaaagtgaatgtgagaaggagagaaacagtgagagagagagagat

SEQ ID NO: 19707 - DNA, 452 bp, Homo sapiens
ggtcagaaacactataaaagaaaataagaatgtcttgggcttcttaatagattagacttggctgagggaagatctctgagttcaaggatatgacaaacagaacaaaaatccaagatctatcagaggtgtaacaaatgcataataagaattctagaaggagagaaaggaacagaaacatttgaaacaataatgactgagaatttctccaaattaatgtcacacactaaatcattgatctaggaagctcagagaacaccaagcaagataaatgcccccccccccaccaaaatatatctaggcatatcacattcaaactttagaaaatcaaagatgaacaaaagtcttgaaagagaccagaagcaaaaaaccaccttatccatagaagaacaaaggtaagaatctttgttctgacttctcagagaagcatctgacttttcagaaatcatgcagca

SEQ ID NO: 19708 - DNA, 584 bp, Homo sapiens
tcacctaggtatcctacccagttactccctcacctccctgaagtggtcctgcctgacctccccattgaaaaaatatgacttctgtcattcacaattctatttgtgtacttgctaatttttttgattcctgctttaatatgtatgcttcataaggacagggagtttgtatattttgtttactgttctatccatagagccaaggtccatgcctggcatttaataggtgttctatgaatagttgttgggttcatattaatgaatatgttgctatgaatatttcacctgatcttaagtagagaagaacaatcataatcagccacaaatttcttatgctaacctctacctttccttgagctacttccctttccatatttagctggaatatcaaggcttagtttccatatcatcttgtctgatgttaaaattcactattgatgtttgggtgaagacagttatggcacagatggccacatgccccttaaacacatttcccaagccctcacctaggtatcctacccagttactccctcacctccctgaagtggtcctgcctgacctccccaaaaaaaaaaaaaaaaaaaaaa

SEQ ID NO: 19709 - DNA, 573 bp, Homo sapiens
cagattgctgggtcctacccaagagtttcatctgcatttttaccaagttcccaggtgacactgatgctacaggctgaggagccacactttgagaactactggtccaaagaaggctgctcagagctgcttctagtcagattcagtggcctgcaggtgaaggggtaggtgtatctggagccccacctgaagtctggcctggttttcagtgctctaaaagggatgatcaagactaaggattttaaagttaagaggaggctggactcagtggctcacaccagtaaacccagtgctttgggaggcccaggcaggaagatccttagaggccaggagttagaggttacagtgagttatgattgcaccacggcactccagcctgggcaaacagaacaagccccatctggccggatatggtggctcacgcctgtaaccccagaactttgggaggccaaggtgggcggacaacttgaggtcaggagtttgagaccagcatgccaacatggtgaaaccccgtctctactaaagatataaaaattgatcaggcatggtagcacatgcctgtaatactaagtactt

SEQ ID NO: 19710 - DNA, 562 bp, Homo sapiens
ttgtggagacagccacgtcgcaggcaaaggcaggcatccttcaggagctgaggcctcagtcctacaaacatgaagcgctacgttctgctaacaaccagcaagcctgggagagaatgagcctccgatgagatcacagccctggctggcaccctaatttcagcctgagcagaggacccagctaatgcccagactcatgacccacggaaaccgcaagataataaatgtgtgttgttttagattgctgagtttatggtaatttgttatacagcaatagaaaatggatacaccacatggggtgaggggtgccaccaaccaggaaaatggaaaagacagaggtgggacctcatgcccttttaaggcagcatggcagtgggagatgccaaagccttctagttctggcagccaagctgttcatatttattcacaagtcaggctgggcgtggtgactcacatctgtagtcccactgctttgagaagtgaggcaggaggattgcttaagaccaggagttcaagaccagcctgggcaacgtagcaagacaccatctctacaaacataaaacta

SEQ ID NO: 19711 - DNA, 593 bp, Homo sapiens
  misc_feature 210, 211: n = A,T,C or G
atgctattcaggagagtcaagggaaaccggtgcaaagaagcgtttgacaattatgagcacactttgttccttgggaaaacatacttggttagttagaaaaaacaaattaaaagaagaatgagctacatgttgtactaatacatttcattcttcttaacactaatgcataccttgaggtccttagctgtagcccctaccttccaggttttnnaaacaatatcattgcatttatttggggcttcagttaagattaaattaattgtttaaaccatgcactttttgaaaaataattactaaacagacaactctgggtatttttccattttctcatattagcataataactgggttttactatattatttcatcacaaagtcaatgacaagccaatctcaaagtaaaatattttgggattatgattatgttcactaccaccaatgccatgatacaaactaaacaatggaaaataaataaaaagctagttgaatttgaattaaatgatttttagctaaaacacagcaacgtgaacacatgtgtttatcttatctcctttgggaaacaccattaaatatattctaataaatgaaaataat

SEQ ID NO: 19712 - DNA, 506 bp, Homo sapiens
acccatctataatgagcaggaacatatatttttttaaagtttataattcctcactttattttcttattgtaagtacataaagtattaaaatttttcaaagtaaaaaaaaaaatttaagaaaattgaaattatatcaagcagtctctcagaccacagtggaataaaactgaaaatcgactccaccccaccccccaaaaaaattcacaaccaggcaaatgcatggaaattaaataacctgctcctgaatgagcatttggtcaaaaacgaaatcaagatggaaattttaaaactcttcaaactgaatgatgataatgatacaacctatcaaaacctctgggatacagcaaaggcagtgctaagaggaaagttcatagccctaaatgcctacatcaaaaagtctgaaagagcaccaacacacaatctaaggtcacacctcaaggaactagagaaacaagaacaaaccaaacccaaacccagcagaagaaaggaaataaccaagattatag

SEQ ID NO: 19713 - DNA, 408 bp, Homo sapiens
cgtgcttgactttcaagactggctcttctgcccttagcaaatgtccagtctatttcactgaaacagaaaaagcaaagtagaattgatttacaaaagtgaaagatggatttttgttagaagagtgatgactgaatttaattttatttttaaaggtctgtgtacagttacacaactcacatacgtatatgcacatatacacgcacacatacattgtcttgatacaactgcctgagggaaaaacacacgtttcctttgataaatctcttggtctgtaaaatttctaaatcagagatgaaaggcactactaaataaaagctcaccacaagacaggcatggaagtttataaccaatctgatgttgtctagataaccaattctgtgtttggagctgggtagcattgcacttctg

SEQ ID NO: 19714 - DNA, 584 bp, Homo sapiens
tcagtgagaacaaggagctggggcactcataacagtgactgacacatagaaagcattccataaaagattttgttaagttgatgagcaaatggatttttaaaagtagttaaagttttgatgaagatgtccataattgaacaatcaacattctgagcacgtttatgaaaagggaggcaaaataccttcattccagaatgttggaggaagaaaaggtttatctgggattacgtaagtagccatcagtgaactctgagggaagattctgggattaagaggaaagagtaggaccataaaaagggtatgtgcacaggagagtcagaagaaatgaggaggagctgagggaaggacagactgatttgggggaggttggtggtaaagaaatgagacagaaaagtgatgctcagaaggccagtagttgaggccaggcacagtggctcatgcctgtaatcacagtacttcaggaggctgaggcaggcagatcacctgaggtcaggagtttgagaccagccttgtcaacatggtcaaaccccatctctactaaaaatacaaaaattagccaggtgtgatggcacacgcctgagtcc

SEQ ID NO: 19715 - DNA, 648 bp, Homo sapiens
tacaatcttgtgcaagttatttaactcctcaatagtagccaccacaaccatcaggcaagattttgatagcgatcaaatgaaattgctgaaataagatgctcagcaaaacgactctctcatgaaagtactcattccatgtgaggttccctttgcttctgacagtggccactactgagactgtttcccgtatctaaataagactagttcgtaaagaagcacactggtgttttggcagaagagaaatgtgggagcataatgacaatactgctgacacagattttagacaagggaacacaatctgggtttaacacaatctgagtttagcatgaagcttaaaatcagaaagtttggagttcaaatttggttctaacatcttctagtaatatcatcttcaagtcacatatcctcataggtaaagatattaatgagtattaattgagataatacttgtaagtcatttgtcccagtctctagaacataatgtgctcaataatgacagtagtcattactatgcataatacagcattctaatacaacaaaaatataaaaattgttgcccttgaacataacttccttaaacaatggtttatagtactgtatagccagaggctagatattccgtaactgggaagaatgacatctgctatg

SEQ ID NO: 19716 - DNA, 525 bp, Homo sapiens
cccagcaatgccccctttgcacagccctgcaggatagggagggggcttggggtgtgaaatccacggggtaaaaatctgatatctggaacatgataaatcaccatttgctttcctatttcagaatatttcccccatctttttatttaatactgccgacaaaggacctgcagtgaccagaggggctctgacaactcccatctgggctctgcatttaaatccccatcagaagttacagaaaggggccagctacggtggctcatgcctataatcccagtaatttgggaggctaaggcaggtggatcacttgaggtcaggagttcaagaccggcctggccaacatagcgaaaccccgcctctactaaaaacgcaaaaattagccagacgtggtggcatgcgcctgtagtcccagttacttgggaggctgaggcacaagaatcacttgaacctggaatcctggaatgtggagcctgcagtgagcccagattgcaccactgcagcctgggtgacagagcaagactccatctc

SEQ ID NO: 19717 - DNA, 357 bp, Homo sapiens
tcaacgaactattaaaatattaatttaggaattaattgtaaagacttccatttttctttaatgtaactctttcattttcagggaattacttttaaacgtgtaggtgttccttctacaatggatttagttaaatctaaaagcatggattccatcaggtatgctttctgaacttgctgaataattgtttcttttgtattaggctattcatctgtaagctctcccagttcaaatagcagaaaattttaccaccagttttaccagcagacatttagttatattaaaatataagctcatgaggtcaggagattgagaccatcctggctaacacggtgaaaccctatctctactaaaaaaata

SEQ ID NO: 19718 - DNA, 491 bp, Homo sapiens
gtggctcatcctggctcaaaaagcacccccactgagcatcttgggacccccactcctgcccaccagagaacaaaccctctttgactgtaattttcctttacctacccaaaccctacaaaacggccccacccttatctcccttcgctgactctcttttcggactcagcccacctgcacccaagtgattaaaagctatattgctcacacaaagcctgtttggtggtctcttcacacggatgcgcatgaaagctacaatcgtggtttttggctatgtattcatttttctcctaccatttagctattaaagtttcattgctataatttcaaaggcattgagtttggaaatattaatatgaatataaaattacagcaaagctaatgtaaaataattttacttaatgtgaactaaaagagtaatgtttctttggtaatttaaaggataagagttccgtattttttttttaggatttaagtctttatatatttatata

SEQ ID NO: 19719 - DNA, 544 bp, Homo sapiens
cattactagttctgaactattagagcatgggaatcaggggtgagatcttgcctcactaaactgcccaagatttctgcaatgttgttatacttcttttagatataaggaaatacaaagggcaccagaaaaaaaatcatagacttattacctcataaccttaagaaattcattcatcaatctaagcatttgagaacttcatctcttttaatgtttatgagaatgttgtgttggaagtggggataagatagaattcatttaatgcttataaatcataaataataaacatcattaataagtgttttaagagtctaggaaaaaagactgcctcatatcactatgttatactaattatgctgtgaactggttgggcttttcctgtcaattttttctgtgaattttccaatgcatttgttgcctacaattctagcagctgccattaggtggtgccttctcatgggagctaaggcctaaataaaggaagaggtaaggtacacaacacaattctataaacagtagaacatgttatcaataatcataataaaat

SEQ ID NO: 19720 - DNA, 482 bp, Homo sapiens
ctttcttcctgtttacagtgaagtgtacccggaagatcatacttcgccatttttgactcttaatgtgcatgcccaggaagtttcttctccctggggtctgcctttaattaatactttaatgttgacaggtgtggaccctcaggaaatagccaatttatcactattagagaggcaatgtgataattgccgaaccatccgacatttctaatgggtgcagggaagaggtctctcctgccccactcagacctaactacctgtaacactctcatcccatcatgaccaggagttcagtttttcaggcttctctgggtccccttggccaagaggtggcccactcagtcatttggggaggtttaggattttagtttagtttatgctagactattcctgtctgcagggcctctgaataaccatcttgaaatatgtcaaagaagtatattttggggtaaaatgtttttggtttcctttacacacaaaaaata

SEQ ID NO: 19721 - DNA, 437 bp, Homo sapiens
attatatttttaatttactgtggatgactaacacttattagtattcttttctgctgccacgaacactgaaagcttctttctgtctgggtcttggcaaagtatgaaagtaaataattctttaaaatatacatagtcagtccaagaaaatcgggagacctcaattgagtttggagtcactgatgtacttcacatttaccttagaaaactgatctagagtatcaaagaaattaaaaataattaatttttagaatcacaatgcagtataaatcattcaaccaaactccacactctagatggccattaatttgcaagtgaagtaggtcactgggactcttaatatataccagggattttgttttgttttgttttttgttttttgcttttttgcttttttttagtttttttaattttattttcaatacagtgggtacatgtgc

SEQ ID NO: 19722 - DNA, 409 bp, Homo sapiens
actgtatctgtgtccgtgtgtgtgtgtgtgcctgtcttggtgtatctgtgtgtccatgtgtgtacctgtcagtgtatctgtgtcctgcatgtgtccgtgtgtgcatgtcttgtggcgtgtgcttgcatgtgtgcctttgtgtctgcatttctgtgcatctggatgggtatatgtgtgtgtgcctgtgtctgtgtctgtgcgtccgtgggtctgcctgtgcgtgtctctctgcgggtccacacagacacgagggcatctccaaacaggtggacaaggctgggcacagtagctcacgcctgtaatcccagcactctgggaggctgaggcgggtggatcccctgtggtcaggagttcgagaccagcctggccaacatggcgaaaccccatctctactaaaaatacaaaaatt

SEQ ID NO: 19723 - DNA, 625 bp, Homo sapiens
agattcctaagtacccattggatcaaggtccttaatcttacaaaaacttatgcaaatcaataataaagagatgataacccgataatcaaaaatagacaaggcatataagaagaaaatgaattaaaaatattcaaagcattcaacatatacaaatgcgctcaatctgatatataatgaaagaaaagtaaattaaaacaacaatgggcatgactaaataacagtatgagggagcctgaggagaaggagcatttgaaatttcagtacagaagaggaaaggggtgacttatagaaaaaggagacagaaaccatagaacatgtttggaggataagactcaaacaggtagtggggacccttttctagagtaggatgaaaacaggtaatgtgtgtggatgcaaatatgaggcaggatgtaatgggaagttgagcgaattcatatttagtcattcattcaaaaatacttaattgagttactgctgtgtggcaagcatcattctacaaacagagggcacagtgataagcaagccagtttgtactctcgtgtaacttacattctactttgagaagacagattataaataggttaaaaagtcaataatatgatgtttcagcatcaacaataaaaaa

SEQ ID NO: 19724 - DNA, 544 bp, Homo sapiens
gtttttttttaataataaaattgcttcagccattaaaatgaatcccagctgaagatagaaatgactgatgttaatcaaagacttgcttattaccagtgtgctataaatggtagtcaaaaatacacagggaaaagtttgcagcaattttttcttactgccaaggttagaccaacgggtactgagttttggaagcatctcccacaaggagtatttttgttttagttttagaagcaggtaacaacagaaaaataaaacaaaatacagcaaaaacccctttcactttggctactgtagatcagaacatccacctgcctcctggataaattaggaataagactttttagactttcattacatgcagtgttatttgaggaacaccgtttatcctaatgagcatgattataacctgggtctactataccaacagcaggctgctaattcttgccttttgtatgcttatttcccttctgatttgaacttaagaattctaaaattatgccaggcacagtggctcatgcctgtaatcccaacactttgggaagtc

SEQ ID NO: 19725 - DNA, 467 bp, Homo sapiens
gggaaattttaccacgttatttttagcagagtgcatgttaccctgacacaggccataaaacttactcacttctttggggtctgaggaatgtcatcttgtgactggttttacagggagaacttatcggggtgcagttgcagtttccagagtgagtcagtgccatcattgcctccgctgttattcagtgggtggggcacctggagcacaggaatgtgctctctgattccacgacaaaactaaggactgaggctcccctaggctcagttgtagattttgaggctcttgagtttcagttctccaatgagttccaggtaaaatgcagaaaccaggccaggcgccaatggctcatgcctgtaatcccagcactttgggaggccaagatgagtggatctcttgcccccaagagttcgagaccagcctgggcaacatggtgagaccccatctctacaaaaaatacaaaaattagt

SEQ ID NO: 19726 - DNA, 462 bp, Homo sapiens
tgtcggcctagtgtggattgactcctttccaccacattccccaaccaaggacagtctataccaagctcacagcactgaggcgctgggggagggccagcccacacctagccccgtcaatcttggtggcatggactcccccctaaagctttctcaggaggccccatttcctactgcagcggggcaagaattcgggaggagcccactcaaaggggagacagaggcagtgctccctgtgagcagctcttcctcctcagagctgtcatggacaattggagagaaaaaccgggacattctccccaaccaggatattttgtatgctttgcacttactgctgcgttcccttcatctaaaagctctaaaatttcaaataaaaaggtacaatgaaagcagcagcaggataaatagccacagtgatctgagctgaaaccctggaagctttattcacatctttagaaaaactct

SEQ ID NO: 19727 - DNA, 300 bp, Homo sapiens
taacttttgtatttttagcaaagatggggtttcaccatgttggccacctggtctcgaactcctgacctcatgatccacctgcctcagcctcagcctcccaaagtgctgggattacaggcgtgagccactgcacccagcctgtggtctttctttatgcagcgaagaacacctcaggtagctacaaatttttctctttatacttttcagtgttttcaaattccttgcaattaacatatattaatttatatttttaaatatatttaaaaagtaaagttttgctaggtgcagtggctcacactt

SEQ ID NO: 19728 - DNA, 354 bp, Homo sapiens
aaatcaaacctgggtaggttccagcatccataactcttagtgaaaaattctatacagccatatctgtaaaataacaaaatacattatcattaaaggaatattaaatatggataaataatgagtattctactatatgtgatgtttacatgattaaccccatgtattagttctcacactactataaagaaatacctgagactggccgggtgcggtgtctcatgcctgtaatcccagcacattgggaggccgaggtgggcagatcacgaggtcaggagatcaagaccatcctggctaacacggtgaaaccccgtctctactaaaaatacaaaaaattagctgggtgtggtggtgggt

SEQ ID NO: 19729 - DNA, 523 bp, Homo sapiens
tttgtgatctgtcatggtcatggtatttcagagttggaggatggtctgagttctgacctggtgtaggaatcccttctcccaaaactctaacagtacattctcaggcttcgtgagctcaggcttaagacacattattttctgatgctggacagcttctttaaaaaaatgtagtttcttacattaagctaaaatttattttatgaaagttcaagaattctggtccaaattgggatgaggcctatggtgcaggacttccgtgaaattttatgagattacaaatgcaaaacacttagaacagtttctggcctattgccagaattcaataattgaataaaggcaggcagaaatataacagagataaatgtcatgtgctgtacttaggttaaagtatagaatatattagttctgttccatcttctagggtttttattttattttattttttcattataaatcctccactggaattctagggtttttaaaatcaatttttaatagctaaaataatgctttttcaatctag

SEQ ID NO: 19730 - DNA, 463 bp, Homo sapiens
caaatactgtataattcctataattccacttatatgaggtacctagagtaatcaaattcatacagacagaatctagattgatggttgccagggatggggagaaatgggatttgggagttattatttaatggatatggagtttcattttgagaagatgaaaaacttttggatatggatgttggtgatatccttgaaatgtccccctgaaaatggttaattgtatgttacgtatatattttaccacagtttttaaaaaataggtttacttaaagtggttgaatatatgagcaatacaaaattggttatatttgaaacaagtattatttaaaaggacatcgtttacaatatcaacaaaagaaacaaaatatcaaacaataagtggaataaaatgtgtaagacctatatgcagaaagttataaaactttacaggaagtcattaacaaagaactaaatagagggagca

SEQ ID NO: 19731 - DNA, 335 bp, Homo sapiens
aggctagggactttctggattttttttcttgtcctcgtcctgagtgcagatcctgccaaaagacagaacctgcttcctctcctaaagctgtcacaactggaacaccttgtttaaatcttggaaacttttattttgaagtgtgggaaaagaaactgaggaagaagatcaaagcaaggagtaacattatgctcttctgaagtgtaatacagtctgtgtcagggaaaaggcataaaatagagagacaggaaacttcaccctgaaaataacaccatagaaagagtactctgcttaacattaacagctgattagagctaatgattaagtgtatcatctct

SEQ ID NO: 19732 - DNA, 345 bp, Homo sapiens
aaaagaatttttttatgttaaggatttctgtttcaggaattgagatctctgatctcctggcagacctcagaacagaactttctccagggccattatgaagctggaaaattcaccctaaaattcaagatacttttcagggtcagaggtgtcctcattcactagcaaaaaaagagcactagttagatttttgaagccttgggttggccagtttccccgctatgagatttaacttcatagaacatcaatttccttatctctgaaagagaagtgtcattgatgggctgggttctgggtctacctagtagaagaagagaatgggaggcagtggtgtcctggtaagcacat

SEQ ID NO: 19733 - DNA, 424 bp, Homo sapiens
caaaataataatagttatgacatttatgaagtgttagctctatgcagaacacttgactatttgcttcaaatggattatctcattgatgttcttaactaccttgtgagatacagatcatgaatatctctgtttttccagggaaagaacagatacttagagaagctcactaatttgttcaagggcaagaagctaataactggtgaaacaaatatttaaatcaaagcagaatggctccaactttacatctccatgccataatataactgcaaaacatatatatttaattatatataggaaatacgttaagatgttaaacatatatgacttttgtaacatagatgagatccattatatgtatttttctccgagttgtaaggattaaacgagatgtgctatgaaagtacaaagcatggcacatgacatg

SEQ ID NO: 19734 - DNA, 95 bp, Homo sapiens
gcaaagaaagaagaatccgaggagtctgatgatgacatgggctttggtctttttgactaaacctcttttataacatgttcaataaaaagctgaac

SEQ ID NO: 19735 - DNA, 447 bp, Homo sapiens
taggattaaaataatttaagttattaaatcatttcctctcacaccaagcctggcacaaaatgcacaaagtgagaagcaaagtggcaaagtgtcccaagaatgctgccaacagtgatgcatagctccatgatgagatgttgagagcttcactggggatgcaaactccaattagagaatttgacactggaagagaattcacgacttgttctaactcacctttcctctctgacctgggttccctcttatagaataaaactagtgtgatccaagtaacttttgatgacagtatttagacaacatgtcctcacactaaaacttaaaaaaaaacaaaatactgaacaaatactgaactctagttaataaggtattttttcccccacaaagccatgggttagcaattctgaaactaggactgaataaataaataatataccgaggaacatggga

SEQ ID NO: 19736 - DNA, 402 bp, Homo sapiens
aagtctccaaacaataatctcagcttctaccttcagaaatgaaaattaagtaataaattaaacagtaagtagcagaagaaaggaaatagcaagatcagattgaaagtcaatgacatataaatttggaaaaaagtacagaagatttgaaaggaacaagtaaaactatactcaaatataatatgcttgtctatgtagaaaatatatttgaatatattgtgtgaagcaatttgaatgatatgtgagcatatattttcataattttcatagatttttaggacatagggccttctaaaaatcaattgtatttgtatatactagcaacaaaaaaatcatcaattaaaacaaaaacaatttcttactttatcacataatatgtatgaactatctcgggataaatctcac

SEQ ID NO: 19737 - DNA, 471 bp, Homo sapiens
cctcccgagttcaagtgattctcctgcctcagcctcccgagtagctgggattacaggcacccactgccatgcccggataatttttgcatttttaatagggatggggtttcactatattggccaggctggtctcgaactcctgaccttgtgatccgcctgcctcagcctcctaaagtgctgggattacaggtgtgagccaccacgcccagccaagattttttttttctctctagtcaactgccaactactacatgggttcagatttgggttttggaaaggtgactagtgtgtgtgatcctttcatccacagcagctgtccccatcattcctcacgtcaatcaatggctggccttaaggcacgctttgctgggacatgagtgctcacacctctgtacacttcatgtggcggggggcactggtttatctccacaactgcataaagattaatgacagctttttttgggtcgggca

SEQ ID NO: 19738 - DNA, 492 bp, Homo sapiens
gattagggcattgcttctctagctttaacgtgctgtccgatcacctgggcaccttgctcaaaatggatgatgctgagtccagagattggggcaggggctgaggttctcctttccttaccagctcctgggtgatgccggtgctgctggtgcagaccacacttgatagcaaggctgtacggatgaggcttctagtgcgatttacacgtgcgtcctgtgtcactttgatgttgtgagttactgtgtaccgaggaaatgttagcattcaaaatcagacgtggggtcgggcatggtggctcacgcctattacaatcccagcactttgggaggctgaggtgggtggatctcctgaagtcaggagttcgagatcagcctggtgaacgtggtgaaaccctgtctctactaaaaatacaaaaattagctgggcttggtggtgggtgcctgtaatcctagctactcaggaggctgaggcaggagaatcgcttgaacctggga

SEQ ID NO: 19739 - DNA, 473 bp, Homo sapiens
aaagctggacattttcctttctctatggatatatgcagacataagaaatgtaaaggagatgtaggggaacctggcaaggcaagagaagatgtgaaattgattttagttttatttcctccctcctcagtatccacatttctttctctcatgttttcctgcctccctcctctccccattttttcctctattgaaactgaggggccgggtgtggtggctcatgcttataaccccagcgaaggcccaggtaggaggattacctgaggtcaggagttcaagaccagcctggccatcatggcgaaaccccatctctatcaaaaaatacaaaaattagccgggcccagtagcacccacctgtagtcccagctactcgggaggctgaggcaggagagtcgcttgaacccaggaggtggaggttgcagtgagccgagatcgggccactgcactgcagcctgggtgacagagcaagactctgt

SEQ ID NO: 19740 - DNA, 450 bp, Homo sapiens
agtagctgggattatagacgagtgccatcacgcccagctaatttttgcatttttagtggagacggggtttcaccatgttggccaggctggtcttgaactcctgacctcaggcgatccgtctgcctcagcctctcaaagtgctgggattacaggggtgagccaccttgcccaggctatattttatttttactagtttgtatttaaagtaaccttgagacttagatggataccttgttttgttttctaggccaaacaccagagcaccctagaaggtttaactaaaagaatgctcatgtttgacccagttcctgtcaagcaagaggccatggaccctgtctcagtggtaagttttccaagattgaacacctcgccttattttttccaagtgatgataacattattgtgtgttgaattattccttgaaatcatggccgggcgtggtggctcacg

SEQ ID NO: 19741 - DNA, 597 bp, Homo sapiens
ttgcccaggcaggtctcaaactcctgggctcaagcaatccacccatcttggcctcccaaagtgttgggattacaggcgtgagtgaccaagcccagccctctcaatcaccttgattaggagagtcctctaaagtcctaaacacaaccacttccttgctgggtgatattgggaagttacataatctctgagagtctataaatctgaaaattctgagattctggtattgtttcctcatgccaaaagtgaagataatatctgtcttggtttcctcattggattagtatgacaacaaaacatctcaacagcaagaaaaaaaaatccaatcaaaaaatgggcaaatgatctgaacagatatttatcaaaagaagatatacaaatgtccaacaaatatatgaaaaaacagtcaatatcactaatcatcagagaaatgtaaatcaaaaccacagtgagatatttagagactcattccaatttcaaccacaatgagatatcatcttaccaaattagatagctactatcaaaaagacaaaaaaagtaaaaaaacaacaacaacaaaacaatgctggcaaggatgtagagaaaaggaaactcttatac

SEQ ID NO: 19742 - DNA, 488 bp, Homo sapiens
gggcagtgactttctgagcattttgtagcaattagagttgttgtttctcgttcttggcattgtttttgttgccttgtgagagaagatgtgtggcaggatgctgctcttaaaacttttcctttaaattgactcaagctgttacttccttctgaatgtctgatcttataagacatagtagatgctattaagaaagatttgttttactgttgtttagcacttaaaacatatattttgtagttatatgggttagctagggtcaaacatataaaaactcaaatgctggctgggcgcagtggctcacgccggtattcccagcactttgggaggctgaggcgggcagatcacttgaggtcaggagttgaagaccagcccggccaatatggtgaaaccccgtctctactacagatacaaaaaaacaattagccaggagtggtggcaggtacctgtaatcccagctactcgggaggctgaggcaggagaattgcttc

SEQ ID NO: 19743 - DNA, 572 bp, Homo sapiens
gtgtgctcacaggagtctcacagaggagccctttgggatggaggtgcattgctctttaacctcttaacaagtcacctttcttctgttctcatctcaatttccaaaccctcacactactttctgaaagcacctcccaaagaaataacttgtagccaaatcctagtcttcagatttgtttaaaagcaaacctaaagggtttccctaagctagaacagatgtgtattgtacatggtgtaaaacctggtgcacattctagtacacatgtgtacacgacacatctgcatcaaagtctgagttaggccgggcgcggtggctcacgcctgtaatcccagcactttgggaggccaaggtgggtggatcacgaggtcaggagattgagaccatcctggcgaacactgtgaaaccctgtctctactaaaaatacaaaaaaattagctaggcatggtggtgggcgcctgtagtcccagctacttgggaggctgaggcaggagaatggcatgaatctggggggcagagcttgcagtgagcagagatagtgccactgcactccagcctgggcaacagagcgagac

SEQ ID NO: 19744 - DNA, 617 bp, Homo sapiens
tgtttcaccttctagaaacagtcttttcacttcaaatttaaaatgccatgttaagttagcatagaattttggcttcaattgttcctagatgttaggtccacttctcctcaatgccaattaaaatgacatagtctgatgtatgtgtatctgatgtttccatagcagctaacactaagcagctttacttcctaattagcttgacggtacactgtgaaattccttcgatccaaagatgagatgttataagatatggcctttgtgtaaatataaccttctatgacaggaagccaaaaaagcaaaatttatccagatgaaacagaaaggggaaatgtgctcagccaaagtgttaaattcaagctgagatttggcagaacactgggaagaaaatatcctctactgttttgttatcacacacacactcagtggaatacttaataatcagaaggaatttaaggcttggttctgtaatgcagtttggcaactggcatctccagtacccgaggtctgtacatatcatcacaacacattatttaatactgatttagaggatacatcagcctgctgattcagctccactacttcctgtcaacaatagtgataatattataaaaactctc

SEQ ID NO: 19745 - DNA, 535 bp, Homo sapiens
gaaatatgtttaggcatgagtaggtatgccaagcatatgaaattgcatgaataataagtagaacagcaggatgaggatgtaattgcatttacatcacaaagaaaaccatacctgatttacttgatcaagtttgctaattatattgagtcgaacatctggaaactcatcttttaggagggaaagaaaaattggaagaagttgttctatagttgcatcctacgggaaaaaaaggaaactctggtaagcttgccaataagccataataagggtgaaaaagaacctaaagctgcaccatttgacaagttacagaacataaaatatcagacatatttattccttcaaatatactgacttgcaattatcttgatgcaagcagttcatttcatgtggacattggataactcgagcataataagatgcttgaagccttgaactataatgtaggaaaagtaactagaaagaagctactaaaagattgttttgtggatattttagctgttaacttcaataaaagtgaaaggtctgaaaacatatc

SEQ ID NO: 19746 - DNA, 504 bp, Homo sapiens
agtttgcctccaagacaagtgaacatgttaacagaatatttacaaatttatttaaaatggcaatcattggtcctgagagatagggaagaaagcgttcttacttaactaagaaaatgatcagtaggtgaaatatccaagaggtgtttcttaatacatctctattctgctcctattttatcctgttatactgcagttccctgaattctcaaactcagaatttgacaaagtagaaaaaaattaagtgaatttacttgatgttttgaaaacaaaacacaaacagctttgcctagtacatgtataaagttattacatagtcgctatagattgactttccacctttcaaaataatagacaacaaaaatgaatctgaatttgtaaagcacatttaacctcctcaagctcttgaaataaagttattcattagcaatatctcaatgattaaattcaggataacatgggatttttttgaaaaagtgtgaaagcaaatagaagcatttattagct

SEQ ID NO: 19747 - DNA, 124 bp, Homo sapiens
tagtagccatagtcatccaaattatggagactccttatcagcccaccgagtcaggcaaaacagataccagtcccttcattatccctctgaatacccagaataccagatgcacaatccacttctc

SEQ ID NO: 19748 - DNA, 561 bp, Homo sapiens
ctcatctttctcttatgagagaatgttaaatgggttttttgctcctgtcctggaattcaagctaagacctgaaatgctaaatgtaatcagacaaccatcctttctagcctcttggttcatataagaagagggaaaaagatcagtcctgatgacaggctagttcctcctttcctgtttgaagtcagagaatgaggagaaaggaatggagatagaaaagcagagagaaagactgacatttcatgattagccagggcaatttcttttttgttttattttataatggctgctcagtaaggatagcctcagcttactgatgttgttagaaagtgacaattcttgccttgcagaaggattactctgcattgatctggcactttggcctcagtttgaaatagaatttgcctgcagctacattagcataataaaacacagcaaattcacagtctctttctggcacttttcctgcagtatttgtagaatactagaaactattttttacacattagttatacttgcctaaaaatcttcagaccatcatcaatctacagagatctgagagaa

SEQ ID NO: 19749 - DNA, 602 bp, Homo sapiens
ggaagcctcactgaggtgccatttaaagtcagcaatcttgagagagtacagtgtcacactgcagtagagaaacagctcagaatccatcagtgacagcaagctgtactggtagtttattatattctttgtgattactttctcatttgttgtcctttagcataaagactttcagaagttctacactgctttaactgcagagagcgtcaaagaaaagagtgtccacaatggaagagaaagaagaagaggtgaagttagggtatgtctgaggtcaagcacagtattgtggaaaggatgtgagaatccccccaggaggggaaccctcagaattcaagttccagcctcacagtctagtcatctacacctgcaagattctccttcctaaaaccagaggtttgaagttcttctcttaagggcaacagtattctcttttagttgttcccactaactcttaagaatggggcaacaaaattacctacttattaaaaagagaatgagtagagtccctatactaatatacttacagataagaattctaagaattctaaaactggtctcagttgagtctcaatcagttttttctaattgtaaatggagataacgat

SEQ ID NO: 19750 - DNA, 660 bp, Homo sapiens
ctacttatgacgtcgagatgagaggatctcttgagcctaacagttcaaggcgcagtgagccatgattgtacccctacgctccagcctaggtgtcagagtgacatttcatctctgaaaaaaaaaaactttttttcctaccttggcacaaggccagtgctacaagcagcagtcacacagtcccatgcctgacatgtgccctatgcacgccgaccccacccacttaggcaggctgcaggccctgtgctaattgaagaagcaggtggagagctggtaacatcaagcacagggacagatttcattgtgacatcaccaacagacagcaccccgctgaggtggtacccacagccgatagccatccagctgtacattactcacaacaggtaacccacccacccaccaaaccaggccctacccttaaggagggttggcccaggaggcacaaacacaagccttttgtgtctccattttggagtctgaaagccttcttgaagagaattctcccgatcagtctctccctcaaagaaatgtaatgtcacatatatattcacaaacaaaacggcattttaaaaactcttttcaaatcttacatttcagttttaacaaacagtactggagcaattggatgtccacaggcaaaaaaaaaaaaaaaaaaaaaaaaaa

SEQ ID NO: 19751 - DNA, 599 bp, Homo sapiens
ggaaggtctaagaaaggcaactaccaatgacgcctttataaataactgcagggggtggacgggggtgatgattctacaatttcatataaaacaacatttataaggatgctgtatcctcatgtgcaagcatccctggatgcccacaatacctcacaaataccatgagaaaattggactgcagactcttgatacatttcctttaagaaacaaccttttctgactctgcgcatttaaattccaaataaaatgttaattgcctgacaagcccgttttccttgtcatttataaaaatgtatacatcctgaataaaaagtgggagaatacttaaaagagtaggagaagaatcttgattttaacaacaaataattgtcacgctacggagttcttggctttaattgctgcttttgtgatttgttttggaatttgggctgatgacaatcacagagcccagtgttaaaaactaataatgatatagtatttcattcgaaacatttttggatcttgatagtattgatttgaaagaacaagtttaggccactcattgttagtattagttccaagagcaccctctagtgcccacagctttgaagaaccctgtg

SEQ ID NO: 19752 - DNA, 527 bp, Homo sapiens
atgctagatgactccatcagccaatatgttagcattatctagaggccttatgtgaagtcctagtggtcctttccagttctatgactttaaacatacaggtgaatcaaagcttcaggaaggcctagaccaacagctattactgaagctcccatttgtgcttaggactatgcatagagaaactctcctttgggacttggttagggtccaaagccctaaggtcaaaacactaattgggggcttcttacttcagatatgaagatgaagggattcaaaataaacacaaatcggctggtgcagtagctcacacctgtaatcccagcattttgggaggccaaggcaggtggatcacttgaggccaggagttcgagaacagcctggccaacatggtgaaaccccgtctctactaaaaatacaaaaattagccaggcatggtggcaggtgcctgtaaccccagctactcgggaggctgaggcaggagaatcacttgaatcctggaggcagaggttgcagtgagccgagatcacacc

SEQ ID NO: 19753 - DNA, 479 bp, Homo sapiens
tataataattacaccacatataatcataccattttctctatcacaattctgtaagcttcctgaaggaggaaccaacttttatccaaggggctttgaactattctcgcactcacaggacctggataatttgtcatatactaagaacactgctaaagagagaatggaaataatgactgtagttgaaaaacggttgtgtataaggaagggtatgcatacaaaggaaaacttggttagggtggcagtgttacaaacgattaaaacaacagcagcaacaaaaaattactacaggctgagtatcactatccaaaatgcttgggatcaggagtgttttggatatcaatcagactttttttggattttggagtatttgtgtatacgtcatgagataccttggagatgggacccaagtctaaacacaaagttcatttagattttgtatacaccttataaacatagcctgaacataattttacacactc

SEQ ID NO: 19754 - DNA, 508 bp, Homo sapiens
tcctacagacattgttgctggatcagccagcatgaagaatttagcatgaaaatgtaaaatctaatagctagcaagactcctagtctccctgggagataaactcagtcacattactgaagtctgctggaaatgtgacactaatgacaagcaggaactttatagctcccattttcctttgctgacattacaaatgtaaaacctctcatttccccagaagttcatctacttgatctatgctgctgagcctacatattctgtatctctttgacagcaggaaagattctggcgagaccagtgggcctgttcaccttgcacaggaataacttattccaggacatagaagccaccctaatctccccaccccttttccatccaacaccccattcagcatgcactcacttgcaaagtccaaagacactgtcagctgtaagtgagtcacttattatatcatcaagaatgtaagaggataaacaagcatcctctgaaaaaaaaaaaaaaaaaaaaaaaa

SEQ ID NO: 19755 - DNA, 543 bp, Homo sapiens
acagatttcttcgtttcttctccactcccactgcttcttcacttgactagccttaaaagaaaaaatatacgtatacatatatacacacacatatttctttaaagttatggagatttataactcattatatccaattaaaatataaaagtcaataagactttttgaaaaaaaaaagtattaaagtaaaaagctatacctttctttagcctcttgggaaatctaaagatccaggtggtacagcagaggaataatatcgctaccaaaaagaaatattatgttaagatattatctaaagtaacagctggcaaataagagatgtaacaggatttcatcaaaagttgtaacacagctgtgcgcagtggcacacgcctgtaatcccagcactttgggatgctgaggcggacggatcacctgaggtcaagagttcaagaccagcctggccaacatggcaaaaccccatctctactaaaaaatacaaaaattaactggggccgtggtggtggggcgcctgtaatcccagctactcatgaggctgaggcaggg

SEQ ID NO: 19756 - DNA, 340 bp, Homo sapiens
gactctgagctccagggaggcatggaatgcattgggtactacacctctaagccacataaaaccacactaagaccaagtggctctatgaagacggagttttgtggcagtaacagcaggagccacatatacaaggaatgatgttctggggttaccaagtcctctgacttcaaaagcgtgggggggctgaattctggctgcattcatgaatgacaaaaacaaccagaaatgaccaatgagacaccagtaagcccaaggattatgaggcaaatcaatagagagactgtaaggcaagactgactgcatgctctgctaacttatgggtctgcgggaattcagaatt

SEQ ID NO: 19757 - DNA, 579 bp, Homo sapiens
ataggatgttaaaagaaccaacccagaaagagagttttaaaaagctttgtcttccccactttcatttagatgtattctaatcagagactctctgaggccttttacattaagcacagcagcctttgtggagaaataaaaatatgtattaattgtacagccctcatagcaattaaatatctgggagtagatgctaccatgtgaggtcctggaatataagcgggagagcaaagatgcaagaataacattctgggaaactccccctcgcaaatggaggtggtttgatatggagaaagtgatgagctagagaaattgaaagtaaacaaggaaaggcttccgtttaggaagcaaggaagaataaagactgtcattatttttcatgtctactatgcatactaagtagtgttttagtcaatgttggatttgttgcataatatagcaaaggacctagactctaaaaagagttaaataaatgtttgctatagataataggaaggaagggggaatgaaagaagggaggaaggtaggtaggagggtaggcaggcaggtagcaagtagggaagcagatgaacaagagtgagt

SEQ ID NO: 19758 - DNA, 601 bp, Homo sapiens
tttccattgcaccagccccacgaatgcgacttgtgtgggggcaggctgcatggggacaggcctgcagggagcagggctttggcagggcacaccctccagggctcatctcaagcttcctggttgtagggtaaccgaggtcactaggcagctggggaggggtgggaaccaaatgtttgccgagcatccactgtgttcccagaactctactgggctaagtcggataccaggaatcatgactgtcataatcattgcgggcagagattcttaggttgttagtgcaacaagcaaccccagaggccagtttgcttggggttttcaaactcatggccatcagggtcaggcaggcgacattcatgagtacagcaggaggggcatgaaggctggtatgaatggagtatcgctgggaatgggagagcacagtcccctctctaaaggggacggccacgactcagcatctgccatgtggagccgtgggacttgggctgccacatctcctgatttttccaagagaacctagaaatctcaggtgaacgcctccagtcttgaaaatcagatttgggggccaggcacggtggctcatgcctgtaatcccaacacttcg

SEQ ID NO: 19759 - DNA, 574 bp, Homo sapiens
ccccaacatgcaaatgactcccatggttttctaccattattacagacaaaacatatgattatcatccatattctcaagctgtaatttgaaaccatttatttctattgaatcaaacttcatacccttccttgagctttacttcaacataatcatggaaccttcgtttttgggtcagctagtaatacttttagttttaatctcctaatctctctgtaaaacccacagtaagcattcctatgaactgatgaataggaccagaagctccaggtccaacagaacaatcatcaaatccacttctttttagcagtcaaccatacctaagtattttgctaggctacataaggacctataaataacatgtggaatgtatttcaattcacatttatttcatcaatcttgttcacacatattttaagtgtaattaaagacaaaataatagactaaatttttactgagtttatgcagtacctgtgagaagaatcttgaattcagaaccaaccatatatatatgcaaatgcttccacttaatttaatcatctacaaaaataaggtaagatcaggaactcatgaatat

SEQ ID NO: 19760 - DNA, 653 bp, Homo sapiens
catcagtgaacagaatacatctagtgctgcatgagggagcttcttttttagtgaaggaggacattagacacagatgtataaatgagtcattgaacaagataattgcaggcagagatggattctatgaaagaaataaatcagggtgatgagagggaaagtgacagagagacagctttaggttggaggctaaagtgaggcctttgaagaaatgataattcatgtgtgacttgaatgacaagataaaatgtagagagttagaggctgaggattacaggccaaggaaatagccctgtgcatatgttgtgagacatagctccaagacatagacatgcatagtttaattcaacttgactcttccagaaatgaattgaaggtcgctaggcctggagtgtcaggaagcaggggagaagttgtgagagaagagtttgaagtgagatgcctgtgtcatttaatgaagcaaatcacatgaaaaatatcactggcattttttattatacgacttatttaaaaatagcaataaaatttacttcctactttatcctaaggttctgaagacctttcaatggtgttcttggaggagagtttacaattttggtgtgtatcatgattgtaaagataccctgatatctttataaaatagaagtaaatttaga

SEQ ID NO: 19761 - DNA, 621 bp, Homo sapiens
tccaatcatcttaatatctctggtacataattgtttagacacagttttcctgaatgtttgctgaagaaatgttagcaccaatggcacttccagaaatgctagataaaaccaccaaggtgcgttatttcaggccctcaccttttacattatggttttagggaaagtgtaggaataaggacagagcagaatgtctgttcctacatctgcatgtgtgctgaagctgactgagcacttcttactgttaaactcgttccgcagtgttgcggcttagcagcattacgaataatatcatttccactatctctgtgtggtagctgttggtctgtcattcacccttgatttttgcattgtaattgcacatataacaaatgtataaaataaagagctagaactggtagcaaaaagatatattattgcatttactgtgctgcttgcaagtatgtttttatcttctcaacacctcaactgaggattgtatgtattctataaagcactttttagtactgtggttgggtcctcacagtgcaggaagtcctgagactattaagatatccctcaatattcacacagatttttgtaccaacgaccacagaattataggaataaaaattaaactggctc

SEQ ID NO: 19762 - DNA, 91 bp, Homo sapiens
aagtgagaaaaactcagaaaattaatttggagtctgaataatgtttatatacttaaaaaagatttgtaggtacataggtgtatatatttat

SEQ ID NO: 19763 - DNA, 575 bp, Homo sapiens
ggttttgttttaagccactaagtttgtggtaatgggttatgcaccaatagaaaactgatgaatagggtttgcacatactcgttttagtagatgccacaacagtttttcaaagtaccaatttgtattcttaccagcagtgtacgagtgttccacttgctctatatccttgttatcccttgttttgtcagtttttcacattttactgttttagtgggttcatgctgcattgcattatagttctttgttctgtcctttactgtttgtatgtccttagagccatcttttcagcagcctaagtcactcatttcccatcagcgatgtgggcataagaaaaatgtgaaagcgcctcgcacagttcccagaagagtaaatttcatttaaaatttgagacacaggattttcagtctaaacactttctttaactaacatttatgtatttagagacaaagaacacagtatattctgaaggcccaaagtaactcagcaggaccattaaaattaaattcactgaagagacaaaagaaatgttgcattggttacttttagagaatgaaaggaagtgaatccatttaatc

SEQ ID NO: 19764 - DNA, 630 bp, Homo sapiens
catctgatcaagtgatattgaaaacccttcaggtacggcttttagaagactttgacctatttttgcttgtgttgactctccctccagctttgtggaaagagggatcatgtaggttcatttctcaggcagatcagtcaccttttgccatcaaagttttagcatccatttcgaaaatttggtgtacaagttgatattttggtgtttttagctaatctggggtcaaaacagaatgccatagatgaggaagcttataaacaaatttgtttctctcagttctggagatggcaaaattcaaggtcaagtggttagcagattctgtgtctggtgtgggcttgctttgtggttcatagccatgtttctaccatgtcctcacatgacagaagagatgagggagctctctatggtgccttcaataggggctactaatcccactcatgtggtccctgccttcatgatctaatcattccccaaggccctacctccaaatatcatcacatagggaattagatttcaacacttgaatttgagagggacaataacatttggtctatagcatcaggttacccagagccttatgcattcggaggaaatccaaaatcttctataagtatttgctggtcccctctgggc

SEQ ID NO: 19765 - DNA, 614 bp, Homo sapiens
catgacaacttcttggaggtgctcatacaatgtttccaggtagcccctgtagtaactgtgaaaggccccatctcctaatggtgcatggcccattcgcagtgtcaagggcactgaagagagatcttaatggcatcatctaaaaattatccttaaccatgaacataagtttcttcttctggggtcacgggaagaggattccaagcagatgtgcaccagtcacttctgattgttagaacagtagtgttgctgctgctagtggcagccaaggctgatgtctaccaggcactgtaccaagcactttgtatacatccttatgtttatttcttggacaggtggcgagacttacccagccgtacaacacagccagtcatgagtgaagctgggagttgaaaccatcaaaagcctgagcatttctattaacagggagctcattagcacgtaaggcgctccacagctacctttaaagagttgcagagagattttggctcattatgagaaataaatttctgagtactctcatgctatgatagttggaagtgagctctgttctgaaaaaagacaattacagtgctgtctttggaatcacagatgtcaaaaaaaaaaaaaaaaaaaaa

SEQ ID NO: 19766 - DNA, 540 bp, Homo sapiens
gggtattagataatttcatatgacagatgaagtttatcagccttgtcatgtggtatgatttaatggctgtgtaaaaatactgtctaattcttggaaaatggctcgctttagtttttaacttttgatggtaaaatcttcacttaggtcttttaggctttaagggaagttagataaagtagacacgtgcatcatgaaatgacatttttaaagagtataattagacagaatataatattttgaattaaagaaaataatggaaagtcaaattatactttcattaataatttgctgtctattctacgtgttagtaatttaaaaaaataactattctgcatgagtaaatatttttatttaaaacctctaagaaactgcaaatgatttaacaaacatcaatatgttttgtgagtttgcagttcatgaaatgaggaaaaaacccatttgccatttgacatttctagtttaaaattaagattaaattttcagaagtagtaactaaattttgataaccctttcttcattaaaaaattaaaatgaaatgta

SEQ ID NO: 19767 - DNA, 609 bp, Homo sapiens
gagactcttgccttaagccctgattctttcaagggagcttaaatgtatccagtgtggtaacagcctctggctcttgagaaaagcaaacacaaattctctccggaataaagcatcaccaataaatgctcccaggatccctacagattatgttcaacaacattaccaaacttgccaggaaacaagcttcgctgagtgagatcaacagaattaactaaatacagatttagagtcatataaatttctgatgctggaactgtcagatacaaaatataaagtatgaagtgtttacagaaaaaaatatgtaactaaaaactgaacaaagaccaagagaccataaaaattgatcaggcagattggaaagaaaccacatagaaattttagaatcgaaaactataatcattgaaactcaatatatttgttaagcatcaaataagagaaagatgagtaaactaagagatagatctgaagaaattatccagaaggcaaaacagagacaagcagatggaaaatatgaaagataaggaaattccaatgagaaagcattatacacaccacattaaattagttaatatatgtaaacactcagaatagtgcctggcaattagtatc

SEQ ID NO: 19768 - DNA, 143 bp, Homo sapiens
tagcagtcaaccatacctaagtattttgctaggctacataaggacctataaataacatgtggaatgtatttcaattcacatttatttcatcaatcttgttcacacatattttaagtgtaattaaagacaaaataatagactaa

SEQ ID NO: 19769 - DNA, 442 bp, Homo sapiens
atggaatattacattgtgttccatagagagggagcgaatcttttctatgtgtgggacaaaggtctgcatggatatttggatggccagacttctagttttcccaaaagactgactctccttcttccgaagtatataatctatttccccctccttccttggtactggcaagagactacatttcccagtctgacttgcagcaaggtattgtcatgtactaatttctctctattggacagaagttctttgtgcaacttctgcctcattggcttttaagaaaattatttgtactgattttctctctttcttcttcctttggaatatagacaaggcagcagtctagttttgaccatggagatgaggacaacatcctggcatatgtcaatgcaatgagatgggctagggccctgagtaatctaatggagcagaactgtcatatttgcct

SEQ ID NO: 19770 - DNA, 501 bp, Homo sapiens
gattccgctcactctttatgctatttaattgacaaatggaactgatcttttatgtggccatagtaatgagatcataactccaaaaactctcagcaaagaaggaagttctggatgtaagcatcaactttaactagtcactaataacttcagctctgaaactcaattatattgcacatgttcaacagagaacacaaccatatcctccataataaaacatgaaattacttataaaaggtaaaattcttgatgtgtatgatctttcacatgcagagattactgaagtattaaagcaatgtgatgtattaccataaacgtcaaaatttttcaatggatatttctttcgtcttcttattctttttggctgtgtttctgtaggatgatggtgttataataattgaaaagattaattattgtatttgcacctgaacctattttatttaacattactgtgacaattgagagcaaattgtattgacaggcccttcttaaacataattatgc

SEQ ID NO: 19771 - DNA, 314 bp, Homo sapiens
cagaagggaaatagcctttactgaagttgtccagacatgtccatatacaaataaacaagcaaacaacaataagcttcaatgggcatcagtaactagagttacagctacatattatttaaaacctctagtttggagcaaaatactatgagacatgtaaataaacaggaacatataacccatacacaagaaaagaagcaaacacaatcaactgccttgttggagccaagataatgaacttattaggaaaaaaatttaaagcaattattataaatatgttccaataacaaaataaaaccacgtagattgtaaaaaga

SEQ ID NO: 19772 - DNA, 474 bp, Homo sapiens
cttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaa

SEQ ID NO: 19773 - DNA, 616 bp, Homo sapiens
tggttcgccgctgccctctcctagggtcatgggactatcccgtggatcccacagagaagacagactagagtccatcgctgacgcacctccacagaggactccttttctgccaagccacagggactagtcgccaggcaaaggtggtgttcactgtgatgcgagccgtggctcactggtgccctgagactggcgcatgcccattcgggaggcaggctcaggcatctgatgatggcttcttcctggattaggcccccacagaaattgaggaagttgttatcagtcatttataccctgaaaatattagttcaccagagccctggagggggatgggtagaagctcattaaagtaggtctggatggtgcacagagtgtgaagaaaacagagaaacccagaaagtctaagcctgaagacatctccaatcctaggagatactattattatgtccatcttacagaggaggaaactgaaacaaaggaagagaacttgatcaagaccatgttgccccacagtagaagagccaagatccaaacccaggtaacctgcctcatcatcagagcctggactcataacctcatgctgcagttaagcaggtttgcactgtggctagatacacag

SEQ ID NO: 19774 - DNA, 582 bp, Homo sapiens
ggttgttggagtaatctcatagatcccccagtgtcaaagaacttttaaaattgccgattaataatagatatgtatttcacctttttgcattaattgcctagagacttctgtaatctatttagggtaataactatctttaaaaacaaaatcaaacacaacaacttgttcttatgtttgcctttgtattccagaaggataaaagttttaaattctttttatggacagaggtgttcaggttaagttctcagagaattgaaagaagaaatctgtttcttagagaagctaaaatagtactttcaaaaaaagaaaagaggccgggcgtggtggctcacgcctgtaatcccagcactttgggaggccgaggcaggcagatcactatgtcaggagttcaagaccagcctggcgaacatggtgaaaccccgtctctactaaaaatacaaaaattagctgggcatggtggcacgtgcctgtaatcccagctactctggaggctgaggcaggagaatcctttaaaccgggacctgggaggcaaaggttgcagtgagccgagatctcgccattgcactccagcctgggctacag

SEQ ID NO: 19775 - DNA, 547 bp, Homo sapiens
ctgcacagtccttagtgacgtccttgcctctggcaggatcccctggctgggccctgctgcccccctcactttcctcagtccctgctttccagtgtgaaagctgtcagaatcaaaatggagacacttgtcttaaacaaaacaaaacaaaaccccaaccaatagagctgggaacagccctgacggtattccccacaaaaccatcacagaagacagcaaacaccacaatcgtgagcaaagtccatcacaacctcacacaaaaaacacttctgtgaggacacctgcccaacctcagactgttaccacccgtgttctcgattcctgtggcaaggataaatatcccaaaacaattctgtgattctcttcactttgccattaaagcctctgtgcttttacctccctgaaaacgcacagcggactccagcatacgtatttgcacgcaatgcccgactcctgaacgaacctcgttttcatttggagagcctctctggcggtggttcgggtggacgctagtgtggacatggcattgggaaaacgctgcctgtgcacc

SEQ ID NO: 19776 - DNA, 586 bp, Homo sapiens
caaagccagcctgaccagcacccagaggagttctggcccatggactcgatcaaggaaatttgttcatcattatcagggcaaatgcttcctcctgtgctggcagcaggacaaacaggctactccttggtgatacaaaccagtgaaatattcatgattatatgacaataatgaacctggccccttcttcccttcatcttcctgattctcactgtgtggcagggctgtgtgtgctcacaaacagtcctgtgtcctcgtcattatcataattaatcaatatttaataagtgccccccacactatgaaaagccctgtggtgactcaggatacaagaaagtggtagcctctgcccctgagaaggttcacaaatctaaatgaggaaagtagaaacatgcaccaaaaggtaaaccataaccaatacatggctgcagtgacatgggtttgggatttaaaaggccatcaaaaggccaggtgcagtggcccacacctataatcccagcactttgggagaccaaggcaggaggatcacttgagcccaggagttggagaccagcctgggtgacagacagagtgagtccctgtctctaca

SEQ ID NO: 19777 - DNA, 588 bp, Homo sapiens
atgttaaatgttcttactacaataaaaataaaattagaaaacacatttaggatgatgatgaggaagatttttgaacattgtctgtcatcaaattatgggataatttcccaagggaaatgtgaaaaaatgccatcattgaagacatttgaaaccagactgaagaaaaacacatgaacacataaagttggccttgttcttctgcctacatggatgacaagacccaaacatgacctaagacaccattagattttacagccgatgagcaccttctgaccacccactactgtgagggatgaaaggggaaaattgggctggaactgatgactcacatcaggaagacttgctcagtgtgttcctggctctgttacaacttcccgagggtgctaggaaaggagcagtttgcaccaagtcatcatactcccagttcatagaagtttccagggaatacaggaggctcttctctactgcaccccacttttttaattggtctgtgttttgttttcttttttttaagtcataaataacccctgtagaagaccagaacatacaatctatacagaacaaacaatctatacagaacaaacataa

SEQ ID NO: 19778 - DNA, 544 bp, Homo sapiens
ctgttctggtagaggcaagggcaacacattacactagaaacaatcactcattatgaaacgaaaccacagaactgaaatgagctggctcactaaggctgcaccaaagctgtgccatcaagtaagtgcagaggttacttgtgggaagggacagatgcaaacaaggacacaggagacagagagcagcacaagccaaaggcaggggcttacacggcgggaattaggaaggcccaatgccatcgtagccgcatcactctgtctcgtcatttcatctttctgcgcattagctagctcctctccttctatagttttgaataacttacgaaagtatggccgggcatggtggttcacacccataatccagccctttgggaggctgaggcaggcagattgctttgaggtcaggagtatgagaccagcctggacaacatggagataccccgtctctacaaaaaatacaaaaattagccacatgtggtggcacacacctgtgttttcagctactcaggagactgaggctggagaatcacttgaccccgggaggcaa

SEQ ID NO: 19779 - DNA, 611 bp, Homo sapiens
gtttcagttacctgcagcacagttcaataagatactttgaaatcagagagaccacattcacataattttattacagtatatgactaccattgtcctattttattattaaagtataataaaatattattaatctcttcatgtacctaacttataaattaaactttatcataggtatgtatgtacaggaacaaacgtagtatatatagagtttggttctatctgtggtttcaggcacccagggtgtcttggcaccagctctgtggataaggagaaactcctgtattttatttgtggaatttaaaaatctaaatacaacatttgtatgttaaacttcttcagtctgaaatgctttcagccatctactggggagcttggcactacctctgtggataagggggaactcctgtattttatttgcagaattttttatctaaatacatattttttgtgttaaacttcttcagtctgaaatttaagaataaaaaccagagagagtatgtgaagatttagaacgttactcggcatatgagagtagctagcaccaggccaggtgcggtggctcatgcttgtagtcccagcgctttgggaggctgaggcaggtggatcacttg

SEQ ID NO: 19780 - DNA, 665 bp, Homo sapiens
tggctcacgcctgtaatcccagcactttgggaggccgaaacgggtggatcacttgaggtcaggagttccagaccagcctggccaacatggtgaaacccatctctactaaaaatacaaaaattagccgggtgtggtggcacatgcctgtaatcccagctacatgggaggctgaggcaggagaatcgcttgaacccaggaggtggaggttgcagtgagccgagattgcaccattgcactccagcctgggcgacaaagtgagactctgtctcaaaaaacaaacaaacaaacaaaaacccacatatatcccacttttctttcccttccaaaagagagtatatggatataatttaatcatttttcctgtgttatgtataattgtacaattagaaacaaccaaacattaaaaggtagggaattgattaaataaattatgcttgatttaccttttaatgataatgctttagaagaatatgcaatgttggctggacgtggtggctcacacctataatcccagtactttgggaggctgaggtgggcagatcacgtgaggtcaggagtttgagaccagcctggctgacacggcaaaaccacgtctctacaaaaaatacaaaagttagcttgggtgtgattgctcacacctgtagtcccagctacttgggaggctg

SEQ ID NO: 19781 - DNA, 518 bp, Homo sapiens
aaaattgttaattaaatttattcatttgtcaatgaaatttatcaattaacttaaaatgtaaaaaatatacacatattaaaaaatgtaaacaatacagaaaaacaatccagaagtaagccttccaccccttattgctagccacatagttctgtcctccagaggtaaccactaattgccagtttctaatgtgtttttcccgagatactctatgcctataaaacttctctcttggctggggatggtggtggctcacgcctgtaatcccagcactttgggaggccgaggtgggctgatcacgaggtctaaagatcgagaccatcctggccaacatggtgaaaccccatctctactaaaaatacaaaaattagctgggcgtggtggcgggcgcctgtagtcccagctactcgcgaggctgaggcaggacaatcacctgaacctgggaggtggaggttgcagtgagccgagatcacgccactgcactccagcctgggcgacagagtgagagtggatctcaaaaa

SEQ ID NO: 19782 - DNA, 483 bp, Homo sapiens
aagtttgtgaatttaaatctcaactgacagtgatgaatttatttgctttgtgctgacaagacagtatgttgaagttttgttttccaactcagttctaaatctgcagtgtatcaaaatctcctcattatgctttggatgttatggtacataaatggtatcttcacaaagatatattcattctggtactgaaagtgcatacttaaaattcttcacgaacagttttattgaaaaaatatgtagacaagccattaattatacacagtgatctggaacaaattcttacaagaagcctagcatgtcttccattaactgtatacaatttataaaaagttattgaaagtcttcctgaggttaaacaataaatcttttaaatttaatcactgtgctccctcaaaggtagttttttctttatgacactcaggggatacagtcagatctcagcctactttaaacaactaggcagtatttttagtgcacttttct

SEQ ID NO: 19783 - DNA, 411 bp, Homo sapiens
ctatgaagtgactgactttccatgtccctgattatctcatgttgtaaactgtaatcctctcctatctcaagcctcttctgattaaaccatggcttctcctggaatttagaaacacattaaagatacaggagttataggttggcccagagacctgctatgtcacaattttttcttcaggaggttttagaggacaaggtagaggaagcatatttttcattttaaaatattttattgatagcatcattaaattaagaaattataaattttattttatttatttgatttttggcaccatttaagctacttaaatgaagtagcttgtggttggcagagcagtaattatcagaaacagctagaagggaaagacaaaatacaaaaactatccatgtgaagctatgagtaacctgctag

SEQ ID NO: 19784 - DNA, 92 bp, Homo sapiens
ttgtatcgtatctaatagcacagtggtaaatgaatataatttgcaagcgattattcagactgcatggacaaaatgcttttaccacacggatg

SEQ ID NO: 19785 - DNA, 480 bp, Homo sapiens
  misc_feature 179, 180: n = A,T,C or G
tacaagagcaacaatgcccagaaacacaccagtgtaacaaatgctaacaaaatgattactgaaatcctattttttataataattaaacataaattctagttaattatggcttagaatcaagaagtttccttaaactgtagtaccactactgcacaaactattatgtgggcttgctggtnngctattatgagaggagcactctattaaagtcaggatattttctccattcatctttttaaaaaattgtacaatgtattagtctgtacaagaattcatttttaagcctaacagaagctgttaagatatcacttacagtaccatttaagtgctcactgctgaatctgtagcctttgaacatatactgaattatggctctgtcaaactgcacacatcccagccaaagggtagtcaggggagggagccaggggaaaagcagtgaagtacccccatctatattcatttgtttgtctctgcttaagt

SEQ ID NO: 19786 - DNA, 559 bp, Homo sapiens
catgatgtagaacaaaaccaaacccttagacctgcctcaagtgacatccatattcttgtagtgtctcactaagaattgcaccaggcccacctcaggccaaattctagaaagagaccagtaggtatacagtagtggttcatgtggcgtttacctttgatcttcccctcagtcccatttttacctctatcccatggcttttccagaatagcaagagctatatgtggccaccagtcagctgacgtgtcaaatgccatgagttcagtataactttaaagactgaatgtcggccgggcgcggtggctcacgcctgtaatcccagcactttggtaggccaaggcgggtggatcacgaggtcaggagatcaagaccatcctggctaacacggtgaaaccctgtctctactaaaaatacaaaaaattagctgggcgtggtggcgggcatctgtagtcccagctacttgggaggctgagacaggagaatggcatgaacctgggaggcagagcttgcagtgagccgagatcaagccactgcactctggcctgggcgacagagcgagact

SEQ ID NO: 19787 - DNA, 346 bp, Homo sapiens
aggttggccaggatggtctcggtctcctgacctcgtggtctgcccgcctcagcctcccaaagtgctgggattacaggtgtgagccactgcacccggccttaactttctaattagtgatacatttataagacataaatagctatccacagagttaacaaaataaactttggtccacaatctggatgagttcatattattttgataagatttggtatataacatatttggatgaatgttgttctttattataccttgttaagtagttaaaatgacatttattcaaatggttctgaaactctcttccctggttgtttgaaaaatactccagggttggccaggtgcagtg

SEQ ID NO: 19788 - DNA, 440 bp, Homo sapiens
cattcaacctatcctggtgtagagagatcacaaagaatatttaattagcatttctcattaaaataaatgtgtgactttttttcttaccttcaaaaatgacatggcctttgaaaatacatactggaaatgagctgggaagagaagggttggattttgaaggcagccacttgatactggggagtttgcaagttgagccttcctgagtccttcccattctttcatcggggggagaagaagactttgctgtgcacctgtatataatagtgaaattaatttcaaatccaggacctgctttattcttacctcagattccatgaaacctgctttaaactttttctaatattctagaaatctactctatccttacccaagggatagaggatatttctgtggcacccaagctgttcagtgaacagatgaactgtcccagggtcttcact

SEQ ID NO: 19789 - DNA, 524 bp, Homo sapiens
aaccaccactatttatttctttttggttcacaaaatgatgcgataaacacaagtgatgaaatcacacggcagtctgtcctcaattaatgaggggaatcatccagattaatcagactacttttacattaattaatttaagttagaattgaaaggaacatgcttaaattaatatacagttttcttgacaccttacgaacaggtctgtaggtcacaatttgagaaataatgttatcatgaaatgattagttggaatgtctctatagtctaggatttaaatcacatttcaggtagaaagctggccaagactcttaggattgtaagtggcagaaatccaattgaaactgtcataacaataagataaaatattggctcacagatttgtggagattactgagaagaaagaaaagaaggaaggaagggaggaagggaggaaggaagggaggaaggaaggaaggaaggaaggaaggaaggagaaatagacaaatccacaaaatcagagttggagacttcattacgtctctctc

SEQ ID NO: 19790 - DNA, 427 bp, Homo sapiens
gggcaggtgagggaatgctttgtccttcttttgctgtattgtggtatttcaaggccacctccatgtatgggtacagatggaaggataagttagcactggggacagtgccagaggcctttggctttgccagaggcctttggctttgggctttttgtattcttgtgaacccttctgcctccaaccatctgacattcatcatatgacattatttaaattcacatataaaaattattgttggccgggcatggtggctcacgcctgtaatctcagcacttgtggatcacaaggtcaggagatcaagaccatcctggataacatggtgaaaccccatctctactaaaaatacaaaaaattagccgggcatggtggtgggcgcctgtagtcccagctactcaggaagctgaggcaggagaatggcgtgaacccg

SEQ ID NO: 19791 - DNA, 510 bp, Homo sapiens
taattagcaagttttacaatgctctctgatgcccaagatgaactaactacattcgcatttaccgttaaccaattttagttctgtcaagcaaggtcagacttaagaattatcacagatatttcccaaggtccaaatgtaactcaaaagaatctttggaggcaaatatcctggtgtgtcttagcataattttctttcacaaagaaagagatactcaaccagttttcatggcaaacaatacttaatatatttgactagctttatgcaaatcatcctctcttaaaagtaagaacaggctggcagcaatggctcacacctgtaatcccggcattttaggaggccaataggagaggactgcttgagcccaggaattcaagaccagcatgagcaacatgctgaaaccgtatctctataaaaaatacaaaacattggccaggtgcggtggctcacgtctgtaatcccagcaccttgggaagctgaggtgggtggatcacctcaggtcaggagttcaag

SEQ ID NO: 19792 - DNA, 379 bp, Homo sapiens
agttgttatatttcatgccttgtagagaataaaaaccctgatttaggaatgagttagccatatttgcaaggttgttgtgctctgccgttaactacaggtgtatccacttaatcaatctgagcctcaattcctccatctttaaaatgttcacagtaagatcacgaggtcaggagatggagaccatcccggctaacactgtgaaaccccatctctactaaaaatacaaaaaattagccaggcgtggtggcgggcacctgtagtcccagctacccgggaggctgaggcaggagaatggcgtgaacccggtaggcagagtttgcagtgagctgagatcacaccactgcactccagcctaggcgatagagcgagactccgtctc

SEQ ID NO: 19793 - DNA, 607 bp, Homo sapiens
atcattgacttccttgaacaaaaccattcccaacacctaaaagctttatcatgcaatcaattctgttgaaaaaataaacacattgggtctgtttttctggttttcatttgcaaaagtaattagaataagttagaaacctgaaactcaatttttctactcatagattgtgctgcaacaattgcacaaacaaatgtattgtcattctcatgggtgacttcctactgtggagaaagctctccagtggtaaatgtttgtgctaaagatggtgtatccagttatgtgtgtgacaagagcccccactgaaccatgaaaataattactgaacttaaagagaatgaattaaaattatcttgtctgagaaacagaaagcaatagagagtaaagaagaaagaagagattttcagagaccatcgcacttgcaaacatgctcatgagcagagtctcagaaaaagaggacagagagaaagcagaaagaatacttgaagtaatgaccaaaaaacaaacacaaaaactaaaactttccaaacttgatgaaaaatgttaaactactattcaagaaattcaataaattccctatgagataaactcagagaaccacacataaata

SEQ ID NO: 19794 - DNA, 601 bp, Homo sapiens
tagacaaaaagttaaaacgtactgtgacttttaaaggagacctgtttgaaataggccatcctgagttaactcccaaagcttgaaaggttagagaataatactccagataccatctgggcaaattaacaacgctggatgatgcgaaaccaaaactttaatgaagaattccatgaataagtagaatagatgatctcgccctatctaaaattaatttgctttcatttccaaactctgacgctagcagagttcttcctcaaaatgacgaacctgtagagcattctgggcaatagcatgcaaatgagtaagatcgctgtgttccctgcttggattctggcagaccacttcatatggcaagaaatatgctagggtagagcttattccaatcttaatctggttgttttcagattttctgtttgaggacattttgtcattatcctagttttctagtgttcctctttttaatgtctggtagctcaattgtcttttctttcatgcctcttttccagcatttcaggccagtttgatacctttattctctccattttagattctaaagcatccattgagtgtctaaatgtatctggcgttatacaggtgcttt

SEQ ID NO: 19795 - DNA, 422 bp, Homo sapiens
ggaatgtgttaaatattagcaaaagcaggtattgcagaatgtctatacatttctgggcaggtggagattattgaaagatttttagaaataatcttcgttcaccacattccagtgccaggccctggacttctgtctctatttgtgataaaatgtttttaagaaatgctggctgggcacggaggctcatgtctgtaatcccagcacttccagaggctgaggcaggtagatcccttgagcccaggacttcgagaccagcctgagcaacatggcgaagcctcatctctacaaaaaatacaaaagctagccaggcgtggtggcctctgtctgtagtcccagcttcttgagaggctgaggtgggaggatctcttgaacccgggaggcggaggttgcagtgagctgagatcgtgccactgcactccagc

SEQ ID NO: 19796 - DNA, 607 bp, Homo sapiens
ggcacacagtagcatgcagtacatgttgtataagcatatgaaacttgactagtgtccagtggtgatatgacgtcaactcagatgtgtttcaggtgttctgatgcccagctgactagatctagccctttgtccttatggagacactgcagtatctgtctaagggtttttctttgtttaggaatgtgcagtataccttttactgagatatttggtgtagggccagttcctgcactgcttaaatgtcattaattcaaaggtttatcatcaatttaataatcacttttgaggagcaagagggaaacatctcattaaagataaagaaggattataaaatgcattctgggctgggttcagtggctcacgcctgtaatcccaacagtttgggaggctgaggcaggaggatcacttgagcccagcagttcaacatagtgagacctgtctacacacacacacacacacacacacgcacgcacacacaccccatctctgcacacacacacatacaagtttggtgtgttggcatgtgccttactctcagctactccagaggctgaggtgggaggattgcttgagttcgagaggttgaggctgcagggggccatgatca

SEQ ID NO: 19797 - DNA, 631 bp, Homo sapiens
gcacctctcccaagaccagaatggcagtgggtggtggtgctgtgatcccacactctgacccctgacaccctaaggcaaacctcgcacctgccaggctgacccacagccctgtctgcctctctcactcctcccaccactccacccctcttgacagggaggtctcctcaacacagagaggcccgttctgcctccataaatttgtgccagaaaaaactgctgtccaaagacccaaccctccagccttacctggagaagcctcagtgccttccccaccagatcttactcttaccgtctgaggccccggcactgtgcttttgctctgttaaaatagaaaccagggcatactatgtcctgctcagagctccccagaggcttaaaatagaatcccagggtggtgtgaaacccatgagcttaacttcccacctcaaaatctagaaaaagaataaatgaaacccaaagtaacagaaaaacagagtatataaatctatgaaatagaaagtaaacaataaagaaaattaaaaaggcaagcaatgttttgaaaggctaaaaaaaggttaaatttctagctagacagaagaaggagagaaattaaaaattacaaatattaaaaataaaaggagtgccttcactg

SEQ ID NO: 19798 - DNA, 456 bp, Homo sapiens
gggggcacacaggattctcccagaaagcaaaatggaaacttatcttctatttgttaagcctccctctgtgccctaaagactctatttgataatttatggacttttaatttaattatgacagtaatccggtgaggtggattttattatcccactttatagataaggaatcaaacattcagagaataaataatctgcccctagtcatgcagctagtaaattgagccaggatttcagaacaagcctttctgctttgaaagcccatcccttctccattagaacatgctgcctcctgataaaatgcttggcgaattgatacaggagatagcatatgccaccgagggcaggataagcattttctggtagaggagccgtttgctcaaggaccgagaagtgggtggaattggcacgtgtgactggggagaggatttcctggaggcaacaactgtgaaggagtcg

SEQ ID NO: 19799 - DNA, 615 bp, Homo sapiens
ttttccaattcttaatggccagtcctagaacactacaatccattcaaggatatgttaatttactgactgaattatgctgtgccacctccccacatcacttggcctgtatagtccaaactccagtgagtttaacaagcatttagctgcttgttaagatcaagcttctggaactttaattaacgattgacttgttactagttttattttatttgagactctgacttttcatttgagggcaaattatgctcatcatttggcaaaaggtctactctggttatctgatggcagccttttatgtagcacatttttatgacatgtcacattgacatcatgatcacttctctacagctttgcacacttagaccttaggatttatacttttcactgagttctttccactttatataaagtgtatggtaattcagaaaaatatgagatgataagaaaagaaaaaaagtcatgcagtgttctggctaaataaacaaatgaaatgttagcaatgaagtgagcacaagataggaagggaaaaaatgatctcatatggcctgactatgatgaaaactatgtcacctaagagtctgtacagaagacatcattcaaagtcatgtgcaccac

SEQ ID NO: 19800 - DNA, 506 bp, Homo sapiens
agtaattacattagcaggtttagttgtcatgaatgagtttgggaacaatcactgatgactcttggtaagcccctctgtgggaaagtagtatctccctgggtatccaacttgcagggagtgttcaggatctcatgttctgtagaggtcataaggagtgccagctaatctgggctgtcatgtagacacagctcagtggagagttttctggcaaaaggaggagcaaaggccctggggcagagaaaatcttggagagtacggaaaggccatgagactgaagtgtaataaatgaggcaggaggagtgtgtgcgaggacaggacgcaaagagagatggggagaccagaccttatagagtccatgactatgttaaggagtttggattttatactacaaacactgggaagccaatggccagttttaagccaggaagacagataagagaggggcacccctgtatgtaataactacccatcttctttcctggtaaagttgtgtgagactctcaccc

SEQ ID NO: 19801 - DNA, 450 bp, Homo sapiens
aaagacattcatatgaaatacccaattgatacctttctagggtatgaattaaagctattagatgcattcagaaaagacacacacaaacagagatatatttatatttgagaaatacaagtagaagtaactgcagaatactggattattatgtttatgtcaaaatggaatgaggaaattctgtttagggtgatgaaacattttggaaatagtggtggtggttggacaatactgtgaatataatcaatgccactgaattgtatacttaagaatggcaagttactgtatatatattttgccacaataaaagaaaagttttaaaaaatggaaagaacttcaaatatcaggtttattggcagaaggagaccacagtcctagttctggctttgccactaactcgctatgggatttggccaaatcttagtggttgatttctggacctacagatggacc

SEQ ID NO: 19802 - DNA, 486 bp, Homo sapiens
aaagacattcatatgaaatacccaattgatacctttctagggtatgaattaaagctattagatgcattcagaaaagacacacacaaacagagatatatttatatttgagaaatacaagtagaagtaactgcagaatactggattattatgtttatgtcaaaatggaatgaggaaattctgtttagggtgatgaaacattttggaaatagtggtggtggttggacaatactgtgaatataatcaatgccactgaattgtatacttaagaatggcaagttactgtatatatattttgccacaataaaagaaaagttttaaaaaatggaaagaacttcaaatatcaggtttattggcagaaggagaccacagtcctagttctggctttgccactaactcgctatgggatttggccaaatcttagtggttgatttctggacctacagatggaccaaacccttcatttgacttaagcaggtgaagcaaact

SEQ ID NO: 19803 - DNA, 411 bp, Homo sapiens
tagatgaaggcttaaagggaccaattagtgcaccacaaccttcttggaagtccactgtcatgataacttgagattagtgttctgtttcaaatcccaggaactccaaacctggaattttgaaaattaccccaaaaagaaattgaggccagtcctgggagaagtgtcttttactgtctccgtggcagattgcattagagtaatttggcacttattggattctgccagaatggtggggtgtggtcagcataagaagtttctgagttataaggacctgatatgataatgaacccagacacaaccctctgagccacagacccatccaggccctcaattaaggtccttgagatggaactgcaaatgggctttaggtggcttagtctgatgagtaagccatgactgaccccatgcaga

SEQ ID NO: 19804 - DNA, 77 bp, Homo sapiens
ttaagtatttgagtttgaacaaattagctctgaagggaagagaatttccacaacatgaaggggaaacaagaaaattt

SEQ ID NO: 19805 - DNA, 461 bp, Homo sapiens
aggtggagagattgaacttgaactagaggcaaaaagaccttagcttctgagacttagtggaaggtggtgagtatggtggttgaggtatcagcttccgaagttagggaggatgggaaatagaggcctttcagatctgatagcttttgttttcatggagtaattgggggaaagttgtttggtggggattgggagtaaatgagaggttaaagaaagtaatgaagatttagttaggtcactgaagggagcgagaaagggaaatgaaaagattgtttggcattgaggacccagtgaaatgggaggtcatgaatttaaagggctcagtttcagaaaagagaatgtagatcatggaccctaggttggggctttactagcaatgtgtgacaaagagacagggatgcctgtgagggagtgatctaagcggtcagccatgcatctggcagggtaggggcgtcagtgagccg

SEQ ID NO: 19806 - DNA, 447 bp, Homo sapiens
aactaaaattgaatattagaaataaaacatttggctatttcatgacttccctaaaagctcatatattcaagctgtctacgaaatattttgaatcttctcatgggcaaaatggagaactgtttatatacacagtatatgtaatttaagttttctctttgaaagaaactaagttatttgtgactaacacacctcttgaactgctactaacagcgttcctttctttcctatttgtctgtatgattggttcaaaacaatcactgtactagtttcttccagtaaagagttccaaaaataattttcatagagtaaattttaagaaactgtttaacacatatgcagctgctactttcaaattatgttaattacttgaaacagttactttcaactgtcatatgcaggtgttaaaaatagtttcagttaagttctgagttatgcaaattattccat

SEQ ID NO: 19807 - DNA, 571 bp, Homo sapiens
cctggccaacatggtgaaaaacagtctctgctaaaaatacaaaaaattagccgggtgtggtggcgggcacctgtaatcccaggtactcacttgggaggctgaggcaggagaatcacttgaacctggaaggcggaggttgcagtgagccaagatcgtgccactgcactccagcctgggagacagagtgagactctgtctcaaaaataaaagaaaaaagatcaacctgagccagcacaggcttcttgtaccctgagctgtggcttcttccctgcgtggaaacaacaggtgtctgtcgttggcttcaaggtcggcggcgtctgaaccgcctctaaggggcagggttggggacagtggggaatccaggtccggtcgggaacgcccgtgtggatttgcagacgctgtagttttggggatgtggaagaaaaataagtcttaggctgggtgcggtggctcatgcctgtaatctcagcactttgggaggctgaggcaggagaatcgcttgaacccaggaggtgaaggttgcagtgagccgagatcgcgccattgcactccagcctgggtgacagaccga

SEQ ID NO: 19808 - DNA, 522 bp, Homo sapiens
gccaatccctggactttgcaaagggctattttcgaaggaccaccctgtggctggctgtgacaaagccacagtcctgtatgctgtgctcatacaactgagagtcccaccctgggccctgtgggtgatgcaggaagagccctgaccacagaggacatggagaagcaaaggcagctccaagggggactctgaagggaacctccctgtatgatcccctagggctgccatagcaaactaccataatctggggagcttaacacaacagaaatttattttctcacagttccagaggccagaagtacaaaatcaaggtgttggcagggttggcggcttctggaggctctgagggagaatctcttgtgtgcccctctcctggcttctggcaattgccagcaatccttggcattccctggcctgcagctgcattactcgcatctctgtctccatcatcacatggtcttcttccttggatgtgtctctgtgtgtcttttcctgctcttataaggaccctagatactggattca

SEQ ID NO: 19809 - DNA, 538 bp, Homo sapiens
tgcgtattgtttttgtattggaaagatcaaagcagggaataacagaaaacaggccacaaaagaactcacgtgtcatgctacagacgtaccaatctacctgccacttaccgagtgacagccagcatcttctgttggtcaagggtaaaatataatggtttgtggaaccaaaatgcctggctttcagaacttgttctcacacttctcttatatgtgacctcctgttctactcctcaattttctatctgtaaagggaagtgatgtgaaagagcctacctcatgaagctgttgtgaaggctaaatatgtcaatgtttgcaaagctaagaaggctgtggccacattgtaaggacttagtacaagtcagctatcatttttatattactacattggtcagttaattcttcctacaattttattaggtgagtgttattgcctactttacagaagaggaattcatattcagagactttacctgataaagctaatattacatgggaagtaaacggtaccacctaacaaagagctagtagagactgtctt

SEQ ID NO: 19810 - DNA, 529 bp, Homo sapiens
acttaactctgggaggataggtggagttttgtttgtttgttctgagacagggtctggctctgtaacccaggctgcagtgcagtggcataatctcagctcactgcaagctatgcctcctgggctcaggtgatcctcccacgtcagcctcttgcgtagctgggaatacaggcacacgccaccacgcccggctaatttttgtattttttgtaaagagggcattttgccatgttgcccaggctggcctcgaactcctgggctcaagtgatctgcctgccttgagctccaaagtgctgggattacaggcacgagccactgtgcccagccttatagttttgaaagtactaacacacactgttcctcaatgaacctgcagctgagatggggcaagtcctccttatcagctgaatctgtggaagcagatggctgcaggaggctggcgctcttccaggagctgaggatgctccttcatgtcctgcaggaggacatgaagcctctggtgggggaaaaaaaaaaaaaaaaaaaaaaattt

SEQ ID NO: 19811 - DNA, 593 bp, Homo sapiens
gcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaaaaaaaaaaaaaaaaaaaaaaaaaagggggcccttttt

SEQ ID NO: 19812 - DNA, 605 bp, Homo sapiens
ctgagattacaggcatgagcaactgtgcccggccgctatatggaatttaacaagaatgtggttcttcttgtggccctaggaatttagaaatctgtcatgcagcagggccctgaatcttccacccataggtacctttcatttccttaactttagagttcatcttagtcagtaaaggggcatctatttttgtctctcagatcacagttgaaaatactttcttctggggaatgagatggaattgggcaagggattacaggagtactataattttaaaattgttattacagtacttcactaagagttctctttctctcagacacacatccctacatccttctgaattaagactttgactatacaagtgtgtctatacaagagagaaaaccaagaatgcaaactaatttctatttttactgtaattgagtttatggacttcattgacttgtctgatgagagagttaattccaacacgttgtaagctctctgaaacagagcttgttgggttaaggttggaataggattggggttagggatgttggggtgcttccagtggaagatcacaagccagagtgcctgaagtgggaagcagaagcatataaccagac

SEQ ID NO: 19813 - DNA, 529 bp, Homo sapiens
gctcaatggggaagaatttattgtcataaggatgtaggagtttcaatattttggcgagaccacatggaggtagaaaatctgagctaacataatgtgctaacagtgtttgaagattgtgtgataatggcacatcctgagaactatttcagcttctgatagtagttgatgtagtttggatgagtgtccctgagcaaatctcatgttgaaatgtaatcctcagtgttggaggtggggcctggtgagaggggattggatcatgggggtggatttctcatgaatggtttaccaccatcccttgtggtactgtcctcataactgtgagtgagatctggtcattttaaagtgtgtagcagacatgcacagtggctcacacctgtaatcccagcactttggggggcagaggcgggcaggtcacttgagaccagcagttcgagaccagtcagggcaatatagtgaaacccaggctctacaaaaaatatgaaaattagccagcgtggtggtgcccacttgtagtcccagctacttggga

SEQ ID NO: 19814 - DNA, 596 bp, Homo sapiens
atttcctaccataagtcactcaactgtatctttatacctactggtggtcacatacattgttattagaattactctatacttttgtttcttatattgcatgcctagcacacataggatactgtttataatcttatttctaaaggatggtcaacataccacccttaaaataaagattgatgaattctatgtccaaattcttaaggcagaaggtatttatttaaaatatatcaaacaggagctcaaagtcttgcaatcagcctgccaacatggcaatcaaaaaatatgttttggcactgacaataattcaaaacacaatttacagtttggagacacagggaacacacggcaccctcaggaaacttatactcaataggataagaagtagatttttcggccaggtgcagtgggtcaggcctgtaatcccagcactttgggaggccaaggtgggcagatcatgaggtcaggagtttgagaccatcctgactaatatggtgaaaccctgtctctactaacaatataaaaattagctgggtgtggtggcggctgcctgtaatcctggctacttgggaggctgaggcaggagaatggcttgaacc

SEQ ID NO: 19815 - DNA, 509 bp, Homo sapiens
ggaaagcaggcagagcctgggagcagatcaatccaaaattaaagccatgcagatggcctgggcctataaattccgaaaataatcatctcacatctggtcacaagttactctgtatgctataattctctcctgttaccctatacctttaataaagctatgttaaatgctataacttaccctgggcaacatagggaaacccagtctttgcaaaaaaatgaaagaaaaaaaaatagcctggcatgatggagtgcacctgtagttgcagctactagggaggctgaggcaggagggtggcttgagcccaggaggaagaggctacagtgagctatgatcactccactgcccctcagcctgggtgacagagctagactgcgtctcaaaaaacaccaaaattatagctttatcttagaaatcgttgaggaactatgagaagggtctgtgtccaaacttggactacagtgataaacgggacagtagcccctttgtttgtgtgtgtgtgtgtgtgtgtg

SEQ ID NO: 19816 - DNA, 611 bp, Homo sapiens
aacgtgtcatactctaggacccagctagtaccaaggccagcagaaatttgggtgtagtcctggctaaccccaaagcccatgatacttctcttattcttgcctcccactgcctctggaaggcagaatgcagtgtgtgaatgactcctgaaacccactcttctcactcaatattgggaacctaatttgttattctatcaggactatgcaaggaggtaaggcttcaaagaatcagtccaaaaacaaatttccaacatctcctatacatatgcagataattgaagactagaaggtaggcagtttgttgcacatctataaataacgttgaccctggtcaaccattttccacagacaactcttttggtgctgacttcaagtagtggttttgtgtagtcccatgttggtttctggatagttcaagatgagatggacaattttacagttaaggaggtaggggcagcggggggtggatatcactgtcttcctccttcctcagggcttgtcagaccagttggaaggggatgaacttgtcagttgctggaagcaattttcaggccctgtggactgtggaaagggttttaatcaatctggtatttcctagtcctgactctcct

SEQ ID NO: 19817 - DNA, 429 bp, Homo sapiens
tggttgcaatagtcaacctgagctcaaagcaaagaaccattctgcacatatgcacaatcagctcagtatcccacttgctcctgacttgcatgtaggcaaccagggccttttgagatgggccttcgctctgttggccaggctggagtgcagtggtgtgattaaagctcactgcagcctcgaactcctgagctcaagctaggactgtaggtgcacaccactgcacctgggtagccagggcccccttggttcttatatactttccacctcacttacctcctcttggggagcctgaccttaaaaaaagaaagataactgattcccccagttttgagtacagcagtggtggtggtagacagtaaaatacaaacaagtattacttgttatgctgacctaattattattttttcaagaccttgggattatattctt

SEQ ID NO: 19818 - DNA, 534 bp, Homo sapiens
taatagataatttgtgagttatttgagtctataatagctctaagattggagattacgtatgctactcagagaaagaaaagaagatggggaaacaagaaacctgaaagatgttcaattcaattaaatgtcaagtattaaaattttagcctgaaggaatgaaaatttcaggttatagacaatgatggagacctccaggtagcccaggaaaatgactgttattgaatttggatctctccacacatcctccagaaacctatacagaccaataagaaacataaatgcaacccacataacccccaatgttaaccaaaccagaagaagaataattccccaacttcaaattacttgttagtagaaaaatataggctgaatttcagcagaacattcaacttaagctctagccacaagtctttgagtagagggagcaatatcccaattgccccaccccatcttgtcaaagtacgtaaaagaggaagaactgaagggccaatattaaacctgcacataatgaaacgatctgttaaactcttgagt

SEQ ID NO: 19819 - DNA, 587 bp, Homo sapiens
aatataaaactacagaaccaaacagaatcccaaaaaatgaggtaagcaggtgagattagataataaaaattagttaacagtagattatatactactttaaatatcaagtaactccagaaacactatacattttacattacctcacatgtgatacacacaagcctatatgttcccattttacaaatgataaatttgagatgaggatgtcagatgatttttctaaaatcttgtagctaataaatggcggagccaaaaattagaagccacatcctaactcaggtttctaatctcacattctttccatcatactatattgattgccatcatccctcccaactccaaaacatccattatgtccatggtataattaaatgttactctgtgagagttttcatggggcaggggaaagaggaggggttggagatattaatacatcctatagtgttcaaataattttaaaagatgtggaacttgaagaatgggtagaatatggacaggcaaaaagatgacaaatattctaacaggccaaaatagcatcaataaaggtattaagtgggcaggtgcaatatatatgccaacttttaagg

SEQ ID NO: 19820 - DNA, 603 bp, Homo sapiens
caaaatggcaaggttatgaattcccctaacaattgcctacaaattctcatgttcagcaaccccaaatctcagatttttctagactctcaatgctttcagttattctgggaaaacaaaatccacccaaatgcaaactataatatccaagccttacagcctcttacaactgctactctagctacctcatacttgttcttcaggtcagaaggccaaaacacacttcgtttcttcactctaagtttaatatcttgccttaaatctgaggaagcattcttcctccataaacaaatgcatgtatttgtcttccagccaactgaactagaacttgtacactagtttacttagccctagacatccaaattgctccttccaatcaattccttccaatcccactttatagttctagcagagaaaactgagcaatccatctgattgccctgttcattggcctagggattgccattgggttaagcatgggaataataggtatgagcctcacagcccatacttattataccctctcaatggaacaccccaccaagctcaaacatatctcggacacccaggaagtcctccaaaatcaggccaacttcatagcacaaa

SEQ ID NO: 19821 - DNA, 528 bp, Homo sapiens
gaccagcctggccaacatggtgaaaccccttctctactaaaaatacaaaaactagccaggcatggtgatggtcacctgtaatcccagctactcgggagcctgaggcaggagaatggcttaaacccaggaggcggaggttgcagtgagccgagatcacgccattgcactccagcctgggcaagaagagagaaacttcatctcaaaaaataaaaaattaacaaaattaaagtttctgaatatttgctgctaataactaaaatttaaatcttccaaagttcaatttaaagccttttagtgagaaaatggcttacttatcatgagcctggagaatgtaattatttacaacacagactttaaaggcaaacctaggttcaaatcccaactgtgctactgttcactgtgtgatccagggcaagagaaaaattttctgtcttcaccgtagctcagtctgtttcctcagctgtgagatagaaataacttggagaggtttctttaaggattacacgaataggccagtggatcgcttga

SEQ ID NO: 19822 - DNA, 469 bp, Homo sapiens
aaaaacagtttttcagaaattatcttttgaaattgaaatatattaaaggtgtattatgagagaaaaatatcgatattaaaataatatgtaagataaaatataaatcacataatatatttgtttttatataataaatgtatctacaagagtatcaataacttgtcgtctctggctgagtgggattatatttattacttaaattcattgtttcttttgtttcaaaatatttagtgattattttctctaatgatatatacaattagcataatcataacaaacattatagcttatgcaacttaaaatgtaatctcaaaacaattctatgatatatttttattaaatggtttactcatggtccaaaattggaccaggtacaattactttgttaggcgtatggtccatgactctccatctttttcctccaccagggttgattcataactgtcatgcataccacatgtttctactt

SEQ ID NO: 19823 - DNA, 584 bp, Homo sapiens
cagagagtgtttttcctaggcaagcgtttctatactgtcgtgatgagcaaactttctcatctttgttacactctaaaacagtggaaattagccttggggtgctttgtgaggaaggctgagtccccaaggaagtgatagtaaatctaaatggggtttttaaaaccacaggcagtgtgatattctgcaaaagcgtaatttgtcactaaaaaggcagtctgaaggtatcatttttcattcacgcagcagcaaaatccttgcatcctgcatatgtaataaaggacaccttctgagacactgaggaaaaatagaagccgagctggcctctttgttctagacaatgtaaagaaactcgctcttgcgttttgacaaggagcgtatgtctatttatatatatgtattctatatgtgtacaaaaatctcaatctgaatgtaattaaacatggaaatgtgaaagtgtttaacagacttgcagggaaattttaattatacttgggaacagccaattgtaagagacaactgggaaaggaaaaaaaatgtttcagctgagttctggggcataggtaaaacttttgcaaagaaagtca

SEQ ID NO: 19824 - DNA, 494 bp, Homo sapiens
ggtactaaatcctagggggagggggacaggccctgaaaccagtttacactggatgtgtatgcaaatcattacaacaagcagtcagggggttggcttcagctcacagagcagaagacatttaggactggcaaacaatctcactgccaggcagtttgaggccaggaagatgacaaactctaccatacgctgtgtattccagggcaggtcacttaatctctttgaaccccaacctccatacgtgcaaaacagagcaaatcatctgccctgacaaccacacagtagggagagatgtctgatgaaacaacagatgtggaagcaatttgtagactttaaagctctattgttagcatttcttgttacttttataactatctcccagccttagtctttcaccagcaaacgtgtgtcaaagtacagcatttaagaggaaacccagaagcagagatgtcccaacaaactcacaccaaacaccttctgagaaagtccaggaagct

SEQ ID NO: 19825 - DNA, 440 bp, Homo sapiens
tctctcaaacagaaagcgtgtgggatttgacctttgataaaagaaaaactttaggagatctccggcagtcaatatttcagctgttagaattttgggaaggagacatggttcttagtgttgcaaagcttgtaccagcaggacttcacatttaccagtcacttggcggggatgaactgacactgtgtgaaactgaaattgctgatggggaagacatctttgtgtggaatggggtggaggttggtggagtccacattcaaactggtattgactgcgaacctctacttttaaatgttcttcatctagacacaagcagtgatggagaaaagtgttgtcaggtgatagaatctccacatgcctttccagctaatgcagaagtgggcactgtcctcacagccttagcaatcccagcaggtgtcatcttcatcaacagtgctggatgt

SEQ ID NO: 19826 - DNA, 607 bp, Homo sapiens
acggacgtcaattagattaccatggcacaatacggccggaggtagggcacaggaagttaaaggtatttatcctggcaccagctgcgataatggttatgactaactcagtcagtaactttgaaagtctgtgataaccagcattgaagccaactgtgtttataacatgatggaaagtgtgtttgtgctaaaagcatatctgtgaggtgtgctaagaggtcatcctcaacagttttgggcttcttcctttaaaatatgtgattaacttgcttctggaattgaaaaagtaattctgcagtaagttattttgaagtgaggggtagttttgaagtgaggggtagtttaacactcattaggtgtttattactaataaagtataagctttgtttcaattcttggactaggccaggcgcggtggctcatgcctgtaatcccagcactttgagaggccgaggcaggtggatcacctgaggtcaggagtttgagaccagcccggccaatgtggtgaaaccttatctctgttaaaaatataaaaattagctgggcatggtggcaggtacctgtaatcacagctacttgggaggctgaggtaggagaattatttgaaccc

SEQ ID NO: 19827 - DNA, 547 bp, Homo sapiens
ggagctggagacccagggagtagctggtgctgctgttctagttcgaggtttgtggagctggagccttggttgggagccagtgccacctcccaagtctgagagtcattgagctggagatccacgggggagctggtgctgctgttgtagtttgaggatcatggagctggagacccaggtggagctggtgctgcagttggagtttgagggtcagggagctggagatctggggaggagccagtgctgctgtttaagtctgagggtcggggagctaaacatggagccaaagttggggaagtagagagagttacaggatgaccctggaaacggtgatgtagctgtagtccaagcaagctaagcttgggaacttctcaatgctagtgatgagtgcattctttttcctcttatacagtttggatttcttttctgtctcataagacagaaagttcctgattaatacccttaggaattgaaaaccttaaaaaaactaaaggatgttggtaataataataataggaattaaaccatgattatcctggctgacagagac

SEQ ID NO: 19828 - DNA, 476 bp, Homo sapiens
cacctaaactctgaggtttctccagggcaaggactatacatgatttatctttgtgttctcagtgcttagattcaagaatgccccacacaccaaaagcattttgtaaattctctttgcagttactattattattaaaagcttttgtcaaatcccttttctattgaacttccaacaataaaagcaataattttctttttcttaagaacatcgatgaatgctagaattgaaggtagtagctactgtagacaactcagttacccacattcataaggatagtttgttaatacaaaaagctggaaatttttttttttagatggagtctcgttctgtcgcctaggctggagtgcagtggcacaatctggactcactgcaacctctgcctcccaggttcaatcgattcttgtgcctcagccttccaagtagctgggactacaggtgtgcaccaccacgcctggctaatttttgtatttttagta

SEQ ID NO: 19829 - DNA, 502 bp, Homo sapiens
atgttaatattttgaaaccacacagattggataacaataaaggtaaaaaaaaactctttttttcagattgctaattgtagcagacacaaaagaaataactctgagatatagtatataatacgtgaatgacttttatattagaatctatagcatcaaagtgctataaaagtaaatactgaatagagatacaacatttgcgactggcactgttgcagggctatctgaatgccatttctaaccctcttcttctttgcttccctcacaccatagaatttgctcttagcggccgggtgcggtggctcacacctgtaatcccagcacttagggaggccgaggcgggtggatcacgaggtcaggagatcgagaccatctggctaacacggtgaaaccccatctctactaaaaattacaaaaaattagccgcgcgtggtggtgggcgcccgtagtctcagctactcaggaggctgaggcaggagaatggcgtgaacccgggaggcggagc

SEQ ID NO: 19830 - DNA, 506 bp, Homo sapiens
tgtccttgaatgacgtcctctttcctgttttatccccaagcccctgtatgtgagatctgccatccttcccctcaagagaatattctcccctaccctttgggtaggagtcctttcatgaggaaggtgggattttctgactaagctctacctaaggcattatcctttggcctaagggaactgaagtttccagcagaagccacagagctttaagataggaccttgggctgggcgcggtggctcacgcctgtaatcccagcactttgggaggccgagaggcaggtggatcacaaggtcaggagatagagaccatcctggctaacatggtgaaaccccatctctattaaaaaataaaaaaaattagccaggtgtggtggcaggtgcctgtagtcccagctactcgggaggctaaggcaggagaatggcgtgaacctgggaggcagagcttgcagtgagctgagatcgcaccactgcactctggtctgggcgacagagtgagactccgtctc

SEQ ID NO: 19831 - DNA, 561 bp, Homo sapiens
aaccgaggcagtgagtagtgagtgcccaagcacgagaggaggggacaaaggctgggtccccggccatcaacaaacggagagctagctcataaaacagtgacctggagcttcagtcagcagccctcactcccaaaaggggtgaggagtcttcagaaactcccctgtcttatggcagaaagctgagctctgcacagaccctggaaaaaccactgttgtcaaaggagagatggaagtgggcagaaagcccaggaaggagggttccagactagtggaggtactagcctcaaacaagacagctgagtacttagagaagaagagatacatgccaggcatggtagctcatgcctataatcccagcactttgggaggccaaggtggaaggatcacgtgaggtcaagagtttgagaccagcctggccaacatggtgaaaccctgtctccactaaaaatacaaaaattaaccgggcgtggtggcgggagcctgtaatcccagctactcgggaggctgaggcatgagaatcacttgaacccagtgggtgaaggctgcagtgagctgagatcg

SEQ ID NO: 19832 - DNA, 533 bp, Homo sapiens
tattctttttagcaatgagcattagttctgtttttcttaacagtgaggcaaactatgtatatttacattttgtagaatatttcctccaaaattggtttctgcatactttttgttttttgctatcactgtttgggcttagagtagtatccttgaggctcgtctcatcttttttatttgttttgtttttttgtttgtttggttttgttctttgagactgctgcagtacaatggagcgatcccggctcactgcaacctctgcctcgtaggttccagggattctcctgcctcagcctctggagcagctgggattacaggcacatgccaccatgcctggctaatttttgtgtttttagtaaagaccatgttggtcaggctggtctcaaactcctgacctcaggtgttccacctgcctcggcctcccaaagtgctgggattacaggcatgagccactgcgcccggccaaggcttcccttatctaagaatagaatctttaaaccattctgtggttatatcatttttagttaaagttttta

SEQ ID NO: 19833 - DNA, 440 bp, Homo sapiens
taaagcacaaaagcaggcaataataatctatggtgatatcaatcaaggataatggttaaccaaacatggtatgttttcacatgtgcatatgtacaaaaacatattccttcacatgcttgtgaaggaatgactgaaagggggttttggggtgatgtcagtgatgtattttctgatacgggtggtggttacacaagtgtgttaagtttgtaaaaattcattgagtggtaggtttataatttgtgcacttttctgtatgaatgttatacttcaaaaattagctgggcgtggtggcgggcacctgtaatcccagctacttgggaggctgaagcaggacaatcgcttgaacctggaaggtggaggttgcagttagccaagatcgtgccattgcactccaggctgggcgacagagtgagactctgtctcaaaaaaaaaaaaaaaaa

SEQ ID NO: 19834 - DNA, 543 bp, Homo sapiens
aaaagtttaaaaggtgtaataatcactggtcttttgcccttgtttacttaagaatctgtctgctgaaaattttcctgttgcccttattatatttgctttgcagcagtgacgaataatctatcttattctgtggataaaatctccacacttcacggagattttttttattgttggaatttagttggatctcatattaaataatgcataaacattgcgttatccaatcttatctctttttctttggtcctgcttgctaactaaattctccccctttaaaaaacattctttatatgcttgatatctctcctcctctttgctactttttccttcagtaccataaacataattgttgcaccatggtgctcttgctagaaataggctggaattcctgtaagctccacttgatcaagacagctcccctgttgattttgtggtatggcaggtgtgacttttccctgcccaagtgacaccaccaaatactgttaacttaagtggacctgttttggccatgaggagatgggttatctttctgaattagctaag

SEQ ID NO: 19835 - DNA, 493 bp, Homo sapiens
cttttttctctctaagcaatactttttgagaaaggtttaaacatttattgttattcttaattagggttaaacaaagagatttgttaaaaaacaattttctatcccatttaacaaaggaccattaaaaatggtattgttacactactttaagatctggatactatgacatgtattagtaatcatgaaatgcctttaggctgagtttagaaagtattttctccaactgcaccccaatctgttaatcttttcttcatcaaatgccagcttttgttatcaggtaagcctacattagtattgcctttcaatagccaccattgagacttgggtaaatgtgttgattttcttatcttctccattgatgcttctgcctactgcctaaagcctaggaggagtagaagagaagggagtgtggatatttacagcatagctttcgttcaagttttttaaaactgaaatctttattgttactcaaggatggaaagaaatctgactc

SEQ ID NO: 19836 - DNA, 603 bp, Homo sapiens
gatttatcatggcttttctgcaggaatgacacatcatgggatcagtagttgataagggaaaaatcttctttaggagaagaattctacccaataaataagtaaaatgatagaattagaatatcaccatttagcaacctgtaatgaaagtatagatctgagcagttaccatcaatacctgctaaaaaccagcaggtgaaaagttgatgaggaactgcctgataaatcttaatgtcatgaaaaatagaatcacaagttctgtgccttctctgggataccatagaatgtctacaccaccacctatgaagcagtcttgcaaaataaataaataaatgtcatatctcaccaagtctcctctagatctatgaccattttacaggtaatggagagggtggcggaacatattaaaccacatcaaggaggaaaaccaaaactgtacaaccgttttcttaacaaataaaacaaggggagaaattcaaaaacattctatatatttgataattctgagaagtagtctccatttctttaaatgtgatcactgtattgtgcttatgcttaaaaaagatttctactgaagtttttactgataaaatcatacaatatcta

SEQ ID NO: 19837 - DNA, 576 bp, Homo sapiens
gtatgtctttattaacagtgtgacaatggactaatatagataccctccagtttctacctattacatatatggcaatcaagtagcttattctgctctcctctgtctccctctgttcttctatatttttattactttagttctgttatttctacttttggacatagaacatttacatattatcctcacgcctttgtctctgccttcattttagtctcttcaattaaataaaggacatgttcaccacagttacctgctgtattttctccagttatctcttggtttaatgaggcttgttatctagtgttaacagattcctaataagggccaggcacagtggctcatgcctgtaatcccagcactttgggaagccgaggtgggcggatcacttgaggtcagaagctcaagaccagcctggctaacatggtgaaaccccatctctactaaaaagaaatacaaaattagctgggtgtggtgccgtgcacctgtagtcccagctactcaggagactgaggcaggagaatctcttgaacccacgaggtggaggttgcagtgaactgagatcatgccattgcactc

SEQ ID NO: 19838 - DNA, 407 bp, Homo sapiens
tgggggcagcaacaagggccaacagccctggtgctggtcagagatccagaagactgtcaccttcactaactggtatgtggtgatgttggaacctcaaagcactcaatgtctccttttcttccagaaagggccaaaatgacctccaaatgacagatttcctatcaagggcatattcctggtccctaatataagaaatcaagagttatttcaattattcaccccccaccttccctgaagattcgagatgtcactaaggaaagtctaagatgtgtagtttttgctgcaacttagtggaaacattgttctgttactcacttaaattattcaagcaaattagtgtaaagcctggcacatagtgtgtgttcaaccaatcctacctcaattcccctttttctgctctgatacac

SEQ ID NO: 19839 - DNA, 473 bp, Homo sapiens
tgctgactctgatgggcttctcatgccaggatgctggtgtagggacccccagcccccatctggtggggggctgtctttgggtcacagcaaatagtttgtttgttccttccttccctcccccaggacggtggttctcaaacttttctacaatttggtctcacctggaggtgcttttaaaaattctgatgccggctgggcgcagtggctcacacctgtaatcccagcattttgggaggccgaggtgggtggatcacctgaggtcagaagttcgagaccagcctgaccaatataatgaaaccctgtctctactaaaaatacaaaaactagccaggcgtggtggtggctccctgtaatcctagctactcaggaggctgaggcaggagaatcgcttgaacccgggagatggaagttgcagtgagccgagatcgcaccattgcactctagcctgggtaacaagagtgaaactccgtctc

SEQ ID NO: 19840 - DNA, 589 bp, Homo sapiens
cgtgcctccctgttccttgtcctctcctcacatgacactctgcagtgaatagatgtccctcacttttccatcccctacggttcgctccaagtggttcaaggacatgtcctcttcccacatgacactctgctgtgaacagatatccctcgcttttccatcccctccagttctctccaagtggttcaaggatatgcactgggttttttacttgataccacttgcacataatagactctcaacaaatgtatcagataaataagcaaatttcaagaattgtctaagttgttttgttgacgtcagtatcatttgacattataagagttgtcaggtggagctcactcatgctctgaacattaacaaaattattattattttgttattatcatagagaaaactataggtacagaaaacagatccagggtcttgctatgttgcccaggctggattcaaattcctgggctcaagcgatcctcctgtctccacctcccaagttgttgggactacagacacatgtcaccatgcccagctaacgaaattattaaaataaaactgtttgcctttggaattcggtagagcaacacaagcatgc

SEQ ID NO: 19841 - DNA, 506 bp, Homo sapiens
gtgcttgatgaatatgtagttctgaagttggggccttgtattttcaggatttctggaacatatttgacctgacattctcatctgacatcagaacatctgaagtcttgcttcttcatctgatatcagaaccaaatccacttgctttccatctcactcaaaatggcataatattgaaactccacctaagatagagctaatgactagggagcatctagtttatttgggaggtgatagcatgaggagagtgaggtagggaggaggagaagccaataagggcgatgttaagaagtgaggtgccactgtgtgcaagtggggctcaattccattgggacctcctaagtgtcatcaaaaataacttctacaagatagagtgcagaaggatggttaccagaggctgggaaggtagtgggtggggtgggggcaagtgggatgactaatgggtacaaaaaatagaaagaatgaataaaagctagtgtttgatagcacaatagggtgactatcataat

SEQ ID NO: 19842 - DNA, 457 bp, Homo sapiens
catgttgttctttgaagtaggggaaattgacttgattttaattatagaatagcatttagctttatatgatttttctcatacacaaacacataaagaataagtgatcagtttcctttgtaagaacatacaaagtcagtcattcaggaagtttgtgatcttcccctggatgcaagccactggcagtcccaggatcccagtatatccaacacgaaggtcctgtcagagttccagtgttctcccgcacgacctcccacctcctacctcccagtacctcaacaggaaaggacacatctgtgaatcctctggcatgacttcaattccttacagctgtaaaatccactgcatggaaggaaaagaacatttcctagactgggaatccccagacactttcccaaactgaacaagtgaacagggttttcgctctggtgaatgataccccgtcaaggagagtgcagag

SEQ ID NO: 19843 - DNA, 628 bp, Homo sapiens
ggaacacagtggaaaagtttgagcaggggaatcacaagattagatttgagtatcagggcattctggtcatggtataaagcagagattggcaaacttttcctgtaaagtgccagatagcgaatatgatgggccatgtggtctctattacagctattcaactctgccattgtagggtgacaggagtcatagataatggatgggcaaagaggcatgattgttccaataaaagtttgtataaaaaaccatttagaaagctgaatttggcctgtggcctatagtttctggcccttcatatagaagatagatggaggataatcacataaaaagatttaaagatgaagtttttgtagtagttcatgcgatggtctttttttttgtaacaaatctgtggcctagtatcaatctattatgaaagtttgatccatcaagggtaaaatgaatcaagttcagtagctcaatttacacatttaaacatgtaggtccttctttggcattattttattttgattaatttttttaacttaaaaaataagaacagtaatttgtagggtttcttttttccctgtgaaagccatcagttaaggggccacgtttaactagtaaaaaaaaaaaaaaaaaaaaaaaaaaa

SEQ ID NO: 19844 - DNA, 504 bp, Homo sapiens
aggctacctctatttctgtcacttaacttcttgtctcaagcaatatggctactgatttttttctcctttagtccagactatcgtttaaaaaaatctcagtattctatgttgtggagatacgtttttactgactgtattagtgctgggtaatttctattttttagtagcaacaataacaacaacaaagaacaaaaaaaaacctgaaaaaaaaagcctttctactttttaggccacattaatctccagttgcctctggtaaatatttaactggttaaattgtcatagaaaagtgttattattttaatattagaatgagagaacatttagtattctcaaccttcagtatagagaggcagaatgctgccttaaacaagctttatttcggattgtccatgttacaaatgataccagtatatatgtaaaggctcaattaatttttgctaaataaatgcatgaatgaatatattttgaaaaccatctgtgattaatatttaaagaaactga

SEQ ID NO: 19845 - DNA, 577 bp, Homo sapiens
tagtattccatggtctactaaaattttaatgaatcattataaaagatgagtggtcctgatgtttcaccaactcttcaacctgtaaaaggaccgcaagagattcgctcaatttatactagctttgatatttttttaaaactgattattttttttagggtggttcacatctgtaatcccagaacagggaggccaagataggaggattgcttgagtccaggagctcaagatcatcctgggcaacataatgagactctgtctctacaaagaaaatcaaaaaagtggccaggcacgatggctcatgcctgtaatcccagcacttttggaggctgaggccggcagatcacgaggtcaggagttcgagaccagcctggccaatatggcataaccccgtctccactaaaaatacaaaaattagctgggcatggtggtgcatgcctgtagtcccacctactcaaggggctgaggcagaagaatcgcttgaatcgggaggtggaggttgaaatgagccgagatcacaccactgcattccagcctgggctacagaacaagacctgtctcaaaaaaaaaaaaaaaaaaa

SEQ ID NO: 19846 - DNA, 480 bp, Homo sapiens
gtaccagctgaacgtcttacttctccttgtccaggatgagctgtggccgggaagactgattgggaaagtcacgtgggtgttcttcaaccttagggttgccacttgaaatgacatagagtaccttgcctcaaaatgccactcaagtgagtcagatatatggcagtgattatagatttttatcccactttatgtgagtgtgtgtgtgtgtatagcatcaagtatagccacaaggtagtagccttagtcactaaattgtttgctattgctggctgtattcatcacgggagtccatgttgactcagatatgtaggacagcaagaattcccacgtcttcttcagctcaccttacagagctaagagatatggcagccttaatgaaaggggggagcctttactcacataaaccctgtgaattctactgtaaattttcctacattcaaatgggatgtattttggatgttgaggattgttgagggggcg

SEQ ID NO: 19847 - DNA, 364 bp, Homo sapiens
aaatgtgatacagtttaacaaaacccattgttctgtaactatacatagattttcaaaatgtcataaaaagtgcagttatgaattgttaacatgtcaatacacagttcctttattccagcactttgggaggccgaggcaggcagatcacctgaggtcaggagttcgagaccagcctggccaacatggtaaaaccccgtctctactaaaaatacaaaaattagccaagcacggtggtacacacctgtaagctcagccacttggggggctgagacaggagaattgcttgaacccaggagacaggttgcagtaagccgagatggtgccactgcactctagcctgggcaacagagtgagactccgtctc

SEQ ID NO: 19848 - DNA, 459 bp, Homo sapiens
tgataatttacttaatagccctaaagaaaaaaatctcaagggaaagttggggtcacatgaatggttattcgatgaccagtaaattcaattgtgctggatggtcaagccttggtcagcaccctttgggtagaaatggaaaaatctcttgcacacaactgcctgaaaaatctcaattttggtgtcattcgtttatatattcagttatccaaaaatacttcctaagcactttctaaattctagcattgtgctactagggaatgaccatcgcagacatgaaagaaatggccctgccctctctgaaggaaggtagctgagctgtgcctattatttgaaagaagcgaacaaatggcctagaaaacctgaggagactggatccaataggtaaacaatattgatacgaattctaagggcaattacaaaaatttaatgacattatatttctatattaaatataacgtg

SEQ ID NO: 19849 - DNA, 495 bp, Homo sapiens
gatgggaaaactaaatcggatgtagaagctagacaatctagtaaagctcacaggcttcagttgtgcattcagcagctgtattgcagaggcttcccaccattcctgtgtcatgagcctggaaataactaactaacttagaaacaaaagcctactcagagaacatggctgcctctgaaagtcattgctattgtactgcacatttcttaggtgcaatatccagagcattgtaaattttccattgtgctttagatattagtctacctgtggatgaagaaaagctcaggtaaatatcatggaagattacaactttgcacattgatattgaggatgctttgccagatataaaaatgttacggatacagcttagcaaataacaaaaaatatataaggactttaagtttgaatatatttatacttaaaatatatttccaagagggaatgaactcccaagagggacaaattagtattagaaaataagtaaactctttgaaaaat

SEQ ID NO: 19850 - DNA, 502 bp, Homo sapiens
ttttccattttgtaagaagatgttaatcaaatgggaaaatttatttaacattaaggggggagcaggttgtaaaacagcgtgtacatggttatcctaattttgtttaaacattagtagggaataaaggctcaaaggataaacaaaatgttaacattgtttatcaccttcaaagtaaagggactgtgggtgacatttttctatcaggtgttttatcttcctgctttcctttctccattccccatcagaacaaactggcaatgtattttaaactatattcacaaaatctcattcctatttgacatttcgaatacagacagtccctgacttaggatgggtcaacttgattttctgactttacgatggtacccatacaaccattgtttttcatttccactacagtattcaagaaattatatgagatattcaacactttattgtgaagtaagcttttgtgttagataattttgcccaactatatactaatgtaagtgttctgagcatg

SEQ ID NO: 19851 - DNA, 600 bp, Homo sapiens
agtatcagcctcgtgtggcatttcagaagtcagttagattcagaagcttgtcttcatggggacggtgggtggcacaaccccatgtgggaagtcagagcttgagcagggagtagagtgtccacatgtggaggtgaactgttggggttttggagcccaactagggtgagtagaacatcaacacagtaggcaatccaccttgggaaatcagagcccaagtgtggtgaaaaggggacttgtcagggacgcatagcatggtgtgaggtatcagaatccaaacaagatgaagagcttgggggtggggagtcagactctgagggaggttaagagggtgtccacgcaagagggtggcccatacagcatgtcagagccttatcagtctaggtgtgtgaacttccaggcagaggttgatcatgtgccggttgcctgagtctgcatggagtgaggagcacagccgcacagggaaggaggtgacagcagagatggcagagattacgtgtgtggcagggtgtgggggtgcagggagaaagttaaaaaacacaggtgaaactgtgtgtataggggtgtgtgtgtgtgtgtgtgtgtgtgtgtgttccatacaca

SEQ ID NO: 19852 - DNA, 465 bp, Homo sapiens
agttggctttttttgctcgcagcttttggatcccctttctctttgtggagtctctgtgggcggactctatagtacctctgcagtgaaattctgcctccctcccgtccatgcagaaggtgcatgtgcagtatggtccccagcaggtaggaatagcgggaagtagtgcattaaagccaatggatacaggtagatgtgggcatggtggtttaaaaacatgtcgataaattctttaattattctttcttcaagaggtggagcttagcttcaatcttccctcctctgccccaagtgtgggctagacttggtgacttgtttataaagactagaataagggaggagtgataatactgatgtaaaacttcagggcctaggtcatgaaaggcattgtggtggatcacctgaggtcagaagttcgagaccagcctggacaacatggtgaaaccctgtctttactaaaaatacaaa

SEQ ID NO: 19853 - DNA, 483 bp, Homo sapiens
caggcgtggtggctcacacctataatcccagcactgtggcacacggcctatagtctcagctactcaggaggctgaggtgggaggatcgcttgaacctggaagctggaggttaccgtgagccgagatcgcaccatggcacttcagcctgggggacagagagactccatctcaaaaaagatttttgtaaaaagtatatgtacactaaagaaaaaaaatgaaggccattctctaaatgtccaaatctaaaaaaggaagttactcaatatccaaagatcttttcagaccaattcctggagcaatgtgaaggaattgcagctgagaatttctgtcaggcttatatttaacaatcccttacctttatttacatggcacttaaaaatggacatgatcggccaggcgcggtgcctcatgcctgtaatcacagcactttgggaggccttgggaggccgaggcaggcagatcacttgaggtcaggagttcgag

SEQ ID NO: 19854 - DNA, 587 bp, Homo sapiens
ttgggagtcaacagagtgatggagcctgtcctgtccttgcacttgatctccacattcatagtgtagccctcggccttgacatttaatgtcacagggtggactttcttttccacattgcagatcaaattaaagttcgcatctccttgctgctttggagtgaagaaaatatcaattgggaacctggttggggaacaaaacagcagattacctgactaggccaacttgtcaaaaccttaaaaaatatgagcctactgaattagcagattcattacgaggaaaaggaaactccaaattatgatgacattttaagatttgtggctatagtaaccaaaacagcgtggtactggcataaaaacagacacacagactaatggaaaaagatagagatcccagaaataaagtcacacacctacaatcatctgatctttgaaaaagtcaacaaaaataagcaatgaggaaaggattccctattcaataaatgatgctgggatagctggctagccataagccagaagaataaaataagacccttacttttcaccatatacaaatattaactcaagatggatcaaagatttaaatgtaag

SEQ ID NO: 19855 - DNA, 500 bp, Homo sapiens
ggtcagaaacactataaaagaaaataagaatgtcttgggcttcttaatagattagacttggctgagggaagatctctgagttcaaggatatgacaaacagaacaaaaatccaagatctatcaaaggtgtaacaaatgcataataagaattctagaaggagagaaaggaacagaaacatttgaaacaataatgactgagaatttctccaaattaatgtcacacactaaatcattgatctaggaagctcagagaacaccaagcaagataaatgcccccccccccaccaaaatatatctaggcatatcacattcaaactttagaaaatcaaagatgaacaaaagtcttgaaagagaccagaagcaaaaaaccaccttatccatagaagaacaaaggtaagaatctttgttctgacttctcagagaagcatctgacttttcagaaatcatgcagcaagaagagactagagggttgaaaggaaaaaacccaccagctaaagttct

SEQ ID NO: 19856 - DNA, 557 bp, Homo sapiens
cccctgcaggacaactttgtcacccagttctctccaagctgccagtgagctccctgtgcagcctcactcctcacctacagcatgagcccttgcagctctcccagcatcacaatcttgtatctcagtcctggcttctttcactgctggcatccctctgtctctccctttttcacctacttttcttttttcaaagaattcttctctttcatctgcttatatgaaaaataatgacacctctgaaattctttcctgtagttctgcagcatcaatgccaggaagacaggcctcatcctcccagcttctatgctgctcctttcagatcccttaccctgtccccattttcatgacacaggctctccagccaggaagaagacactgtttctcactctctcttttccatctttgcctgtccctctcgctgtgtaacttcccttataactcagcctgaggccagtgctagaaaggcacatcacctgacttattctgtgcctgattctacctagatcagtgcaaccactgggcactgatgaactgctgccaacacagtcatcatttct

SEQ ID NO: 19857 - DNA, 479 bp, Homo sapiens
gtttccccttataaaaccatcagatctcatgagacttactaccatgagaacagtataggggaaactgcccccatgattcaattatctcccaccaggtccctcccacaacatgtgggaattatgggagctacaattcaagatgagatttgggtagggacacagccatatcagacagaaagagaaaaaaatgagccatgatcagtagaacgtggggacggagcaaacctctagcatttttacttatgagagtctgtaaattccacatttcctagtactccaggttaagttcattttccatggtttgcaaagggagtcccaactaatcaggaaacttccactggctgtcagtgatatgcccagaataaagaactggtccatctggtggtacggtttaggtagtgagcacactgcccttaactggaaaggtaggtattcactatctgttaacaaagtggctgttaaacacctctctatgtatc

SEQ ID NO: 19858 - DNA, 511 bp, Homo sapiens
atcaacattagaagtaactaaatctgtggtgatgatactatacattttgtgatgtaccttaacagtacataaatgtcttttacacccattattgcatctgacctggcagaccccgggaggtatgaggaaatgaagcccactctccaggtcacatggctggtaccaattatagtagtagctaataagtatttagctgcttattatgtgctaggagctgttctatgtgtgtgttaactcattgaatcctagcaacaattctagaagttgttttctacaataaaggcacagagaagtaatttgttcaaggtcagctgggtgcagtggctcacacctgtaatcccagcactttgggaggctgaggcgggtggatcatgaggtcaggagttcaagaccagcctggccaagatggtgaaaccccatctttactaaaaatacaaaaattatccaggcgtggtggcagatgcctgtaatcacagctacttgggaggctgaggcagggaattgcttgaat

SEQ ID NO: 19859 - DNA, 404 bp, Homo sapiens
aatgtttctgaatcaaagagactcatgcgagagtcagaccacatctctgaaatccagttttcagtgcaacaaactatgatttaattgctttgacctggcaggaaggaatatttcctttaaacctcaaacacagaagacctcaaaattaaagctcttcaaacgcataaaatgcctcagcaatataacaaactcagggtgatgagagttttatgaagagtcagaagaatcatcagaaacagagggagtagattctaacatgtgaggaaggctgtgttatgtaacgtatggaacattggcggactttcagctccttggctgttcatctttgcctgtgctgggtctccacattctccttttaattggaatgtgtatttgaacagaaagtcattagaatagcaacttgt

SEQ ID NO: 19860 - DNA, 482 bp, Homo sapiens
tcatatccggataaaagaaaatcttcaatgaattgcaaaatctttagaggcagaaggcacccaagagacaggtcaccatgcagaacaattctaggtggctccattcacatttagcctatgtacgtggtggcccctgggattgtgcagtgcgcaacttacacaactgtatgcagggattctgctgaatccagtcattaccacccttgcccttcctcacacacagatttaggatccttttacagaggaggcaagtgaggcccagaggaggaaagcaagttgttcaaagccacccagctaaccacagagccagactaaaatccagattattgaattttagagcaatattctttcctctctacaatgatgactggaaaggatattgtcacccaaaacagccacctccaccacagcaataagttcattcttaaaagtatttgtttcaggccaggcatggtggctcacgcctgtaatcccagtacctt

SEQ ID NO: 19861 - DNA, 507 bp, Homo sapiens
catggccacatgctgcagtggagccagaaggtatctcccatcataggcatagaacaaactccaattacatggagtaagcctgactcaggacattaacaaaaacatcaagaggcagtaagacctaggtctttcaacaaaggatacatgaaatatatttttaaaaacaactagaaagatggtcgattttaatattactagatccattatcacattaaatataaatggtcggccgggcgcagtggttcatgcctgtaatcccagcactttgggaggccaaggtgggtggatcacaaggtcatgggttcaagaccagcctgaccaacatggtgaaaccccgtctctactaaaaatacaaaaatgagctgggagtggtggcaggctcctgtaatcccagctactaaggaggctgaggcaggagaattgcttaaacccaggaggtgcaggttgcagtgaactgagatcacgccacagcactccagcctgggcgacagagcgagactctgtctc

SEQ ID NO: 19862 - DNA, 551 bp, Homo sapiens
agtgttttgaagctaagatgcgttcagccctcccagaatcttagggattatatgaatcctctatttaaattctgttcccagccctgagggttgatcacagaaacagtagcttagagaaacaacatacctgtagtgtcacatgttgaaagattcctattcagagatgataaccattgttcattctttgcctctactgggaaaagtgtgcttttgcttcccataagaactcaaaatttaggcttgttttaaggaaggaggctatcattgaccaaattgtagatagacagccaggtgcggtggcttatgcctataatcccagcactttgggaggcagaggtggacagatctcttgaggccaggagtccaagaccagcctggccaacatggtgaaaccccatctctactaaaaatacaaaaattagccaggcatgatggctcatgcctgtaatctcagctacttgggaagctgagggatgagaaatgcttgaacctgggaggcagaggttgcagtaaactgagattgcactactgcactccagcctgggcaacag

SEQ ID NO: 19863 - DNA, 345 bp, Homo sapiens
tgatgggagctgtggcctcttcacccacacacagaaggatgccagtccctctgtcagtctgaggtcagcttcctggggctgccccaccctgagggctccttacagggtgctcctcacagccatcccatctgtacccccgggctctgtccaccctgctgctgccctgggcacagaccctgaggtctcagtcctgcctccagccaagtttctgcctggtgcccagtgattcctgctgggcaccccttcgctcactgcccctccaccatgcagcagccagacacacccacagcacccgcagacctctaggccgggtcccagacatggccttcccccaaaaaaaaaaaa

SEQ ID NO: 19864 - DNA, 97 bp, Homo sapiens
aacactcaatgccctttgccccccaacacacacacataactgataacaacaataattcatgtatctgcagtggctcatgtatctgcaagctttttct

SEQ ID NO: 19865 - DNA, 552 bp, Homo sapiens
acccaggctggagtgcagcagcacaatcacagttcactgcaatcttgaactcccaggctcaagcaatcctcccacctcaaaatcccaagtagctgggattagagatacatgccaccacaccctactaattttttttgtactttttgtagagatggggttttgccatgttgcccaggctggtcttgaacttctgagctcaagcaatctgctcgctttggcatctcaaagtattaggattgcaggcgtgagccaccgcacccagctgcatttgagttttgagccttgtttctaattggcaaagttgttttcttcaagaaaccaacgagcaggcatccctgagatcccatcataaggtaagcagttgcctcctccactaagatgaaatcagccctgatttcagtttcagagtcaaccaatatttatcgagcaccttctaagagccaggaactgtgctaggagtgttagcttgttattttctgttaacctcctaaattctgtaaaccagtctgggtttggctacaagtaacagaagccattatagacagtttaagc

SEQ ID NO: 19866 - DNA, 525 bp, Homo sapiens
taggactaaaaaggcattattccccgttcctcttatcaggaacctcattgacagaggcatttactttctatgaatacaaatgactatggctattgtgattagaagcagaagaaaaccagctcatgaaccagaccctgaacacaatatctgggggcatgacagatatcccagtcactcctggagcaggggagagagctgaagaggcatcacgttaagaagacgcaccagtgctgggcacatttggtgaatctaattaacaggggcaacttgtcggctgggcgccgtagctcacgcctgtaatcccagcagatcgcaaggtcaggagatcgagaccatcctggctaacatgatgaaaccccgtctctactaaaaatacaaaaaaattagccaggcatggtggcgggctcctgtagtctcagttactcgggaggctgaggcaggagaatcacttgaactagggaggcggaggttgcagtgagccgagatcacaccgctgcactccagcctgggcaacagagggagtct

SEQ ID NO: 19867 - DNA, 432 bp, Homo sapiens
cctccctgaaatactctcctcccttgcttccaggacacagtctgatggttcttccccctattccaatgaatgaatgctcccttctcagttgttattgattccttctgatcttcccaatctctacacactaaagaactccaaggttcaaggtttggtcctttgactttaaaatatcatgttcataaatccagccaggacagttgctctaaatcctaggtataaatccaacaacctgcttgactacactgctagcacctagaacagtggctaacacagaaccaggtgcagtggctcacacctgtaatcccagcaccttgggaggctgaggtgggtggatcatctgaggtcaggagttcaagaccagcctggccaatacggtaaaacctcatctctgtgacagaccatatgttaggccatagtaaagggctctac

SEQ ID NO: 19868 - DNA, 608 bp, Homo sapiens
cgacagaagggaaatactgaggcgtttgcaatttataaagtgtcttctatgttataaaatgtggtgcaacagaaacttctctgatatttaacactttgctttctttgatactgctgttaatagctcttgtagctacaaggaaggtgccatgcctgatacaaataaagaggtaaagggcataggtggtttccactatatagcctggaaaagttcttttcttttccatgttttctcttcttttttcctgttgctagaggttggcctttttggtatgtcctagtagatcttggtccttgttttcctctctgcaaaactatggtacaatactctcaagtgttccactcacctaatggcagcacagccttcaatttttaaatgtatcctcactggcttctcactgtctttggacctcttctacttaatcagagtttttcacgcaaaacaattgcttgatgcaattttaactaaattaaatttaattaaatgaattctttgtttcattatatttatttagaaactgcacaaggtctatttcacagcagcacagggaaaggcaagtaaaacagctctgggttgggtgcagtggctcacacctataatcccagcac

SEQ ID NO: 19869 - DNA, 547 bp, Homo sapiens
tatcttatttcagttacaatttgcattttaattatgattaatgagactaagctttttttgtgtagttgactgtacctttggattcttttcccaaatcccttttcatttcttattttctttatggtttcagaaaatgtagtttacataattgcagcttgattttttaatcagttaatggcatgcttaatggagagaaaaaatattaactatatttccctttttaattactgtgcttttttcttttttaagaaaatatttcattatgttaaatttcagtgttattctacttagctattccttaaatattatagtattttggatttcacatataattttgtaacatatcttgagttttttgtatatacagtaaggctattttctcttttttgttttttaaggcaaaaatcacataatataaaattaataacttaaccattttaaaacatacaatgcaattgcttttagtatgttcacaatgttccaggacaatttcatcatatcccttctaacaacccattatgcataaagttggtacaccctattctgc

SEQ ID NO: 19870 - DNA, 407 bp, Homo sapiens
aaatcacaaaagcctagtccacaaaagcaaaaacaactgacagaatgagaaaaaatatttaccaactattcactggacaggagattgataccctgaatatacaaggaaatcaaataactcaatagcaaattaaaaagaaaaaaaacccaaacaacccaattaaaaaacgggcaaatgatctgaacagacaattaacatatgccaatttacaaaataaaattgaagtggaaaaagactattctgtatacgtaacatattgaaaattgtaagctctttttggattccataattacacaaatacggtggaattatagctgctaagacataacatgccaaataatgcataaggtaatatgatacaaaatgggggctaggcatagtgctgcgtgcctctaatcctggcattg

SEQ ID NO: 19871 - DNA, 480 bp, Homo sapiens
aactagatggagtcctggcactcactgtgattgagaacacatgacaaactaataggtttactgggcaggcggctaagctgatctacttgctggttcaattagctccactttccggaggctagcattttcccaaccttgccccatgctcttgtgggtacatttaccctatttggggccttagcgctttacaaatgaacgtttcagtttaagagacattgccacataacttatattaagtggtatgaattcaaaagcaagctctgccactacacatcagaatccagcactgaaggaggtgtggaagtcagaaagatggacaggaagatcccttcaggcttaaaaaggaccccagggccgggcgctgtggctaacccttgtaatcctagcactctggggatcacttgaggtcggcagatcgagaccagcctgaccaacatggagaaacgctgtctctactaaaaatacaaaattagccgggtg

SEQ ID NO: 19872 - DNA, 499 bp, Homo sapiens
agtgagttcaaaaaggatgatgttccatagtttactgctgttattattgttgttcagatcattattgatcatctctcctattgtcatttttgttttaatgtaaaaataaccagacatgacttaattttacagtaacagcatcacttcccatctgatttgagttcaatagggatcaccgtagatctgcacttggctgtgcatttgtcatactgtgccaggaataagcttctttccttgtctgtccacatttggctgcagaatctttgctccattatcagtctgtgtctacctttgtctggatagctatctataataatatacgaactgttttaacctcataagttagtaaagagagacagaatattagctgagaatgatagggtcacactatgaaataaaaaatataatttgttaaacagtcaatgaagacaaccttacttatgcaactatctaaaatataaaataatggacacttggtgttaatttttgcttttcctga

SEQ ID NO: 19873 - DNA, 532 bp, Homo sapiens
caaaatagtaacaaacaatttataaaccactttttttttcctttgcgcttgctgttgtcctatgcctagaagacctttgctcttcttggtacagctaattctgacttctgttctaagactgcctctttccaagtgaaatgagggtatgaggaatgtcttaaccatctttgtatgcctagtatttagtgcaattcttggcatatagtagttattccataactttttgctgagtgaatacatttgttctgcatttctgaaaggaaagtgttctttcaaaaattcaaaatcaccattttgctatgggcaagtagtaacctataggcagacagtaattatgctatgttatttccatttcatagagttgtctttgttcttgtgctattatagttttcaactagattgcaagccccttgagggcagcaatgtgtatccctcacatcttctcagaataagtaattaatagttgttaacagtaactgagccaggcccaggtgtttttccttatatttaacttccattaaaacttcggcat

SEQ ID NO: 19874 - DNA, 537 bp, Homo sapiens
tgccacatgatggtcgtgtgacattagggaagtcacttaacttctttgtgtctctgtatatccttatctgtaaaatggagatgataattgtctctagttctctctagagattaaatgagttcatatatgaaaatgcttagaataaacctgcatataataaatgctatacaaatgttagccactattattgttgctgttgctgttaacttgttttagcaaatgaagcatctctcttacaatgcaaagccggcctctttcccagttcatcctcctacttacctacaaaatgagggatggagatgaacatgaacatgaactctaaggatttttttgttaggcttgcctttctgggttctactctaagccacattcagctcaccccaactctaaggctgcaaagctgattcggcatttagtagaccattttcctgctcatggtccatggagattagccttttctctttagctctaagttccttcagggcagggatgaaggttccacctctgctatgtctcctggatcatctaggatgatcc

SEQ ID NO: 19875 - DNA, 600 bp, Homo sapiens
gtatttattaagtatttaccctgaaataagtactgcacgaagcatattcattcagtattgtccagttgctcttagcatgaagtcactggtgtcaccttgatggcagtgatgagacaaattacttgtttcacctctttaaacatcagatagattgctggggacaaagagacagcatggcttccaaccattacacaagtcccccttctgcagccaggatcatgtctaggatgatgcagttatggaagacagcatgctgagtttctattaatttgatgaatcaccaaattgagaccagtggtggtggtgtccagggacaaagtgaattgcttcagcagtgggtagataacccactgtttttcagttaactttttcagcaaggtaataatttccttgggatggtatccaaagggtggcaaacctctccctaaaagtagtgtagatgaaatctaggctcagttctgtagctattttctttaactagcactctaggaaccactctaggaaccagtattacacttacatgaggacttgtgatgacctggacacctcttttgttttctacgatgagagtgagatgaaatggagggggagtgggtgatc

SEQ ID NO: 19876 - DNA, 436 bp, Homo sapiens
cccagctcacctccgtgcacatctaaagagccacacacagcaccaccaaaggcagcacaatgagaacagcattctcctcaacagacaagctgggagtatctagacacctgacctcaatagctccagaacagtcctaaaacagttcctccctaaccaccactcaagtcaccagcttggaaagtattaagaaaacccaaatcctgacacaccactatgaaacaacttaaaacagcaaagaacaacccatttaaacagcaatgccagctgttgggaaaaaaaggaacaatgagtagaggagaaacagacctctcggggtccaccaagacccagtctctcagcttcagcacttttaaatgcagaatccatacccctctggggcctgtggagctccacaaggcatatcgtcctcaaagataaatgagcaggcaagctggct

SEQ ID NO: 19877 - DNA, 434 bp, Homo sapiens
  misc_feature 316: n = A,T,C or G
cttaatttcattagatgcttacctggttttctacttgaagtaaagacactgatgtatacactctagaggtacccaaaggtgatgcgaggactcaattagaatgtataaaaaggcaagtgaaattcaatgaagacaattttaaaaatttgatagggatgatattttccccatcttgttctcttttgtccttctcggaagagcagtaacaacctattagtctttgttgtctcttttattttgagatatataaaggatacttcttttgcataacttttttccctgaaataaaatttctcaagccaattttcataagttntactttgaaggaaaaataccttagtaggttatatgtcattcatatacatattctaaatggcaaaaattactataaataaattgtttaaaatgtagtctagactatattatttctccct

SEQ ID NO: 19878 - DNA, 544 bp, Homo sapiens
aaaattagaaattgcacagagtttgtgcaagtaccatgggttggtaacccttgatttgagaggctgctttcaaagtaaattagtgaaaataaaattttcgtaaggacttctaaaatcagagaggaaggatagaaatcataaacatatgtcatccctctttctcttttctgtaataatttagagaattcccttctgttagaagtctattagtattttttaatatcttggcaacctgtcagattttgcaatgtatagtggttgagatggtgggagaaaagaggcccaaataagtaaaataacatacaagaaggagtgctgaattatagatatggagaaagaaatgtggagatacggccgggcgcggtggctcacgcctgtaatcccagcactttggggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccg

SEQ ID NO: 19879 - DNA, 457 bp, Homo sapiens
tagctaatgatgatgaaatcaaagctagaaaacagattttccatcacttagttcagaactgcatgttctatagacatgtagaagttaaagaaacagatgttaaatgtcttacacctctcaacagatattaaccgctacaaatgtcatgatagtgctaatgcctgttttatgactaacataaactgcttatgtgaaaaagatcattttgcactttcagacatgaaacctatttacctgtaaaattgttttagagctagaaagttgctaaccaaacaccattttgaatgttacaataagttgctagagcatagtcttcattttaaaatagttaattaaaagctcctgtgttcctctcactatttttacttcttggtttatgtaatagaaatagatgtttattctatttctgaggagggctaagatccaggtcctaaaaatggagctcactcttactaag

SEQ ID NO: 19880 - DNA, 453 bp, Homo sapiens
cagtataagaattatgggactccctttacgctgtaaattattgtttttccattcttttattctaacagcactcagtagaggcagatggaaacaaattattttttccttttaattatcatctaaccttcattaagtgatactatgtacatgaaacagtgcaaagtgtttgggcaagcaatacagaaataaacaaaagtgcaaaattatagtaactgttaaaatttgatggctttatctataactctactttcttatgataatagaaagtgaggaaaagctagtcaggtagactctgcagttagccagagttcaaaatctagctgtctcttacaatctctgtcaccctgaacaagtttttaaagctctctatgtctcaattccttaaatataaaaagtaagaataataatagtgctttgagcagtacctcagtaaatgctagccattattattgc

SEQ ID NO: 19881 - DNA, 544 bp, Homo sapiens
ttatgatggacagattctgactatgtttgaaccacttttgaattattttcctcacctctacaaagacagaagaattatttttagtatctccaatggcagattgaacctatacaggtcacagcttctgagggatttttaatagctggttaaatgcaaaaggagcacacaggccccaaggctgtttgcagacagatatatttcataaagtcaaacctcttctaaggggatggcaaagcttaaattataaaactcaaagtatttgtctgctttttagtagtgctattatagcagacagacctcgggggtatatgaatttattccaaaggttggcttagttgcttactcagatttaactgattgtaactgcagtatgttttatcatgactaccatccggtagtgagatctctgaggcccggcagcagggcctcctcatcacattacctctctgcatacccacttggctagacggaacagggaatcctaggagtctgatgaaaaagtaatgacatggcctgcaggcacaagatataaacaagcaattca

SEQ ID NO: 19882 - DNA, 436 bp, Homo sapiens
gggggctgggggtcagatgtggaaggcagatgtttcattgtatattcttttagatcttttgaattttacactgcatttaaagaaaaccagactattccttctgtggttactgcaaaaaccacccccaggaggcaggatggcgactggaagtagcagattctcctctggggcctcagcatgcatcagtccaggcctggcatcgaggaggaacacagtcaaatgctctgaactggggtcgggcgcagtggttcacgcctctactcccagcactttgggaggttgaggcaggcagatcacctgaggtcaggagttcgagaccagcctggccaacatggtgaaaccccatctctaaaaaaaatcaaccaggtatggtggcaggtgcctgtaatcccagctactcaggagactgagaaaggagaatcacttgaacccggga

SEQ ID NO: 19883 - DNA, 416 bp, Homo sapiens
  misc_feature 282: n = A,T,C or G
gttatgtctcagaaagtcaaaaacataagaaagcatagctcaaaatacacagatgtgaaaatgaaaatcattgcagacagagatagaaatggttggaaaacctccaaagccagagtcagttgatgcaggacatcacatttgctctggggaaagcatcaggtgaatctttggagaactgcaaaagtcagtgacatttatacccaggtgaaagccaggattatgagcactgaggcaaaaatagtgagaacattgctccagatagctgtgactataagacgtccncattcctggcagataactagtggcaaaaccagcagcatgttctacaccttccccataaactggtagcaacctaaacagaaatgtcatccatagacagatgaacagggaatctcaagcataatgatgattgcaca

SEQ ID NO: 19884 - DNA, 122 bp, Homo sapiens
agagagctgggtccatcccttccaaacaacccagctctgccctgggccgactgagaaaggccctttgaaatgtgagatcctctaagctttatctggagcgggtttgatggaagggatggacc

SEQ ID NO: 19885 - DNA, 469 bp, Homo sapiens
gtggtttcatgtagtggtaatatttgagtcctttctatttcttatttgtgtgtttgctctggcagtgggttttaaactttcatgtggtttcatgttggtggatatcattctttagcttccagattatgttcttaaggggaaaagtaatttttcaaaacatgttaaaatttagaaaacgtaagtatgttgggacaaataacaccaacaacatagactaggagattaccgtttaggtttcatggcatgagattgttttggacctacaggctcaaataccatattaggtcatattaaaaattgtatatgataatggggccaagagttaaaatatgtgaactactctgaaatagtaatctcacatatgaaaatagaaaacatgagcaaacccaagagtcaatcattgattataaggttgcaataacagcatacgagaaagggttaaaagagtttgatatgtttagtgcaaaag

SEQ ID NO: 19886 - DNA, 594 bp, Homo sapiens
tctcatgtagttatttgtgtgtgtggtgtgaacattccagatctactgtcttagcaaatttcaagtatacaatacagtattgttaactacagtcatgctgtgtattagatccccagaatatattcatcatttacctgcattttgcaccctttgaccaacatctctttatttccctgcctatacagttttcattctagggaattagttattttagcattacctttttaactaatggtcaggcttaataattttgttcttcttctaaaatatctggggcagaataaccatcaggaaggggtaaaggagggtgtctgctgaagctgaaacaactgggtatcctcaacagtcaagggcctgcaggagaaggcactcaaggggcgtcgtcagttctttctcttcttctgcatgaaggaggtggctggggaagctactgtggtttgtttcagatgcaggcaacaagagcacagaaaatggtatctgttgatgaagtgtggctatattgggcctatgagtcaggagtgttccagaaactttgaaccacagaaccagtgtgacagtgactcaactcgattaactaggaagagtctttaaact

SEQ ID NO: 19887 - DNA, 116 bp, Homo sapiens
agttaaccataatccttactttgaaagctaaaatctagttttattcttttttaatattttatatcaataacagcccaatatgtagcatgttacaactggcttcttttctcaatatt

SEQ ID NO: 19888 - DNA, 568 bp, Homo sapiens
cacaggccacgcctttaattccagcactttgggaggccaaggtagaaaatcacttgaggccaggagcttgaggacagtttgagaacagcttgggcaacatagcaagaccccatctctacaaaaaattttttaaagtctgggtatagtggctcatacctataatgccaacactttgggaggctgaggtggaaaattgatcacttgagcccacaagttcaagaccagcctgagcaacatagtgagaccctgtgtctataaaattttttttaaattaggcatggtggcctacatctgtagtcccagctacttaggaaactgaggcaggaggatcccttgaacccaggttgatgctgcagtgagctgtgttcatgccactgcactccagcctgggtgacaaagcgagaccctctctctcaagaaaaaaatgtttttttaattagctgggcatggtggcatgccatgagcagaaatttgtcagggtattaagttgaaacaataacagtcctttaaaacttttatatgctttaaaaaaatgaccttatgcccccacccactcctttccctcctg

SEQ ID NO: 19889 - DNA, 530 bp, Homo sapiens
gacagaagggggaaggtctaagaaaggcaactaccaatgacgcctttataaataactgcagggggtggacgggggtgatgattctacaatttcatataaaacaacatttataaggatgctgtatcctcatgtgcaagcatccctggatgcccacaatacctcacaaataccatgagaaaattggactgcagactcttgatacatttcctttaagaaacaaccttttctgactctgcgcatttaaattccaaataaaatgttaattgcctgacaagcccgttttccttgtcatttataaaaatgtatacatcctgaataaaaagtgggagaatacttaaaagagtaggagaagaatcttgattttaacaacaaataattgtcacgctacggagttcttggctttaattgctgcttttgtgatttgttttggaatttgggctgatgacaatcacagagcccagtgttaaaaactaataatgatatagtatttcattcgaaacatttttggatcttgatagtattgatttgaa

SEQ ID NO: 19890 - DNA, 634 bp, Homo sapiens
cagagtgagactcgatctcaaaaaaagaaaacaaaaattctagagagaactagtgtacgttcctgttccataaagcaggattcatttgctgatctgtgctgtagaatcaggcgtttacagtccttaaactagattctaaagaaaaggccgggcctcagcttactcccatgccacttaggaaattcctttttctccttcttctcccttctgatattcggtatctttgaatagtcatgacagcaatgaaaatcagggtgatgacagtagttgtccctcactggcacatgctgagcaatttacttatatttgcttatttaatcttcacagcaaccctaagaggaacattcacatcatccccattttacaagtaagaaggctgagatttagaaagattaacttgcttgatccaagtcacacacatttagacccaggtttatctctccccaaagcccatgatctttactcctgaataacacatgggactggaaaatccttgccaaataaataatcagtataccagcattatcgttccaaatttaaaacccagaaaaggtaaggagtggccaagcttccagtgcaaactagtaaatgacaactttattttcacgagcttgactctgcagttaaacatata

SEQ ID NO: 19891 - DNA, 628 bp, Homo sapiens
agttactttggttcaaatcatccttagtagtgacaccaattctcttgaattggatgtttcataaagctacttctgggaccaggtgcagtggctcacgcttgtaatcccagcactttgggaggccaaggcgggtggatcacttgaggtcaggagttcaagaccagcctggccaacatggagaaaccccatctctactgacaatacaaaaaattagccaagcgtggtggcatgtgcctgtagtcccagctgctcgggaggctgaggcatgagaatcgctaagataagtaaagaaagctacttctgtaaaacaagcatattatctttttaaatgaagcaagaaaataaggctgggcgaggtggcttaagcctgtaatcccagcactttgggaggatgaggcaggcagatcacgaggtcaggagatccagaccatcctggccaacatggtgaaaccccatctctactaaaaatacaaacattagctggacatggtggtgcatgcctataatcccacctactcgggaggctgaggcaggagaatcgcttgaaccagggagttggagggtacagtgagccgagattgcaccactacactccagtctggcgacagagtgagactcgatcccaaaa

SEQ ID NO: 19892 - DNA, 558 bp, Homo sapiens
gagccatggtcagaggaacaagctgcactgcagtgtggtcttgcagttgtggggagagattgcactcgattctgactacagcatgggcaagtggggacttgcagccatgaagcagggtggaggtcagtgaatggaaaataactgagagaaaacatcggggagaggggaatcctgttggaccaacccaataggactcttgctgaaggcagatcaggctgataagatgtagacagtggtcagataccaaggctgggggcgtttccctgccctgactcggcaggattcttgctcaaactgaattctgcaaggacataggctgggcctggtcaggaaggtctcagacgagcctcattaaagttttggtcaaaggagagtatctgtccccacttcctcttggttcgggtagagttgccctggcggtctctgcctctggtccaggtgtcagaatccttctgggatctaaggtggcccctgaagacagaggcctcctttccctctgagaaaatactgtaagggccaggcgcagtggctcatgcctgtaatcccagcactttgaaa

SEQ ID NO: 19893 - DNA, 512 bp, Homo sapiens
gatgttcttccactgggtgtatttacaggccaaaatgcaatcaagcctaggggaccttggctccagctccagctgcaaatgaggtaagtacagatttccaaatcacatcttcaatctgccactgcattctctaccactcaacccccttccccaaatttgaaattctaataatgactccatattatttgaagtattataatctaaggaattcaccttattttctaagcctttgaaggacaaaaaaaggtatgcagaggtcaaaatacataaggtgttcaatgccatgccaagagacagttttcctttagtaggagctaaacaggttttaaagcagaatataaatgaacctggtttattttagaaagatagttctgggctgggtgcagtggctcacaactgtaatcccagcactttgggaggccgaggtgggtggatcacctgaggtcaggagtttgaaaccagcctggccaacatggtgaaaccccgtctctactaaaaaatacaaaaaatta

SEQ ID NO: 19894 - DNA, 635 bp, Homo sapiens
tctgagaattttctataacacaaactccttaacttcctggtgggtaatgttttctgggtgttttttctgttttctgttttttttgttgtcatttcttctttagtaaaatgaaaattgcaagtagaaaagaaactaaaaatggatttagtgtgaggacaggttccttttcctggcaggattgtagaacactggtattcagttgactgtttacaatgaatatatcttctggttggtcatggccagaagagaaaatgtcattggtttgtgcccaagcaaattgattattaaaatacgttgaatatgaccccatggttgcaaacatcccttttcttagtaattcttagagatgaagaaagtcttttatctgttttctatttcaactttctgggtaatctctatcctttctttttgataagtctctgtcttccctctatcagtgtgaataatgttactattgaaaaactggttccctagctacctcagtcctggggtcttaaggtttcttcaaaacgtgacagtcatgttaaaatgaaattctctgaatttatttagagcactgtttgtaaaagtgtaagtgttattatgcagccttgctttcctacctacctgaattctctcccctactctccccaact

SEQ ID NO: 19895 - DNA, 634 bp, Homo sapiens
catggaacaactgaaggactagacacttggctcccatgtgcccaagagacagaggagctctgaataggggcctaaaatgcactgtttagcaggtatgttcatgtcaaaaatgttcctccctggcctggggtcagaaatgaccctgttttagtgcctcacacatctggagtatgacctcatcttgccatgtgaccctggacaagctgaattctcctctgagcttcagtttctgtatccatatattcccaatacaaatacccacctctcaagactcatagttgaattaaatataatacaacattgacttcatgggcacttaatccatgttggttttctttctctagaatgttccatgaatgtccactccacaccccactgacagtgtgaggcagatcgtcgagacagaaaactaataaagtagttctggacttatactcaatgtttgaccaattgaacccaataggcatttacggaatatgttactcaaccacagaacatacatcttctcgtctgcacttagaacatagtctaagatcgaccacatgtttgaccataaagcaagtcttaataaattcagaaaaagcaaaataattccaagtacactcctggaccaccatgcaataaaaagagaaat

SEQ ID NO: 19896 - DNA, 587 bp, Homo sapiens
tggtcaggctggtcttgaactcctgacctcaggtgatctgcttgcctcagcctcccaaactgctgagattacatgagtgagccaccacgcccagcctcttctggtcactttgaccttatatttttaaagaattttttctacgttattaagataacgtgagttcaccacaaaaaaagagaaattagtacaaaaatatgtaaggaaaaatgcaaaaataattctattatccagagtaaatcactgttaatatttcagtaactgtgcatttatacatctttctatatatatatgcaaatgtgtaaataaaactatactaatagaacattatacacatgcttttattataaacacatttgttttcttctagtctttactttttattctgtgttcactccctcagcctctccccagccccacctgccccaaatggggaaatcaattttaaactaaacttataaatatatattaacatttatagaaattttgtcatttgtttttaaaaagtagattcctggccgggtatggtggctgacgcctgtaatctcagattttgggaggtcgaggcgggcagatcacgatgtcaggag

SEQ ID NO: 19897 - DNA, 116 bp, Homo sapiens
aattaggcccattcaaagcacactgtcatgaactctggggatattgagggcacagagaagactctacaagcttccaatcctacatatagatagatgtaataggaaggctgaaggat

SEQ ID NO: 19898 - DNA, 438 bp, Homo sapiens
atatgctaatagtggaagatatcccagcttaaaaaatttaagtagacaaaatggtctgtgacttatatgccttatttcttagaaaattaaatataactcatcattgcatttctctttgtttagctggattttatatgagaaaccacatttccgaggtcagaaatgtgtgctagaagaaggggaaaaggtgttaaatcgtgactggattcttcagaacagaaggcatccacaaagaaactttatattgggttctctcaaacgtgtcttaaaggtaacaactgtagatttttctattttttatttgattttatttatcatatagtaaacctgtgctgtggcctggcgatgtttacaaatcattgctaatttttgtgctgttattaatcttcattaccatattgataatcttttgaatttatgcaaatagagtgaatggca

SEQ ID NO: 19899 - DNA, 435 bp, Homo sapiens
aactaaaattgaatattagaaataaaacatttggctatttcatgacttccctaaaagctcatatattcaagctgtctacgaaatattttgaatcttctcatgggcaaaatggagaactgtttatatacacagtatatgtaatttaagttttctctttgaaagaaactaagttatttgtgactaacacacctcttgaactgctactaacagcgttcctttctttcctatttgtctgtatgattggttcaaaacaatcactgtactagtttcttccagtaaagagttccaaaaataattttcatagagtaaattttaagaaactgtttaacacatatgcagctgctactttcaaattatgttaattacttgaaacagttactttcaactgtcatatgcaggtgttaaaaatagtttcagttaagttctgagttatgc

SEQ ID NO: 19900 - DNA, 435 bp, Homo sapiens
aaagtttgcagtttttatttccccaaatacccttcctgtttcatttttcttagctttctgcaattcaggttatacatatgttagattttcttacagtatcctttctttctatcacttgcctttacttacttttcattattcctttctatttgtctcatcttggataagttttttaaaatatgaactattttccatttcatgaatttcagctgttcagcccattcattgcattcctgaatttggttaatgaactaatcatttctaggttttccatttggttctggcatgctatttttatagtgtcaagtttcttgctaacattttcaagctcagtcaagctcagcttttatctacatgaaaatattaaggatatttgtgttatagacattgcttttagtcttactttctatgatttttggatctcctcttttatct

SEQ ID NO: 19901 - DNA, 495 bp, Homo sapiens
tctcagatccttggccctaccttcacacaaacgatcctctttgaatcattacgggatacccatgagaataacctactaatgcaaactagcagaagatttcaaactaactcagttcaacaacctcagatattgtcagggattaattaaatacacacagccccactatactccacaattgaggcttcttgtatctttaaactccctgatcagtccttacttgcttcataagtaagtgatctggcattttgaaaaaacaccaacatcagaaaactaaccttgaacccagagggaggggaccttttattgtttcactcattgctaacactgctaacaaattacagagtgtttgaacttgggtgcatgtcttttagttgaaaaaatacaaaatctatttcaattggaaggcactctaaccagagactcacgctgagactctatgaacaacctccaggccaggcgcggtggatcacgaggtcagcagatagagaccatcag

SEQ ID NO: 19902 - DNA, 454 bp, Homo sapiens
  misc_feature 276, 277: n = A,T,C or G
atacactgctagatagagtgtacattggtacaaccagattggaaaattctttagcagaatctactaaagctaaacatattaaaccttatgatagaacaattctattccttacatatattcaaaataaataagtggttatgtccactgaaagtcatgtacaataatattcaaggcagttttattcataatagcaaaaactggaaacaaatgttcatcagccacaaaatgaatgcataaattgtgggatatttatacaatataatatacaacaatatnncacgctttgcttggactcaagctttttgcactgcagtcaggaaactgtcctatgcagacagctgagtaatcatggagcctaccctgttagtttcctttctctcaaagatctcaatcttgtacttatcttgtacttcctgttattcattgcctgaaaacagctatctcatgtattttt

SEQ ID NO: 19903 - DNA, 511 bp, Homo sapiens
ggaacgccccagccattcagctgatccgaggcaaagagccggcacttgccccagcccagcctgcttgaaggacctacaggtttgtctcttccagatcagaactggggaacaaaaacccccatcctgggaaaaatggggaagctggtgagtcttaccactctctctctgcttgcttctgctaagtggcacgcctgtctgctctcacccaggaagcaaagtaagaggcgttgctcagcctctaaccccacagctccttcctgaacaaatacaatgctttgcgaatacctccagacaactttttctgcctgttttgcacaccgaaaatccacagaggcaatgatttttagcactttagacattccagagagtgtttttcctaggcaagcgtttctatactgtcgtgatgagcaaactttctcatctttgttacactctaaaacagtggaaattagccttggggtgctttgtgaggaaggctgagtccccaaggaagtgatagtaaatctaaatg

SEQ ID NO: 19904 - DNA, 441 bp, Homo sapiens
tcattttgagattaaaagtattgtaacaggcctggcgtggtggctcacgcctgtaatcccagcactttgggaggtagagatgggcggatcacctgaggtcaggagttggagaccaggctggccaacatggtgaaaccctgtctctactaaaaatacaaaaattagctggacatggcagcaggcgactgtaatcccagctactcgggaggctgagtcaggagaatcacttgaacccgggaggcggaggttgcagtgagccaagattgcaccactgcactctagcctgggtgacagagtgagattctgtctcaaaaaaagaagtactgtataattttttaatgttaaatctgataagttataataatatcgacttctttgactcatagctgaatagttcatattgtagagaaagtcactatatcattaatacagtatttttag

SEQ ID NO: 19905 - DNA, 549 bp, Homo sapiens
ttgctggatgctgggaacacagcaatgaagtttttaccacatcacttccacagtactagatgaaaccccctggtgatcacactgctgacaggcttccttgaccattttccagtgtgttggagtagggggagagcactgataatgtacatagcctcacaacatgtggggttgttaggataggccaaactttgctttaagatgaaaccagggtggctagacttccctgaattataaacgaccacactgaatcaaggcaaacttgaataaccaagtaaataacatttgttgcttccctcccccaacaaaatctatcagagtaacagtgctcccttgactaaaagaaagaagattggttgtgtagtttcctcagcaagaatgtggacttgataactccaccttttagaataaaaggagatccggtgcggtggctgatgcctttgatcccagcacttcaggaggctgaggtgggaggatcgcatgagcccaggagttggagaccagcctgggcaacatagtgataccctgtttttacaaaaaaataaaaattag

SEQ ID NO: 19906 - DNA, 499 bp, Homo sapiens
tgtccgacgccctgcccgtaaagtcatcctcacttagcaatcatagggaactttccacacacaccaaagggaggtctacctatgaaacgggacctacccactaccctaaatccactaccacagagtccatacaaaggataggtatttggggtgaacatacccgcattggttccctattgtaatcagcaaatctttccttcacaaaaataaatgtaaaactaagaataaacagtcatttgaagaattttaacctgggaaagatacaaccaactgaacaaaactactgaagaggccagacacagtgtggctcatgcctgtaatcccaacactttgggaggctgaggcgggaggatcacttgatgtcaggagttcaagaccagcctggccaacatggtgaaacttcacctctactgaaaatacaaaaattagccaggcatggtggcacatgcttgtaatcccgtctactcaggaggctgaggcagaagaattgctagaactc

SEQ ID NO: 19907 - DNA, 531 bp, Homo sapiens
gacagaaggggaatacaaactttggctaggcagctggtccagatgtcttttcaattcttgatatagatgtgggcaaaaaggcatgggcattgaagccagaaccaagtggtaagaatcttggaacctccactgacaagctgtatagttttaagacagattattcaatttcagtttcagccatgtgtttaagatagattctgttagcctgccagtccctgaatgactgggaagagtagaattgtccccatacccaccccaatccctgccattccctgacctggtactgctcaggattatagtccaatgaaaaaataaatatgtttatgccattatacatttgggcaacaatttgttagtacagctagcattatcccaatagaaatcattgccttgaagtggcactaatgctgctgtaataaaaatcaagctatagggcactggcttagcagtctggtagcaaagataaagatggaaacaaaaggcagtggcaaactatttagcaaaatatctcctataacttggaagctgact

SEQ ID NO: 19908 - DNA, 518 bp, Homo sapiens
cgacagaagggttttactgaaaagtaccagtcctgagggttgacaacaacatttaagaaatcatttccatcttttcagtacaaaacagttttctagagctgtttgtaaactggactgacaacagtaactcttttattaatccacagagcagcaatcattgaaaagattattttaaaactataaaagaccttgtagataaatcaaccttggcctagaaattcaatgctactgcactgacatgtatgagaagggtaggactgcaaatatagcagttctgcaaatcaacatgttaactttcagagatatacacaaaggaattgaggttttggtgtgtaagtgcactacagtccccactattcatttaccaacacaggtttttgtaaaaggaaggataaactgatgaataattcatgtctggagccattccaagtttactatgttgaaggtacaaaatagtgcctcctttcatcttttacattagactatgtatctacctgggctactgagcactcctacag

SEQ ID NO: 19909 - DNA, 559 bp, Homo sapiens
aatgggaggctttccctgttgaaactcctcaaggacatcggttgccaaggtttattaagagtgaatcttccccacatgggttatcccctctactgcctctagtgacagaggatcacatttcactggcaaaattattcaggaaataggaaaggttacacacaccagccaaatattccactggacttaccatcctcagtgataaagttctatacaaagagccaacagcatcctcaagctgaactggctaaactgtctgaagaaagaacttgccatggtctcagatccttggcccttccttcacacaaacgatcctctttgaatcattacgggatacccatgagaataccctactaatgcaaactagcagaagattccaaactaactcagttcaacaacctcagatattgtcagggattaattaaatacacacagcctcactatactccacaattgaggcttcttgtatctttaaactccctgatcagtccttacttgcttcataagtaagtgatctggcattttgaaaaaacaccaacatcagaaaactaaccttgaaccc

SEQ ID NO: 19910 - DNA, 561 bp, Homo sapiens
atgaaacttatacataagactctaggagtactgactagaaaaatagttcccgcaactttacaaatgatacagctctctgggagcaagaaggggctcagaggagtggttggtgatacatcttctgctatgagcttactcttcatagtggtgctgtataaacctggtagaatgcaaacaggttttcatcacaacaaagatggcctccctaccagccaatactcaaacaagctttgatgagcatctgcaaagtaccagatcctgtggaaaataagaaaccattcgcccggcatggtggttcacacctgtaatcccagcactttcggaggctgaggtgggcagatcacgaggtcaggagatcgagaccatcctggctaacatggtgaaaccccgtctctactaaaaaatacaaaaaattagccgggcgtggtggtgggtgcctgtagtcccagctacttgggaggctgaggcaagataacagcgtgaacccgggaggcggagcttgtagtgagcggagattgtgccattgcactgcagcctgcgcaacagagcaagactctgtct

SEQ ID NO: 19911 - DNA, 145 bp, Homo sapiens
agaaccttcagctgaaccacaaacaccattaaaaacaaaaaccattctgatcaagtcactcccttgccaggaaagctccccaagctcccccattctaaaaagagtctcaactcctttgaatggataacaggtctcctgtataatt

SEQ ID NO: 19912 - DNA, 513 bp, Homo sapiens
atacaagaagaaataactgttatcagaatctggagagaaagttgtatggggagggctacctgacaggagctgtgacttttagtagaggggatgcagttagccatggattaccctgaggtgaatgaaccaggctaataaatataccagcaacctccctccaccatcaactagggtgattctataatttattgtccaaagtgggacaaccactatgggcaatttagtcatatctattaaagttgaaattgtgcatacatagaattacacttacttattctggagacactctctcatacaggttgcaaggagacatgcaaaagaatgttcaacagctacaagaactgagcaatttattaacctctctgcttcagtttcctaatatgtaaaatgtacataatagctcttatctcacaggatactctaatgattaaacatgttaagtgctttcatgtatatgaagtcttagaaaatacacatgctaagtgtaagctgctattataattgacacactgc

SEQ ID NO: 19913 - DNA, 556 bp, Homo sapiens
cggtgcgagaagacacagaagggtagaatctttggttatatgttcttttgctgaatatcttcatctaataactcaataacgtattcttgattaaacaaaagttgtgcttaaaagggaatgtattagtcttcttgggctgctgtaacaaaacagactgagtggctgaaacagtagacatttatttctcacaagtcttgggactggaaatctaacatcaaggtgccaacacatttggttcctggtgagtgcatcctggcttgccaccttcttgctgtgtcttcacatggctcagagaaagtgatctcttgagccttgttttgtaaatatttagatacagaaaggcaatgggatcatagcatcagtttgttatttcctggccatacgcattttccctgtggaacatattgatatcagatttcagtaaagttgcgggatacaaaattaacatacaaaaatcagtagtatttctatatactagcagttaaatagcagaaaaaggaatcaagaaagcaacataattacaatagctacaaagaaaaaccctatatattaattt

SEQ ID NO: 19914 - DNA, 583 bp, Homo sapiens
atgcaaaataaagttaaatgggattattatttactttatttaattcacacaatgatatggctacatggtctcctttaatcctcacaagaaccatttgagaaaggaaatactattctaaagttgagcacaagataataaaaatatgtctgatgccacagaactgataagagtgatggctctaagctatgttatctactttacattcaaattttgagaatttagcttgtagtgaataactatttctaagaaaagaagaatagtgtattcctttaaaaacaatagctaagcttgacttctttgtcactgggatttagggcatgataaacatgtgatccaagaacaaagtttataccctcagactacatatttggaaacatgacatgccaattcaagtgatttaagtcctggttttccttattaatcatagaaaaaaaatttctacaagtcagaggatttacctgctttgtttgctgctctaagcctggcaccaacaacgatgtcaaacatacaataggagctcaataaatattagttgaatgaatgagtcaagaatgaatctactcataaagcatataatccagtg

SEQ ID NO: 19915 - DNA, 610 bp, Homo sapiens
tttatccaattcactccaactccagagccacaatctttgcaggcccaagcaatctgatgtgtacagtagctacatctttctcaactataattctgatgtcacacacaaggctgttctttgttgttagcaaaacatcacattcaaatccctcaaggaggtttaaaacgcccctgctactagaacatcttaagtgcaaggaatgcataatgtttcttcacaactccaagcttttgtacatgtaggtctcttttgaaacattcttctctaggtctttcattgggctacttcctgctcaccactcaaccaatagttcttgattgtcttctatatacctctgtacataatgcttattcacattaacaatgtacattagttgagaatatgctgtgtggaaagtgctgtgttgagctaattctacctattatctcatttaattctcacacaacacttatgaggtgagtatcaagctattccacactgctacttccacaggaaaaagcagcaaagtgaattcaagaaattgtccaaggccaagagtcaggaaatggcagattcaaatccaggaagtctagctccagaggtcattctcttatccatgacaccctcacac

SEQ ID NO: 19916 - DNA, 541 bp, Homo sapiens
aagaatacaagaatcccaagtaaaagcaacaggtggaacgctaaaataactgatcacagatttcagatgctgggcaccacagcagagactaactagaaaggcttggtaaataatttgggctttctacagacctgccttaacaaagcataaaaccatgcctcaagataatcaaccaataatttaactacctaccagagcaaaaacaaaactctgcaaaaattaacaaaagccaaaacttctacaacatatcacctacattttccaatatgaaattaaaaattactacatgtgtggtgaaataaaaatgtgaccattagtcaacatatccgaggatgacaaagatggtggaataagaaaaggattttaaagcagctattataaatattcaaacactttaagaaaaagacagtcaaaatgaatgaacaaatggaggctcttaagacagaaaaccatttaaaaaaagaaaattctagcactgacaagcacaatatctgaaatgaaaatttcactggataagcttaacaatggactggagcagcag

SEQ ID NO: 19917 - DNA, 582 bp, Homo sapiens
ggaggccgcacccgcctccggcgggtctctcagtgaaaaatgtactctgacctgaatcctgaattttccttgatggtcaaaagattaagtctcgtcctgatggccagactggagtacagtggtgtgatctcggctcactgcatcctccgcctcctaggttcaagcgattcttccacctcagcctcccaagtagctgggatcacagaaatcatgagtggaggatctcaagcccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtgga

SEQ ID NO: 19918 - DNA, 622 bp, Homo sapiens
cgctgcctttaagaactgtaacactcgccgcgagggtccatggcttcattcttgaagtcagttagaccaagaacccaccaattccggacacactatcatcaaacggtgggaaacaagttaaatggtttattaggtttaaagtgccattttccatttaccttgaatccccatatttcttttaatcttaaaaatgttatgttgtcttacttgttctcccattgactctggatttgtaattttttgtaaataatagacatgtatctccaactcattaaattatttctactccttgtatttattgtctactcttaagaggtatgtatcaaaaccatcctttgtggaacctcactgtgcttacatttgtgaatgctcactttagaagttcgatcttggccagatacagtggctcacacctgtaatcccagcattttgggaggcccaggcaggcagatcacttgaagtcaggagttcgagaccagcctggccaacatggtgaaaacccatatctactaaaaatacaaaaattagctgggcatggtggcagatgcctgtaatcccagctactcaggaggctgaggcgggagagtcacttgaacccaggaggcaaaagttgcactgagct

SEQ ID NO: 19919 - DNA, 607 bp, Homo sapiens
cgcccagtgaagatctaagagaatcctggctattaaaagatgccagcattttgaactgggaggagataagaagagaaagggccaagtgatccagttctaagtatcatcttttgttttattatgaagacaataaaatcgagtttatgttcacttcaaaaataaataaataaaagtaatgtcttactgttggcctgatccttattattagaccaaagctcagaaaggcagaatcattgacatgaccagtcctgtaaccaggaaggacacttaaaaaagagaaagcgattgtttatgattccagtcttctctttttatttcattcctagtaacaagttcactattttagaagatgaaaatgtaccgcatttttattgagaataatatttatagcataaagggattcaaatgcacttacaagacagtaggaaccaggcacctactttattagtagattgccaaatggacttggatgtgtgactatgtgatgtaaaatttctcctacatttatattagtaagtcattgttatttgtaagcatgacaataatcactttattaaatatatagtattattaagcaggattctgcctgtattttatgtaaaatacg

SEQ ID NO: 19920 - DNA, 445 bp, Homo sapiens
cacatgatttcaaatggttaatttaaataaaggaactgctttaagttgattatgtgatctacttctacaccaccaacccacaccattgcgtaagagactgtttatggaaaattatgtcatcccgcagtcgggaatggctaattgacttaatgaacagcaggacagtaacatggcttctttctgtgtatcctaaggaaagaatgcagcaaaataaagatttaatcttctttatttatttttatctagctatagcctcataataaaaaagaagtacaagatataggtgccatggagatgtccattggcctgcaaaaataagaaaaagatttctgtagttgtacttttagaaaacagtgaattctttaaaaaaataaaagactgagaaaagagagaagcttcaggataggcttattaatgaaaaacaaaagtggaacaagagtatccg

SEQ ID NO: 19921 - DNA, 491 bp, Homo sapiens
tggacaattaaagtctatgatacagacaataatctgagagcctgaagactgagatagagaaactctactttagcggtggaagcctttgagcaccagagggggcattgggatagagcatcctttgcccatatcaagaagctatgtaaagcatcgtcccttctgtgacctcaccagcctcatctcacattgctaccgagcaaagataaggttaggctgggcacagtggttcacgcgtgtaatcccagcactttgggaggccgaggtgggtggatcacgaggtcaagagattgagaccatcctggccaacatgatgaaaccccgtctctagtaaataaaaaaaaattagcctggcgtggtggcgggtgcctgtagtcccagctactcaggaggctgattcaggagaatggcatgaacccgggagacggagcttgcggtgagccgagatcacaccaatgcactccagcctgggcgacagagtgagactccgtctc

SEQ ID NO: 19922 - DNA, 582 bp, Homo sapiens
catattttttaattactttatttaatacagagaagatgagaagacaatgtaaatgctgctttgtgagtgatgggaagaagtacttttagtgatagcagtgaatcaaagcataaggtcatcaatagtcgacttcattgcccagtgttttcaaagtccccacgtgtgttggttattctttagtaaagtagacgtgacaatgctcgttggctgttattgtgaagcttgactgataatactgggattttgagatcaagaggctagaagccaagatgtttgaaatatgtaaggtcagctgcctgctctttcctcctcccctacgagtgaatcaacacttgctttataagcttttcttctctatctcctttctctattgttagtttcacttcctactcttaaaaattctgagctttcaaaatcatgtttatcaggagaaaaaagagactgaaagagcttaaaatgggatacctctggccgggtgcggtagttcacgcctgtaatcccagctcttagggaggcagaggcgggaggatagcttgagcccaggagttcgagacctgcctgggcaatatagcaagaccccat

SEQ ID NO: 19923 - DNA, 316 bp, Homo sapiens
tttgggaggtaaaagccacagggctttatatacaatggattggctatgatggcacgggcgagggagatggaggtgttaaatactttttattgggcttaagggtttatatctcatacactggggacagcaaaaacatggctgatgttatggcagaagtttcgtgagcacctgcactgtctcctatgaacaggaaaaagggaaagatcgttctattcccctatagtggtgtacagtattaccaggtgcctaatatggcctttaatatagaggaaaagaaccatcagctctgcaacaggaggggaattctggggcatct

SEQ ID NO: 19924 - DNA, 453 bp, Homo sapiens
caatctcaaagctattcctgagaatccaaaccaatatagtccccttgtttttcaattttttgaagtatgagaaaaaaaataagaaaaagttaacatacatttccaatactaattttctgctctcagagctttaaccgctcagtaatgcataaaacaaatatttataccaaggatatgaaccaaactgctacaggtaatctcttcaatcatgatcaacaagtcttgtttttttctaatcctagatagctttacagggtaacaactgtattaaattgtgacaaatttgctgttgtagaccaaaagtcactggcggctaatatgcattctaaacttgcaacaaattaaaagttttcaaaagtactctacctcctctggccaaagtgtgaaattatatagtttttaaaaaatgcaggctggcgtgatggctcacacctgtaatcccagcactttggg

SEQ ID NO: 19925 - DNA, 496 bp, Homo sapiens
gctcagacctggggattgtaactttagcctcataccttctaatgaaggccatcttaaagctctaccagtttcagctgagggccgatccagcagatcccagttgttcctaaagacctggttgctagctcctctgagactggggtggggtgggtgtcccaaggtgatgaccaggagaaaagagagcgtcttcctcccagtcacatcccaagattcgtgaccgagcgcggtggctcacgcctgtaattccagcactttgggagaccgaggcaggtggatcacgaggtcaggagttcgagaccagcctggtcaacacggtgaaaccctatctattctaaaaatacaaaaaattagccaggcacggtggcaggcacctgtaatcccagctacttgggaggctgaggaaggagaatcgcttgaacccgggagatggaggttgcagtgagccgagattgcaccactgcactccagcctgggcaacagagcaagactctgtctc

SEQ ID NO: 19926 - DNA, 473 bp, Homo sapiens
caacagatatgcaagagcaactacccaggtgacggagatctcatttacatatgtcaaattaagtccccacgttttaaaaagatgccagaaatataagtggattttaagtaggtcaggaaaatctactcaggtttagaaaggcctctcagctaccagacaagtgattatatcccaggcagctcttgaaagccagaaactgccatgctgtgctgaataaattcttctcaatgacctttccatgacaactttctcatttcctataatgtggagacaattaggtgttaaattacgtgtttgtggagcaaagcagcaacctttgaagcagaggttttattgaagaatatattgggtgaatgtgtaaaaatagctcctaacaagtaatagagttgtacagtgtccagctccttaatttaacaaatgagaaaactgacgtctgaataacttctctaacttatcgagtgcaaaacagcaat

SEQ ID NO: 19927 - DNA, 607 bp, Homo sapiens
gttttagaaatgagaaatgactttccttcttgccattaaatgttttgactgcatggatcaggaggacatttaattgactaaacattcaattaaataaggtcttttgaggccccctctctctgaatgaaagtattttacacaaattgtggttttaatcaggacacatgggtgtctgacctgggaatgtttgctgacaagctcagggtctcattggccccactggttctcctaattcagaaactattaatagtgcaaagttaattaaactggtagcatattataaatgcagctgttgtaatttctgagtcaatctgatatgtcagtgtggtatattgcataaagtctcagatttggtatctgacaaccttggattaaatttttatctctagattttaggaattgtcatttcctaatctatataattagaattattataaatataagagaaaaaagtgtatcttttaaattttcttattaatatgagtatagatatatctattagacatttactggtacccttgtctcccttctcgttattattctcacaacaattttaatctctcttggccaagtttctaggcaaaaaaatcatatgcctttgggccca

SEQ ID NO: 19928 - DNA, 520 bp, Homo sapiens
tcagggctgagggaggctggctttcttagctcccccagcgctgggccaggcagggtcacaccagctgtaacaaagagaaaaactggtgactgagacgttctggcctgtgggctctgcgaacatgtgtgtccccaaaacaaagcccgccacaggctgcctgttcttacacaccctgggagggcccccaccagactcccacagggtatgcttgactgagtctaaaattacctcttttattttctggtggagaagaattgaacattgagaacggcagtggtcaatgtgtgtggaaagctagatagccttaagaaaaatcattgtgtaagcctttcaggtagctccctaagtataggaacctgggaagcagattaaacagatgtgtatagtaaatgaggtcctgttttccagcatttgagttccctttgcagtagtggctggtaactctggtctgtggtctgagcatctggttttgtaaataaagttttattggcacacagccaccttcattcatttgcatatt

SEQ ID NO: 19929 - DNA, 88 bp, Homo sapiens
ttatgacatgtcacattgacatcatgatcacttctctacagctttgcacacttagaccttaggatttatacttttcactgagttcttt

SEQ ID NO: 19930 - DNA, 512 bp, Homo sapiens
ggtttattgaagccttacatatgggcagactagtggcagtgggctggacaggagaactgctactgtttgtaaaaagcatgcagtttacatagcattttcacttagtatcctctacccgggaacctcaacctagcaacctccatttaaccctaaataaagggccttgatgccctgtgtgccctgcattccaaggaatgggccaagggtttagatgaccctcatagataaggaatgaggctccaggctggccactcctggatttcttagcttggaactccaaaaccagcactcttcttagaccacagggccagtctcagggtatgtttaagttattgctgtcaggtgcatctgccatacactgtgtgtttgtgtgtgtgtgtggtgcatgtgcgtgtgtgtgtgtgtgatgtgctggagttgctgttgtgctgagtgggagagctcaacttcattccttgggtgacaagggagaagatactgatgggaggaggcgaatcacaggtttgcatttc

SEQ ID NO: 19931 - DNA, 519 bp, Homo sapiens
ggaaagaaagggagaaggggaggagaagaagaagaaggagaagaacaagaggaggaagagtagggaggagagaatgggatggaagatgaggagaagaaggagaagagaaagagtgggaagaggagtgaaaatgagaatagtatactagaattcaggtgtggagagggggtgggggcatgatgtggtgagagcagggtgtagcttagttgaggtctggacagcttggttgacaaggcgagaattcagtcaagaattgaaggattggtagttaggcaaactgaattgtatggaaagaacatttcatttcctatcgtctacccatgacctagaacagtgcctgatacacagtagctcaatgaaaactcactgaatgaatggaagtgcaggcaccatctgttgagtcctgttctttgttcacagactgacatgaaaattccacattttatctttgttcagtttccaactctcctgtgagcaaatcgataaacacgaacacataaacccaatgatcaaatactt

SEQ ID NO: 19932 - DNA, 471 bp, Homo sapiens
gaggcggggatgctgcggctccgcagcgggctgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagccattgcagcacctccatcagagggagaggctaatgctgagctctgtcggtatctttccaaggtcctagaactcaggaagagtgatgtggttttggataagggtggtaaatctcgtgaaaaggtggtgaagcttttggcttctacaactccagaagagatcttggagaaattaaaaaaggaagctaaaaaaaaaaaa

SEQ ID NO: 19933 - DNA, 76 bp, Homo sapiens
aacagccacctccaccacagcaataagttcattcttaaaagtatttgtttcaggccaggcatggtggctcacgcct

SEQ ID NO: 19934 - DNA, 543 bp, Homo sapiens
tctgcacactccagccacactagtgtcaattcagtcccacaaaagggccaagtcctcaccttccaaaagtgatgttcactatatcggaactcaacatccctccatggtccctaggatggtcactttctaacatcttcaggtctcagcaaaagccttacttcttgaaggaagcctcctctgattcccttggaccaagttaaacttggacacctagaacgcagtacaacccttcaggttgtaattattatgtaattatttccttccaagtatggctttcccactgtcttaattccagcaagacggatcacagtctacctacacttggctgacagcgggcatctaatgagggtaccacagtggactacaggtataaatactactgtgcacactacaataaaaatagtacaggccgggagtggtagctcacacctgtaatcacagcactttggtaggccaaggtgggcagatcacttgaggtcaggagttccagaccaacctggccaacatggtgaaatcacatctctacaagaaatacagaattag

SEQ ID NO: 19935 - DNA, 596 bp, Homo sapiens
tggccaccatgcctggctaacatttttttttatcttttggtacagagaggggtctcactttgttgcccaggctgttcttaaattcctggcctcaagcaatcctcccacatctgcttcccaaagtgctggcattacagatgtgagacactgtacctagctgaggaattttttgtaaagacatttcaccatatgggcccatgggcagatggacacccctgagggctggtctcactgagaggtatgtagaaagttttgagctcaaatgccaatattgctattcattatgtgaccttagataagtcccttaaacttcatctataaattgggagtcattgtatcaattccagagttgtcaagcttatcaaaacaatcaattgtatataaaatgcttaatgacctgcctgacaccatgctcagcacatactaattccctgttctttgattgttgacaacctggaatactgtgttaagaaagagtttgaagctagacatgggcctgggatagaaagaactttatggttgattagcacggtttgcaatgaacttgagaaggaaggggtaacatagtggctcaagacagcattcaactgaatgcc

SEQ ID NO: 19936 - DNA, 531 bp, Homo sapiens
caagaaaattgggtacctgaggaacaagggtaggagggtcattttgtatgtttcaaataccgtatattttgatttatgtactatttgaatgtatttcccattaaataacactttgaagatgtaatcagccaaatcctgaaggtaggaaattctacaggataaattatctggtttcttcaacaaacaactcaaaaaagagggagagcgacgaaatgttatagacttttaaagatgtagaaaatgtcaaccttaatatatctaccttatttggacattttgatccagatttgaacaaactaactgtaaaaaggcattttggggctgggcatggtggctcacgcctgtaatctcagcactttgggaggccgaggtgggtggatcacttgaggtcaggagttcgagagcagcctggccaacacgatgaaacccagtctctactaaaaatacaaaaattagccaggcgtggtggtgcgtgcctgtaatcccatctactagggaggctgagggaggagaattgcttgaacccgggag

SEQ ID NO: 19937 - DNA, 571 bp, Homo sapiens
gacctgctacccaggattggaagatgatgttaatttttccatctttactataaaacctagcagttcaacagccaacaatagcaactgaataaaactaaaaattggagcggtcaacttcatgagcaaactggacggcaggcttgttatcagggggtgggttggtaggtagcaaatgaaatattgaataaaagctatggtccaaaagccacaaatggaaggcactgaagacattaccaagcagggttgatgggtgggcccacacaacatacatatctatagacaaatcaagtgaagcagtcattctctcagtcttgctacaagatatggtaggtggccaatgtcagtcctgctaatatctgggccccaacagaatacattggaaatctcaatctagtctctttaaaatgaagccaatccactgccttcaaaaatcacacctctgggccaaacatggtggctcacacctttaatcccagcactttgggaggcccaggcaggaggattgcttgagcccaggagtttgagaaaagccttggcaacatactgagacctcgtctctaaagaaaaatac

SEQ ID NO: 19938 - DNA, 596 bp, Homo sapiens
gacttttattcttgggcctcaggagtttagattttgtgtttaactactttccaagtagggttaattattatttatggcttgaagattttttagatgagtcaaaagaattcttagaatatttcatgagttttagacatacctaccgtgcttttctttcttgactatgtaaaggtgagataaaatagaatgtgagctagtcctaccttaaatttggaatattaataagatgacaaccagcacacagagaatgaatctcacaattctattcacaaaaccacagttcttaatgtctatatctggatcattatttaaattcttcccatggtcattttgacagcttcctgatatattaagctatatatttctgtagccaacttttatgcttccatagaaagaaatttagacaggctgggcttggtggctcatgcctgtaatcccagtactttgggaggctgaggagggcagaacactgaggtcaggagtttgagaccagcctggccaaatggtgaaacttcatctctactaaaagtacaaaaattagagggcatggtggtgcacacctataatcccagcaactctggaggctgaggcataag

SEQ ID NO: 19939 - DNA, 502 bp, Homo sapiens
agaacaggacacgctttgatgaacactttgatctttttatttttaaagaagagtaagaatcatctttgattcccttcatctctcacaaatctggtcatccgcaaggtcttgtgaatttgaacacataaatagttctggaatgcacagccctctacctgcctgaatttctgccctagttcacctctctgactacctcaactccagagttatagcctcctcctgaaatacctgacctctcatatttcctttccctattaatgtcacagtcagagcaacaatcttgaacatactatctcattttttattctgttcataaatgttcattggccatcactgaccttgagactgagtccaaatatccattgtgttgctctcaagactctgcaaagtctgattgcctctctccccatgagcccaccttccagacacacgctcatacatgcctatgcacacacatacatgtgcacatatacttaccttcacatgcacacatgcacacaca

SEQ ID NO: 19940 - DNA, 528 bp, Homo sapiens
gtaaacagggctcagactaaatgaaggcaaaagtagagacactaatagtgtaactattacacggtgagtggggtggcaagagatacgatctgaatttgatgaaacaatatcaaaaaatcataagcatattatttaaaattcaaagaagtattatgaaagaaaactcaaaatagcaatattaattatattagaaggaagaaggagagacaaggaaggagtataaaggagctaaatcctcatgcatgaccgccagaaggcaagagcaatgtcaataatggtggctgggcgtgattgctcatgcctgtaattccagcactttgggaggctgagggggtggatcacttgaggtcaggagttcgagaccagcttgggcaacatggccaaaccccatctctactaaaaatacaaaaattagctggccatggtggtatgtgcctatagtcccagctactcaggaggctgaggcaggagaatcgcatgaacctgggaggcggaggttgcagtgagttgagatcacgccactgtact

SEQ ID NO: 19941 - DNA, 439 bp, Homo sapiens
aaataggatataattaaatatcagaaaattaaatggtcctacttgcagaccataatgtatgatttaaatattatacttagaaatttacaagaatgtgtgaactgaactgataagctaaagaatttctaggttaaaaaaaatcaaacgtacccacctattcaatgaaaaattgtcttactcttggggaagagcttgggacaatgatcagattccaccatctgcttgcaaccaagcccgtgcaattactagaaaatgttggatactggccaggtgcagtggatcacgcctgtaatcccagcactttgggaggccaaggcaggcagatcacctgaggtcaggagttcaataccagcctcggcaacatgacaaaactccatatctactaaaagtacaaaaattagctaggcatggtggcatgcacctgtaatcccagctactt

SEQ ID NO: 19942 - DNA, 86 bp, Homo sapiens
aagaggaaattgagggcaaaaaaagagctacaactaatagagaaaaaaatgataaaatggcaataagtcatttcttattaattact

SEQ ID NO: 19943 - DNA, 520 bp, Homo sapiens
cagccccatgattcaattatctccacctgggaccacccttgactcatagggattattacaattcaaggtgagatttgggtggggacacagccaaaccatatcaggatgttccccagtcctgtgtgctctgaggtcctcaggtgtgggtgggcagtaggttcgttatgctggcaatgcaggttagggacaactaatgatatgatgtggactctcgtaggtcagatccttcttcccagagacagcagaagccattgaagtttttatgttgcctttcttggtcccaagggtgaaggaacataggagggcccagacagtggcaaaacaagcagtgtctctgaggagagaaggtcaggaatatcaaggcatgagctgatcaaaccctgggctcggacttcaaatcctttgtggaacagagtgttcacataaagacaaaaacaagccaggcacggtggctcatgcctgcaatcccagcactttgggaggccgaggtgggtggatcacctgaggtctggagtttgag

SEQ ID NO: 19944 - DNA, 565 bp, Homo sapiens
gactgttaaagtgacagtcctccaactcccaccctttccattacaccagactgatccagttggtgagaattcctgccatgaggtcagtcatacttactgggaagaaattcaaaggtgtcagaaagagatagcttatgaactgtgactcatctaaaacatcccaaaatagtattatccagttcaatcacaccaccacatttgttagaactggctatgacaacattttatgctcaacgtatttacaggtgttccaccaaatcacgtaacaattgaaaataaatttagaaaatgttgaatgaggctaggcacagtggctcacacctgtaatcccagcactttgggaggccgagatgggagaatcacctgaggtcaggagtttgagatcagcctggccaacatggtgaaaccctgtcgctactaaaaatataagaattagccaggtgtggctgagatcacgaggtcaggagatcgagaccatcctggctaacacggtgaaaccctgcctctactaaaaatacaaaaaattagccaggtgtggtggcaggcacctgtagtcccagctact

SEQ ID NO: 19945 - DNA, 641 bp, Homo sapiens
cccatcttgattatactttttcctgctgtctctttcttcaaattctggatcttatcttctatcatatccttcttatttacaaattactacataagtgcttgacttttaaaattaagaccacttaaattcaatgtgtatttttagtcagagtttactgtcattccatgtccacttaggttctctctctcctcattttctctgtttattaatatttagggccagtcaacagcacaaattaatgggaaattcctcctttggcattactcagccctttgttttaatttggttagtattaaattattttagtagcaaagttatcattcagtggggactaaagaatttaagtgctttaagttttatacttcctctagataaaaatatattgttctctttgggaggctgaggccggcaaatcatgaggtcaggagttggagatatcagcctgaccaccatggtgaaaccccgcctctactaaaaatacacaaatcagctgggcatggtggcagcctcctgtaatcccagctactcaggaggctgagtctggagaatcgcttgaacctggcaggctgaggttgcagtgagccaagatcgtgccactgcactccagccctggcaacaatgcgagactccttctaaaaaaa

SEQ ID NO: 19946 - DNA, 589 bp, Homo sapiens
ttaatatgttctttacatcaatcctttgtcactcgtaagatattttaaatatatttcctagtctgtgacttagtctactaagtccgccactactccccagtctgtgagaaggcacactgtttggaaaattttttgaagcacaggtttacattttaatgttatcaaatttattaatcttttcctttataataggcttttttttggctttgcctttctctacttattttaaagcttatatattttaaggtttatacatttcccttgaattatgactgtggcttgcttcagtttctcattcaattctaaatctgaaaacctagataaaatacgtcaactcctaaaaatgtacacatattggtaaaattggcataagagaaaatctgagtgaacaaagacttaagaaattaaaatggtagttaaaaaaagaaaaacccttcccttcctaaatctcttggctcagatggttttgtacagaaggccatcaatctttgaaagaatcattcattcacatctttacaagttgcttcagaaaatagaaaaagaacaaaacaatgcccaacttgaggctagtgcaatcttgattccaaaa

SEQ ID NO: 19947 - DNA, 634 bp, Homo sapiens
agcaggcaaagccagctctctgggcagtgtattcacccaccaatgtgcatgccagagaagaaaggtcacagatcacagagtgattcctgcccattaggaagccatgacccagtataccccctacagcaacttcatcactgggaaacagggtaaggggaggggactgagagtttctcctccctatagtaagaatggtagctagcatttactgaatacccataggcaggcctgtctagctccgaatctcatgctcttaacttctctgctaggaggcaccaaaaaggaaggcagtgcaacttctcagatctaaaagacaagaacatatggccaggcatggtggctcacacctgtaatcccagcactttgggcggctgaggcaggtggatcacttgagttcaggagttcaagaccagcgtgaccaacatggcgaaaccctgtctctaccaaaaaatacaaaaactagctgggcatggtagtgcatgcctataatcacagctacttgggaagctgagtcaggagaatcacttgaacttaggaggcagaggttgcagtgagccaagatcgcaccactgcactcctgcctgggggacaagagtaaaactgtctcaaaaaaaaaaaaaaaaaaaaaaaattt

SEQ ID NO: 19948 - DNA, 569 bp, Homo sapiens
aatgtaaaaactaaggcacagagtggtagggaaaggattgccttagacaaagctaccattttaagttctggaccccagttgaattgtccacctggcgagagttttgcagggtggaaacaatgccttcagccagttatgaaataagcaaaagtctgttccctgagaggagacatctgcatgaaacctacaggcatgtgggaaccagatcttaaccttggtttcaatgcaagtatttgagaaattactgcaaacagcagtaactaccagttttgtcttttattattcagctttcttgttaacttcagagaagtgcaaatgtgaaatggacatcgccccatcccagcagaggaaaacataacatacagctaacagagacaaagactttctattgccaggaacaatggccaacactcatcactcttggtaaagacagtaggaaactgggattcaaacacacagtgaagaatttcagttagatgcaaggaagaaatttccacagggactgtgagtgataatgtggtatgttgcaaagaaaactgaacttaaatatagaacactggattttagtt

SEQ ID NO: 19949 - DNA, 362 bp, Homo sapiens
gtctccacgtgggcatctggtcttgttcattcgcagagtacgattcctgcctccgggctcagtcagattctctaacatctcccacaggcagttctttggaaatctaaacactgactcacaaatgagccatgtatttcattctgtcctgcactagggagggtgctccttaaaagagcgggccgtaccgggcatggctcacacctgtaatcccagcactttgggaggctgaggtgggtggatcacttgaggtcaggagtttcagaccagcctgaccaacatagtgaaccccgtctccagtaaaaacacaaaaattagccatgtggggtggcgcatgcctgtaatcccagctacttgggaggctg

SEQ ID NO: 19950 - DNA, 541 bp, Homo sapiens
aacactctcaagatttccaccaacaacccccactagagatataattgcttctcatccacagtggtctatgacaaaaatttactatatgcaaaagatgtgcctaagaaaatgtagaatttggaaaatcaaaaacaactgtgttaggcaaaggtgacagtaagcaatatctgcatactgaatggttggacatgcaccagctgatttcatcttcctgattcccatggtgagggaatctaactgggatagtgaggcatctaactgggaaaataaggtcttagaataaatacaaggaaaaaacaataaagtagagaaaattagtgaatcatcagaaaacctaaaggcacactgctctctacaaaaacatcaggaagtctccaaaaagaaacaagcactataatctggaatattcaaagaacaagagtaatattttttcaattaaaaatttgaacccatacccaaaaacacagaagtgctggaattttgagcaatctctatctcacagaaggtagaaaagccctagtaacaaacattgacaatatga

SEQ ID NO: 19951 - DNA, 497 bp, Homo sapiens
tagatttagaaataaggaaagttaagtgatactgtaactttcctaaggccacacactgaaaataatgtagccagaatttgaatactgattccaagccctcttaaacataaagctgtattgaatgggtctgtaatttctgacttcatctcttctgtatcttcagtggccagcgtggtgctgggtacatagtagacactgtacatttttgtttaataaaacaagactctgtgtcattatttatttgctttttgtctataaagacaaacgctgcccacccttctttcaaataccttttcaagttcactttcttccacaatgctttccacagctaacctctccagctcacttccatttcttcctagctcatggtctgtgctagaagcttgcaactaatgctctacttccttccaacacttatgtatttgtcgtccttctttttcatttatttttgctcatgtggtctcattaattcttaaactttgagttctttacactac

SEQ ID NO: 19952 - DNA, 387 bp, Homo sapiens
tatttatttttgtgagatagtgatatattcataattttatctactttttcttcagtatcatgtaagccccatgaaaaaataattttgtttgtttctttgttttattcactattccttccctactaatttgaaaagtgaaatgtcaataaatacctccagtcaataaacacctgcagattaaggaatgtatgggacccatggatctctttcatgtcagttcattatgctgggattctgtccattgttcaggatagagttctcacctatatagatttctacctgcaagtgagtttctgctacatacactatctttttccataagggatgataaaattatcttctatctcatttttaggtacatgttaattcctactcagcctcccacca

SEQ ID NO: 19953 - DNA, 540 bp, Homo sapiens
tgtgcctggcgcggagcaggtgctccctaattgctggctgttactattactgttgctgctgttgttattattgagagactaagaagcacattggaaaccatgaaaacccagagatgcaaattttaattgccagagagagatttttcaacattttcaatgtgctgtcatgaagtatgaaccatgcaaatgtaggtttgactacttcgttttgtggaagagccacctacggctaagagaggttagaagacttacctgatgttgcacagtgacaaagggtggagtccaattcaccagaacccaggtctgtctcctgaatccaggatcgtgactgctggtttggccgtgggggctgagaggccttggtacagtgggcagacgggaggtccctgtatatgaagggcagaagcttggggctgcacctgggaccctccaacatcattgggagaaaagcctggagctctcaagctctgacctggcacagtcaggcagacacggctcacaaagaccaaaataaccagaggcatcattaaggatgtcttc

SEQ ID NO: 19954 - DNA, 632 bp, Homo sapiens
ctcccacatgtgtgggggtgacacatgctcatgaaatttacctcccagatatgctttcttggtgttacaaaaatgtagccttcagccttaataagagatacacttaagaattcaaggtattggcccggtgcagtggctcacgcctgtaatcccagcacactgggaggcctaggcaggtggatcacctgaggtcaggagttcaagaccagcctgaccaatatggtgaaaccccgtctctactgaaaaatgcaaaatgagccgggcgtggtggcacatgcctgcaatccaagctactcaggaggaggctgaggcaggaatcacttggacatcagcgtctttaaaagaaccttattagataagcagcccacatctaactgcattctaactggatgccctgcacagttgaatctagaaggatggttctcagtgctgcattcctctggggggctgacccatgcccagagattctgactctattccacagtcaggactgagagcaactctcacagctaatgaatgattatcaaaatgaaataatttatcataagcagaatactaaagtaaagctgtgaaaccagatcctcctcaaacaggcgaaagaaagagagtcttcagaattgcaaacctggcat

SEQ ID NO: 19955 - DNA, 436 bp, Homo sapiens
atgtcccttctccctccctttgtctcaccattctgtccacagcagctggcgcctgaaaggcatgcagtggaccctctgcattttcatttcacagtgatctttctccagatatttctcatgtgatgtctgtatcttgctcttacctcttgagactgtgcatgaccttaatgtaatgatcttttgaggtaacacacacataccatttttctgcatcgtaagtttcaggggatggatttttcctatatattttcacattcttcactgcatcagaagtgatgctgagtatatagtaggtgctcagttgtttaaaggacattgaagagagaggagtcaaggtaaccaaatgcacaaggaagtaaagcaacatgagtaagagccagcagaatcaatggaaggcagaaatagacccacacaggcttcaggtgttaggattatc

SEQ ID NO: 19956 - DNA, 421 bp, Homo sapiens
tatccttcaaatttgaatctaaacctgttatccaataacgacagtaaggaaacatgcgtcttccttgcttggtcagaatcatctctgtgcttcgatgatagaactcattccacatactattgttatcgagggtaacagtgattccacccacagtacaatcagctgtaaggcaaatcttccctttagattttactggtgatgacacactactagccaaagcacaggcatcctgattagtaaccaaaattccttgatcagttttgccatttcctggctgctttaagatgacaaagaaggtaggtgctgctcctgccactgttccaccatcttgattagccaatataatctgctgtttctcctccatgatttcagtaggaaactcagtagtaagacaactgtaatcaccacatagtcacaatgg

SEQ ID NO: 19957 - DNA, 532 bp, Homo sapiens
tttatataagatgttcttaatttaagaaacaaacaaaatgacttttttcatatgtgtctggcatgcaacataagcaaacagacacagagtttggtaaggatttatttttttatgtcacattttgggtaacaagataggttctctctgtattctattctataatttagtaaatgaaacttgtaacacttttgtctgtcagaaaataaaaattaattgttcttaaaaggtgtatatagtcagccgggcgtggtggctcacgcctgtaatcccagcactttaggaggctgaggcaggtggatcatgaggtcaggagatcgagatcatcttggccaatatggtgaaaccccatgtctactaaaaaataaaaaaaaattagccaggtgtggtggcacgtgcctgtagttccagctattcaggaggctgaggtagaggaatcacttaaacccaggaggcggaggttgcagcgagccgagattgcaccactgcactccagcctggccacagagcaagactccatctcaaaaaaaaaaaa

SEQ ID NO: 19958 - DNA, 596 bp, Homo sapiens
tccttgaaaagtgagaagtctggaaggggtggctactgacatagtgaagcaactagttcaattctacaacttgacagctacccctgtgccaggctatctacgaggatacttagaatgcataagacattccttcaaggaactccaggaacagaggcctgacatgttgcaatgtttagtgtcaagcagtgtactagagacacattatcacactcaaacctcacaacaattctgtgaggtaggagttatcactccccttttatagatgaaacagaggcttagagtgattgatttattgaaagtcaaacagccagtaaatggtgtagccaggattccaaacttgctgtctcactgagactgtacttaattactggagggaccgggtgtggtggctcattgctataatcccaacgccttgggaggctgaggctggtggatcacctgaggtcaggggttcgagaccagcctggccgacatggtgaaaccccatctctactaaaaatacaaaaattagctgggcatggtggtgggctcctgtaatcccagctactcaggaggctgaggcagggcaattgcttgagccgagatcacactgcact

SEQ ID NO: 19959 - DNA, 429 bp, Homo sapiens
acttcatataaacatctgcatttcatctgcaaaacgcctatccaaataaggtcacgcttacatgtcccaggggctagaatttcaacatatcaatatgttcaatccataacaatgcaaatagtcttaaaggctgtcactatctaaatgtactcagtgtgattcaagggaccatgtctctgtagaaattctaatgcacaatccctcaagatttggcaagaagtattattctctgttacctacatatggaagaattagggtctgcacagcctgtgttctcattttattacaggctttcttggttcattgtccagaataacttatctatacactttaaaattttggattacctgttttgtttttttaagtcagaaatagcattcctggatatttggaaaactctgcctatttatcttttcctctccagtgttt

SEQ ID NO: 19960 - DNA, 364 bp, Homo sapiens
ttttattctttatattagatattaactcacaatcagtgctgctgctttgtaagtttctacttcctctgtgaaatgtgcaatatcagcaatgtatgtacactgaaaagagggagtttttaatttattgaaatatggtagcaggctgggcgcggtgggtcatgcctgtggatcatgaggtcaggagctcgagaacagcctgatcaacatggtgaaaccccatctctactaaaaatacaaaaattagctgggtgtggtggcacgtgcctgtagtcccagctactcaggaggctgaggcaggggaatcgcttgaacatggaaggtggaggttgcagtgagctgagatcacgccactgcactccaggct

SEQ ID NO: 19961 - DNA, 468 bp, Homo sapiens
caaaccatggaaatattaaaagtaagagctatacaagctggaatgattataggccatataaagtgaatcacccaatgcctaaggaatgattgtggccatacttgagccacagcgacagcactttgctctttttgcatcctaataataacacagccatacagtgctttactaaacaatactcacatatgttatttaattcaccctttcaacaacattgtgagtaattcagggactgttttacacagattttacagacaagggaactgagaattcaagagattaaacaatttacccaactgtctcaaagtcccttaacttcagagctgaaactcaaatgagagactacataaagtgatgtaccttgcagaataccaaggggacatggatccaagtgtgtttgctgggattgcattcagatagatgacagattgattaaaaagtcaggaatagcagaaattgactagagaa

SEQ ID NO: 19962 - DNA, 302 bp, Homo sapiens
gttttttgtacctataggcacagtaccacagtctacagtcctgattatttgtaagaactcaatatataaaaaagaaagtataagaaatcaatgggaaagcatgagattatacaagaaatgatgttatttacttacatggagaatactagtttagcagttttaagctatcacgtatcttaaaaataaatccagggccaggtgcagtgactcacgcctgtaaccccagcactttgggaggccaaggtggaaggatcacttgaggtcaggagtttgagaccagtctaggcaacatagccagaccc

SEQ ID NO: 19963 - DNA, 466 bp, Homo sapiens
aatgatttggaagagcaatctgcttatcttgttttctttggggtacagaaacagtttgcttttccaatgcattaggaaccaacctctgctctttcttttatctttgcttgtagactgggcaacttttgtctttcttatagtaacttgctacacacaccaaggtttagctaacatccaaccttctggctttattcaccttctttctttagagctactggtatatggtctgctttaagagttattataggcaaaaagtttttcaaatgttttgccataatctaacaggtcactgggtttcagcccggtgcggtggatcacctgagttcaggagtttgagaccagcctgaccaacatggagaaaccccatctctactaaaaatacaaaattagctgggcatggtggcgcatgcctgtaatcctagctacctgggaggctgaggcaggagaatcccttgaaacccgggag

SEQ ID NO: 19964 - DNA, 655 bp, Homo sapiens
gtttcgattaaatatcacacttcatgtatgaataattataaagatagtcaaaattctgaatactgttattcttcctctagagataatttgttttttgtttctgccatgcagttaggctaggggcagattactttaaagggattcaaagctgggctttagccatttgaggtttcagctgtttctgcttcaccctcattgttagggtatagccatttgaagataccaattgaaaaatctgctgcatatctacaactatctgatctttgacaaacctgacaaaaacaagcaatggggaaagcattccctatttaataaatggtgctgggaaaactggctagccatatgtagaaagctgaaactggatcccttccttacaccttatacaaaaatcaattcaagatggattaaagacttaaacgttagacctaaaaccgtaaaaatcctagaagaaaacctaggcattaccattcaggacataggcatgggcaaggacttcatgtctaaaacaccaaaagcaatggcaacaaaagccaaaattgacaaatgggatctaattaactaaagagcttctgcacagcaaaagaaactaccatcagagtgaacaggcaacctacaaaatgggagaaaattttcacaacctactcatctgacatat

SEQ ID NO: 19965 - DNA, 599 bp, Homo sapiens
aggggactcaggattggcaacttggcctgtgtccagccttgctggttggagagctcagacctccccaaccccaaatcctggtctaggagaagcagaacgatggagtgggtttctatgtgagtctccagcagctgcccctgttcagttcagttcagttcaacttgattcatttatgttgaattcaactcaactccaaaggttcaggctagagtcttccttggcgaaggattgtcacgattcctttcttacagctctcagtcctatctctgaagcccagggcactctgtgtgcaggaggcacgtaatgtttagaaagagaagtggaggccgggcgcagtggctcacgtctgtaatcccagcactttgggagactaaggcgggcatatcacgaggtcaggagttcgagaccagactggccaatatgttgaaaccctgtttctactaaaaatacaaaaattagccagacatagtggcgcacggctgtaatctcagctactcaggaggctgaggcaggagaattgcttgaacccgagaggcggaggttgtggtgagccgagatcgcgccactgtactccagcctgggtgacagtgggagactct

SEQ ID NO: 19966 - DNA, 347 bp, Homo sapiens
aagatagggtggttgactgagtttacaggtatggaaactgagatgcaggcttagtgacctgctcaaggtcataggcttagtaaatggtgcaaatggaaaccctcatatgactccaaacccagttctgtttctcttataaaattgtctctatgtccaaatgaaggatatgaagactaaatgaaggaattcttttttttaacaaaagaaaaacatgttaatgtgtatctgtcagacatggtaataaggaagttctggagatatgggggagtttgtaatttttagaagctatgggtaagaatgtactcagactttacagagagttagagtgctttaaacaagtgcttctc

SEQ ID NO: 19967 - DNA, 480 bp, Homo sapiens
atctgtaaagagtggcaaatatatattagattttagtctatgattaaaatgatgctataaaaccaaaataaattaaagatgtatcaaagatacacattgaaattgtgaaattgaaattgtgacaggacaacataaactattataagaaagactggttaaataattttacaatttcaaagtacggaaggcatttcaaaagtttaacctaaaaacacaagatcataaaatagaagtctaaaacatagattctacaagacttttataatcattattttaatgtattatttattttatacattttgttgaaggtataaaaatatcttcaacaaagaaagtacgggaaatttttgcaaaacatatgataaaccataagctgaattagcaaaaaattaaatgcctgttagaaaagatgttaaaattcaaatataatttaagacaagcaaactaaccaaacagaaagaactttatatgaataagcca

SEQ ID NO: 19968 - DNA, 544 bp, Homo sapiens
cttggaaccaactcaactgcccatcaatgatagactggtaaagaaaatgtggcacatatacaccatggaatactatgcagccataaaaaagaatgagttcatgtcctttgcagggccatggatgaagctggaaaccatcatcctcacaaactaacacaggacgagaaaaccaaacactgcatgttctcactcataagtggagctgaacaatgagaacacatggacacagggaggggaacatcatacactggggcctgttgaagggttggaggaaaaggggagggagagcattaggacaaacacctaatgcatacagagcttaaaacctagatgacaggttgataggtgcagcaaaccaccatggcacatgtatacctatgtaacaaacctgcacattcagcacatgtatcccagaacttaaggtaaaataaaatttaaaaaaagagaataatgaaatctgagagatgccacactgaccaaggaatcaagtttggcattgccaaaaatttggcacgctctcttatgagcctcacaatgtgatgta

SEQ ID NO: 19969 - DNA, 447 bp, Homo sapiens
gttggaaaaagacccttcacctgaaaataaaaatttgcctaggtaagttactgatatgcaccttttctactgtaggataagttatgaattcccctctgcctcttgtttctccaagcatgaaattctcaagcgtctcatcaataatttgagccaagaaaagataatgaagaattcctggccgagcccagtagctcacgcctataatcctagcacttgtggatcacctgaggtcaggcattggagaccagcctggccaacacggcgaaaccctgtctctactaaaaatacaaaattagccggtcatggtagcgggcacttgtaatcccagttactcagtaggctgaggcaggagaattgcttgaacccgggaggcagaggttgcagtgagccgagatcgtgccattgcattccaacctgggcaacaagagtgaaactccatctcaaaaa

SEQ ID NO: 19970 - DNA, 453 bp, Homo sapiens
ttttggctaagatcaaaattagtaacaaaaactacagagtttgagaggaaaagattatggcccgaaaattccatgcccaattattctgtatgagggcagagggaaatatttctcaggctggcaaaggctcagaacagaggccatccctgttctcttgctgagaaaattactctaagtcactctacctgagcaaaagataaatcaatataaacaactcaagaatgaggaagttgtggtaataaaggattgatggtgtccctttgggcattgtactttttagtctgtattgagttctttccactgcttgactaatagtggggtatatggcatgtggcaagctcttcctttttaagagcaaaagacatcgcacttgtaaaacaggacaaatggacttgtcccctcccatcagccccggagggaaaaccaaaggagaattccatcagaatacactca

SEQ ID NO: 19971 - DNA, 515 bp, Homo sapiens
gatttaaaattcacagtaatgttttcatgaattcatctgtgaataacattttatagacaaaatgtctgcactaggacaagagaaagatgtataattaccttgttctaaggtaccgccattcattgttattattttaaaatacgagtgtcgactgatgttaaaacacaaaatggggccgggagtggtggctcccgcctgtaatcccaacactttgggaggtgggtggatcacctgaggtcaggagtttgagaccagcctggccaacatggtgaaaccccgtctctactaaaaatacaaaaattagctgggcatgtgttgcgcgcccgtaatcttagctacccgggaaactgagtcaggagaattgctggaatctgggaggcggaggctgcagtgagccgagatcacaccagtgcactccagactgggtgacagagcgagactctgttcttccccccaccccccccaaaaaaaaaccacaaaaagggataattggccgggcacagtggctcatgcct

SEQ ID NO: 19972 - DNA, 549 bp, Homo sapiens
agtgtgactccatctcaaaaaaagaaaaggacaaagtatattggtccaaaaaagaagaaagaatgaaaaaaaggacaaagtatactggttagtatcgtaacagtgagatagtccccctttgagattagaaaataacagtatactcaaagtaacatcaataagaaccaacataaaatagacaagattcactatctacaaaagtaatctgcaccaagtagcaatgtatgagcatgtggtggagaatattgtctataatatgtgtactagaaggaagagacctcaagaaaaaggtcagagctggaaatgtagattagggaatctaggtcaaagttttgagattttaggagtcctgagagaatttaaaaagcgaaatagccgccgggcgtggtggccacacccataatcccagcactttgggaggccaaggcaggcagatcatgaggtcaggagttcaagaccagtctgaccaacatagtgaaaccccgtctctactaagaatacaaaaaattagctgggtgtggtagcacatgcctgtaatcctagctactt

SEQ ID NO: 19973 - DNA, 645 bp, Homo sapiens
taaacatgaatttgtggcctttctataaaggaagcccttcagaatatgtgaattcaccatggctctgattggttcacaggcaggagcccaagccctgagcttgggaggtggtgcttctggggaggccgtgggcaggacggggtagcagctgccctgtgggatgcggctccacttctgctccaggtccccaagaaggctgtgaaggcagggaagcctggggcgggagagaaagcaaataattccaagtcctatgtttcagacaaatgtgaattgatcaaattattaataaaagctgggcagaggagaccaatggagggaatgaggagtcttctgtgtatccaaatgttacctcaaaggttaaaaagaggctggacgcggtggctcatgcctgtaatcccagtagtttgggaggccgaggtgggcagatcacctgagctcaggagtttgagaccagcctgaccaacagtgaaactctgtctctactaaaaatacaaaacttaaccaggcatggtggtgcatgcttgtagtctcagctactcgggaggctgtggcaggagaattgcttgaacctgggagacagaggtttcagtgagctatgatcatgccactgcactccagcctgggcgacagagtgagactctgtct

SEQ ID NO: 19974 - DNA, 515 bp, Homo sapiens
cagattatgtacctcaactggtacctcccccttgtgtcataagacagttttaggcttccttatttgtatttatcagtcattttattgcaggcatggtaaaataaattttggggtctaggccattcattgactagactgctatctgtaatttatcaggttacttggacctgtctgccatcatcaagatatatggctggggagatagcaccataaaggaaacaattattgagaagataaatgacctgtgagagggctacaagtctctagagtgtgtgaggaaaggcagaaagttaccttggccaaagattttgcttgcatccatatatccagttagtttcgggcccaggaacagtgtattttcactgatagcttccccgtctttcaatttcattcttgttctcttagtcaatactccatagaaagtgcctctggccccacacttattattcctttggcctactgcagaaattagaatatattttgaattttaaaagtggcattcattgagcaacagc

SEQ ID NO: 19975 - DNA, 389 bp, Homo sapiens
aaagtttccaaacctctcacttttttagcatcaccaacctatagctcacaggaaaaatatggcctgcctcctgttttcatacagaccataagctaattatcatttttacaattttaaagaatttgaaacaaaaatggaagaagagataatgtagaccatatgtggcactcatacaaagtctaaaatatgtattatctggtctcttacagaaaaaaagtgtcaatgcccaatttagacaaaagcaaaactggtggttgatactatttccccataaatcttagcaccttagggtggttcttacctcaggaaactggtggaagaaaacaatcaattcaatagcacatggttgcagtaaggaaactcaactgttttgctttcaacacatgtgc

SEQ ID NO: 19976 - DNA, 536 bp, Homo sapiens
  misc_feature 455: n = A,T,C or G
attgttaatatgtgacacaaaattcacacaaatctttttaaaagacccataattgcaacattgccatctaaaccttactgctgaatgccaaagctgcactagctttatgtgcaccaacaataacatatacatttggaatactcctggtcattttcataaattttcattgaagaagtcttatgattggcttttttatcttgctttcatgaatttagactaagcccttgatgatgacattaaaatctgaaagtgcacataatgccagtgacacagtgagggacaccttatggaacagcctcacattaattgccagtcttaccacttggcgttcctttccaagtagtcatagctagtgtaagagccaagaaatctaggtgatggcaaagcaagcgcaatagaaaaatgaaagaaaatggtcaatctaactaagtaaatttgcagcaaatggaactcanatctcatttaaaaatatcaaccaacatccaccatttcaccataatttggtctataaaggaacacatcactaactctcattt

SEQ ID NO: 19977 - DNA, 537 bp, Homo sapiens
aattaattataaaagtagttacaagtagttacttttataattatacagctaaaaatgaatataagttatatttttactcatggttttggtgttgtcaaagctcacatttcagcataatcctttatttgctgttgagttgtggagtttatttggttcattaattattgaaaaaaacaagaagaatattaaataaaaccaacatacatggagatatatcctgtagtagaatgctttctttggctttcatgattaaaatgttaatgaagtggacaagcagttctttaataatatgaagcaataaacataagggaagaagaaggtaaaaaaataaaatgatgtgactcacccatgtcaaatattgcatacccatcaccaaatctaaaaactattcacgtaggtatattgtagtccatgtctttaacatcaattacaaccccccctttcctcaagattagccacaggacaaattagaagctgctctgtggatgctgcttctctttaaaaactggtttccctgaatcaataatactgaacttg

SEQ ID NO: 19978 - DNA, 478 bp, Homo sapiens
catgacaacttcttggaggtgctcatacaatgtttccaggtagcccctgtagtaactgtgaaaggccccatctcctaatggtgcatggcccattcgcagtgtcaagggcactgaagagagatcttaatggcatcatctaaaaattatccttaaccatgaacataagtttcttcttctggggtcacgggaagaggattccaagcagatgtgcaccagtcacttctgattgttagaacagtagtgttgctgctgctagtggcagccaaggctgatgtctaccaggcactgtaccaagcactttgtatacatccttatgtttatttcttggacaggtggcgagacttacccagccgtacaacacagccagtcatgagtgaagctgggagttgaaaccatcaaaagcctgagcatttctattaacagggagctcattagcacgtaaggcgctccacagctacctttaaagagttgcagagag

SEQ ID NO: 19979 - DNA, 424 bp, Homo sapiens
aattatatttcaatatttaaattttaatatatttagatgttttgtttgatgttgtttctgcttttgtgattggtgtgtttgggtatgtgtgtgcatttgtattggtatgtgtgggtgcaaaaaaaattttttttctctacctcttatgaagcattttaaagtggttgagttaaattaccactcatttccattttacagaggaggctattaagaaattgttaagacaacatttgctgccaaaggttaatatatacatataaacattatatacttacacatgtgattctatatatacctattcagagaaatgggaaaaaaattttttccgaaaacatagccatctgtatctgagcacagcacatttttaggtaacaaatacaacataatgaagtattatgtcttgttacatcaagagaatggtaat

SEQ ID NO: 19980 - DNA, 549 bp, Homo sapiens
tgtagtctcagctactgaggaggctgaggtgggaggattgccttgagaccagaagatcgaggtcactatgagctgtgactgtgctgctgcgccccagcctggacaacagagcaagaccctgtctcaaaaaataaataaatatataataaatataaaaaccaataacaaaaactctggcttaatctacctatttctttatactacattaattttgctgaccacattttggttttatcaggtgatttgaaccatatcatatactaattttttcagaagctattcaagtcatttcttgacaggtaactttttctccagactttctctaatgctgtgactgacatacaaaacctctgggtactgctgaacctttccctgccatctccctgcacccccatgtcttctttgtacctctgagagcatggggtacaatgcaatgctgtggatgaacaagtggatgacatgccatgtgagtggctaaattcagttctgattctgcctccattacaggggccactcacggtaactgatattaaaaaataaggctaggtg

SEQ ID NO: 19981 - DNA, 381 bp, Homo sapiens
ggggacctcacctttgggaattaattgctgacagtgttagagttacaaagtagccagtgtcacggagggaacctcaaagagacaaagggacacctcgaaggtgtcagagagacggttgtttcggacagaaacagaacagcgaagcggaaagaaaacagaccttatttctgttctgttccacttcagatagtagcagaggagacttggatttcattggtgttggttttcgtgattcctgccttctaaaatcccaagacttatttatcatttatcatcagctcagatcccaggaaaacagtccactgcacttcggtttctgctccaagtcacccattaaataaataattgaacacctgctggtgccaggcgcagttctaatgc

SEQ ID NO: 19982 - DNA, 370 bp, Homo sapiens
gtaggaagtctctgccgtattggattagaaattgagtaaaagaggcctcaggcttgggagtgcactgaagaaataaatggaatgcctttagattcaagaaaagctgtcctcttggtctttggcagtccttggtaataagacaggagaaaaggtttctttctttcaattggaaggtaccatggtatagtaaagaggacactggactggaaattggtgtaatctggccttggtcctcattctgctattctctagctgtatgaccttggccaaatcaatgaacttttctgggcatccatttcctcaccacagaaatgagagggtagaaccttaaccagaaatatgtattagaaatcttttggggccgggcacg

SEQ ID NO: 19983 - DNA, 605 bp, Homo sapiens
gtggaggtggcagatggaagacaggggggatgctgaaaagagggtgacttgaatgtaggacttagaagcctaggtaggcttctactcaacttgggggatgaactggagggaagagaagatggggcctcaagaaaagggtgagaaggaattaaaactggctgaaggaatgaacacaaggcactaggggaatcaatttgtatggatcatgtggcttaactttcacaagctgtgaggcattatttcttcttggcagcaagaaaaaccaatcagaagtcccagagaggcatgcctggaaagactcctttatttattcatcagtttgtttttcattcttttgattattccaaatgaaatttttaatgatgactgtaatgtatgcctaataaaacagaagctcaaataatgatgaagtgttgaaaatacaaagcgaaggccaggcgcggtggctcacgcctgtaattccagcactttgggaggccgagacgggcggatcacaaggtcaggagatcgagaccatcctggctaacacggtgaaaccccgtctctactaaaaatacaaaaaattagccgggtgcggtggcacgtgcctgtaatcctagctactc

SEQ ID NO: 19984 - DNA, 579 bp, Homo sapiens
gatatttgtgtgtgtaaagaattcattaaaagtggaatattccttcctgtttggccaattccttaatgaatatatttgcatttaataatagcatcttacctttagagctttcttgctcattttctctgcctttatcctaagcagtaagatttccaaggttaagaccaaaggctttgtaaaaatgtcatgggtttgtccttgtcaaaaaaaataaataaataaaacctcagaagtcttttctggcagtttacttcaatgtcatttcaagcataagaaactttatatcatcccagacatgaaatcaaaaatattgttttgtactgttatgaaagattttattctatatattttgcctttggacagacatattttagggcagttcataaagatgacattacaactgttttactttcattacaaccccaaattacaaatttatgtcttaagccttgtctttgtagaaagggttgtatgaaagcaaactccaagatgttaaatgaagcaatatgcttatttttaagaacaaattttacattattgtttgttaacgagttatatagactcatgtatacattattg

SEQ ID NO: 19985 - DNA, 521 bp, Homo sapiens
gacagaagggaggtttgaaaataaaccaatggaatatatggaagttttggagtaaatatttaaaagttcacgttgaccaattacccaagtgattccccaaggcagtaccagtctgatccttctggggtggggtgaagatttccagcaagaagggagcagtgatgctcctcctcaggggatgttaagcacccaccactcctctttggtggaagtaatcatgacatgtagggcttaaaagtagttcattattggccaggagcagtggctcacgcctgtaatcccagcactttgggaggctgatgtgggcaatcacaaggtcaatagatcgagaccatcctggccagcgcagtgaaacccagtctctactaaaaatacaaaaatttggtaggtgtggtggggcatgcctgtagtcccagccacttgggaggctgaggcaggagaattgcttgaacctgggaggcggaggttgcagtgagccatgatcacactactgcactccagcctggcgacagagctagact

SEQ ID NO: 19986 - DNA, 532 bp, Homo sapiens
gacctgccccatagtctaactctgttaatggaaatgccaattaaaagcctttccaattctcagtccaataaatttagccacatgctctagagtcctccacagtaaatgctggtccgaatacaaacacaccactttagcccaaggttcaaatgttacctcatctcattgcacgcacttagttatatcttataaaaacaacaacagcagcaaccaaaaagacacctcagctgttatgttgacccatgcacacaaaatccatcgctgctatctgctttgctatcttgagcagatctagcttaactagtaagaattatttatcaaaatagaagccactttggaaataaaactgacctgccgctctcttcattagtgtatcaccagggctaagaacttggggtcagaagagcaaaccacagtagatttttgtgggaaatgtcagggctttaatttaattaccaaaaaatgtatcagggaatagcacaggggacatacaaacaataaacttgccactagagtctaactctgaagttgg

SEQ ID NO: 19987 - DNA, 492 bp, Homo sapiens
caagatcacaccactgcactccagcctgggcatggagcgagaatccatctcaaaaaaaaccaaaaccaacaaaaaacaaaacaacaacaacaaacaaacaataataggtacaaagtcacataatatttctgtacaagagtgctcgatattcattaattcatcaaatatttactgtgcaactacaatgcacccatggggcacggttctggacttgaacaaagcccctgacctcaagcgacctgcattgttataaaatcgaaacactgcaaaccactatgatgttcagagaactgtgtaagtcacagcacctctatgcttaggaatattatacagcagtggaaaagaatgaagtagagctcaataaataccaggaaaggtgtgtgggattattacttaatgaaagaagccggttggaaagcagcatatggacacacgctggagaacatgtagaataaagttgggaagcacacatcccaactcattaacagtgac

SEQ ID NO: 19988 - DNA, 575 bp, Homo sapiens
gggaacacgaaccccagtgcttacccccactggctgtgggctagagatgtcttgttgtttagtaattgctcatgtggcatttttatgtgatgccagagattctagtagcatatttcttttaagctggaagggaggcctgggcacaagtaagctcgtgtggattagtgcagaggctgggtacagtggctcacgcctgtaatcccagcactttgggaggccaaggtgggcggatcacttgagatcaggagttgaagaccagcctggccaacatgatgaaaccccatctctactaaaaatacaaaaattagccaggcgtggtggcatgcacctgtaatcccagctactctggtggctgaaggagaattgcttgaatccaggaggtggaggttgcagtgaggcaagattgtgccactgtactccagcctgagtgacagagtgagactctgtctcaaacacacacacacacacacacacccaccctgaccaacagtgtgaatccccgtctctactaaaaatacaaaaattaaccaggcgtggtggcgtgtgcctataatcccagctactcgggaggctga

SEQ ID NO: 19989 - DNA, 534 bp, Homo sapiens
cttatgtatttacatcatattttatcaagaggccttgcccatcttgattatactttttcctgctgtctctttcttcaaattctggatcttatcttctatcatatccttcttatttacaaattactacataagtgcttgacttttaaaattaagaccacttaaattcaatgtgtatttttagtcagagtttactgtcattccatgtccacttaggttctctctctcctcattttctctgtttattaatatttagggccagtcaacagcacaaattaatgggaaattcctcctttggcattactcagccctttgttttaatttggttagtattaaattattttagtagcaaagttatcattcagtggggactaaagaatttaagtgctttaagttttatacttcctctagataaaaatatattgttctctttgggaggctgaggccggcaaatcatgaggtcaggagttggagatatcagcctgaccaccatggtgaaaccccgcctctactaaaaatacacaaatcagctgggca

SEQ ID NO: 19990 - DNA, 506 bp, Homo sapiens
ctgggctcattgtgcatggaaagtgctagcccagggttgggctacggaagcactctgttacctgctgctgtttctcagaagtgagccctttggcatggagagctggaggaagaggacgaatgctcaaggtctcagggctggagaggaaatcatgatcatggggtggcaaaggacctcaaggcactgccagacactctgggctcttggagaactgttcagagttggcgataactttctgtaatcctaggcatctcttctcttgtcacatttcattgagatatctgtctatcctatttaacccaagcctgattttggataggatccagaaatctaggtgaatttcaggggcctggttgcttcctcatctagcttggtggtaagaagctcagcccctctctgtgggccatgtggagagtacagaaaataaaactgtatcagggccgggcgcgatggcccatgcctgtattcccagcactttgagaggctgaggtgggctgatcacttga

SEQ ID NO: 19991 - DNA, 485 bp, Homo sapiens
caattcatctgtatacattaatgtattacagccattcagttgttgttgctgtttgagacggagtctcgctctgtcgcccatgctggagtgcagtggcatgatatcggctcactgcaacctccacttcccaggttcaagcaattctctgcctcagcctccccagtagctgtgattacaggtgcctgccaccacgcccagctaatttttgtatttttagtagagacggagtttcaccatcttggccaggctgatcttgaactcctgacctcgtgatccacccgccttggactcccaaagtggtgggattacaggctgagccaccgtgccaggccaattcaattggttatcaatcctcactcacatttctccattttaccacaaggatattaagataaactgttataaaacatgtcactagactctaaagaaactgaggatttatctaactctctctggtccttcagcctagtaacactattagaaca

SEQ ID NO: 19992 - DNA, 530 bp, Homo sapiens
tccagtctggtgacggcgtgagactccatctcaaaacaaaaaacaaacaaaaaaaggaacatagccaacacagcatagattatcaaccagctcacactgtggataactgaaacctgcaatgtagaacataatcctaggagtaatcccaccagaagaatgaactttcttgggcttgtgattgagggctgttccacggggtatggaactatactatttggcatgctatgtttatgaaaaaagcaggctccaagttcaagagcaagttctcctacaggtgtaggtggttggaatgtagatagtgaacaactggcaagcagctttaagtggcggctcctagattgaaactcaggtctaactgtagttaaaatcattgctttctcaagcatatcctactaatgtgaatcttccccaggtgttccatgattgagtgaaattatagactgagaccacaggtcttttggaatagcacttccctataccctctccagggcaagataagactctaagaattagtggtaggccatgtgcag

SEQ ID NO: 19993 - DNA, 390 bp, Homo sapiens
tccacctacataggttttcgtttatctagggttatgtcagtggcatgaggagtaagatattttttttttctgttcctcatctgtagctttccccacaaagagaactttctctaatcttcagggataaatctttggctttctggagatcaacatctgatataaaaagtggaggctgggcgcggtggctcatgcctgtaatcccagaactttgggaggccaaggcgggtgggtcacgaggtcacgagttcaagaccagcctggccaatatggtgaaaccccgtctctactaaaaatacaaaaattagctgggcgtggtggcatggcgtggcacacctgtagtcccagctgctccagaggctgaggcaggagaatcacttgaacctgggaggc

SEQ ID NO: 19994 - DNA, 488 bp, Homo sapiens
gctagactggaactactggccttgagtgatcctcctgcctcgggctcccaaagtgctgagattataagcttgagccatcatgccaggccagatggtgcacagtttttaaatgaaatatttaaatcatataaaaactcatggggagtaatataacgaatataatacgatacaatgcatacaatgaacaacacaatggcctaatatatgacaagtcacctttattatctatggacctctttttacccctccagctctccccaccaatgaaaaccattatcaggccaggcacagaggctcacacctatgatcccagcactttgggaggctgaggcgggcagatcacctgaggtcgggagttggagaccagcctgaccaacacggagaaacctgtctctactaaaaatacaaaattagtcaggcttggtggcacatgcctgtaatcccagctactcaggaggctgaggcaggagaatcacttgaacccggga

SEQ ID NO: 19995 - DNA, 496 bp, Homo sapiens
taactcttagagttcacgtgagatatactaaacaaatacaagatctgtattttcttgaataatacgtgtccactggaagcatccatctttactaatggtgttaaataaagaatcccaggagcatttgtacataaatggttatttgctttaatatataattagctccactaaaatcacagtatagtgtgatttacaatcacatgaatatctaagaatgaagccaggcacggtggctcacacctgtaatcccagcactttgggaggccgaggcaggtggattacctgaggtcaggagctggagaccagcctgaccaacatggtaaactccacctctactaaaaatacaaaattagctgggcatggtggcacatgcctgtaatcccagctacttgggaggctgaggcaggagaatcgcttgaactcaggaggcagaagttgcagtgagccaagatcacgccactgcactccagcctgggcaacaagagagaaactccat

SEQ ID NO: 19996 - DNA, 467 bp, Homo sapiens
cttctttctttgtcttttcttcctttagtctttttttttctttatggcctctactagatacatgggacctgaggctaaaaagacttatttttactttcagtcattttaataaatatttcaagaaaaactccacaaggggtacgagcaatctgagtgaggtttcatgatataaataaatgtaaacaataagttatgtttcaaaagaaaagaacatatttagggtagcttatctgtccctgtatttacatataaactaaacaaagagtctgtcctattactataaagctgtggactctcaaaggcccttcagagccccactattgacaagaacgtgaactctgaaatcaggctgcctgagttccaattccagttctgtcagttactagtcacatgacttcaggcaatttttttagccttcctgggtctcagtttcctcatctataaaatgaggataataacagagctta

SEQ ID NO: 19997 - DNA, 598 bp, Homo sapiens
agatggccaggggtgggggatggcttccacctaagcaaaacttgagggctatattatgtgaaccttgcccccaatgctccctgggaattctgctgttgtaataaaacttcagaagaggaaagaaaaaaggcagcatgatggaattcaaaataatgctctaaaagcacacagagagattaagacatccattgtaagacttttgtatggtgcttctgttggttatgctgaaaagagaccagacattgctgaacagagagtgaagctttggctgcgagaaacacacaaattaaactaaagacatttcttgattattagaatagggctgttgtattctgtgtcatcagggtttgagcatttacatcttacaccatattacttttaactgagcttcagttgactttatattaggaaaagttaaaacaaggaaaatgatctagttattagaatgacaggattgaatgtctttcctggtacaaatataatgccacaaacacctgtttatccagcaagatcccctttcccatatatgcatgattgactgatagatacgattgatagatagatagatagatagatagatagatagatagatagaata

SEQ ID NO: 19998 - DNA, 476 bp, Homo sapiens
gcaagggatacctagaggggttagggcaagactagcaaaaaacttcatgtaggaaaggtagggcacccactcccttggaaaatagttatcagggcagtgagcagatagtccataggccagtatgagccaaattttctgcattcagtagcatacagctctctggaggacctgcatgtttgcttatgaaggggcccaaaggtggggctagaagtgagcaaatcagaaaagtgcccaggttgtggtgaaaaacttcaagaggttaatatctggcaacatgaagatcccaggattataagtatgctcttactacaagtacctaattcaattttgaacttagctatgctcccagagagtgaaaaggagggcaaatggaggtaccaaacaggaccatgggatcttgtaccatagttcaagagctgaggtcagttaaagagcccagttcaagagctgaggtcagcaaactacagtctcagagc

SEQ ID NO: 19999 - DNA, 471 bp, Homo sapiens
ggcggatcatattccttcatctaccatggctcagccgggaactctgaacctcaataacgaggttgtgaagatgagaaaagaagtgaagagaattcgagttttagttatccgaaaacttgtcaggagtgttggccgggggaagtcaaaaaagggtactgaagatgcactgttaaaaaaccaaagacgggcgcaaagattgcttgaagaaatccatgccatgaagccagattctactgcaactgaaagagcaattgccagactagcagtacatcctcttctgaagaaaaagatagatgtgctaaaagctgctgtacaagcctttaaagaagcaagacaaaatgttgctgaagttgagtcatcaaagaatgcttcagaggacaatcattctgagaatactttgtattcaaatgataatggaagtaatttacagcgtgaagcaactgtcatcagtgagcaaaaagtcaaagaaac

SEQ ID NO: 20000 - DNA, 510 bp, Homo sapiens
ggtagcaagggggtgatgtcaaggtgctgagaactgccaagacgctctggcttgtggcatgtgacactctgatgttcgcagaaacccacccgctgattcaatacggggaccaggaacctgccatgacagtcacgactcagtctgcctgcacctacatgattaagaagctttattgctcacacaaagcctgtttggtggtctcttcatatggatgcgcataacatttggtgccgaagaccccggacagggtgactccttcgggagattggtcccctctcctcaccctcactccatgagaagatccacctacgacctcaggtcctcagaccagcccaaggaacatctcaccaatttcaaaccggaagacaggaatgtcaggcctctgagcccgagctaagccatcatatcccctgtgacctgcgcttatacatccagatggcctgaagcaactgaagaaccacaaagaagtgaaaatacccagttcctgccttaactgatgacattccacca

SEQ ID NO: 20001 - DNA, 475 bp, Homo sapiens
ttacgcacttcgtggtcctcaggtcccacagcttgatctgtggaaaaagcaccaggggccatcagggaggggccagggggtaccatggtggtccccaagtgcaaagccaggaaggcaaggtggtctccagtggcctgtgcaggtcatgaagatctccatctcgaattcttgagccttgttgttcatcaaaagcatgtaaccaggccgggcacggtggctcatgcctgtaatcccagcactatgggaggccaaggtgggcagatcatgaggtcaggagttcgagaccagcctgaccaacatggtgaaaccccatctctactaaaaatacaaaaattagccgggcgcagtggcgggtacctgtaatcccagctactcaggaggctgaggcaggagaatcgcttgaacctgagagacagaggttgcagtaagccaagatagtaccactgcactccagcccgggcgacagagcaagact

SEQ ID NO: 20002 - DNA, 540 bp, Homo sapiens
tatataaaactgccacacaatgatcaaattgctttacaataatactcaaagattgtttccaattatttatacttttggtagaaaaataaatcctagataagttttagaaatatatttattatagtgatgttttcaatttaacactacccaatgaaaatacctaatacagatgtatttatgattgtacatttatttatattagaaaatttaagatacgaagtgaattcattttaaactaagccaggcatggagggttgcacctgtgatctcagccacttgggaagctaaagcaggaggatcacttgaagacaagtttgagacaagcctgggcaacacagaaagaccccatatcttacaataatgttttgttttttaattagctgggcatggtggtgcacactgatagtcccagctacttgggagaatgaggcaggataatctcttgaatccaggagctcaaggctgcagtgagcaatgatgataccactatactccagcctgggtgacagagtgagatcccatctctaaaaaaaatttatc

SEQ ID NO: 20003 - DNA, 486 bp, Homo sapiens
caaataaaagacacaaaattagagttaattttattgtaactgggttggctccagagattatagttaggaagtgattacattaagctgtacatatgcagcattctagcaaatttcaatgcagtagacaaaatctataaataatgtgaaacacatattaacatgttaagcataatatgcattcattgtcttcaacagaataattctctattaattttttaaatgtaatacaattttactttaaaaacactgaaaaatcaacatatttcattaagaaaaaattataaatgttgcaaaatgatgatgaaaatacctatagtaataattcccaactataacaattttgttttatctaatactggtcagctttccatgtgtccaagcattacagaacttttcattaagcctaatcctcacaagaacattgctttgagtgatattccagagtggtagtcctttaaggcattagaacgatttgtgaaatcacta

SEQ ID NO: 20004 - DNA, 285 bp, Homo sapiens
ggaactacaatcagcagactagtcctcaataatgatgtcttagcctttcctgaaaaaattcatgaataaatgaaaataaaatgttccaagtgacacagtcatcatttaagactacttacataatgcatacatatatttggtaaatattcagattagcattacttaaatattggcaaataaaataaaataaataaataatggtaactattaacattaaagtgtatatgtatataatcttaatctataaggtattagtttgctggagatgccataaacgcatagcac

SEQ ID NO: 20005 - DNA, 546 bp, Homo sapiens
cgacagaagggtacccttgggtttgtattgtaacttggtatctttccattgtctcttaccacaaaaattccttttaagaaactgcattcagaattgaatccatcaaacttcagctgctcattctcctcctccttatggaagatttagtgactaagtctttgctttgattttctctcaaactttgagggttcttactttctctcctaattgcaacaatttggtgtccccttttgcttgggcgcaaataaaaacagcaacaaatggttaaaagacatgggggcgcaccggtgcacatgcctgactagctgatggactgcaagtttgggctgtcaggaaagagatcttcccacagcaccatgcactggcaatttcaacatgcgtgctatgcctggcacagtggtaagtgttctacgtgcattagagttctcctaggaggaccaataaggcaggccatggtattacttccatagtttcagattagagaattgggtctaaaagattttaagaatctttctcaaggtcattcaactactaagtcctagaact

SEQ ID NO: 20006 - DNA, 490 bp, Homo sapiens
gaatactaaaggtatacattttgtttctggcttttgttttgggattaatgttgttcatgaacatttcctatgttttcatattacctttatatacacatcaatgaaatatttgctggttataaaaatatatgtttcaatatagaaaccttagaaagtggggaatagttaaaagaagtaaacaaagcaatatctccatttcctctttcaaggctcactctatttctttccaggccttctggatatataattggggttattctttatacagaatttatatattgctttcttaatttatcatagggttcatgctatttaattaattgtgtttttagtgtgggatataaataaatgtttctttttgtagttatagtaattaagataacaatgaacatccttgttgataagtctttaaaagcatttctcatagtcttcttggaataggttcctatatatggaagtactggttcaaatgatatgaatattgcaaagc

SEQ ID NO: 20007 - DNA, 540 bp, Homo sapiens
tcagctaattcactcttttcttctttctggtaaggactttccagacatctgtagtggaagaactaggtctaggcccaaatcatttaattactagctgagcgacctgcacacaactgcaagaaattgttccatcacaaaacttcaggatgattggggttctctctttttctctcttttattccaagcttaaaaaaaaaaatctgctgaacgtcccactggagctgaaattgtagaagacaactagctctttaattatgatgtgcagtgagctgcttttacttttcacttgtctctgaagctgaattgcccagtgcctctgaatactccctcacatgtccctgtgatttgtatcagctcacaaaattaaaaaaacgcagacttgcagctctaatttgccagaatccttaagatctcttttatcatgccctgctgcctggatggaaagcagcattctctttagcggcaatctgctgtaatcattttttattcaggtggcaggcagggttcaagcaaaacatgaaagacagtgattggagcaca

SEQ ID NO: 20008 - DNA, 488 bp, Homo sapiens
agtggctgttattttgatagagataaaaaaatagcggctaccatttattgagccctttgattgttccatgtctcaaataagtaattcatatgctttcatttaatccacacattcattcaacaaatatttattatgtgcttacaatgctgcagatattgttctaaatgctggagatacggcagtaaaccaaaaaagtggtggtggttgagcagacgtggggtctctggtcttgctccattattctatcctccacagagggttccttctaaacattaaatcagatggtctctctttgcacaaatgcctctactggcttcttgtctcattcagagtaaagctttcctgacaatagtgctaaaggttctggaggatctttagtctccctgtcctaccccattttctaccactctctcttttgcctggcccacttctgccatcataaccaccttgctttcctttgaatatgtcaagaatattcttgcttcaaa

SEQ ID NO: 20009 - DNA, 435 bp, Homo sapiens
aaatgggttaagaatgaatggactgaggaagtggaaccagttgggatcaactcctctttttgaggaattttgatatgaagaggaacagagaaatggagtagcagctgagagcggttcagaatcaaggtagatttaaagtaggagacaactttggaaataatgatagttttattccccttttcttctttgttaaaaagaagacatgacttacctgaggaaattcttagctttaatatctacagtcgctataacatgagaaaattgtcattgaacgagatagcactttttgcattgtggtgctaaaaaaaaatctttatttttgtagagatggggtcttgctgtgttggccagccttgtcttgaactcctgtcctcaagcagtcctcctgccttggcctcccaaagtgttgggattacaggtgcgagctactgtatt

SEQ ID NO: 20010 - DNA, 451 bp, Homo sapiens
tatatgatttttctcatacacaaacacataaagtcaataagtgatcagtttcctttgtaagaacatacaaagtcagtcattcaggaagtttgtgatcttcccctggatgcaagccactggcagtcccaggatcccagtatatccaacacgaaggtcctgtcagagttccagtgttctcccgcacgacctcccacctcctacctcccagtacctcaacaggaaaggacacatctgtgaatcctctggcatgacttcaattccttacagctgtaaaatccactgcatggaaggaaaagaacatttcctagactgggaatccccagacactttcccaaactgaacaagtgaacagggttttcgctctggtgaatgataccccgtcaaggagagtgcagagaggaaaacagtcttgagatgattgtggtctctaaatgtctgggcttcactgcac

SEQ ID NO: 20011 - DNA, 121 bp, Homo sapiens
ggttatatcactacctatatttagttacagactgcattttctttgccaagaactgctgtactagctggattactgtgctacatctgagaaaagctgaactgtctgcaatacaatatatatg

SEQ ID NO: 20012 - DNA, 540 bp, Homo sapiens
acaacctctctttcacggaaggtcactatattgagcaccaacccttcgttcataattcagaaaggttctccatcctgggaagagcaacaaattaaaaaaccgctaccgacgtgcagatattttacagcgcaatccagtgagactctgcattttcatactgagaagtaaaatatgacctagacaagacccagacacaggctcataagaaagactacggggctttaaaattattgccttgatcatggaaagaaacatgaggaatcactggcagccacaactcaggatggtctttgggggcaatcagtgtttgacagaatcaaagaacatctggaaatcagcatattttgagctagttcacaccctgcttggttcatatttcaacagctctatgtactaaggcagttatatggccctgagaaaagcagcctggatttatcctttgggattaaacaatttcagcaaagctagcaggagtacaggaggtaatcccccctcactggactctaaatgctacacctgcggctcgggtgtgtcatggct

SEQ ID NO: 20013 - DNA, 396 bp, Homo sapiens
tttacaaatttaggatatgttcacaaccagaatccttgaataattactatccctatattttcacaggttatctgcttgttaacaaacctggatatttcattacatgcaagacagaattgtgtaacatgatagtcccaagaatagtaatgcaaatacctccattttactcccaacaattgcatttcattttatttttctgatacagataaaaaaattatcactgattatcacttagtattctctgtcttgtcactaagctttctagaaaattggagttgttccactttgcaactctacctctgcttcagcctctggcattctgcatatccctcagcacagggtaattaagtagtaatgacatctcatggggcacagcagcataattactggagatat

SEQ ID NO: 20014 - DNA, 518 bp, Homo sapiens
tgatttaactttataagctacaggaaacaacaagtgaaatgaaatatactaacatatataggtatacaggtatgtaacattctcatatataggtgttcaaaattaatgatgggattacatgcataaggctggagaggtggtaacaatccttaattctaaatacctaatgatgagagaaagtcaactaaatgaagctcaataaacaagataggtgaaataactgtagttaaagtcaatgaacttaatacactatttttgaaataaaggcctaagtaggcttcttaggataccaagaaatacatattgggccaggcgtggtggctcacgcctataatcctagcactttgggaggccgaggcaggaggatcatgaggtcaagagttcgagaccagcctggccaacatgatgaaatcccatctctactgagaatacaaaaattagctgggcatggtggcacgctcctgtaatctcaactactcgggaggctgaggcaggagaatcacttgaacccaggaggc

SEQ ID NO: 20015 - DNA, 526 bp, Homo sapiens
gattcaaattccatcatcaactcctcttctcttcgaagggttgaatctctcatactcttgaatattttaagagcttctagcttctctgaggctaataatggactaaatgaccaacatttagttcattatttttcccacccatctatgttttggggtgcattgtttgaaacccctcaaatccaattcccaaggcccctaatcccccactccccatagcattctcagactagtagccacaaagggcatgtgtgaataaatacacaagatcaccttgggtattatacctcttgaacactgccccttgctagatatacatcttgggaaaataacctcagagacttgagctgctccaaacaacctggcacaaacattgaggtttgaaatgagactaagaaacagactctgtaagtattattaaatgttataagcacccccgctagagaacaagtatagaaaggaatatgagcctataaatattccagaggtagacaaaccatgtatgtatatcacgtatattttaaaacat

SEQ ID NO: 20016 - DNA, 483 bp, Homo sapiens
agatacaggaaagaaggatcctgagcttactgggagagtctgggtcattctgtctcttaagcatggccattcacagagtagtccccagaccagcagcaactcatcctctgggaacttgttagaaatgagagttcatgggctccacctagaccttctgaatcagatgcccagggagtgggttcctatttgggttttcaaaggaattccagataatttcctgggtcatgagagtttgagatgcactgtcttaaggcctgggtgaaatagtcacaaatcctggcttgtcctggggtaaggctgaggccagtctagctcggcaccttgatttttgtgggacctgataattcttatctatttagtaccctgggcctttaatagcaccttggttacaacccagataaggaacataggctcttcttgacccaccattttgcactttcatgcctcccagatgcagctcacatgaggtacatcatagatttt

SEQ ID NO: 20017 - DNA, 529 bp, Homo sapiens
tatggtgtgtattgaaactactcaactctgacttggttgcaggaaaacagccatagacaatatgtaaatgaatgggtatggctgtgttacaagaaacaggtagcctgccagagctggccatcacattacggtttgttttccttgatgaggtctacacaagtctggaactgggtagacctcggaggagtacagttgaaatagcacggtgtttttcaaggacagattggggagctgtacttagaagagggtgctggtttttgttttcttaggcctgcatattgcttcaccttctctaggtcagagtgaagaaggggtagagatagtaggtagaaccgaataaaattacagatgcttctcttatggagagttcacaacccatttcaatagagaaatttgagtttttacatcttccttatgttaaattgaattctttcagtctgcaatcttcatttgtttcttgctttagagggtatcaaaagaagggaaaaaagaaaaacagaaggaatggtctagtgtcccaggcaatatg

SEQ ID NO: 20018 - DNA, 609 bp, Homo sapiens
gagactttttttatcagactgaaatccgtcctgcctttttagaatgagctcatttttcttcactccagctaatgctgacatttaccaaatccagtcctgattaagtaagcttccatcaccaagaaaactggaaaaaaggtaggattcataagacagtggattcccatccagtgcttgtagctctgttatcctctttagaagtatctgagggttaacaaaattggaaattgtagaggaaacaaatttgcactgaatttagacctaatttacctgaaaatgggattcctttaaaatccacagtgagcccacagttttgtcctgtgactgagattcagtcacaccttgaccatgtatttatttcataaattaagccttcaggccaggcatggtggctcacacctgtagtcccagcactttgggaagctgaggtgggtggatcacctgaggtcaggagtttgagaccagcctggacaacatggtgaaaccccatctctactaaaaacacacagtactaaaaaacatctctgctaaaaacataaaacactacctgggcatggtggtgcgcacctgtaatcccagctacttgggaggctgaggcaggagaattgc

SEQ ID NO: 20019 - DNA, 614 bp, Homo sapiens
ttctctattcctgtttccttgtctgtaaaattaggataataattgttcccaaatcataaagttgttatggggagtaataagatagagtgtgtaaaatactccatacagagcctggaccatagttaagagtaagtactctacaaaaacttgtgtttgtcattagagatacaataaaaagttatgaaccaaagtggccagtaaaaaaaaatgaaagtttttatatactgagcatctataatgtgtcagtcattatgttaaccagttttcatacattatttcttttaatttgttgtcttcgaattattttaaaagaattaaaagaacacagtatgatttaatgtgaaaacgaaaaagagaagattccagctgggcacggtgactcacgcctgtaatcccagcactttgggaggcctaggcagttgaatcacgtgaggtcaggagttcgagaccagcctggccaacatggtgaaaccccgtctctactaaaaatacaaaacttagccaggcgtggtggcatgtgcctgtaatcccagttactcaggaggctgcggcaggagaatcacttaaacctgggaggtggaggttgcagttagccgagatcacaccactgcact

SEQ ID NO: 20020 - DNA, 535 bp, Homo sapiens
tgaggaaacagtgatatagcaactggcgcatcattgctgatcttagacagggctcaagaagaggaagcaggaaatttagccagatctttcaaggaaatgaagggatagagggaaagaggaaagttgctagaggagtttgtaagttttaagaatacttttaaaatagtgaaagatcttgaacacgtttgtaacttaaggtaaaagtaccaattaagaagaggttaaatatactagagagagttgaatattgacccctgagggaataggaggggctgaagggttggtaggtgtgaggaattgtcagtgggtgagtggaaagaggcattttctgcagggtggcttcaattttctctttgaagtaaaaggcaaggttatttgcagacaatggagcgatgtggctggaagggaatgtgaggaaagcgaaatctggggaaggggttagggcatacactgattcacatagatggctcagccgatgttggattcggaacgataaatctacaagtgtgcttgtctatgccttttgagacagtct

SEQ ID NO: 20021 - DNA, 643 bp, Homo sapiens
ttctcatgctgtggctcaatcttaatgtactcaagctccaacaactgggaataagagcagatattacacacattccccactatctacaacagacaagttggtcattttaatgagggatttttgtctgttttattctttttattcctttttgcccatatcttattcagtattctttgtgtggtggctactttgctaaagtggttcaatatttaatcaaggattaaatggtaaagcagtttgcctattaaattataaaaacctttagtgtttacatagccttttctaattaattaaataacttaattgaaattaaaaattagattttaaagtaagctttgagaatacacaagttattttgaagatattcagccatgaatacaacatatatcagtcatggtattacaggacacacagacagtgccagcaacccaggaagatctccagagctcaggcagcctgagctacagtctgcagtgcttgttagatggacactcaaaatcgggctttggaatagtgattccctgagacaggaaaagcacatcaggttatccaaggaggtccagagggaatgggtgcagcacaccagcatggcacatgtatacatatgtaactaacctgcacactgtgcacatgtaccctaaac

SEQ ID NO: 20022 - DNA, 584 bp, Homo sapiens
cggaggttgcagtaagcctagattgcgccactgtactccagcctgggcaacagatgggagactgtgtttcaaaaaaaagaaaaaaatagcagcagtacttcacatcacagtcacattcaagagcaatctacacattcccgttctctcatccctcgctcttttagttaggtcatttggtaatgtttgtgtgtttcagaacataaaagctgaggacttccagctaagcatggaagattgaatacgtatgtttatccctgttccatcctgaaacccactaaaatattttaaaaatgggattagaggccaggtgcagtggctcacacctgtaatcccagcactttgggaggcgaggcgggcggatcacaaggtcatgagatcgagaccatcctggctaacatggtgaaaccccgtctgtactaaaaatacaaaaaaattagtcaggtgtggtggcgggtgcctgtagtcccagctactcgggaggctgaggcaggagagtggcgtgaacccgggaggcggagtttccagtgagccgagatcacgccactgcactccagcccgagcaacagagcgagactctatgtctc

SEQ ID NO: 20023 - DNA, 564 bp, Homo sapiens
caagagctctacagtcacttgtgtgtgtgaactggcaatttgaagaccctccacccaggctgggtgcggtcgctcacacctgtaatcccagcactttgggaggccaaagagggaggatcacttgagcccaggagtttgagaccagcctgggcaacaagcaagatcacatctgttcaaaaaatccaaaaagtatctaggtgtgttggcgcatacctgtagtcccagctacttcagaggctgaggtgggaggattgcttgagcccagaagtcgaggctgcagtgaactgtgatggcaccactgcactgcagcctgggcaacacggtgagatcctgtctcacaaacaagaagaagaaaaagagaacgaggaggaggaagaagacctgctgcttggaggagtctgaaaatagccatgggaatagtaacaagaggtttaatgctcatctgaaccaaccacttggcacatggttgctgtccactggcacagattgcttatgggaagctggtttcaacatttactggctgcacaagcctaggcaatttatttcaactctctaacctttgct

SEQ ID NO: 20024 - DNA, 511 bp, Homo sapiens
gcatgtttaccagcagaaggattttgtatatgccaaaggcaacaccttacacgaccctctatcacctatatgtatactatctccctataccatatcatcaataacattgaattagtgtcagaagacccagatgctagccagctggagaattacagctgtgactgcaggaaagccacttaacatctccagtctttctgtttcatctgtcagcagcaaatgtaggacgaaaggaaaaactaaatcaagcaagtgatgtgacagtgcttgaaaaattattaaaacacgataaatgccagtttctatttgcagcagcatctttagcatctcctccaagattgggaaacattgttaaaagaatatttatgtgaaacgttaatgggaagacaggtaaatgtaacaatccctaaagtacaggagtttctgactgcattcaaaacaggactgaatagagcaaggccacagggtcagggaagaagaacaaggaccaacatgttaaactgacctagcttca

SEQ ID NO: 20025 - DNA, 124 bp, Homo sapiens
ttacaaaatagaaacaaagagaaatatttgtgcaacccagatgatcctcatgggagcaccctagtactcccttgttccactgtaattgtaaatggacatgtgccacaaccccaaacagaacagt

SEQ ID NO: 20026 - DNA, 520 bp, Homo sapiens
tgtgcctgtaatcccagctactcaggaggctgagacagaaataaattgtatcagaacagtgtaaacatgtagacagatactgacaggaataaggttttgtgataactttttggttacctgaagcatttatgaatacaggtaagtctgtggctatgttatagaatattgaggtctccattggtttgacttccaaattagcgctttattaaactcggtgtcagtgtttgtacacctacttgggctgtatcttttctactatgaaacatattttaactgtgaaatgaatattttaaagaatcaccttggggccaggcatggtggctcatgcctgtatctccaggactttgagaggccaaggtgggtggatcacttgaggtcaggagttcgacacagcctggccaacatggcaaaaccccatctttactaaatatacaaaaattagccaggcgtgggggcacatgcctgtaatcccagctactcgggagcctgaggcaggagaatcacttgaacctggaggctg

SEQ ID NO: 20027 - DNA, 354 bp, Homo sapiens
agggccaagatatcatctctgctaatctctgaaaccaaaagtctgaagttaattgggcacaacttctggttgtagatctttgatggaaatgaactgaaattgaaccaccttataaaaactgaatactagatgaaaaggccgttagaaataaaattaaataaacttgaaaacaagaagaatataatgccccaataaataaccagtttagtacttgtaaagaatggtcttctagctgcttcagtagaagtgtccatcttgaaagtttgtgcccttgttattgatgggccaggtgtcattattttgcctattttaggccattgttaaattagacagacacaaattcccttcacccat

SEQ ID NO: 20028 - DNA, 142 bp, Homo sapiens
aacatatctggaaaggaatgtgatattgaagtcataatattcaaaacaattatctactgtggtaatctaataattgattcttgcgacaagaaatacagacctctcttggaatatacttgcaataatttcttactctgcttta

SEQ ID NO: 20029 - DNA, 474 bp, Homo sapiens
aactgttgtatttttaatagacaatttcacgacgttggcgaggctggtcttgaacccctgacctcaggtgatccacccgcctcagcctctcaaagcgctgggacaggcgtgagacaccgtgctgggacagtagtaacttctaatggataatgtatgcgtggggtggaaaggggagtaccagtatttttataaccctcagcacagagcagtttcataagtccatgccatcgtgccatatgccttcttcactggccacttcgattagtgaggaaagaatccaaagaagttaaaatatagtgggccgggcacggtggctcacacctgtaagatcacgaggtcaggagattgagaccatcctgctcaaaatggtgaaaccccgtttctattaaaaatacaaaaaaattagttgagagtggtggcgctcacctgtagtcccagctactcaggaggctgaggcaagagaatcgcttgaac

SEQ ID NO: 20030 - DNA, 82 bp, Homo sapiens
tttaaagtttgtattttttaattgtaaatcgacaaattacagctgtatatatttattgggaattaacatatccattacctca

SEQ ID NO: 20031 - DNA, 370 bp, Homo sapiens
ggacttgagcgatcctctcgccttagcctcccaagtcgctgggactacaggcccacactaccacaccagctaatttttaaatttttctgtagagatggggtctcactgtaatcttgaacagctggcttcaagcaatcctgccgccttggcctcccaaagtgctgggattacaggcatgagccactgtgcccacataacaatgtttcttaagtgaatacatgaatagctcatcatctatggaatactgtgctttacaccaagtagtttgcatttattatttagtattcataacagtctacctgcaaccattgcttttcctattttatagaggagccagaggctaagtaaattcctcagtctcacacacagt

SEQ ID NO: 20032 - DNA, 589 bp, Homo sapiens
ctatcatcactatagcttatctttcattaaccttgtatcctcttagtgtctggcaaagggtgagtaactaatcaaaatttggtcaattaatattaattttaaaataattacatgtatattagtacagagccaaaactccagctcgaaactcccacctgctttcattacccttcctggtgggcttctctgcttccccattggattataagcttcttgtagaccaggattatgtgatacttcattgtgtgagcatgtaaatagttgatactcagtgttcttaatataattgaaatgtaaattattatgattacacagggccagcataattaataggccatacactcaactgagaatacaagagataagttgtttgcactgcagatggtattttctaaaaatgaataaagtggcatgaactgaatgcaagtttatgttatctctagttgaaaagaaaagtttctctcttaagcactattacgccttcttttggcagcagcaataattttcttcttaaattcacaaaagtcctaattcttgaaaaagtatgctaaagcaatgtggtttactcaaacaacagcaagcgctctct

SEQ ID NO: 20033 - DNA, 428 bp, Homo sapiens
tgtgtattttgtgtgtatgcatatgcatgtacatatgtatatgtacatgtatatatatgttctaatctcaactcacttctctctccatgtaaagtgggtgagcaggtatgtgaggcaaagccctgcctcttgggaggagctgccctcactgctgtcttctagggttcggtccagttcctgttgtgtgttccctgagtctgttctgtggaagttgtactagtcagatttctccagagaaacagaccaataaaatgtgtgtgcatgtgtgcgtgtgtgcatgcgtgtgtgtgcgtgcatgcctgtgtgtttgcatgtgtgtgcatgtgtgtgcatgcctgtgtttgtgtgtgcgtgtgtgtgcgcgcatgcgtgtgcacgtggacaactcttgaacgatgcaggggttggggcactgaccccctgcacag

SEQ ID NO: 20034 - DNA, 553 bp, Homo sapiens
agtggggaagccctggagttcccattggctccatcattccacgtgaaagatgcaattaaagtcccccatctgtgagcaaacaagagcatgtcagggctggctatggcatgggcctcagaggagaactggccctcctcacaagcccacagagacactggtgggtgggggacacccctcccagtgccctgcaagagtgtgctgcagtcaacgttgtaggtacaaacatcaaaacaattcaggacaataccataactgcccattattctgaaaaacatcaagacccaaaataaatgcttgcttgcaaatgagtcatacgtacctaagggaaacctccatctacttctgaaatgcacatgaaggatgtagtaagcaatatgaaaattcattttccaaatcacaaaatgaaaatgttatctgtctgactagtgatttaactttaagtaaacagtttatataaaaggccacacaaactgctttttaccatatgagaagctgtgcaacatcacttgtagtaagaaatggaacctacaactgcaataagatttctcaccta

SEQ ID NO: 20035 - DNA, 567 bp, Homo sapiens
tgcccaggctggagtgcagtggcgtgatcttggctcactgcaaactccgcctcccaggttcaagcgattctcctgcctcagcctcccaagtagctgggattacaggcacccaccaccatgcctggctaatttttgtatttttggtaaagatggggtttcaccatgttggccaggctggtctcaaacttctgacctcaagtgatccacccacctcatcctcccaaagtgctgggattacaggcatgagccactgtgcccggccacatttgtttccttttaagaggatttttacattatgttaaaaatcttgattggtagaagttatatttcataattttcttcttcctttgtatgaataatatgcttttatagtgacgtcacaagaggtgccttttgcagagtgcctcatacgtgtcactggactaagtaagcattttatctcattaatcttcacaacaggctattagagtattataattttaattttgcagatgagaaaactgaaacttaaaatgttttaaacttggcaaggcacggtagctcgatagctcacgcctgtaacctaat

SEQ ID NO: 20036 - DNA, 481 bp, Homo sapiens
gtcccgttgctgagggaacccttcgggtgtttgttctctgtgctgaaggtccgtcaagtcaatgcatatgaagtccaaaagaggaactcgagggtagaaagataaggttttatctgcttatggctacccagaaagccttttgagttgaaggagcgaacagattttttcttttaatggaaggaaaaacccacacttcccacaccactttttctagataaatttcgacgcccctgaaacagctctgagagcaaagaggtcgcctatgctatgggaacaaagaaaagaggagaaaagctggataactgactcgtctgtgataatcagaaataaccactttggaaaccacagctatttgatgtggtcataattaggtctcgtcctcctggtttatgttttgtgattttggagaatttcataatcaaatgtttagaattggaagggctagataatctaggttccagtgttgtcatttagagatgag

SEQ ID NO: 20037 - DNA, 120 bp, Homo sapiens
aagcaactcgaggggaaaggatagttttgccaagaaactatatgagagtggctagatattagtattgaaaaaaatatatctaaatccttactccacaccaaaaaaaaaaaaaaaaaaaaa

SEQ ID NO: 20038 - DNA, 391 bp, Homo sapiens
cattataagacctacttaatggattaatattctgcattttaaaaatagtgattaaattaagtagatacgtgccttgtgtatttaatgaaaaggagaacagaaaagtacaattaacaaaataaggtatgagaagaggaaataactattgaaataatattcttaagtaaaataaaaaattattcttcagatatcataaaccctgcataacatagataatatgctaggaatattaaaattattttattagaaatacaaagttcgaacagaataatatctgtagtggaaacaatatttttaagaaactacttcattaagaacaacaacaataacaagaacagatgatttcaaaatgggattcaaagaatcttcaagcttttacaaaatggtgatg

SEQ ID NO: 20039 - DNA, 437 bp, Homo sapiens
ataactacttccagcggtgatggcataagagagaccagatttatgctcctaccttaaacaactaaaaatctagggaaaatgggaaagaatggttttctgacactggacaacaggtagtatagcattgtaatctccaaaaaaggggaaacaaataagatgattcccgtgattgccttgattactgacttgagagagttcccaggccacagagtaggaggggaaacacaggtagagcccggtagactctttgaaataagaagataaagttgggagttgggaagaacaaggcagatagagttgaaagattagtactgaataagagagtactgcagacagaatatgattaagacatcagttcttcttcaagcaaatccatagattcaatgtgattcaagttaaaaaaacattaacctaattctaaaaatttatatcgaaag

SEQ ID NO: 20040 - DNA, 592 bp, Homo sapiens
ataactacttccagcggtgatggcataagagagaccagatttatgctcctaccttaaacaactaaaaatctagggaaaatgggaaagaatggttttctgacactggacaacaggtagtatagcattgtaatctccaaaaaaggggaaacaaataagatgattcccgtgattgccttgattactgacttgagagagttcccaggccacagagtaggaggggaaacacaggtagagcccggtagactctttgaaataagaagataaagttgggagttgggaagaacaaggcagatagagttgaaagattagtactgaataagagagtactgcagacagaatatgattaagacatcagttcttcttcaagcaaatccatagattcaatgtgattcaagttaaaaaaacattaacctaattctaaaaatttatatcgaaaggcaaaggaactaaaatagccaaattacttttgaaaaggaacaacattggagtatgtcaagacttgctattaagctacaattatcaagacagtgtgatattggctaaacggtagacagaccaatggaacacaatagagtccggaaatagatccaca

SEQ ID NO: 20041 - DNA, 522 bp, Homo sapiens
ctataaagttgcagctgtcaaaggacgatatagctaccattgaaacgtcagaacaaacagctgaagctatgcattatgtaagtaccaaggcaacattggatcttcctaaataatcttttatatctcacaaaatatatctaacccgattgtcccaaagtcccctttctgacttttttttgttctttattgaagaaattttcaataagtataaccaagtaacaaattacttgttgtttttcagtatattagtaaagatccaaatgcagagaagcttgtttccagatatcaccctcagatagctctaactagtcagtcattatttaccttattaaataatcatggaccaacgtacaaggaacagtgggaaattccagtgtgtattcaagtaatacctgttgcaggtttgtaatttgctatgtcaaataatgctctcaaaaaagagaagttggactgcatgttctcactcataaataggagttgaacaatgagaacacatggacccagagagtgaaacaacacaca

SEQ ID NO: 20042 - DNA, 171 bp, Homo sapiens
aagctatttgtagaagcagacagaaagctccaggagagacgatccttgtcagagggctgggaacagcaccagaaaaactgtttcaccccatctctgactcagatacttcctgccctggctggaatcagatgttgccaagacagctgtgggaaaaaaaaaaaaaaaaagggg

SEQ ID NO: 20043 - DNA, 445 bp, Homo sapiens
ggtattgggaactgccagaagggtgttgttggagagcaggctgggtttctgccagggacgtgacctgcgtgtgacgcaggaatgcacctgcatgtctcggctcacctggagacagcatcagctgacattcctgatggcatggagagcaggaaggatgctcagggccttctatcatcactttgggattcctccgggtgaccggcccgatgcccagctcagagagaagagactttctgctttcaacccgagagcagaaccctcatctgcaggtgcgtggagtctccttatttgctagcttcggagctgagcaatcctcccacagatcagtgcctaaataaacttgtgggataaacagctggtgtggaggagggaactaaggactggagtgaaagggtacatgagtggaggaagggctggacatgcagaacactcatatcaaacaggt

SEQ ID NO: 20044 - DNA, 508 bp, Homo sapiens
taacattgtgctaaattatcatatttcattgattaataaatggtgttgattgtaaggtgcaccctcaataacgactagcctaaaaagctagtaaaggttttttgatgttgattttgtgaagcattctttttttcagaaatattaaaatgtaaacatatctttgacttgaggggatactatattttaaaaattgcacaaggcaagactgtacaagggtggaaatggaactttagcgtttaagaagtatgagcatttgaagaacttattggcagtctaataattctaaaagaatattttgggagctatcatgttgagctccattccttaaaagtcagtgaaatggctgggcgtggtggctcacacctgtaatctcagcattttgggaggctgaggcagaatgatcctttgtgaccagcctgggcaacatagcaagaccccatctctaccaaaaacttttaataagttagccaggcatggtggcacatgcctatagtcccagctattctag

SEQ ID NO: 20045 - DNA, 419 bp, Homo sapiens
atctaagatgatcattttcccactcgaactgagtgaaaaaggtgtttattgttgcagaaaacatctgcgtataggtattggatgctagtggtgcatatatgaatacctatctctgctcttcaggtggtcacagtccactgggggagaaaaacacagatacttagtacaatttattctatactgcagatgtgcagagtgctgtgggtatgtagataactttaagctgaatcttggtcggtgagcaggtgttcagaagatagacttagtggccaagtgtggatcacttgaggtaaggagatcgagaccatcctggccaacatggtgaaaccccgtctctactaaaaatacaaaaattagctgggcgtggtggtgcatgcctgtaatcccagctactcgggaggctgaggcaggagaagcgt

SEQ ID NO: 20046 - DNA, 199 bp, Homo sapiens
agctgtgcctcaatacaaaatgctctatacaagttaactaccagtagtaattgttgacttagttaagaccaagattaaaaggaatgatttaattgacttaattaaaaataaattttctggttgggtgcagtggctcacacctataatcccagcagtttggggggctgaggcaggaggatcacttgagtccaggagttca

SEQ ID NO: 20047 - DNA, 507 bp, Homo sapiens
aactagtagtccatgaaaaagcaattcttccagttatttagcaattctgtaaattactactaggactaggtctagctctttttctaggaatctaaaaaaaaattcaaaattattttaagggatgttagagaggtagaggctcagataaaaaggtgaatgttagtgatacctaatttaggacaagatttatatgcttagaaatttttcttttattatttctaaagcacactattccaaatagagccatttgcttactgattagaaattatttgtgatcagacttcattagcaatgaccccaagagacgtgagtctgttgtgagtcacagtaagtccacaagtaaacactgttcatatgattcaaatttttcgttttattcacttaccctgtaaggttgctaggaaggactcaaactttaagcaagacagtggtgtgatctgatttttttttttagtggaaaaaagaaagttctgaaagttgacatgttgacatgcaagttatatagga

SEQ ID NO: 20048 - DNA, 393 bp, Homo sapiens
ctaggaaaaggaaaaattcaaaaaacctgcctgcccctcacctcagctgttctcccttcaggaaatgtgttaaagaatcagtgagcatggaggccaagatctctcaataaaggtatttatcacagcagtatttgtgaatgaaaatagaaaacaatacagctctccaccaataagtgcctaagtaaatcatgcttttcacataatggaatattagacagacctcatagtcctattggtaattttctccatgctaatattactatagcataatgataaattaaaagggcaaggtcaaacttgcacacactattatgatctcaattaggtaagcaatcatgtggatagaaagtgactggaggccgggcgcagtggctcacgcctataatcccagca

SEQ ID NO: 20049 - DNA, 487 bp, Homo sapiens
cttttgctaactctatgacttcagataagtcacccagttattctggaacttggttaattcatctaaaaaaactggttattataaagataaaagaactgtttatttaaccaacagccatttcccccatctttcttcctgagagagccctgattttactcaggtatcaggcaggcagcaaagtgctcggaaaaggcaggtccagcccaagagctgaaccactattggtctaaacccatcatggcaaccccattcccattttccagtgactggtttgctggtacgcaagtaagccagttctagacaatggagcacgagagtatgctggctggggagcttctcagggatgtttttgcaaatcaaaagagcaatgcatgaaagggaatgacccttcctttctgtcttgagatattatcttatgaggcagccatcttacaaccatgagaagaaagccggccgggtgcggtgcctcacgcctataatcccaaca

SEQ ID NO: 20050 - DNA, 538 bp, Homo sapiens
aatgtgagtccattcttaacagcaaaatttcctctttgcttgtcaccagggaaaaatgggtttgcatagaaaaggtggagattgagggggaagcagaatggacaaggagtaaagagggaatccaactacttagatttgagctttcgttcttctttggtagttgtagaggtgagcttaccaaagcatagatgacaggcaatgtggtatacaagttactacactccaaaagtctggggttcttacttattttgtgcatgacatccaaagtagcctaataaaatcttttcacagaaaaaaaagctttactttcctttgccaaatttttaactttttattctgaaataatttcagaattattgaaaaatttagagactaggacaacccagattcctcaaatattaacactttaccacatctgccttctcattcctctctatatacataggtgcatgtgtggttttaatgtttatttatatacatatcattattattttcttaactgtttgagagtaagttgaagacatgatgctccttactc

SEQ ID NO: 20051 - DNA, 486 bp, Homo sapiens
acataattatattaagcctacccaggataacctgtcttttgattaactcgaagtcaactgattaggaatcttaattacatctgcaaaaattccttcactgttaccttataacataacccaataagaggggtaacatttcataatattcatagatacttctcatactcaagaggaggggagtattcagagcttgcacaccaaatgctcagactctcggtctctgcagcctatagaagtcggcctctcaggcacggaggaagaaaaagagtagatctccttatgttgtggatctctgggtacaaaaacaatatccaacctcataagatttgaaaagtggcagactacaggatcttaggactcttgcctcctactccaaagtgaaatgtttttactaaaggaatggcatgttggagatgcaagttacaaaaacagatctcacatttggtagagagtaatagcgcactgtagaaagtacagtgagagact

SEQ ID NO: 20052 - DNA, 464 bp, Homo sapiens
ggaaacagagaacactcacagatgtggtttactttttcttgtttgggacatctatttatttgccgataacataggacaaggagtgcgttttatctttcaaaggaaagactttactcaattattgtgtttcactgtttgcagttcaagatctatctatataagtatgcagataatataccctcagctggttcactttacctctctggccttatatttctcatttgtaaatttaggaaactagattttatagtcaaaatcagctagcatttactgaatacttattatgactgagctatttggttaaataattttattcaattctcattttttctagaagagaattcattggtttacataattttagttggaagtggactgagggaaaatggcagataggaggcaggactaacttgcagctcccacttggatggacagaacaacatatggagactcacataatgaac

SEQ ID NO: 20053 - DNA, 430 bp, Homo sapiens
  misc_feature 383: n = A,T,C or G
acatacatactaatatgattaatcttctttctttccttttcttgtgtttcataaaagagcaatttcatataaatacctattcttaggtatttatatagtaaatttgagggacaagggaagttgaagtactgatcaagattgggatgagacagaacctcatttgtcatttagatagggaaatgttaagtataacctaagaatatgtatttaaatgaaattgctcttttaattttagagtgacaaggggacttgtttagccaaaatcacttgctttttgaatacctagtatgtgctaggcactgtcctaggaactgagatgaagttgataagcattgtccccgccctcatgaggcttacatgaagctagaacagagagaccttanacgggatgacataaacacacaggctcaataaactctacagtaacttc

SEQ ID NO: 20054 - DNA, 560 bp, Homo sapiens
gtaacaactttacaatggaagtttcctatgagctagggaggcagaaatcggagataacattttcctgaatgagtctttactatagtcactcaggaacatatcttacatgtacgatagtaagactcaagagggtttttttctgattgtcaatgtcctgagacttcagtaaaagaaaatctccggtgtgacaattccaaatgccagtctgaagcctgagtcaatttgcctaataaaactgatttcaccattaaaatagcaataattgttgccttggtggaacagttctataatagctaaagacaagaagaagcagataattagtaaactcaagttgagccaagttttctaacaagaaacactgaaaagagccatttgcagaaggtcaaaaataattaccattaatgtaaaaatgcaaaaggcacagaatattggtatgtgatgtttgtggctactaatatgcaattaaagttttaaactatacgtaggaataaaaaggaataatacgcacctacctgaagaaagaagttacttctagaggcagggtgggacgagatggaaac

SEQ ID NO: 20055 - DNA, 364 bp, Homo sapiens
gcacctaacacgccccacaaataacacatctaatttcaagctccatgagggcagaggacatatatctctttgtgctcacattgtgtctccaatcctagtacagtgagtgactggcctttaatagttgcccaatacatattcattaaatgaatgcataaatatctcccatgtgtttatatccttatccatttctcactctttttgaccatcgctccatcagtttctttctcgtcatcatccttttattacctactttcacttctacaagcctgtctgtcaggtttttcactcatcatcccaactattcatctatccatttctatacctaaagctccctatctgtatctaagcagctatctaacat

SEQ ID NO: 20056 - DNA, 447 bp, Homo sapiens
tagaataaatttcaaaaacatcattgacaaggttggtattcagaattgatttttaaaaaactacaagtcgttgttaaagttcacatagtccagtagaaaaaggcaaaagaagaaatgcaaatggacaataatttgaaaatgcccaatatatgaaataatgtccaagacatgaaaaaatccttagtctcagtagtagccaggagatacaacataaactcttaatgagattccactacacatgcctcagaatagagaaaagtagaacgtctagcagttcaaagcgttgacaaggttggagagcaatagcaacactcatcaagggcttgttgggatgtaagttggaacaactacttttagatacaatacctagtaaagttgaaatttatagcccttgcttaagcaatagcaattttattattcctagagataaatatcctagagaaatat

SEQ ID NO: 20057 - DNA, 555 bp, Homo sapiens
cctcaacaagcacctgccaggatgatctacggacctgactttcctctccaacaccaagggacactgatggctggggagcacaggcactggggaatcttaccacaagcacccagcccaggaagggctttccatctcccacagacaggaggcatcctgtctcaacaagcttctggcctcagaagtcatttcttttccaccaggcctgagaatcccctccttcaccaggatacttgtgggtgggagatgctggtgagggaggtgtggaggggaatctccaccacaataagtagctaggcctggaagcactcttcatccagtcagaccagagactttcttttccccacctagaaacataaagaagcctagcctagaaaaatgtgttctgtcccctcaggcatcacagtatagacccctgggagccccaccagcaccagatacacaaggcccaccaaaataagaccaaaaaatcttggaaaattaaattttccttagaactactgcccactaaagtaggctaggacctacgatgtaaacctaacagagttactacctact

SEQ ID NO: 20058 - DNA, 512 bp, Homo sapiens
aagtatcctttctactgaaagtgtattgctttcataccactgaaaagtcaaaacattttacatcaaactatagaaagttggggactgtactgataaagcacttgtctttagaatttttttaaaagaaataaaaaacctcttcaactcataataagacaaacaatccaatttttttaacccatttatgatagaggttgcaattttttgaattttttgcaatcagaccttggcaatgaccttgagcagtaggatataaataattcccacatgcttagagttccaatgacggaacacgacgcctgagttaaaatgccaaaacatttgaatagaaatttcaccaaagacatacaaatggctaatgaacacatgaaaagacgttcaacatcattagtcattagggaaacgcaagtcaaaaccacaatgacacacattcgccagaacggctagaatcaaaaagactgacaatgcaccaagtcctggtgatgacgcagggaaactagaaccttcaaaca

SEQ ID NO: 20059 - DNA, 533 bp, Homo sapiens
aaatcacaattaactctacttgaaagcacattaagtaacctttttttaaacaaaataattaagaataatacaaattgcttttaacctttactgttcagcattcttttctaagaaggttattgcaatgaatgattttaattatgtccattattagccaaataaatgacagaagaacacgatgtgtagaagcattaattaacataccttatcttggcttattggggcaggtatgaaagaggaataagattaatgtaaaatataggaattaccacaggttagtatgtgtaggagtagaactcagaaattgggaaggctgcacaattcaagctcatgttctaattggtatgggcatctcttaatgttaacccaaaaggtgagacttcaaaaagtatatgttaaaaatctgaagaaaaaatctggttagcagccctctgagagaaaagtaaaaagtttaaagaaccatccaggtttctaggaagacatataaggacactggccatgagagatatatatactgtgacattatctgaaag

SEQ ID NO: 20060 - DNA, 587 bp, Homo sapiens
gtccacggtaggcccagtggatcggtccattgataaactcagtaagtggtctttggtctttacgtctctttgtgatggaaacccatcgtcagtgatgccaacactacctgcgttagtgtttacttggcccccccgccagctcttcctagggagtaacaggctttggagcagctctttccagagctgtggctctacttggctatttccatggtcagagaaggcagaggggtggagacagagggtcgggtagcaaggagaggactggagaccaggacccagcaatctctgaaggcttcccggggctgctcaccaggttgtgagagtcaggcggggtttcagtggaagccccatcttgagatctgctcttctgtcccagaatttgggggaaagaattgtgtatttggccaggcatggtggctcatgcctgtaatacctgcaatttgggaggccgaggcaggtggatcatctgaggtcagtagctcgagactagcttggtacatggcaaaaccccgtctctactaaaaatacaaaaaatcaaaaaattagccaggcgtggtgatgggagcctgaaatcccagctacttggg

SEQ ID NO: 20061 - DNA, 440 bp, Homo sapiens
gtgaatattgaggataaatctaatcccaaaattatagtatgattacatttggaagatgaaagaggggagggtgtgtgtgtgtgtgtgtgtgtatgtgtgtgcgtgtacccatatatgggtgattcatgagttgagagtataaaagaaataaataagcttctttcataacagtataccaatacataataatgcataatgcataaatcagtgccaatatggtttaataagccctgtataagtatttgaaattataaacctatatgtaactttgataactattaatagataaattctggtattaactaggctttaaaggactaggtaaaagtagtaatgcttaatatcagatgcaaaactagtggtatgagtatcagtaaaaatatggaaagtcccactgaaatatctatggggaaaattcaaaaagagatgggtataggaga

SEQ ID NO: 20062 - DNA, 569 bp, Homo sapiens
ggcacaaattccgtggaaattaagcagagtgcttcgctatttgcctcaacaagaaaaagtcatttgtccacttttcattgaacaatcttccttcatccataatttttgttttttagggttttctttttaagacattgtggaagccattctggaattaaaagcattataatagataagcaactatatttacttttattatggaaattaacagataggaaaatagaacagaaagcaaggtttaataatcaaataagaatacttacatgtcttctaaataatattaaacacctatcatctacaaaggtaggttgaaatattattgataattgctgggttttacttgccaaattgccacaaacacacctaatacctgacagtgtcaattcaactgtccgtgattagaagataacacactggaagtcgcacaccaccataaaactgaagccacacatgcgtacaaatggcgacagtgtctggtgtacagcagcgctctgccttgtccagaatacacacttgaattctttgtcacaattcacttcacgtggcactgcaatagcgtcctctcgctc

SEQ ID NO: 20063 - DNA, 488 bp, Homo sapiens
gcacctaacacgccccacaaataacacatctaatttcaagctccatgagggcagaggacatatatctctttgtgctcacattgtgtctccaatcctagtacagtgagtgactggcctttaatagttgcccaatacatattcattaaatgaatgcataaatatctcccatgtgtttatatccttatccatttctcactctttttgaccatcgctccatcagtttctttctcgtcatcatccttttattacctactttcacttctacaagcctgtctgtcaggtttttcactcatcatcccaactattcatctatccatttctatacctaaagctccctatctgtatctaagcagctatctaacattttgttaatatattacaagatatttttatttgttcataattgcatctatgcctctttcatctccttgtcattcattaatccatcattctccaccatgcttttaacctaagttatattgcgtatc

SEQ ID NO: 20064 - DNA, 550 bp, Homo sapiens
ggtcgaggctgcagtgagctgtgtttgcaccactgtacgccagcctgggtgacagagtgagaccctgtctcaaaaaaaaagagagagagagaagaatcaaagccaactagaggtataaacagaattttagaaggcagaaagagaatgaatgataactagactagaaaagcagacaaagatgaaactcaacttctggcagaaggggaagcaaacaaaaaggggcccaattcacaccacagaactaaggatgagctaaggattttgtaaatgtgcactgttgtttataacttggtaaaatattctatctccttaaaagcaacatagagaaggaaggaccaacaaagtatttaggacaatgaatgaaaaatatctacacataggcatgtaactgagacatctcagaaaaatgagaatacacaacagatcctacaggctttcagagaaggaaaaacaacacacacgaagactgggaagtcgagatggcaacagactaaacaccaaaagtaaaagggtaatgtttttgaaaatgcagggattacagattacacct

SEQ ID NO: 20065 - DNA, 517 bp, Homo sapiens
ggacagcgacctggattgtccttctcccttctctgaaaaattaccccccatatctcccgtgtccacgtcaggggatgtctgcaggttggtttgccaggaagtgccattctagccatctctgctcgcatcaggaacctcctcttgctttagtatgtgaagtttcaggaaaatgaagtaataggaagttgtaaccagttgtgggttgatggttttctccagaagaatggagtatcaatatcgtttgaaaaacttaatttttatgatgtgagtcccaagatagttttacaaatgataaaagaggaagaagctggctgggcgcagtggctcacgcctgtaatcccagcactttgggaggctgaggcgggtggatcacctgaggtcaggagtttgagaccagcttggccaacgtggcgaaaccccgtctctactaaaaatacaaaaattagccgggcgtggtggcgggcgcctgtaatcccagctactcaggaggctgaggcaggagaattgcttgaacccg

SEQ ID NO: 20066 - DNA, 439 bp, Homo sapiens
gaagtaattcactcatatgctatgttaaaatttttctgttcttatctttctttctttacctttcctttgttctttaccatgtgctcccaattctctattctctctcttagcagtaactttatgcacctgccatttttttttgtacccattgcttccttgtattctccatccatcaatcaataagccttgggcttccaggactctgcttctttggatctaagcctggcctgctctctctgttatttgtggtgcatccaacctctaattttaactttgcttggccctatcatgtaaaaatgactatttataacaaatcattttagcctactcaaactataggattagcacatattgaaaataggtctgtattaggacaatataaaatcattctggcttgagtatatcagaatcaataaagtagtaaactcaggataaatgc

SEQ ID NO: 20067 - DNA, 108 bp, Homo sapiens
taagcctgaaaaatgatttgcccaaatgaaatcctgttagaaagctacatatcaagagaagccatcttaacctccctcaccactatcatacattattgaggcttactg

SEQ ID NO: 20068 - DNA, 466 bp, Homo sapiens
tgttgctttctgcatgttgcatggctaggtggttacacagcttggtttttctgattccctgctggtttacgtgtgtttccccagagtgttttgaatagtactccctttgttttcaagtgtattgactgcttgagttcagattctagctccactattttccaggggaactaggactaaaagaaaatggaactctgtcccatttttgtcatgtgtaaataagaatagtggtgcttccctcatacggttgctctgaggacggtgtgtattaacacctacgaggtgcttaatgctgtctggtacttagcaagtactcaggaaaagttaggtataattttatgtcatggcattagttttattactttaaaagtattacctaatggtttcttacattttggatttactattagttatctggttatatgtatatgtgaaataaatatcagaagatacagatatcttttctctc

SEQ ID NO: 20069 - DNA, 504 bp, Homo sapiens
ggacttgagcgatcctctcgccttagcctcccaagtcgctgggactacaggcccacactaccacaccagctaatttttaaatttttctgtagagatggggtctcactgtaatcttgaacagctggcttcaagcaatcctgccgccttggcctcccaaagtgctgggattacaggcatgagccactgtgcccacataacaatgtttcttaagtgaatacatgaatagctcatcatctatggaatactgtgctttacaccaagtagtttgcatttattatttagtattcataacagtctacctgcaaccattgcttttcctattttatagaggagccagaggctaagtaaattcctcagtctcacacacagtgaatggcaaagcctgggttcaaattcagttgccattctccaaagctcacagatttccaagcaacttctctttcgaaaagcacaaaagggagctgttcgggataaaagaattattctaagacacaattatgatag

SEQ ID NO: 20070 - DNA, 500 bp, Homo sapiens
acacatggtgggacattgaattggatttttattttacaagtatggtacaattttcataatgaaactctaagctatttgagggcagagactgtctgatattctcatttgtattctttgcatcgcctcacactgtattatacacatgattaggatcaagaaattcttattcattgactgaccttgaaatctggggttaagatctttttctgggatgaaaccgacatattttataaactcaccactccctgagcactcattattagacttcaataatataatctccatggtgaaaataaacataaaaattgaacttaacggcagggcgcagtggctcacacctgtaatcccagcactttgagacgccaaggcgagcggatcacgaggtcaggagatcgagaccatcctggctaacacggtgaaaccccgtctctactaaaaatacaaaaaaattagccaggcgtggtggcagtcgcctgtagtcccagctattcgggaggctg

SEQ ID NO: 20071 - DNA, 540 bp, Homo sapiens
ggtgagtcacaaacacaccacagcactccagcctgggtaacagagcgaggcccttatctatgaaaacaagaaaaaagatgaaacaaatttcaacatgaggtttggaaggaacaaacatctaaatcacacagtagttcctgacctgaagctattgtcacattattgatgtgtataatttagaaatatgtcattaatagccaatactcagatctagaaaactagtggacaaagcgagtgctttaaaaccaaagtggcatttaaaaaaaaatcaaacctactggttttcctactaagtaagtcttgaaataatgcactatagagatcctgtcttatctatacagctagagagaataacaaattttacttttatcagttaaataaattttgtcttaatatgacttattatttatatttatctttttacatttcaaaaacactatgttattcaattgaatgacttataatttttgagttacctggtcactgtattatcattgtcagttattatatttcacatgcattacttagtaaagacaaatc

SEQ ID NO: 20072 - DNA, 299 bp, Homo sapiens
agccactatgccggccgcaaaggattctttaacacaaaagggcaggactcatgagactgacctgaccattacatggtgcagtgagagttcaatttaactaagcctccttatgcttctttgactaatttagggccatgcagtgtcggggtgtatgagggcacaaaagcagcttctccctggctatcttcagaaggaatcttagattgcccttgaacaccatcaacaatctgctatttggagggctggaaactaagcctaagaaaccaccaggcttcggccgggcacgctggctcatgcct

SEQ ID NO: 20073 - DNA, 449 bp, Homo sapiens
atttagaccccttttttgtcaacttgctagtaaaagaaacataaatagatatttaggtgctgaaatttgacaaattataaatattggctaccggacaatttttaggagtatgttttattatttactccttggttcagcttcccctttcaataactcaggatcaagttggttgagctttttacaagattttccttattttacctggcatttgccaaagtgatccttaaaaatggactatctccttcctaaaatgtagctcgccacgcaggagtttataaacaacttagggctagaaagtgcagctgcagaaactgggataaaagattagaatggagggctctgtgaagtctgaagttatttattattgaaaaggaagaaaagtaagtgctgttagaaaatgagaaaagtgaaagttaagctatgtggtaaagggaaaaaaagaagtatta

SEQ ID NO: 20074 - DNA, 415 bp, Homo sapiens
tttactttgaagagcactaaaattagagccgtcctgcttttaaggcaaggaaggtgggatagcagatgcagggctgggagagttcatgtaatcagtgtcccccttatccatgggggctgtgatccaagacccccagtggatgcctgaaacctcagatagtactgaatcctatatatacactgttttttttctagaaatgcatatctgttataaagttgaatttataaattaggcacagtgagagattcacaataactaaaaaataaaataggccaggcctggtggctcacacctgtaatcccagcactttgggaggctgaggcgggaggatcacctgaggtcaggagtttgggagcagcctggccaacatggcgaaaccctgtctctactaaaaataggaaaattagctgggcta

SEQ ID NO: 20075 - DNA, 613 bp, Homo sapiens
taacacattggattgatcctccaggcaagaggtggtccagcatccggggcccctaactaatgaaatactctgggcaggggatagcagagtggtgcagagtcctctctctccccatatcccatcagtctccactgtcaacagtataacagccatcgcttgctgagtacttattatgagcctggtaccattctaagtgctttatatgtatggactcagtcctcaatgagtttggcaccattatgattcccactttacatgcggggaaatggaggcacacataggtcaaggaacctgcccaaggacacagaaccaagacaaacccaagaagtcggccaggcatggtggctcacgcctgtaatcccagcactttgggaggccgaggtgggtgaatcacctgaggtcaagagttggagcccagcctggtcaacatagcgaaaccccgtctctactaaaaatacaaaaattagctgggcatggtggcgggtgcctataatcccagctacacgggaggctgaggcaggagactcacttgaacctggtggggcagaggttgcagtgagccatgatcgtgccacttcactccagcctgggcgaaatagtgaaactccatctc

SEQ ID NO: 20076 - DNA, 425 bp, Homo sapiens
caaagatgattgctacattatctgagagaagtcgagagcttcacaaggaagttgaagtagctaagaggaatttggcccaacagaaaattatatcagaaatggagtctaagttagtagaacaacaacttgcagaagaaaacaagcttttaaaggagcaagaaaacatgagagagctagtagtcaaccttctccgcatgactcaaatcaaaattgatgaaaaggaacaaaagtccaaggatttcctgaaagctcagcaaaaatacaccaacattgttaaagaaatgaaagcaaaggatcttgaaatcaggatacacaagaagaaaaaatgtgaaatttatcggagactgagagagtttgctaaactgtatgacaccattcgaaatgaaagaaacaaatttgttaacttactccacaaagctcatcag

SEQ ID NO: 20077 - DNA, 510 bp, Homo sapiens
ccagatcatgtgcttagggtatcaagctaattctgaacttcagccaccagtgggaaaaagctgttgttatattttcagtcttggcaggagctgggtgaggctgaccacgaaggctaaagaccttcaattcctacaaatgggcaagtctctggcaggcagagactgacagccacaaaatttcttttaatcatatcgcaaatgttacctccccagaaagactttttctgcctgctatagctaagatgcccctcaatactcaccaggtcatcccctgtcccattgctctgttttattcactatctgaaaacacctgaggtatttgtccatgagttcagtgtctgtgtctctccactagaatttaagcttcacaaaagctggaattttgtctcattcattcctatatttctggcacctagaacaagcgcttggtacacaatcagtggtcaggaaatgtttgttgaaacccaggctggaggaaccagtcatctagtataagaaccatttcccaca

SEQ ID NO: 20078 - DNA, 460 bp, Homo sapiens
gtcagaggggcctggcctgggcccaactacatagaatcatgttgcacaaaatgcaggacaaagagttcaacacaaaagtggatcagagcagtgaataactcagagcagtaaactgaactttattttttatagggttggggtcaggtataacagtgatgagggagtccaaaggaccttggcctcagatcttttcaagcaggcatgtgctccaatgtcatgaccccagaacagaaacagacaaaactagcatagatcccattgaaccactaggaaaggaatgaagagtccatgtgtaaactatccattgttcaactaggcaattttattttggacagtgtttgcctaaacaagggagagagaataaggaaaatataagtaaaaagcaactcagtaaagaatatgattaaaaggcacaccaagatgcaaaagtaggggaaatagagatttaggtaacactcta

SEQ ID NO: 20079 - DNA, 374 bp, Homo sapiens
atttagaccccttttttgtcaacttgctagtaaaagaaacataaatagatatttaaaagctgaaatttgacaaattataaatattggctaccggacaatttttaggagtatgttttattatttactccttggttcagcttcccctttcaataactcaggatcaagttggttgagctttttacaagattttccttattttacctggcatttgccaaagtgatccttaaaaatggactatctccttcctaaaatgtagctcgccacgcaggagtttataaacaacttagggctagaaagtgcagctgcagaaactgggataaaagattagaatggagggctctgtgaagtctgaagttatttattattgaaaagga

SEQ ID NO: 20080 - DNA, 502 bp, Homo sapiens
catacctcagttgtgctagatgatgttagatgcaggcacactgtatatgaggttggatgggttgtgcactacacagctccatgggcgccatgcagctatactctatgtgaatacctcctcccacgtggaagtgttcagtacacaaccagcatggtggtagatagtaaccctggccagaagcttaatcaatggaggattttaagccatgaaaatagagaggtagtcattgacatcgcttaatgatcataaactgttttaaattcataaatgaatgctttgtttggattttctatttccaatttcaactaactttgctgtgtgctcctgagagcaagtggttttgatagaaacagactgccacatagaaaattcatacactttggttccctgggaaaccaggccaagaatagttttctttgcacatcctggtttcctctaatgagggccagtataagaatgtgagtgtcaacagtgtaacccataaatcccaaggaatcattat

SEQ ID NO: 20081 - DNA, 506 bp, Homo sapiens
gcaaaataaaaacgtgatattttaaagatgaaaagttttcatcaaatatttcttaatgattttgaccctgaatattatgatgccattttttttaaaggttcttaatccatgttaggtcacaaaatagtaattggaccttataaaattactacttttgagcaagatgccagttggctctcactaatattttctagaaaccaactagaatcctaagagaaaaattgaccacgttatatttaatatagaaatataatgtcattaaatttttgtaattgcccttagaattcgtatcaatattgtttacctattggatccagtctcctcaggttttctaggccatttgttcgcttctttcaaataataggcacagctcagctaccttccttcagagagggcagggccatttctttcatgtctgcgatggtcattccctagtagcacaatgctagaatttagaaagtgcttaggaagtatttttggataactgaatatataaacgaatgaca

SEQ ID NO: 20082 - DNA, 351 bp, Homo sapiens
catctcagccacaatacttattgcctggactgtatattgaagttcaaatcatattctatgtgatatttaaacacagcttcaaacatacaaaccacaaaatgccaccaccacgtgccttgctgtgggtgtcatttcactcaccgtgttaaatgctaccagagttttcaatctgcagacaggatattcagttctgggaaattttcatgtatgtttacaaataacttccttcctattatatactcgttttcccaaaactccaacttggacatcctggatttatcttctacttctaatttctctcctgaattctcagagttgaaagttatgaaatacatattgaaagaatgcccc

SEQ ID NO: 20083 - DNA, 485 bp, Homo sapiens
gatcaaattaaaaatacatatgtttgtctgggagcagtggctcacccctgtaatcccagcattttgggagaccaagatggaaggactgcttgagctccggacttggaagccagcctggacaacatagggaaaaccccgtctctacaaaaattaaaaaaaaaaacatagccaggcataacggtgcactcctgtggttccagctacttgggaagctgatgtaggaggatcacactgagtaagtacaacatgcccacttggtactatataactacttgtgcccaggagggtgaggttgcagtgagccatgatcataccactgcactccaacgtggacactagagcaaggccctgtctcaatatacagagatagacagatagatagatagacagacagacatagattttccttactgtaagttagggtgctattttgacaggtggacttgaagtttgtaagttactcctttgactggattctccatata

SEQ ID NO: 20084 - DNA, 509 bp, Homo sapiens
acgtaggtatagaaatatagatacatattaagaagccatgatttaataaaagcatatactttttatttagtaaaatatttagtatttagtaatagtaatagtaatagatacatattaagaagccatgatttaataaaagcatatactttttatttagtaaaatattagtatttagtaaaatactccatgaatataaattgaagtgaattaaatggattctcgagagaaagacaaattcagagttcttgaaccatgaatataagattccagtgggaaggtaccaataaacttgtaggcttagttgtttagcaagagcgctggttatcagcttaattagtcagacctagtccaccttatcctaacgagcagtggctgttatagggaaaattgttattgtttttgcaaacagttggcctgaatttcacacttagccctgtccttactgcctgtgtgacatcaggcaagtcacttgaacctcttgaaactcaatactctaccatctataaaat

SEQ ID NO: 20085 - DNA, 496 bp, Homo sapiens
tatgctgattttcccaatgctgaatggtatagcagctggtgaattttcaataagatacacttttctcctgttctagcaagttttgatatttgccatttggttccagaaacttattgtgtctatgttcctaaagcactttgactctgagagagaggacaaactgaacctgatatatgatgtttgtgccccttgacggaggctgaattttctgaacttgaatgatcaatacaacagtgtcttgctaaaaattgtctcgcagaaaatttttcattcatttttcttgatggcaagtaatgtattccttcatcagaacaattaaacatctttaatgatttttaaagacagggtgtaattacatgcacatgataaaaatttaagcagcaccaagggcgtacagtgaaaattaagtctctttcctgactggagatcatagtatgagtgtttcatggctcctttcagagagattccatgtctagcatttatacatgcacataaa

SEQ ID NO: 20086 - DNA, 569 bp, Homo sapiens
tactgcagagtaaaataaaaccaccagataaacagagcccgaaacggaccaggatagaaaaataatgccaattacacttgaatccatttaagcagcagcttctggaggaagaaggaggctacaataatagtatccaaaataaacaattcagtaattgatcaactagtcagaggaaattatcctaattcaagatctcatatgaaatataaagtgttatacagacaagaatgaggaaaaaaagacaccaggagatgtatctaatgtgcagttgtgagttcaattgtttatgcaatttaaaagaatatctggcatcgctacttctacacactcttctgaatctgtcttaaatgcactatcatttaaacaaaaacacaaaagcagtctgtcctactttttttccaaagaagtaaatatacagaaaggttttaccataaaatgttagcaatatttcctgtagattataaatgacatcaagaaaccataaaaataaaaattttcactgtggccaaaaaaacaccaaaagccaagtcaaaagacaattgacaggtgggaaattttttttgcaactc

SEQ ID NO: 20087 - DNA, 571 bp, Homo sapiens
tggagcacactcctgcagtcattcaaggaagaggcaaggcccatgattggcattctcagtcaaatcacacgaagggctgcttttctgatatagtaacacccaacagatgaaatcaggagatttcctcttcaagccctttacatttccattgtggccagagtctcagatctgggtgcagacacaaccctgctacactacaggcctgtcctttgaaattcctccacatccattcctcaagcagtctccagtctgggtcaagctcctggagaggctcatcttcccacctgaactctcaaacatccttggtcacataggattgattaagaattcattcctggagctcctgctgcagaatttcctcctccctattcacctctgtgcatctctttacttccttgtttaagaaacaagggcaggccgggcatggtggctcatgcttgtaatcccagcacttcgggaggctgaggcaggtgtatcacctgaggtcaggagttcgagaccagcctggccaacatagtgaagccctgtctctactaaaagtacaaaaaattagctgggcgtggtggcaccc

SEQ ID NO: 20088 - DNA, 579 bp, Homo sapiens
caactactaaaaatggctgctgaagaccaggaaggagggagaaaaggagaggaataggagggaaaaaaggcagccataggtggcaaaaatttggccctgaagcacagacaggaaccactagcctgcctctcctccttccctggtatctggggaagagagtcctggtggtgtaccctagcatttcagaacaccgtctatgaatgtcaaagctgatttacgtatgttcttttcctgcaggtattgttgaaattcaaactctgtcatccttatttatacttctaaaaaccacatttggtttaaagattctgtttgctatagatggggaaagaatttatattcagcttactagcgcatggaaaagaagaacattaggtctgtgtggcacttttaatggcaacataagggatgattttctgtaagtatgatttctgcatagttaacatacttaatgactggtcatttaaaggatataaattcattaaaaatgtttacttaactaataattgcttagctgtcattatcccaagagatttacatggatcatcgtatttaaaatgtatagcaatctctgataaatat

SEQ ID NO: 20089 - DNA, 609 bp, Homo sapiens
gatagccctgagtgagcagcattcacatcacgagatattaaagacccataaaaaattttaaaattgtattctttcttaccaaaagcataactctgtaacttcaaaattcattcttcaaagatggatatattattggaagcatggtttataacataaaaatctagtctcaagcaagacagggctagggagctggcagacctgaaatttacagggaaaaataattgcatgaggctctggggtttcagaggtaaccactttaaacaaattcctttgaattttgtttaggtagaataaggcactcaaaaatagcactgtccaatagaaatataatgttagggcctggtgtggtggctcatgcctgtaagcccaacagtttgggaggccgaggtgggtggatcacttgaagtcaggatatcgagaccagcctggccaacatgggtggaaccctgtctctactaaaaataaaaaaattagctgggtgtggtggctcatgcttgtaatcccagctacttgggaggctgaggcagaaggatcacttgaacctgggaggtggaggttgcagtgagctgagattgcaccactgtactccagcctgggcaacagagtgag

SEQ ID NO: 20090 - DNA, 467 bp, Homo sapiens
ggttcttacaatgtgcctaaacataatacaaggattttatatttcagatctgagctgtaatctaagtgaaagtatattatgaatatgggacaatatgaatgcggtggtgctgtgaatagagtgaagattggagtcatgcagaatttgaaatttgagtcttgactctgtcacttacagttatctgattagacacacacacacacacacacacactttctgaatatgtcagtaagttacatatatcattgattattaagtgaaggtattacatctgcttcacaacatttgcaatgaagagaataactggcaaggttgctgtgtggattaattataatgaaataataatactaattacaattattattattcctagtatcctaatgttttatatatcttgacttttttcttataacacctcaaggagaatgaaaacaattatttccattccatagatgacaaaacgaagc

SEQ ID NO: 20091 - DNA, 574 bp, Homo sapiens
attgcattctcagcatatactacagttgctcttgacaactacaagcaagaaagaggggataattgggtcagtccaaggacacctggaaagttgacctgcagtctcctgctccaaccaagatatttcccttagaaaagctagtgtatttcacatgcccattgacctctccagatctggaggtggaggtttgtcttgtcagatcaatgtaacaccttggctgactctgtctcagtgaaacatcattgagtcatagccagaatacattttactagtcccaggaggactactaccactagcagcacagccagacctctctgcagtagtaatctagccctgggtctcaaagatctagataagaggttgccatagaggttaaagaaggattcttcaggtggccccactgtctacaaccaatgggtcagcttctggatctcctctacctatgtttctacaatacctaagatgtttatcccaatacagtaagaggtgttggcaattgtatacgcttctcccagttgagctaaaagaaagtctggagggccgagtgcggtggctcatgcctgtaatcccagca

SEQ ID NO: 20092 - DNA, 599 bp, Homo sapiens
tacaggtgaggatattgaggtacagagaagttaatcacctgctcaaggccatacctactaagtggtttggcaggaaggcaaacccaagcagtcaggccctataacctgaaagtagacacctagccacaacactacactgtcagtcagttaaagtccagtcagacaattgccagtgagcgccaagtgtggtagcagataccttagtggatgagcagggtacatcacttgaaaaaatcaggcagatgggaaaggaagatgttagcttggtgttatgcaaactctccagtgctaatagagtcctaaatacatagttcctaagtagtggcagacaaccctaaagcaagtctcaatttggtatggaactgtacgcagactgggtaataagatttctgaagcaaaatgagttctgtaaactagactcacattgagcatgaacttgcaatgccaatgccaatgccaatgcgaaactatggaacagggagccagagatgcttcagctcatttagtccacagttatactaaagagaaaaatcaatcaattgtaactgacccaaaaatgacacagatgatagaattactggatgggacattaaagcagc

SEQ ID NO: 20093 - DNA, 636 bp, Homo sapiens
actcgttttgctccatatcaccagctctgggtgtcagcggtaaaagctgtctaaagcaaaggcccttgatagtcaacatggatctccttccatcttggaaatatttttggcatcctggtagataacctaataatgcccttggcagctcctccaagcaagttaactttggtaacatgttaaccaatgttataaccttgccatctagatagaagatttccacaagttagcctctcttcaagggagaaagaagaagtcataaacgggtacaattgtccaaaaattccccctggcattttcaccatcactgggcagagattgttcttcccaattataaaacgtactttaatcccaaaacaattgcctaagtcttatgccttgggaaagaaaatgaaccatgacgacatctctaaagacaattccaaatgttttagagaactgttatatcgaaaggagcatgggaacagattttcatagtccctgtccaaccatcgcaattattttttagtttcataccctgaatagttgatcttcaaaatgcccaagttgataccaggccattcaaagctgtttaaaagtaagctgacacttgaggaataacagtcacagtcataatacaatctaacatctctacaatgc

SEQ ID NO: 20094 - DNA, 556 bp, Homo sapiens
ggttaagtaaattgtggtacaaccaaacaatgaaatactatgtagctataaaaaataagaataaagaagctgtttatgtactgacaaaatgattgccaagatacaaattaaaaagcaagatgtggtacaatgcatataaagtatattgccatttgtgtaaaaacagagggacaaagagtatgtgtgtattcgcttgtgtatacatgaaatattaccaggatacacaagacacagatattactaactacctctagaatggggaacttttgtatctttttgcgttttttgaattttgggacttgtaaatatactgcaatcaaagtattaaataaggaataaaatagttcaatttaaaagaattgagatggtactctactcatatttttctttttaaaaaattatttaagataccaaagatcagcattcactaaatggaattaaacacactcagaaatattgataatacagtagataaggctgggtacagtggcttacgcctgtaatccctgcactttgggaggccgaggtgggtggatcacccgaggtcaggagttca

SEQ ID NO: 20095 - DNA, 630 bp, Homo sapiens
ggttttccatcaccaagtttccatatttttagtaaacaccataaaatccctattcctattccatgtccaaagtattactccttcaaaagctgccaattttgaatgatatatacttttcattttgtgttcaatcacttaaactcattcatttaatatttcataagggcttactctgttgtagacactgaggatagaatagtgtacaagacaaacatgtcaggctttcaccaaacttacaggaaagcaatggaaatagtcaactgatgagtcaaaatcataataccattgaataagtgtgttttacacaatatccccatttccacctctgttaatgagtgttgattatgtcacattgaaaaccattaaaatgtttacccatactctcattagacaatgagcatccctgtgttttcttgagtaatatctagacactggaatttcattcatggcatccaaacatctctagtgaagtcatgggcaggcagacagctaatctaattacctaatttatggtaatctgctcatgggttctcttctctaattaaatctgcattttagtatagccttctagagaggtaatgccctaatacatagcctataaaattaatgctactaatttcagcaactctg

SEQ ID NO: 20096 - DNA, 420 bp, Homo sapiens
gattacatatttgtgtaatcactttgggaaatattgtaatgttatgcagaaatattacaggcaataaattcttacgatctgggatcttcaatcacagggatagaatttcttccatgttttccagtgtgtgtgtgttcatgaagacatttgtaatttcaaaaacccagaaattacatgaataataaaattgtgacatatttattcaatggattgctatataacagtcaaaatgaatgaactgtagctacaaacaatgtaaatagttctcaatagtgctaagtaaaagaagacattcataaaatacatgaacaaaacatttactcacataattttaaaacatgcaaaatcaggccgggcgctgtggctcatgtctgtaatcccagcattttgggaggccgaggtgggcagatcacgaggtca

SEQ ID NO: 20097 - DNA, 339 bp, Homo sapiens
ggtaattccaagcctaagcacttttgtctcctgttgcctgtccacaaattctaggtccctatgaggagctataagttatggccattttttctgtctgctgatgtcacacaataatgtgggaaagaataatgtaatcattgaaggtttggggctagagcgagtatcttttgcctcgtttaatattcttgactcatgatttaagcaggttcataggactgttacattttccaagtagaaagactttcttccattcaacaaaaaattcattttctggctgggcatggtggctcacgcctgtaatcccagcactttgggaggctgaggcaggcagattgcttg

SEQ ID NO: 20098 - DNA, 330 bp, Homo sapiens
  misc_feature 276: n = A,T,C or G
tatagaccaacaagcattctctcatattcttggcaaaaacacacattagtaaaaacttcttcagtaggagctgttggtattttagacacagaccctgttacatgtcctctccccacagatacgtggatcatgtgtattcactgcagcagcaatagattcaagtcaagataagtgtccattcttgggagactgagaggaatattctggagtgcccacaaggacaaatcctgtatttgctgatctggaacaatttccaagatgtatactgttcagcanagagcacaggtttgtagaagagtatagagatacatctttttttgtgtgtggaag

SEQ ID NO: 20099 - DNA, 397 bp, Homo sapiens
cgtgctagccaggatggtctcctgacctcgtgatccgcccacctcggcctcccaaagtgctgggattacaggcgtgagccaccacgcccggcctaataactgttttaagtaaaaatcatcaatggattctgaagctataggtgaaagtttaatgagtaataggatatttatacagtctcaaactatctccccacaagatatctattaattagaaagaggggaaaaatgtaactttttgaagagacctggcaaacacctctttaaccacgtaggaggaagagatatcgtgtgcctcccgatgtgaggcactgagaaggatatgtcacatctacagtattcctgccaaaatctaaccaggaggaagcatcaaacaacgtcaaattgacgaactacacac

SEQ ID NO: 20100 - DNA, 576 bp, Homo sapiens
atgagcctgtggtttcttcctttcaagtgaaagaaaccataacacagatcacctgtctcttgttacagatgaaatgacaaaagcataggctatggctttaaagtacatcatagtatgcttttaaaacagtttaacagctgaaattacacagctttatctaagcatattttagatttataaaggatcgtgtttctcctttctgagtttttattaaagaattttgccttctgtgccatacagtttgaaactgggcaatgagaatagtcaatagtttctgaaattataaggtcaatatcagaaagaaggaaaaaaactaaactaatataggaactgtaataagatgctttttgaactttagtgtaatcattaacaaatttatgatataatctgtctttgtctttttagttatctttaaaatggccaaaaaattattttttctctcacaggtttttgtgaatcggatgaaataatatgcatacagtcctatgtgctcttaaaactaagttctggctgggcatgatggctcacgcctgtaatcccagcactttgggatgccgaggtgggcagatcacctga

SEQ ID NO: 20101 - DNA, 505 bp, Homo sapiens
ctcactcttgtcacccaggctggggtgcaatggcgtgatcttggctcactgcacgctccgcctcccgggttcaatgattcccctgcctcagcctcccgagtagctgggattacaggtgcctgccaccatgcccagctaatttttgtatttttagtagagacaggtttttgccatgttggccaggctggtctcgaactcctgacctcaggtgatctcccaaactgctgggattacaggcgtgagccaccatgcctggccagcttatcaaaactttaaggagtactgaaaatcatttagaagttagtaagttatagtctttatacaaaaaagagtcaagtgttcatgttgtataactacacttagaagacagctaggattttaaagattttcctttattttgtgtagagaagaaacatcacacaatattctacttgtcatctttcctcaacttaattacatatatgctcacacaggcaaaatatttaagtatatcataccatgaatt

SEQ ID NO: 20102 - DNA, 341 bp, Homo sapiens
cataatttcttacagcattttatatagaacttctgcactaatacctagccaatcaataatattcaagaatttggtctgtattttgaaaacagtatctattattatttctgcatagttacccaataatttttttttccttagagttgggggcctaattatattgtctaggctggtcttgaactcctaggttcaagcaatctttctgactgggcctcccaaagtgctgggattacaggcgtgttacaccctgtgcccagccccccagtaatatctttaatgttctagcttatgttttactttgttttataaagaatgtgtaaggctgggcacagtggctcaca

SEQ ID NO: 20103 - DNA, 451 bp, Homo sapiens
gacaaaccttcttaagcagtttctactccttttcactcggctttccttcctatttcccagaatagttcccataacaaaggcagtatgaactaactctaaggtagagcacagagaactggctaaacatgtgtgttcaaattaagcactgtccttggcatgaaaaattcaatctggtcatagtaaaggaatatggaaaagtctcttctgtatgtctacataaatgactatataaaaacactttcagccaggcatggtggctcacacctataatcccaacactttgggaggccgaggagggcagatcacctaaggtcaggagttcgagaccagcctggccaacatgatgaaaccctgcctctgctaaaaacacaaaaaattagccaagcgtggtggtgggcacctataatcccagctacttgagaggctgaggcaggagaatcgcttgaaccca

SEQ ID NO: 20104 - DNA, 518 bp, Homo sapiens
gaactgattttatttcagtgtttgataagatttagaatattttcattgttgcagactcagacttattcacgtccctgccctaccccaaggaaacttccataggctccctgtctttcagcatcaggcccaccctactccctgtaagggaaggctgtgctcacttccctctggggtacagcattcatttggcaactctgaccctgcgtcaacgtctctgcaaagtctgattcttcagttagaaaccaccccgctctgtatgagttcatctctgtaggaattgattgaaagtggggtacggaattgattgaaagttgcatattggccagggatcacgagatcaggagatcgagtccatcctggctaacacggtgaaaccccgtctctactaaaaatacaaaaaattagccaggcgtggtggcgggctcctgtagtcccagctactcgggaggctaaggcaggagaatggcatgaacccgggaggtggagcttgcagtaagccgagattgcaccactgcact

SEQ ID NO: 20105 - DNA, 465 bp, Homo sapiens
ggagatcgcgggagcgagcgcgcggtaacagttcgcggcagttcgcgcgggagcggggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctaacatatgatatttgtgaagtatctcctggaccccacttgaatatgatcgttggagccaatggaacagggaagtcgagcattgtgtgtgccatttgccttggtttagctggaaaacctgctttcatgggacgagcagata

SEQ ID NO: 20106 - DNA, 666 bp, Homo sapiens
agggaaggttggaaaacctgaggccagggctctaggcaacaggaagggatgaatgatggtcttgcaagccactatcactgggataaatcgatttaaccttctatccatctttgtgtcaaagagccttagcttgggtcacatgactaaccttggttgggcaggacagggcaaggtgacttgattcaaccaagacagcacttagtggaggagaagtaaataaattgctattagcaaaagaaaggagtactggatcctagaaagctaaagaacaataaatgtctactacaaggtttaattttgatggctcccaaacccatgttcctttcattaagttaaaagttctctattcctgttagttggtcaagtaaaagacgtttactttgggctgggtgcagtagctcacactggtaattccagcactttgggaggccaaggcaggcggatcaccggaggaaaggagttcgagaccagcctggccaacatggtgaaacccctgtctctactgaaaatacaaaaattagttggacgtggtggcacacatctgtagtcccagctacttgagaggctgaatcaggagaattgcttgaacccaagagacagaggttgcagtgagccaagatcacgccaccacactccagcctgggcgacagagtgagactctgtctc

SEQ ID NO: 20107 - DNA, 402 bp, Homo sapiens
gaagatttccaactgttgtttagcaaaggtaagaacactaaaaactccttgaattttcctgagttttaagatccttgacccagaaaaagagtggattcctggggtccttaaaaaggtaattggaggctgggcacagtggctcacacctgcaatcctagcactttgggaggctgaggcgggtggatcacgaggtcaagagttcaagaccagcctggccaagatggtgaaaccccatctctactaaaaatacaaaaattagctgggcgcagtggcaggcacctgtaatcccaactacttgggaggctgaggcaggagaatcgcttgaacccaggtggcagaggttgcagtgagccgacatcacgccactgcactccagcctgtgtgacaaagtgagactccatc

SEQ ID NO: 20108 - DNA, 530 bp, Homo sapiens
agagcactgtcttctcttttcattttaatcctaagcaataatgccatattctatccttggtcaatgtcctggagttgattgattgatttgggacatttccactactgctcccactgggtcttctccatctgcatttttaaaatgccacctccatcatccacacatgctttctgctaagcagccctccgttcttcagccagtgtttgtgggtctgttcctcctgcatgtgctttttcacggaaccctagatttttaatcagatgtactttttgttgttattgttaacagccatgaaacctatgctctaggaaccatgtgaacaagcattttaaaaggcacaaggggctgggcgcggtggctgatcacaaggtcaggagatcgagaccatcttggctaacacggtgaaaccccgtctctactaaaactacaaaaaattagccgggcccggtggcgggcgcctgtagtcccagctactcgggaggctgaggcaggagaatggcgtgaacctgggaggcagagcttgcagtgag

SEQ ID NO: 20109 - DNA, 461 bp, Homo sapiens
tcccactacaccatcccccactgacatgcaggtaggtatctaggctctgctgtgattggcagcgcaaagaaaacactaatgccagtgaccctgccccttcacactgccactgccactggtgcaaatgcacacacagaggccagcagcttggcacttgccagtgtcctgcacctgctgccactgccaccagcacaaatgcaaacacagacaccatcaatactttccacaaaagtgttccgcttatgccattatgaccctgctaccaccggcacaggaacacacaggaatgcctcagccctgctcctacctggaccctactactgtcaacatgcatgtaccttgcctcacttctgcggtggctgacacatgtgagcaagcatggctcccattgccactgccccaacaaagcactttggttggcaccacccaccagagtgttgcgataagtggactgggaagac

SEQ ID NO: 20110 - DNA, 509 bp, Homo sapiens
gcagttttgttttgttttgttttgagacctctcatagcaagaaaaaacattacataaacttttttttgagacaaggtctcactttgttacccaggctggagtgcagtggcacgatcttggctcactgcagcctcgacctcctgggctcaagcagtcctcccaccttagtcccccacgtagctgggactacaggcacatgccaccacgcccggctaatttttgtatttttagtagagacagggtttcaccatgttgcccaggctggtctcgaactccccaaagtgctaagattataggcgtgagccaccatgcctggccacataaatataaacttaaaaatacacaggaaaacctttcagaacactttgaaacctattttggtcctattacgattgcactgaatgtcccccagcctaatgaagagcaattagatgtcatttggtggcattcttggtggagacagtaagctagggccgcaggagctgcttagtctcccagggtccagcatt

SEQ ID NO: 20111 - DNA, 180 bp, Homo sapiens
ttctgtcttaacttgaaattaaagaattgggagaagactgcaatgaaagatatgaaggtctgtggagaatgaacacatgagctaataattaatatataattgagccaaattcataaacataacttaaccctctctgagcttattttcctatcaataaaatgaaggagctgagtaatatgc

SEQ ID NO: 20112 - DNA, 570 bp, Homo sapiens
aggatggaaaaggaacttgagaaaactggaaggcatgggaagaccctgcttaccacacagggacaagtgtttaaaagaagtaacagttttaacagaggatgaagggaagtaaagaagggagagtgagagaacatggagctccaaccgcacatgctatttactgaataaatgtgctgttcagggtgattttagtccatcaacaaatattttgtgagccctactataggccaggcaaacagtaatgaaaaagcaggaagcatcctttccctcatggatcttacttctagtagttaaaacagacactgagcacaccattatatgtaattaattaatcgcaagtggataaatgctgtgaagaatatatacatagaagtgtaggaagataggctgggcgcgatcacgaggtcaggagatggagaccatcctggctaacacggtgaaaccccatctctactaaaaatacagaaaaattagcttgggcatggtggagggcacctgtagtcccagctactcgggaggctgaggcaggagaatggtgtgaacccgggaggcagagcttgcagtgagctg

SEQ ID NO: 20113 - DNA, 77 bp, Homo sapiens
tgctgctaggctgcctcatgtctagccctgctttgtgatgaggtctgctctcccatgtgtcccagggtctttatttc

SEQ ID NO: 20114 - DNA, 548 bp, Homo sapiens
tgagctcaagcgatcctctgcctcagcctcctgagtaggtaatacgaaaggcgcatgccaccaggcctggctaattttttatttaacctttttgtagatatgaggacttgcgatgttgaccaggctaaaaatgaacaaatcttaattaacttaaatatttctaacactttgggcattcaggaaaacagctccatctatgttgtgaagtaatgagaagtatatggcagtggataaactttgaatgaaaatattaaacaaggccttaggagaaaagtgtaatatgcttattatagatacattaatttaaaaaattctctggcttaatatcattaattatactcaaattagactttgatttaaacacaggtcctaaatttggattaaatataatagattgaccacaaatttatttcgtctccctccggaagcctcatcagtcataaaataaaggttacacccatgaccagcacagaaggttgacagagataatttctaataaatgctgagacataaaaagtagataaagggagtggtaaataacacagaaa

SEQ ID NO: 20115 - DNA, 620 bp, Homo sapiens
tgtattctaagaaaggcaatcactgattttgttaaaatttaaatacatttttgaagcaaacagaaattaataagtaaaaaagcttaaataatatgaaaaacttttgaaatttaagaactgaaatatactgaactttgtaaaatattcaggaaataaggacatttatatcattatgggctttgtagacataatgaaaatgagaatactacatgtgaaatttaaggtcagagtcaaaaccttaccattccactctgcccaaattctactaaagagaaaataatatctttaaatgtttcattactacaaaagatagtaaatatattaataagcattttattctagttggaaaaaatgtataccttaaatgcctccccaaatagattaaataagtataacaactaaaaatgataaattagaaaataaaaagatcagatatgatcatcaaataaaattttgaaaatagattaccaaaggggtaaacttttaacaaatctaaccaagaaaaatgaagagaaaaagtaataaacagagtgaaataaaattagaaagactcttccacaagggaatttttaaagtgtatcagaaaaaataaaaaataaaatttctcacaattagctcaa

SEQ ID NO: 20116 - DNA, 606 bp, Homo sapiens
aatgtcaatagggagaaaaagagaaacagttctgtagaaatgaaggaataaaagtttatgaaaattgtctaaattttttctaattgtctacaattgtgtaacaattttctgatgtgtaaataattaatgcatcacttaaataacgtgacaaaaaactttaaatagttgaattattcgcaatcatcgacttcaatcccttgggaataacatccaagggcttgacttaaattatgaatgagttatatctatttatttatttatagtctcatttattattttccagaatcgcattctaaaataatctgtgaatggtacacaccataaagttgatttaaatcctcctgtgaaaggagaaagtttaatatatatagtaaattctataattagggaatattataattttaatacttaacattttaatggataacttcccttgggattcctttccaattccccttggttattcctgaatctcaataaaggttagacccatgcccagaaaaatatactcatcttatttcactctagtcttacagtctacttgctgatgtcatcctgctactgcccataacctagttgctttagtgctctgggaaaaatgatcct

SEQ ID NO: 20117 - DNA, 601 bp, Homo sapiens
agtgctgggattacaggtgtgagccaccacgcctggcaggatttggaaatatttttgctgcttgctgattccacctaacctcctcttttctgacccacgcctccaacacacatatatctaagattctggatactggtaattaatcaccatggtaattagaagtgtttagcagacaactctttgatgcatcaaacaattttagtgagagagatgtactttctgtattggtttagagtatacaagtgccaatttcctacagcaaataatttattcacataatttggctgcataaaaactaccatatgtaaagtggtacagccactgtagaagacagcctggcagttcctcaaaaaattaaacatagaattaccatatgattcagcaattccacttctcagaatatactcaaaagaattgacaccaagaacgtgaacagatatttgacaccagtgttcatagcagcattattcacaatagcaaaaatgtggaaacaacccaaatgttcatcacctgatgaatggataacaaaatgtggtatacacatacaatggaatattatttactcacaaaaggagtgatattctgatacatgctacaacat

SEQ ID NO: 20118 - DNA, 98 bp, Homo sapiens
taatcattaagctaattagaaagattacagcaataaaaccagatataagagcaatataacacaatcaatatattttctataaaaagatcctatttacc

SEQ ID NO: 20119 - DNA, 369 bp, Homo sapiens
tacacacaaaacacacatgcacacacacctatgcatgcacaaacatgtacgacacacatgcacacacatatgcatgcacaaacatgcacaaacacacatgtgcacatacatatgcatgcacaaacatgcacaggcgcatgcacacacacccagctggcagcctcacaaccaagtgaaaagaatgattattttgggagccctactaaaagccccatcctcagaatagagtcagtagttcaactaaactagaagcaacttggaaaatttctcccatggagcagatgttccttgatttgattcagaatttagctctgaaaaaaaaaaaaaaaaaaaaaacatttggggccgttttctacgtaaatccaaaca

SEQ ID NO: 20120 - DNA, 510 bp, Homo sapiens
taatatctggcatataataagcactatatacatgttacctactggctagaattcatttgattctcacagcaaccttatgaggtagggtactatcattatatctacctgttttacagatttggaaactgaacaagcagaaggcagccaaagaggcagagagggcaaattctgagacaagttctttcccctgcccgggttccagttctgaacaggaacatgggtctggcctatactggacacggactaaggctgggggaagcatagatagtctgacccaccagatctcactgtgtcattctcctccaagctctgggcccctggccccaagtagcacttgggtgctgctccaggggacaggtgaagggccactagtgggaaaacatgcatctaaaagtcaggagatctgggactgagtcccaactcggctactaactagccctgtgatttcaggaataggtcagtcactcattttgaaaatatttgttgagcacctactatgtgccaggcatt

SEQ ID NO: 20121 - DNA, 563 bp, Homo sapiens
ctagtagctgggagtacaggtgcctgccaacacgcccagctaattttttgtacttttagtaaagacgaggtttcaccgtgttaaccaggatggtccccaaagtgccgggattacaggcgtgagctactgtgcccggccacttcgtggatttttaacaagagaaaaatttcaagatattgtaaatttaaaacaaaattttatgtgtaataccattgaaatgtctttaaccagtatcaatcacgtgatatgaaaaatattaaatatatatttattgaataaatgaatgaaaatcataattaccttgatcactatatttaaaatttaaatgaagcaggaaagtaaatcttcctaattatcatatacttaactgtttaaaatcactctaatgacaagtaatacgctttcaatcttgcattataattttaaaattcctgtattgtttcattcactcatccttccattaattcagtgaacaaacattgattccttacccactaggtgctaggtattatgatagattcagggagtacaaaaatgattaaatgaggggatcagctggagtg

SEQ ID NO: 20122 - DNA, 217 bp, Homo sapiens
gtgctgggattacaggcatgagccacctcgcccggcctgggtggatcattttattgcatctcccttctggggcacccctcaagtgaatatatcatttacatcccgtgacagataaagaaacaaaaacacagaggtggaagatgaacccaggtagtttggttgcagtgcccagactaaggaattaattgttctctatcaaaaataaatttatggacct

SEQ ID NO: 20123 - DNA, 391 bp, Homo sapiens
ttgtttttaatcaccaaagagagttggaggagaaggcatgagaagtgcccatatgcctttttaaagactcccagaagactattgtttacctcctctgtctgctaccagataaaggctagttagaaacctgactattccctaacacatggaaagggtgcagacaaaccccttctaggaaaaaacaaaacaaaactgggaggtgaaattctttgcctatttttttctgtgctttaccctaaggaatagcctctggcattgctagtgtgtccatttaaaatcacattattctctaggtctatggagacttgtaaatgccaagactcttttgctcccagagctaagtgatgaaggatccaaatggtctgatagaaactgtaaaagttgtggcact

SEQ ID NO: 20124 - DNA, 484 bp, Homo sapiens
taattatattaggagaattaaaagtctcagatcaataagctcagctaccacttcaagagtatagaaaaaaatcagactataaatccaaagcaagtagaaaaaagaaaacaacaaaaataagagtgaaatcaataaaactgaaaacagaaaaataatagaaaaaatcaataaggcatggagctgcttccctgaaaaaaatcaacaaaatctataatttctcacaatacagtcatctgtctgattcatttagagatatgaaaaagcctcggaattgtgtagataggatcaatgggagcgtgagaattccaagttcagctataacatgtactgtgtgatatcaggcaagtttcttaaaatttatgtgcatcagttcctttatctataagatgtaaagatactggtgcctaacacaatggaggttattatgaatgataatttttaaaatatgtaagacacaaggaatgatttctgtcatataagaagt

SEQ ID NO: 20125 - DNA, 121 bp, Homo sapiens
tgctgttaacacaattcctccggattactaaaaattttcctagatctaataattccaccttttgttttctcattaatgagtcattagctagagtcatggctggttataaaatatataggca

SEQ ID NO: 20126 - DNA, 585 bp, Homo sapiens
aaatacctcccctgaccctcacctccacaaaaaagcaggcagtctccactatcaggaagcaatgagaatgctcccttttcaccccaagggctaagcaacacacagtacatttacagggtagaattttcaagagacaatctcagagacaattttaaaccagaaactgattgaaaatgtcatcgaactaagttagacaaaggagtctacaagacaagatcaaagtaaaaagtaagtacaaatagagcctattttaaaaaataatgataaaaccaactaaccttactgacacctactaagtaccaggtactgtgttaagaatcatatacattacttcatctggtcctatccgcaacccaataaagtaggttcttttattatctctatttcagaaatgagaaaacctaaactaagaaaagttaactactttatccaagttaagaggctactgaatagaattaggactcaaatccaagtctaacttcatttctcaagcaagacgttctaaaaaatattaaaaagctgccaggcgccgtggctcacgcctgtaatcccagcaccttgggaggctgaagcaggcggatcacg

SEQ ID NO: 20127 - DNA, 176 bp, Homo sapiens
cagcctgggtgacagagtgagagaccctgcctaaaaacaaaaaacaaaaaccaaaaaacattctgagctaacaggatgcaagaggaggagaaaggaggctggaaggtgaaagaacattagaaagtcaaggtagtcaggcatggtgggctcatacctgtatcccaaaactttggaag

SEQ ID NO: 20128 - DNA, 374 bp, Homo sapiens
catcccccagaatctcttcagctataaatactgaccctcattttgtatgactaccagtacaaatcattccgaaagcttctttgtgacaccaaatattttggttaaaagatgtttcctactttctaccccaagagacatccaatataatataaatctatttcatatcattataaaaacacagaacagatttaggccttagttctaaaaacataatattgatatacaaatagttaagacgaggcattgggaaaatgaaaagtaattcatactgctcgacaaacctaagagtatctttaaaaagctaatattgccatggtgaaattatttcctttaatgttaatgtgtaaacattataacatttaaacattataaac

SEQ ID NO: 20129 - DNA, 388 bp, Homo sapiens
cccacctcggcctcccaaagtgctgggattacaggtgtgagccactgcgcccagccaagaaaaggtctttctatgttgcccaggctggtcctgatctcctggcctcaagtgatcctcctgcctcagcctcccaaagtgctgggattacagacatgagccactgtgcccagcctaggaatgcatattgtatatatggataataacaattaaaaaatgtaagtcagactattgaatctaaggggatatgagtgcaagtaactacacacatggtggtggctcgggaaagcttttacagcaggtgggcctgctgaaaatccttccacggccttctaccactcttcagataaaattcatactcctcagaaaggcacacacaggctgggcacgg

SEQ ID NO: 20130 - DNA, 597 bp, Homo sapiens
agacccttgtgtaagagtcccttgtgtaagaaccatcttcactcgaggctgaacacatagaatgccgacaggctgtgttgtagccaattgcacatgctgacatttctgggccttaaccttggtgttgctaaaccatcccaacataatctgccccctcatgaaagccgtgttctgtagtcttgcctgaagatgggatgatggactaaacaggctcttaatgttgagttcattttcatctatatttctgtcccatgttcctttacctggattcctgtctctagtactgctgctatctcttaattgtccaatttaatcccagtaccactgccttgggctgggtactgttccttcatgactctcattccaaatagcttggttcataccccatattagtctgttctcacactgctataaagaactgcctggctgggcccagtggctcatgcctgtaatcccagcactttgggaggccgaggcaggtgggtcacctgaggttaggagttcgagaccagcctggccaacatggcaaaactccatctctactaaaaatacaaaaattagccaggtgcggtggtgcatgcctgtaattccagctac

SEQ ID NO: 20131 - DNA, 544 bp, Homo sapiens
gatagtacagtggctcagagcatgcactgctcaaccaggatgcaccccagtcccaccagggctgtgaggacccctcagtaggccgcatctcattctaaagaggcacagttcctgaacatggtgagacccatgaatcctggaagtatcagcccattcattcccttgctccaggtttgggcagttgggacgaagtagcacataaggggtggcttaaacagcacacatggactccttgccatcctggaggctggaagtccaagctcatggtgccagcaaatgtaggtcctggtgaggggcctcttcctggcttgaagagccaccttctcactgtgtcctcctatggcagagagagatggctgtaggaagaggtttctcttccttttctacaagggcactagtcccatcatggggccccacccatatgatctcatctaaacctaaccctccccaaaaaggccccacctccagacaccatcacgcagggggccaggtcttcagcacatgaattttgggaggacccagatactcagcacataacacgttg

SEQ ID NO: 20132 - DNA, 576 bp, Homo sapiens
tcaaaaatatttagaaaaaaaaaagaatggttatatctgtacctaacatgtatcaactattttttgtcattattccccaaacaatatagtataataactatttacatagcatttacactgtatgaggtatcataagtaaactagagataattcaaagtatatggaaggatgtatgtacattacatgcaaatactacaccattttacataaggggcttgagcatccatgaattttgttatctgcaagaagttctggaatcaatcccccgtggatacaaggggatgactgtgtattatctataattatttttaaattagtaagcatttaaaaaattcctcagaatttctaatatggtaatattcataaatataacacattatgtggggtcctcaatagtaacagtgaaaagagattctgagaccaaaaagtttgaaaactttggatgacatgaatcacactcaatagtaaaaacatccttacttgagtcaaatcacttaggaaagccttagagaaagagtgtaggagaaaatcacttaggaaagccttagggaaagagtgtaggagaaattacacatg

SEQ ID NO: 20133 - DNA, 592 bp, Homo sapiens
aggaagacagcaaagtacacagcatttttctgacaaaattccttccacgaggatgccattattttggtttttatgttgaagatgtgactaccacttaattagtactcaaattggagtggcaaaccagaaagtcacagctacagactttcagtggagctgactcgcccctgtgtctccttcctgttttcatgtgttgcagcccgttctcttcagagcctgacacactgacagtagacctctgcaggacaactttgacacccagttctctccaagctgccagtgagctccctgtgcagcctcactcctcacctacagcatgagcccttgcagctctcccagcatcacaatcttgtatctcagtcctggcttctttcactgctggcatccctctgtctctccctttttcacctacttttcttttttcaaagaattcttctctttcatctgcttatatgaaaaataatgacacctctgaaattctttccttgtagttctgcagcatcaatgccaggaagacaggcctcatcctcccagcttctatgctgctcctttcagatcccttaccctgtccccattttcatgacacgggctc

SEQ ID NO: 20134 - DNA, 612 bp, Homo sapiens
ctcagtgaagcactcaaagctactcaacaatatttttactcagctcttctcaactctctttctcaattcctatagcagctgttctaaaatgtctaccaattttctcaagatctccaggcactcttctcaatcccatcaattaatgtcctgattgataaaacagaggtctctacattcttcctctctatttccaaacttattaccacctacaccttctctacctgcacctttcttagaacagaaaggcttctccaatttgtaagcttaatgtccccatatcagttattgatttttcccgtatcccacacctcaaccctattctattactgataggtcaccccttcttcttagacagatctttcttccttttcacaaatgcataatgtgatatatgcatttgtgtaaaaaactcacattcctcaaggtcctaaaaaacagtaaggtttttggataaataacattagtaagaatcttatgcaattttgtaataatcatgataacaccaccaacaatcacaatagatcatttagatcacctaggcaagcaatgcagtatggccagaggctgccatagcacatattaaaagtacacacacacacgacacacacacac

SEQ ID NO: 20135 - DNA, 584 bp, Homo sapiens
gttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacatta

SEQ ID NO: 20136 - DNA, 582 bp, Homo sapiens
gtatgagccactgcacctggtcccaatttaaagctttttaacaagagtttttcagaggggaagggatagcaaagagtctacctaacctgtctaagaatcaaaagctttattgcctgaagcaatttatagaaaaagtgtttccaagtctgggaagaaaaaaaataatgaaccttcagtcattctttcagccactgttgtagtagcaaattgtgtccaataaaacaaaatccctgccttcaaaaagagggtcacctaataaattatatgaaatattcagagttcagcaaggcctcaaaaaagtatgaaaccaattgtacaaaagaggtggaaagttaacaaaaaaaagacataacaactgactctcagaagacaatcagaagtgtaccaggtaaaggcaggagatggtgaagggattaatattccaggtaagtaaagaatgtacaaacgcaaagaaatatcaagcagcatagtctgaatagcaaatcaaaaaataacaacaggttcaacttctgatagtgatagagtaacttatatctggctaacatttctgcatataacaacaataaatcttacataaaatac

SEQ ID NO: 20137 - DNA, 489 bp, Homo sapiens
cacatgtaccctaaaacttaaagtataataataataaaattaaaaaaaaaggaaaaaaaagaggcaactgtttctaagagttttgaaaagtgtgttcgcacaggtttcactaaaacaaaaactataactgcaatataaaagctgctacaggtaacagtgctctcccaagttatttaggtaaaggctttataagctttagttattctttctatagaaaagaactgttcactttattataacaacagtcaaagtgatttacatgtccatgacaacttaaggttatcatttaaaaatgccttttacttatgttatcactcacgcagtgcattcttctcaaaaatggaagacatggccaggcatggtggctcactcctgtaatcccagcacgttgggaggcctaggtgggtggatcacctgaggtcaggagtttgagaccagcctggccaacattgtgaaacccagtctctactcaaaatacaaaaaaaattt

SEQ ID NO: 20138 - DNA, 550 bp, Homo sapiens
gaagacgccagaagggctgtgaagtcatccaatagtacaacaccagcctattgcaatgacttgataaatatctgttgaacattgttcagtgcacaccctgaaaacagaaattgtcagaacttgcatataatagtaagatagatggatttgggttgagaaaacctatctaggctttacttcatggcacacccagcttttcctcttgagatatagactacctgaaacaaaaccaggacatttttaacctgtcccattgtgtgccctttgactcagttcaccagggaatgaatgctttaaccagatgactagggcagggttggtctctctttcacataggtcttggttgttctttgtttgtttgttttgttgttgttgttgttcgagatggagtttcgctctttgttgcccaggctggaatgcagtggcgtgatcttggctcattttaacttctgcctcccgggttcaagcgattctcttgcctcagcctcccgtatagctggcactacaggcacgcaccaccatgccgagctaatttttgtatttttttctt

SEQ ID NO: 20139 - DNA, 551 bp, Homo sapiens
tggtacgtacctgtagtcccagctactcaggaggctgaggtgggagaattgcttgagcctaagaggtcgaggctgcagtgaggtgtggtcgcagcctgggtaacagagtgagatcctgtttgaaaaaaaaagagcaaagggcaaaaaactaagagttgcatatgaaagaaataccaatgaataccacggaaaagatgttcaattccattcataagatgagatatacacatttggtttataaaaagatagtggtcttcacctaaaaaaaaatagcaaaagttaaaagtctcagtatatactatatttgttgaagctgcttcagggaaagaatccagccttgatggtagaagtataaattgataccacctcttcatttgtaatacagctattaaagtaagtgcctataccctttgaacaatccaatttttagaaattcatcctacaggacaaagatataagtaccgggatcttcatttatggtataattaatgacaaaagactaaaaatgaccttatcgtcaggaagagaggacagcttgaataaattacgtg

SEQ ID NO: 20140 - DNA, 572 bp, Homo sapiens
gagcctgggccgctgcgcagaggcgcggcggctgtacaactcggccttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatggggaacagaaagttaagccaaagaatgcagaggactgtctttatgaacttccagaaacattccgtgtttcctcagcaaagaagaccgaggagatgctttccaaccagatgctgagtggcat

SEQ ID NO: 20141 - DNA, 580 bp, Homo sapiens
gaaaccccgtctttactaaaaacacaaaaattagctgggtgtggtggtgcacacctgtaatcccagctactcaggaggctgaggcaggagaatcgcttgaacccaggaggcggaggttgcactccagcctgggcaacaagagcaaacctccatctcaaaaagacaagacaagacattacctaataatgtcttatctagtggtaattattaggtaatgtcttatccagcgagtcctttctctggcactgattagttaaaaccctcagaggatcactcagttttcaaaggtctcacctcttcctatattaaatcattattaatccttgcattggtcaagaaaagtttttaattaaacaaaaggcagaaaattataataaatgattgtgaattgtccatttgttactcactgagcttaacagatccttccattcccaaaagtacattgtcacttttgatgtctctgtggatcacttgattagcatgtaaaaactccaatgcctgtaaacactgaacagaagaaaaacacctattaatgaaatagtccctgaaaagacacagggaggcacatgcagtagctatg

SEQ ID NO: 20142 - DNA, 604 bp, Homo sapiens
acctagtgctaaaaatgtatttttagtcattcccaattttttttttcttgaaatggagtcttcctttgtcacctaggctggagtgcaatggtgcgatctcggctcactgccacctctgcctcctaggttcaagcaattcttctgcctcagcctccagagtagctaggacaacaggtgcccaccaccacacccagctaatttttacatttttagtagagatgaggtttctccatgttggccaggctggtcttgaactcctctgacctcaggtgattcacccacctaggcctcccaaaatgatgggattacagacctgagccaccatgaccagccccaatactttgaaatttaaataaaaattcagcaatttccaaaaccaattctatcaagcaattatttctatcaagttcattacctgtgccagacttgtgaatgcctcagcataattccctacatggtaacctttagcctcatttctaagatagcaaaatacatggtccaccaatgaattttaaagttcaacttaaatatataaaaaataatatataatattaatatattaatttataatatatgggatattatatattaaacattaaataat

SEQ ID NO: 20143 - DNA, 554 bp, Homo sapiens
tcacaatccagccccaggtgcttctcagaagcagaggcgagggccggctggggacactgcagtagtgggctggatgttgcttacttcactgttctcagccaagggcccagcagtggctcctctggggtctccttaaaaggtggctcgctgcccctggcttgccccaggctatgggtcgacgttcctggagtaaagcctgactttatgtattttataaaacacaaataattttcatgagcactggtggttaacatcaactctttggagctttttgtgtttgtttatttaaaatggaagctgtctctcattttcatccaaagagatttcttccctggggcggtcaacaagtcttggcaagtgctagatccctggtttagtttttgccatagcttggctgttactgcaaagaaaagccctctcactaagccctgtgagtttgcatgcatgcctgtgtgcttctgtgagtgctgtggaccctgtgtgttccaataatggatcctggggctcagtaaacacagtggctaaaaggacatctatgctgatgaaatcgtctc

SEQ ID NO: 20144 - DNA, 513 bp, Homo sapiens
tgactcaccaaaatgcaagccattaactacccctggacactggaccagtgggatggaattcctcgcttgactgaggatggaaatgcagtgaagacatcttgggatgcagcccacaaaggtattagggtggccttcggttgaaaaaggcaaagtgaagcaatcaccaggctctttccctccatggtgcagatgtggaaaccacctggccaatgtccaccctgtcattacctggtgtgggggtggggaggagggcaggcccatgactagtagagatcctctttggattgcatgtgagggtttgaccaacacaaaggatatcagatttgaagagccaaagctgtaggcccacgtgttagcaccattcagctaatggggacacctgagccttcctgtgatctagataaggagcaaatccttgcgttacctggtgcagatctccatatattctatgagctctaccaccgttagccattctgagcctcttttagagtagtctggagcttgtgggtggcg

SEQ ID NO: 20145 - DNA, 610 bp, Homo sapiens
tctgatcacttggcagactgagagctggggctggggagacaagtaagaagggaggggcagatttattggtactcactctgatttgcctgggcttcggttctccaagtagacctgtttaagagggaaagatgaggaaaaaataatggaaaggggatgagactgactcttctgatagagaggggaactggcccttcctgtgatcttcagacctgtcatcacctgctaacaggaaaggaccacagaaacccctccctccaagaaagtcttttgtttatttgttttacaaagctcagtgatgttaaggccctaagtgttgtcagttttcatagttcaggacaaaaaagaagaaaatacaatgtattgtaatcttattgtgctattgttcttttgtgcttttgttcaaagacaaaacagaaaaaaaaggtcaacttatcttctctttattgagcacctactgcatacacaaatattgcatcttctgcaaaaacacatccaaatagacctgactaatgctacaacaaacataataaaatgtgatcatgtatgagaaagttcttaaaatacaataaaacccttggtaaataggcattatcagttattgctattagag

SEQ ID NO: 20146 - DNA, 572 bp, Homo sapiens
tcacaggagaaagagagtcccaagaaaatcaagggcatttgcattacaatccacctcaatgcccaaaaatatcccgctgaacatgcagaatttcaaggaaaacagtatgttttgcttatttgcaggaaagaaatgaatgttcaagagagggaaggggctgtggtttaaaatctccaacttgcaaaggaaagcatatgtcaaccaaagaatcgtctttgaccctgcagattttggagctggtcctgtcggggcaggcagaggatccacacacagtatggaggggaaggcactgtgtttggggacagactgaaaggatttgcaatcctattgtttgggaacaatagctgacactgaacccttctttataacaggtatcatgccaagaatttgccaaatatatattttttatttagtaagataaagtaaattgcccaaggtcacatggctagaaaattgcaaagtaggacacacaatcctggcttgactgcttgctggatgatcttaacctttctgtgcctcttcttccagattgttaaaaatggagcatgataaggattctatctgtgctccgc

SEQ ID NO: 20147 - DNA, 542 bp, Homo sapiens
ccaggagcaatatgccgaggttcagactcttagagccagaggctgcatgacctctaaactgtgatttctaatcttgtagctaatttgttagtcctgcaaaggcagactggaccctaggcaagaaggggggtctttttgggaaagggctgttatcaattttgtttcagtcaaaccatgaactgaattcctttccaaagttagtttggcctatgtcctcataatttcctcagttataattttgtaaaggtggtttcaggacctggagcaactagtttagctctcaagatagaaaatgtgggtcaaaagagagagagcgacaagagagaagaaacctgcctggagccagcacactagcctaggccacctactcagatggtgacctgagagagaaatacaattctggtttgcataaacttctgtattggggggtctctttgttatagcagcctagcctgtttcccagttaatccatctgggatcccagaaacagggataccacggaggagagacacaaaaggaacacccgggtgacagtgagggag

SEQ ID NO: 20148 - DNA, 600 bp, Homo sapiens
catgaaatattggcatcatacctcttctgcatatattgacgtgatataaattaattttcatcagaacagcctaaattgcatttcatttctatttattgaaacacatttttactgagcacatgctaagtgccagatacttcagtaggtaagagaacagagaataatcctgaaccaaattattataatgaatggtgtaaatttttattagcatatcaaggtcccattctgattagcctgaccaccaaaccacatcagccaaagagggctgatggtctgtttatgctgttgggtaaagtattgtgttccctttcttcaaagtccaagtctctataacatacattataagatccatacaaaacatttgttatttaagaaatggaataggccaggcgcggtggcccaggcctataatcccagcactttgggaggccgaggagggtggatcacttgaagtcagcagtttgagaccaggctggccaacatggtgaaaccccgtctctattaaaaatacaaaaattagctgggcctggtggtggacgcctgcaattccagctacttgagaggctgaggcacaagaatcacttgaacctgggaagcgga

SEQ ID NO: 20149 - DNA, 516 bp, Homo sapiens
acactttgtttttcaaatttgaataatacaaatatagaatttgcatattttactcacagtattcttcagatatagtatttaaggtaataccatctttgatgaaataaaattatagaaaagtaagagctaagaaacataaatacaaagaaaaatgaaagtatgcattaacttattttttgtatgcctgatattttccctttcctgtgatttctagtcttatacagtctttatgattttatgcttttgagatttggagcagccagaaagcccaaactgcctgaagtaaaaatttcttcaaatagtaacagtaaaagcacaaatgaaagtatcatgtctcctagactttccactgacttggacatgcttggagtatttcaggatcttggcgggaaatgagatctctgaatcccaatagcagtaatccaggagaagcaagagatctaggataataacttcctattaacgttatcatgtttagcaaataaaatacagggtgcctaattaaatttgaatttc

SEQ ID NO: 20150 - DNA, 513 bp, Homo sapiens
acagaacattctagatggtggaactagatcatctcagacaatgaggaccagtgaaagggtctggccattggcaagaaatctgctctaatggtctctgggatgatgaagctagcaaaggagctgctgatttttacaattaataaaatccaataagttttcagcgatttggcttaggagccccaaatttaaacttggttaccacgccttactaattattcacattatttgtctccctaaaaattacctcagagaaggcctggaatgctacattggaaggaatgtgtcaaacttattcttgacctattatttgataattcttagagaaacagttgggcacagattcacctcccaatcactggccactatagggtcctttggagggactaactcagcaaaggagcagtggacaactgagtctgctggcctctctgttcctgcccaacttcaggtttctgaagctgtggaaaaaaaccatttcactggtcatgaacagtgtcaaatgtacaacaccat

SEQ ID NO: 20151 - DNA, 505 bp, Homo sapiens
gaccagggtggtattagtgaccagagaaaaacataaatctgttggggtatctctgtcaccttcaaaagttagtcagaaaaaaatgtacacaaagatgacaacttatcatcagcaagtttatgtaatgtaagtttgtgatatgtaaattgcatgctatatatcactatgtgaagcatgactgttcagttagattgcattactattcttcaaaattaaatttgctcattttcaattccaagttcttttgggcatatacaaaattcaaggagtagctaatgcattcgctccattagtagaaaaaaaaagaattttacaaacagttttaaatgattaaacttttatatcaactttaaatagaaagtcatgtaggtacaataatatttcaataatttcaacccattcatggaatcaaagtaaagctttttggtgtttgttctctaaaagatgaagcatctgacattacttttaatataaatttaacttaaaagttcaaaattaaaaaaat

SEQ ID NO: 20152 - DNA, 490 bp, Homo sapiens
ctttgattgcagcaggtctttggtcacatatggagtattgattaacattccatgcagtggtccctgtttgtctccatatgcctgaaacatgatctgcaggaaaaaaaaatggcatggggagttaagagacagaaaaaaatcagagagctgcctagaggggctttttttgcacaaatattatctctttgaaaacatttttggtaggttgagtagctgagatatgcctcttaacactgggtacttggtgctctcacctctccacagattaaccaactccaaaaaatatatatatataaccagccatataccataactgctctcacttttagattagttgaaatcaacaagaaagaaggccaggcgcagtggctcacgcctgtaatcccagcactttgggaggccaaggcgggaggatcatgaggtcaggagatcgagaccatcctggctaacatggtgaaaccttgtctctactgaaaatacaaaaacatta

SEQ ID NO: 20153 - DNA, 589 bp, Homo sapiens
acttcaacttgggcaaaatgcatgctcacgtttgcaaccacctcccatatgtcattgcactgtacatctgaatcttcaccccagctccctttcagcactgaagtccattttggatgtctgttgattgagggagccacctgcattttcctcaggcttctcagagggagcacagacttcacaaccttcattatccacctcccaaaccagctctttgatctgggctcctgacctgttagtagcacatctaaacgcagtagaacaggcacgtcagtcattcttgctccactgcctttcccctaatttccagttagtcgattcttcatccaaatagctttcaaatttttcccctctctttcatccccacctgtctctttgccttctttcagactttctccagacatccttctagccaaactgctttcagagtgacctgtctgcaaatttgtcaaatcattcctatattaaatcttttaaatgacttgccattgctcaagttgtacatagagagcttattttaaaagcccaggctgtgcgcagtggctcacacctgtaatcccagcactttgggagtctaagcaggcttgatcac

SEQ ID NO: 20154 - DNA, 572 bp, Homo sapiens
atgttctaagccttgtcttcaacaagaccattacagttgataaagtagtgaggtccacagggaaatttcctgcagcaacccagtaacatcaaaccaaagccaaaggtttggagccaggaaaggggctgagggagctggcaaattgcataatacctaaaactcttaggaaccaagagatatgccaagtaacaggtagcaaacttaaatgtgtacagtgtcttggcaagtagcaggagtgtgtaaagctgcttcgactgagaagggagacaataaggtatggtggagattgtggcaaagtagagaccacatgccctctactcagcactggccaattgttacctcctcttccaattttcaagtctaatgggaaagctatatttttatatgaaacctctgaattggcatttctctcagcatttttattttgtttttacatcatgtgtggataagacaaaacatgtctgcaggtaggcaatatctcctgaggcagtggaatggtccactgagttttctccttcagaaataaaacctatagctgtgacttgtctctgggctggggcaagacaaggctg

SEQ ID NO: 20155 - DNA, 601 bp, Homo sapiens
aaatacctcccctgaccctcacctccacaaaaaagcaggcagtctccactatcaggaagcaatgagaatgctcccttttcaccccaagggctaagcaacacacagtacatttacagggtagaattttcaagagacaatctcagagacaattttaaaccagaaactgattgaaaatgtcatcgaactaagttagacaaaggagtctacaagacaagatcaaagtaaaaagtaagtacaaatagagcctattttaaaaaataatgataaaaccaactaaccttactgacacctactaagtaccaggtactgtgttaagaatcatatacattacttcatctggtcctatccgcaacccaataaagtaggttcttttattatctctatttcagaaatgagaaaacctaaactaagaaaagttaactactttatccaagttaagaggctactgaatagaattaggactcaaatccaagtctaacttcatttctcaagcaagacgttctaaaaaatattaaaaagctgccaggcgccgtggctcacgcctgtaatcccagcaccttgggaggctgaagcaggcggatcacgaggtcaggagatcgag

SEQ ID NO: 20156 - DNA, 608 bp, Homo sapiens
agaccagaacctgtttgaagaaggccaaggacaaaagcagctttcatctgacctccccaacagctaagggccacagttggagtttgagaaggaaaaacaaacacctcctactcacacacatcaaaaggcgaagggaacctcctgcaccctggcctagcccagagagggcaggcattggagatgagtccaaacccaactcctgtcacctgtgagctgtgtgacccaaagaaagttatgtaacctctctgagcgtctaatgtcctctgcaaagcatgaagatgaaaatcctttccaagggttatgtgtgtcttaaaacactttcgaggccaggcatggtggctcatgcctgtaatcccagcactttgggaggccaaggcaggaggatcacttgaggtcaggagttcaagcccagcctggccagcatggtgaaaccctgtctctaccaaaaaaatacaaaaatcagactggcgtggtggtgggcgcctgtagtcccagctacttggggaggctgaggtgggaggatcgcttgaacctgggggcagaaggtgcaatgagccgagatcatgccactgcactccagcctgggtgacagagtgagactctgtctc

SEQ ID NO: 20157 - DNA, 508 bp, Homo sapiens
agatagaaaaggaaaagggaaaggctgagccgcagaaatgtgcaaccagtagagctgccatgttattctggaagatgttccagtcttcgctggaactccaaaccttcgcctggctctccaaacctgaggcagcttcttggcttccttactttctcatggatccttagaaaccccccaccatctgaagtcacagaatttgttgttccttgaaacttgaaaaagccaacacactgattttatgaagtgaaatgtcattaaacattctctggattaatcgacaaaatcacatcttttttcccttctaaatgagaaagacaaaggaaaaataataaagatggaatactttagtattaggaggaaatcattttattttcctgagcagaattatgttttcaattatcacagggttgaaaaatcttcagactagaaaagaaaaagtactttcagttttccctctttcccaccctaattaaataaaatatatgtgcaagggacagagtaacacaat

SEQ ID NO: 20158 - DNA, 594 bp, Homo sapiens
ttacaacagctctcatttattcagaccttattctgtcccaggggccgggccaagtactttatgtgcattgtatataaattaatcttcctagcaacctcatgagacagatactattaccaccttcattttatggataatggattaaaagtcaaagtggttaagtgacttcctctttgtcagtggagaaccatccagggttttacaactgcagagcccattaaaccattgtcgtatactgttgatccttgttctcacagatttcaacatgttgggaggatgacatagaaacctgaaactaagcatacagggaagtgggctctagcctatttgaaaaggctctggagggctgggcgtggtgactcacatctgtaatcccagcactttgggaagccaaggtgggaggattgcttgagcccaggagtttgagaccagcctgggcaacatggtgaggtcctgtctctattaaaaattaaaaaattagcccagcatgatagtgcatgcctgtgatcccagctactaggtaggctgaggcgagaggatcacttgagtctggaaggtccagtctgcagtgagccttgatcacaccactgtact

SEQ ID NO: 20159 - DNA, 512 bp, Homo sapiens
tacggctccgagaagacggcagaagggtcacatgaggtcgggagttcgagaccagcctgaccaacatggcaaaaccctgtctctactaaatatacaaaaatcagctaggtgaggtggtgcatgcctgtaatcccagctacttggtaggctgaggcaggaaaattgcttgaacctggtaagcagaggttgtagtgagccaagatcgcgccactgtatgccagcctgggcaacaagagcaaaactctgtttcaaaaaaaaaacaaacaaaaaaacaaataaacaaacaagattgtccttggtttccttgaacttctactgcaacaacacatgatttactttgttttgttttttttttgtcattaattgactggttctaggaaaggaaaatgtaaaaacggaatactgagctaatagcaaaacaaaaaagacatagggtacaaaggagatttgaatctgctctacttgggagaaatcaatgaaaaaaaatattccaagaaataaaaaaattcaac

SEQ ID NO: 20160 - DNA, 577 bp, Homo sapiens
atcagtaccagctagggtaaacactactctagtatcaagtgtgaggtggaattagtaaatgaccagcctgccaacatggcaaaaccctgtctctactaaaaatacaaaaattagccaggtggcacatgcctgtaatcccagctacttgggaggctgagccaggagaattgcttgaacccaggagacagaggttgcagtgagccaagattgtgccattgcactccagcctgggcaatacagcaagactctgtctcaaaataaataaataaacaaataaaaaaacaaacactacattctactagtcttcatcaattgacttcattcatctccaccttccccaactcttaacttccctatcttcatcttgatggcaaccaatgtaacacaatatgaaatttttacttttaaaagttgacattaataagagttaaaaaactaaacatgcggccaggtgtggtagctcatgcctgtaatctcaacactttgggaggccgaggtgggtggatcacctgaagtcaggagttcgagaccagcctgaccaacatggtgaaaccccatctctactaaaatacaaaaa

SEQ ID NO: 20161 - DNA, 633 bp, Homo sapiens
ttactcctgagaccattacaaattctcagcaggctgggagcacagttgagatggataggaggaaatcagtgcgtggctccttccttcctccttgcattcccacaacgttctcaagcatttgctggtgtcaggccctggacacagagagatacagaggagactccagagggctggagaccaagccctcctgcaggagctggtggtctaggaagggaggccaggcagggcagtgacattgtgatgtgaggggctctgagacaggggccctgaggaacagacagggctcaagagctcagggtcccggggtcctgggctagacctcttttccacacatgatgcctccttaccgagcaccctctgggtgtctcaaactcactaatggcacacagaggagggttaaattaagaaatttaaaaattggactaaatcactgccgctaagacagaattcctccatgccctggagtgggttcctccagcactcagttcccaaccagataggtcttggctcccacctggccctcttgtctgtctagccctgactttgtacttgccattcatttgatgtatcatgcatttatcaagggcccctctgggtgtgcacagcactgaactagatgaaatctgatcaact

SEQ ID NO: 20162 - DNA, 584 bp, Homo sapiens
accagctatttaatagatttacagtttatcaccttacaggggcaatatatttaccatgcaatatcttttggaaatatattattattactgctcattccattctgagcaaacaggaaatcttgtagtttgatccccagaatacctttttggaaaagaaacttgaaaacaagcaattccaaaacccagacataatttttaaagttgctagataccccacaaaggataattatacatattaatgtccactgtgggtgttgttaatctgttaagaattctcaatcagatccataataagaacactattatgcagttatataattttgtttcctgtatgtctcttaacaagggaacagaaattctaaaggatttatttcacattgtccttggctcacagcccagggggttaacacattaaaatgaatcacttggctatgccctgttccacagctacaacattcacccaggcctcatacacctgacctaaaggaaaactggagagagaggttggagcatgaacaaatctatccctgctgctgcaagggtggttgagagcatatggcaccctggtgcattccccttgaatt

SEQ ID NO: 20163 - DNA, 309 bp, Homo sapiens
tacggctgccagaagacggcagaaggggcaaagggccccagttcctctggctggggtgtttgctgggcctaggcgcaagccacgcatccatatgggttcctctgcattgagaactgccgacaggacgtcctcggagtcccaagcaattgtctggtttgtgatggacccatctttcatttcttgattattcagtagcttcgtgtcctagaaaccaagaggaccatttctataaaagaggttggttgaataaagacagcgtgagaatagaggagctcctattcccgaagtcagctgcctgttctgctttca

SEQ ID NO: 20164 - DNA, 574 bp, Homo sapiens
taccattagcttttttattgggtactatcctttgactaaatgcccatgtctatcaaagtgatgacactcaacaagcacaagcacttctctatttattcattcttaccatgtactcattagaattagattaactttaaaaaaaatgtaattgatcctatcataacaacatatacaataggtgagcatatgtactgtttaagcaatatagctaataatcattagaactctatttgtaagccccacaattatagtatctcagtaacatttacatttaccattattttccattagactttcccttattctagcaataaatttcatccatagacacaaaaattgaaatttaaaaattttaaagtctcagtaagtcattcaattccaataccattatacattttatgcttaataattatcaaactctttatagactttgttgtttcaatcgttttaatagtaattacaataatcctttctacacatttttaacacttagagctttatgagcaaagatactaaaatataaaaaatgctaagtgctggccgggcgtggtggctcacacctataatcccagca

SEQ ID NO: 20165 - DNA, 561 bp, Homo sapiens
catgctctctacttcaactatagtaaaacgtccataaatgtttgtttagtaaatgaaagaaagagacacgctctgccccattttctctaagtgtcccaactctctgttccactaccatcttcaagtcttaggaatatgctattcattgtgccagaaatgtctcccagttgctcccaagactgtatttccctttctgtcttacaacgcagcaatagtcacctctttcatggcattttcttaaattacacctccttggtttggctttatagtcactcttaaaaacttgcacggtggctcatgcttgtaatcccagcactttgggaggtcgaggtgggcagatcacctgaggtcaggagttcgagaccagcctgaccaacatggagaaaccccatctctactaaaaatacaaaattagctgggcatggtggcgggcacctgtaatcccagccactcaggaggctgaggctggagaatcgctcgaacccgggaggaggaggttgtggtgagccaagatcgtgccattgcactccagcctgggcaacaagagtgaaactctgtccc

SEQ ID NO: 20166 - DNA, 635 bp, Homo sapiens
tacggctccgagaagactacagaagggaatagtattggtaaaactgtgttaaaatcaaatttttttctgaaaaaatatcactttaaaatgtaatcaatttatgaatcttctccctagaaaactatttaataaaactcttataaaaatatgctttgaattatccaaacctaaagttaaaatgagtcatggaattgtaatggcaatagaaaaattacaatcacattatcagcaaaagctgacagtttgactccctctttaccaatctggatgtccagacagtaactgctgtcttcaagagactcacctaacacataaggaatcacataaacttaaggtaaaggggtggaaaaagatattccatgcaaatggacaccaaaagtgggcaggagtagctattcttatttaagacaaaacaaattttatagcaacaacagttaaaaaagacaaagaaggatattatataaggataaaaggacttttccaacaagaaaatatcacagttctaaatatgtatgcacctaacactggagctcccaaatttataaatttataaaacaattactaccagaccttagaaatgagatagacaacaacacaataatagtgggggacttcaatactccactgacagcact

SEQ ID NO: 20167 - DNA, 517 bp, Homo sapiens
gttgtctgataacagtaatatttttaatgtgttgagtgatatttttaatttgttaggcacatcgcaatcttttacatttatctgcatatatattatttggtcctcactgcatccttgtcaagttgttttggcaggcattattttctattttatctgtgggaacacagacccagcaggtctgtggtggaagagccagttagaaaccaagacctccacttccaacccagctatcctttcattctaacacactccctctggtaaattctagaaacaggcagcaaaacagccaaaaactaaagcagcttactttttcatatgtaatatgtaaatgaatagcaatggcaaatgacaatgggaatgtctattaagaaatatataataagcctggcgcagtggctcactcctgtaaataccagcactttgggaggccgaggcaggcggatcacttgaggtcaggagttcgagaccagcctggccaatatggtgaaaccccgtctctactaaaaatacaaaaatt

SEQ ID NO: 20168 - DNA, 542 bp, Homo sapiens
ccaacccaaacctaatatgagcatggaatttcataactttaacggttcttttaataatgttcaatcagatatgaaattaagaaaacgaggcttgccttctgcccctgctctgcctaagctgacgttttaggcagagtgtgaataatatttcctagttcccatggagcagactgaacaaatgatgtgagaatctcttcagttccaaccaagtggcgggaaccagctaagagttgggtactgctgaggaaaattgatgggcagttggtaaaataggtgtgaatgagagaaagctttgttggggaaccatggtgggtatgtgggcacgttctacattactacaagtattgggaatttcccaggggaacagcaaaatcttgtcttatttatgtttaatttaaaaaaaattcccactgggtgcagtggctcacgcctgtaatcccagcactttgggaggctgaggcaggcagatcacgaggtcaggagatcgagaccatcctggctaacacggtgaaaccccgtctgtactaaaaatacaaaaaatt

SEQ ID NO: 20169 - DNA, 590 bp, Homo sapiens
tcacacagatgatttgcacacttattcttgtccctaggccagttgtttcttccaaaatacccattactcaatcgttcaccctctcgtgaaccacttaggaatcttgttctatgaatcctggagcttcaatatttgacatcttcagaagaacatgaatgctatcctagcctggtagcaataaggtaccatttctcagaaaacacgcacctatgcacacaagcaagcatgtatacacacatgcccgcatcatatctatacaattttacactgtgatagtgagctttctttccctagataacttcgtaattgctttcgctacatagtattgtttaaaatatcaaattataggtgctgggtgtggaggtttgactctagtcaaagcactttgcaggcaaagctgggagaatcgcttgaggtggggagtgtgagaacagcctggaaaacatagcaaaatctaatctctactaaaaataaaacaaaattagttaggcgttgtggggtgcacctatagtctcagctacttaagaggttgaggcaaggattgcttaagaacaggagtttgagatcctatgatactcactcctgcaaca

SEQ ID NO: 20170 - DNA, 571 bp, Homo sapiens
ggaaagggcttttctttccggtttggtgtacttttcttctttctcccaggcatgagtggcctgtagtgtgtgtgcaagacatccagtggtgctcgcttcccactgacttagtggcaactttctgggcagctttctagccagtttgcaccagctgacattccaatgactctttcgggtgcctcagtaggtgcctttccagtgagttccagcgacaccttagtgagtagtttcctagtgaattttgtcaggaccctactgtgctgccagttctagtttgtacctccatgaacttctcggccatccaatgtgccaaactcacatttccaaccaggtctgagtctcatgcttccggccctgttcaaaatgtgtttcttccttaggtactgttccttagccccagaggtagtagctgctctctgtacctgccattcatcattcatggtagagcttgctctgccccttagtaattaatctcctgttactaccgaacaattccttaggttaaatttgccctgttccacttctgtgtgatttctggaccttgactgatatagatctcaagacaaagagc

SEQ ID NO: 20171 - DNA, 530 bp, Homo sapiens
taccagaaagagaacaggaagataagggggaagaaagaaattgtataagtaaagtccaaagagttttcaaattttctaggggaaaaaaaatctatatatatatctatatgtacatatttgagacagaatctcactctgtcacccaagtgggagtgcggtggtgagagctcagcttactgcatcctctgcctcctgggttcaagcaattctcctgcctcagcctcccaagtagctgggattacaggtgtgcaccacgaggcccagctaatttttgtatttttagtagagacagggttttaccatgttggcccacctggtcttgaactcctgacctcaggtaattcacctacctcagcctcccaaagtgttggaattacaggcgtgagccaccacgcctggccaattttctgaaaatattaatctatacatccaagaagctcaatgaattccaagttggattacttaaaggctggtcctcactctaatgtgctactctgcctccaccctaagaaggataaactgaaagagat

SEQ ID NO: 20172 - DNA, 484 bp, Homo sapiens
aggttaataacataacttgccctagactaaacatacacacacatgtcccatatgaacccaggagtttatcatgcaaccttctcattatgacttagctttcacattattattcatgcaggaaaagaatgctagcagtaatatttcttgacatgaattagtaagttggtagtataatttacactttttttggtcttgtgatctgatagtaaaaatcagttcattacatcatcattgggtatttgaattaagtaagttttctcccatccttaagaaaaatacaaaaggccgggcacaatggctcacacctataatcccagcactttgggaggctgaggcgggcagatcacctaaggtcaggagtttgagatcaacctggccaacatggcgaaaccccatctctactaaaaatacaaaaattagctgggcgtggtggtgcacgcttgtaatcccagctactcaggagggtgagacaggagaatcactt

SEQ ID NO: 20173 - DNA, 568 bp, Homo sapiens
cctcaagaagaggaaagatatctttatttttcagtatggacacactgaagataagaaaagctacatttaattactggtaatcagcttggactctggcctgattaccttagctaattacttgggttgaggaggtggaacataattgtagagaaaaaggcaagcaaactttaaaaaatgtctgctggaatgatgattcacttggaaccaaacattgttagagtagaaatctatatttggtagtatctgtttgaaaaaatgggaagagagagggattgtgaacttgtacaactccttttttaatgtctagttaagttgaaggtgcatatatcctttgatccagaaatttcacttctaaatgtagctcagagaaattcttatgtgtagaaatagatgaggacatttagaacagtatttcttgtaatggcaaagcaatcctgtttgtaaataggaaaatgggtatatattgatacaatagaataatgtagtggaaatgttattataaatcctgatatataaaaaaaagaggtcgggtgcagtggctcacgcctgtaatctcagcactttggga

SEQ ID NO: 20174 - DNA, 542 bp, Homo sapiens
cagcctcccaagtagctgggacaacaggcgtgccaccacacctggttaattttttttgtatttttagtagagatgggatttcgccatgctggccaggctggtcttaaactcctgacctcaggtgatctgcccgcctcagcctcccaaagtgctgggattacaggcgtgagccaccgtgcccggcctctggttctagtcatatgatgttctggaaaatgcaggattagggacagggtttgcctgggagtgggagagtttttggggagatggaactgaaatgcgttttgattacggtggcagtcacctgactgtttgcatttgtgaaaactcatagaaatatggccagaggctcatgcctgtaatccccagcactttggaagactgaggcaggagaattgcttgaggctgggagttcaagcctgcggtgagctataattgtgccactgcactctagcctgggtgacagagcgagaccccatctctacaaaaagatttaaaaattagccaggcaccgtggcttgcacttgtattcccagctactc

SEQ ID NO: 20175 - DNA, 537 bp, Homo sapiens
ccataggtctagctatatgaccttgaataagtaacttaacactcctgaacatcagttttattatgttggcacagaatatgagtttaagaactgtgattcattcattcaaataatattcactaacctcatcttcgggtgctggaaagatgccaggtgctgaaggaacaacagtgataatgacatagtccctactctcacagagcatgcagtctggtgcaagagaaaaacacatacagtggccaatgtaagtgactgtgactagtcctttgatgtcagtaccagattggagctgcttgagattctgaccaacatctgaagcaccaatatgcaaaattacttcaaagttatttagaaatgttatgccagatatggtggctcacggctgtaaccctagtactttgggaggccaagacaggaggatcacgtgagctcaggtgcttgagaccagtttggtcaacatggcaaaactccatctctacaaaaaatacaaagattagccaggctagtggcacacgcctgtagccccaactactcggg

SEQ ID NO: 20176 - DNA, 566 bp, Homo sapiens
cccaaagtgctgggattacaggcatgagccaccgcacctggcccttgaacactgtatctaaggataaacagtcttattcacatcagagggggcagaatactaactgactaatttgtggaaatactggagctaaacatagtgcctaacacctcctatgtgtatgaattcccaagtctgaacagggcacaagtgaggagagagaaagggaggggaggaaagagaaagggccaggtgcagggaggagataaacacagacacagagaaagacagagaatggcttatcaaattaaaataagaagaataattataatagttacaatttattaaggtggtcttgtgtatcaggtattttatatataatgttttgtttaatactcacaaaaccctctaagatagaaattattactccagatgagaaaactgagattcagaacagttcatgacaaattcaacagggtctatggctgaaatgggattcagtgtgactccaaacccatgtttttccaaagaggccatactacctcccatgaacacaggtcagacaaacaaacagaaattctcagctg

SEQ ID NO: 20177 - DNA, 365 bp, Homo sapiens
  misc_feature 1: n = A,T,C or G
ngataatcaaggaaaccttttccgggtggggatctctgaaattactcagtgagcaaccctaattaacctgattttttgctgataatcactctcaatggaatcaaatcacaaatccggggatggatttgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggat

SEQ ID NO: 20178 - DNA, 600 bp, Homo sapiens
atagaagtccctgattgcaagtgccactggtattcattgtaccacttaggttttgttaagaaacagaaacggaattactttactaaactgctttatgattacacagatagactctgggagtttgctagcaccttttattttaaattatgaacagggaaaaaacaataaagaaaataaatacaaaaatttagactttttaaaatgacttaagggagaagcaagtcacacaataagtttgagatgcagagcagcgaatcagaacaaatagctgcttacatgaacaaatcagtgggatgtgaaaatgcatcaccgtaacctacatttttttctaccaggagatttgcagctgactatcgggtgactcattcctatgcttagggggtgaggtaatgctattgtgaagggtgatgtcatctctgtacctgaactgcatgcatatattgcttctgtggctctcaaggaaaagctccatctgctttcacatatgcagcctgaaagacttgacaagattggcacaaaggtcagcagccatgtgtatgactcataagcaaccaattagcgaagagcagctatttaaaagtgaacttttaaaatcacaat

SEQ ID NO: 20179 - DNA, 80 bp, Homo sapiens
tttaggtcattcagttaataaattaggcagcacacacctatacatgggataagttgcctacaaaatctaaaagataccct

SEQ ID NO: 20180 - DNA, 586 bp, Homo sapiens
tagtactttcttggatggctttggtcatcttttcactcaataaatacatagagactatgggatccatgccagccagtgggaatcctgatctcatggggttcatgttctagcgagagagacacacacttactaaataaataataaaaagaattacagatggtgacaaaatctctgaagcaataagcaggatgcaggcagtggggaatgggagatatttgaggagggatttcactttagatggaacagctagggagggcctctctgatgtagtacattttcttctgagaatgtgaaggatgagaagcagccagccatcaagtactaatagctaacatcattatttaaaattgttattaaaacataattaatggccaggtgcggtggctcacacctgtaatcccagcactttgggagtccgaggcgggcagatgacctgaggtcaggagttcgagaccatcctggccaacatggtaaaaccctgtctttactaaaaatacaaaaaattagtcaggcgtggtggcaggtgcctgtagtcccagctactcaggaggctgaggcaaggagaatcgggaggcaaggagaatct

SEQ ID NO: 20181 - DNA, 93 bp, Homo sapiens
agacagattacatgacacttgtaggcctgatgccatggatgttatgtttatacaaagtgcaagggcattttctcttctaccaactaaatttat

SEQ ID NO: 20182 - DNA, 557 bp, Homo sapiens
ctgtgactttcttcatattctttgcatcacccagactgacctatttcagtctcctgaaatgggccacgctctcatacaccttcagacttcttttatgagcaactacaggcattcctgtgtactttgctcctctcatagaatttccttcctgtcattttttggtaaacaagctccataaatattatttgtttcagcctagacaacacctcttgggattctagaagaaaccccctttacttcccataggcgtgtactccccacagcacagtatcttcagtaccatcatagcatttatattaccatagtataatttcttcttcatttcttgggaacatgcttaaaggaataaaatgtttgagagcatagtctcttataccattttagacccagaaaacagcacatgactagctgataatagatgtcagcatagaaatattgaataaataaatagggaaaattattttagactgtaacctatcaatgtaagttccatatcaattagaattgatagtaaaatcagaggacataaaagatatagaataaaatatatgcaactt

SEQ ID NO: 20183 - DNA, 614 bp, Homo sapiens
catgcctgtaatcccagcagtttgggaggctgaagtgggtggatctcctgaggtggggagttcgagactagcctgaccaacatggagaaaccccgtctctactaaaaatacaaaattagtcgagtgtggtggtgcatgcctgtattcccagctactcgggaggctgaggcaggagaattgctggaacctaggaggccaaggttgtggtgaactgaaattgcgccgttgcactccagcttgggcaacaagagcaagactccatctgaaaaaaaaatggagtgtgtgtgttagagtgcgtgcatgcatgtgcaagagaaatcgcagtgggaggcagttaattggaacaatatagagaaggggctgctaaggacctgagtattatgtttatatttaacaatttaagataaggctgtgtatgtatggtggctcatacctgtaatcccagcactttgggagggcaaggtgggtggatcatctgaggtcgggagagaccagcctgaccagcatggagaaaccccatgtctactaaaaatacaataattagccgggcatggtggcatatgcctgtaatcccagctacttgggaggctgaggcaggagaatcacttgaacct

SEQ ID NO: 20184 - DNA, 593 bp, Homo sapiens
attttaatgtaaattaaaattggggaaagaaagggaaaacaatacagattccatgcataaggcaaaggttcaattgtgggtttatccgtatgagtagactattattttgtcatttaaaaatcatagtttcagctgggcgtggtggctcacgcatgtaatcccagcactttaggaggctgaggtgggcggatcacctgaggtcagaagatcgagaccagcctgaccggcatggagaaatcctgtctctactaaaaatacaaaaaaattagctgggcgtggtggcgagtgcctgtaatcccagctactcaggaggctgaggcaggagaatcgcttgaatctggggagtggaggttgcggtgagattgcgccattgccctccagcctgggcaacaagagcaaaactccatctcaaaatcaatcaatcaatcagtcaatcaatcatagtttcacgccaggtgcagtggcacggacctgtagacccagttacttgggaccctgagacgagatgattgcttgagcccaggttttccagtctagcctgggaaacatagtgagaccccagtctcttaaaaaaaaatcatattttcaaataa

SEQ ID NO: 20185 - DNA, 365 bp, Homo sapiens
ttagtagagatggggtttcaccatgttggtcaggccggtctcgaactcctaacctcaagtgatccacccacctcggcctcccaaagtgttgggattataggcgtgagccactgcacctggccccatgtctctaactttggatttttaaattgagataatgtggatgcgcctcacacagtatccaccatgtagtaggtggttattagcgttaatttccttcccctggtgtcccatttcttaactatgggtttgtgtatgtattttagctttcatgttcactagcaattttgctattgtacacacgaattacatggaatttctaccctaaaaattctgatagataaaactatatatgaaaaacctag

SEQ ID NO: 20186 - DNA, 453 bp, Homo sapiens
caatgtagctggatgcagaggaggtgtctcaaaagtacataaggattaaacgtctatcctccttccaatggggacagtactgggctagaatttgcctctcaagggaagcttcctcctgactgttgaaagtggagtttttctgtttacaaatagggcatggggtctgaccagagggaatggagttgaggaaatagaggtttggggcaaaggaccaataggaccacccacagagaaaaatctcatttcactagaaagtgtgggagggactaaaatgttaggtaaaaactctgactccaaattattttcaggcagaggttaaaaaaagaggtgtggggcttggtgggctgtcctcacagtaagccttttagcaggaaagaaatgatttgtctcatagaggaacagttttaattcatttggcagtgctgtactcttacatggaggaaaacacaaccc

SEQ ID NO: 20187 - DNA, 291 bp, Homo sapiens
gtaggtcagcaatactcagtcttgacaggcaatgtgcatccttatcccccaggctggggttagggtgctccttctaccctttaaagaatttcatttccagaaaaaagggccaggcgcagtggcttacgcctataatcccagcactttgggaggctgaggcaggcagatcacgaggtcaggagatcgagaaccatcctggctgacacagtgaaaccctgtctctactaaaaaaaaaaaaaaaaaaaaaaaaaaaagggggccgttttttacgtaaatccaaacttgaaaaaa

SEQ ID NO: 20188 - DNA, 449 bp, Homo sapiens
aagcagaaatctcctggcaatttttggataagtttttgtttcctgatttagataccacttctttctcctttttcaccctttctggaacacagacatgagactagagataaagcagctattttacaatcatgaagtgacaaactcaagcatgaaagccaccttgtaaggatagtgaagtggagagataaaggaagcttggggccaggtgcagtggttcatgcctgtaatctcagcacattggaaggctgaggtgggaggatttcttgagcccaggagttggagaccaacctgggcaaaatagcgacaccctgtctctacaaaaaaatacaaaaattagctgagcatggtggttcatgcctgtagtcccagttattcaggaggcttcagtgggaggattgcttgagcccaggaggtcgaggctgcagtgagccatgatcacaccacggcac

SEQ ID NO: 20189 - DNA, 422 bp, Homo sapiens
gtttcctgtaaagagtcttttaaaaagagaaaataacagttttttgaaaaatttttagaagtttctgcacatgaataggcatccctggatgggcctgatctgggagccctcatttttagatgcattttttaaagtgttgagttgttcatctggaatttccacataacggccatcttaattttaaattgtctttggtgatatttcatcatttttgtaattgttttctgcttcctgaacctaatacttatacatgtaaaaggcaagcatagctggaaaatagattacttaattctatagaaatcaaggattttatttttacattgaatctttggtgtcttccagccaagataataccccgagagggaaacaccacacggttgggtcatgtaatgctttcacagtaaacctcattacaggaacat

SEQ ID NO: 20190 - DNA, 572 bp, Homo sapiens
aacctcttaaataggtccgggtcaataaccagaacagaaaacttgcttttggccacatctcttaaggaggggccattactagttaagaagagagttccatattaaataaataaataaatgttctggttgtgggttgtttaattcaaattcctattcagttcatctgataataaactatatttaattcatgatgtaattctgtgttccgtaatggtttttacaaagccccaacttgaaaaaacttttttgggtattgcttattagtggatgcagctgttgagaaggggcaaggttttgactttatgttgtagttcatgttcactgatgcagagaggtgtttataatgtattgtgagtgacttaagcagagcataaaacaccatattatcccattttgtaaaataaaaaaacaggcaaatgaaacactaaacaacattatttattaacattagaaaatttgaaacatcaaaacatacttcagagcaaagaaaatggggaacacctaaatgtttaactataaagcaccagcttaataaattgaggtagatatatatgtagccttgaaatatggct

SEQ ID NO: 20191 - DNA, 471 bp, Homo sapiens
ttgtgtgctattaagttggagtgaaacccacagtaacatgtattaaagcccatgtttaagacatcttggtcatattttattaaagaacgacagctcttaaacatgtacatctttaactggaacttgttgcagttcttagtaatggcaactgattgcttggcattttacaggggtatctattaaaactcttttctaggccaggtgtggtggctcacgcctgtaatcccaacactttgggaggcagaggcgggcaggtcacctgaggtcaggtgttcaagaccagcctggccaacagggtgaaacccagtctctactaaataatacaaaaattagcctggcatggtggtgcgtgcctgtaatcccagctactcagaaggctgaagcagggagaattgcttgaacccgggaggcggaggttgcagtgagccgagattaccccactgcactccagcctgggcgacagagcgagac

SEQ ID NO: 20192 - DNA, 525 bp, Homo sapiens
tttggtacagctgcaacacactcaacggaatgctatactcctaatatatgctgaatattgcctactgattgattctatggaaaaaattaagtattaagtcactcataatgtacaaaatccagagaaagcagaaatcctatggcaatgggtgaactaatgatctcattggtatacacttttgggaactcaactagaaacccttccttagggtcacttacaactgctttccttaggaaataactctaggtctgaaatgcaatcattctaaaatgaccttggatatatggaatagaaataacatcttgagatgttattctaatcaattcattgagaattagttaagtaagaatctgagaagaaggtttttgtgctgcatgttaacagggaaaagaagttaacaagacctaatatttcatcaaaatcattgggccacatctaggaaaggtcaagttcatggtgaactttttctccatcttttaaaagaaaaaatagtaagactcatgccagtgatcccaggactttgag

SEQ ID NO: 20193 - DNA, 511 bp, Homo sapiens
aagattattttaaaatattacagtaaacaataaacataacgactacaataattgaaagtatctccagggaacaggaatctgtgatgggaagggttttagcagaggactgctggttttctttttaaagctatggtactgttggagttttttaactttgtcaatgtttgattacaatattaaaattaaattttaaaaggcaaatcaagatcgtccaatatttagttgtacatcctaatgaatgataccaattttacgcaattctcaggaatcctgctattgcaggaatatattaatacttaggttgtatatctagctcatattgattaaagggacatgcttttactctcagatttcactggaagtgttttagcacgcagaattaaaaatattacctaccatgtcattaaaatttcaagaggaatgttttcaagtcagacagtggggagttttatgggtttttaactcactttctgataatacacacttggctttcgattcacatgtgtcagct

SEQ ID NO: 20194 - DNA, 583 bp, Homo sapiens
gaatattaattgtcagaaaacaaaaatgaaatacagaaatagcttgattatttacagcttggctcagcatttgccacatttgcacatggtctgaccagttaacagactatgattggcttaagcttagctactatgattggctaagactaagccacaagttacaaaatatactcttaatttaattgcagtctgtttacacactatgttaggttaaggatgtaagtacagaggcagctttaacaatctaatttaacaatattatctaatttaacaatattatccagtggcatagaaagaataatgtgactttaggtttttactaaataaataaatgtagaaatatcctaatagaggacacagtggccaaagtatactccaaaaacatacaagtcataataagatttaagtgagattttaatgacaggtttttaaaaaattgtcttaagaataaatcattcaaaccatggtaaaatagttgacaatcgggaggctgaggcaggagaatggcatgaacccaggaggcagagcttccagtgagctgagatgcgccactgcactccagcctgggcgacagagcgagact

SEQ ID NO: 20195 - DNA, 507 bp, Homo sapiens
agtatatgaatgtgtatatatacataggtaaatagagaagcatagactaggtactaatgaaagatatcttactctaagggtaaggacataaaggctaaaatatcttctcaatttttgactactttttatttttatgtctcttgattataagtttctttacatattatcacactcttcaaattcattttatacatttttttaaagtcctctttctgtcacctatacagactcttctgctcaacaactctaagaaatagacaaggtgctgtttttttgtttattttcattattttctaggaaatgtttaggtattttagtgaattcaaggttttaagcatcacatctgcatatatagctccaaccttacttaagagcagagatgcacaattcaattggattgaaccaaattctaaactctaaagctggccgggtggggtggttcacgcctgtaatcccagcactttgggaggctgaggtaggtggatcacctgaggtcagaagtttgag

SEQ ID NO: 20196 - DNA, 519 bp, Homo sapiens
gatattttattgtaactatctatggagggtaaaatgggaaggaaattaggtgcttcctctatattcattactcatgcgtgtttattaaaatttagttatataaatgagaacttgacacattaacaagtagttatatggctgttaactcaatttctctttaaagacttgagaaaataagggaaaaatgaaagttaaaaagaagaccctatttattgaactacagccatttcattctcatgaaaatggtatgttcatggccaatgcagttaatttactggtgaacaaaagtagtccaaactagttcattgaaataatatagtgcaaatccactgacctcagaaataacctcagaaacttatatctaagcttaaaaggggcccgttgtctgggcgcggtggctcatgcctgtaatcccagcactttgggaggtcaaggcgggtggatcgcctgaggtcaggtgtttgagactagcctggccaacatagtgaaaccctatctctactaaaaatacaaagaaac

SEQ ID NO: 20197 - DNA, 108 bp, Homo sapiens
ttagttttggactgatgatcttggacattttaatctgcctgtatgctaacttcaaccatctctcatttacaagaactatttaggaaaaatattgaatccacctggctg

SEQ ID NO: 20198 - DNA, 636 bp, Homo sapiens
caacaaatggtttcatcctccactgttggccactggttgagtcaccgaattgatcacagtctgcaaagtggagatttttctctcatccattagggctatttggttaccatgaaaaacagtttctactggaaaagcaggaaatttgcttatttccttacttttctccttttaattagcatttatcagaataatgagttggttgcacatgcttgtcttgacaaattaaagtcaaagggtccagtccctccacagtgacagatgcccaatggccttggtggcttccacccacgtagaatgggctagacagatggtaaatcatgtttgttgaccacaatgcaaatttacagaatcacccaaattccagctgcttaattaagtacagctgcctctacaggctaaagtctgaagacaatttaggtaatagcagattcacctcagcaaaaaagtaagccaaaaacactgacctgaaattagcaagtttcaaaactggattcatacaagctttttatgaggtgaacttcagtttctgattagcagcagcaatatgaactttcatctggcacataccattaggaaatatttactccataatctgttacagaagatctaccagtcaaaacaagtaacacttacttt

SEQ ID NO: 20199 - DNA, 515 bp, Homo sapiens
cctccattcataatttatgttgaaaataactcaagttatttgatagttttatatattttctaatagttttaattgaaaattatacttaaactaggaaaaaatatacacacacaaccaaaagactttattaaataatttatgagatttatttttcagttgtcatattttaattttccatgtgactttaactattaacagttcttctttttaataatgagtaatacatagaccaatgaatacaacttctaagaacttaagaggtactgcatatattagaaatgctctgcaagcaaagttaaatttccttttaattataaacctattatgattggaagggatattagagattactgagttcaaactcctcatttgacagatgaggcacaaatgcccacacaggctcagtcatttgcctataataagccacaagcagccaggtacagtggctcacgcctgtaatcccagcacttttgtgtggctgaagcaggcagatcatctgaggtcaggagttcgag

SEQ ID NO: 20200 - DNA, 407 bp, Homo sapiens
acatctaggaccctgctctggtatcaccatgtctcgattcctccttctctatatgccaaagcttccatggaatttttaaagggcagaactattgtctctttgtctttgaggcacaaagacttaaggccactaactttcagtacatggtggagagagggaagacctggatgggttaaaataaaggaagaaactagaaaatgtccagaatttagctttgggtaaaataacaggtttttaccgtagcctctttggattggtaaatgacagaatccaatgaaagcaatgtgaaacaaatgaccagagcaagtaattcattttaaaatattaaagcttatttctttttttttctgactctggaaaacttttctctgatggaaatgacccctggcaacagtgacattctgaca

SEQ ID NO: 20201 - DNA, 628 bp, Homo sapiens
tcatttcagatgttttacttgaattcctttacacctattcagaaccactctttccatcttattcactcttttaaaaattttgaacacaaaattgaaagttgcatgatataataataatacttaaattacatatttcagaaaacctatgatttagccagtatttatgaggaaggtagcattggcttaaatctcaatagcagggcttaacttagatttacttatttacttataaacaccctgagttctttcacaaagaaattgtgagagcttacaaaaataaacataaaaaagataaaacaaacaagtgacagaaacagagtaaaggggatagaagggtcatactataataaagcccttgatgtacagaagtataaacatatgtgttatgtacacactgtagttattaagggtaggtcacatatttggcctcaaagcttttagcagtgaaagcaaaaaggaaactagtatcagttacaagaaccagggttcctaagacttgaaaatgagaacgaaatagaaaactgtaattcaggaaaaaaaatataccccaaactaaaaatctgagaaatttccctcatggcttctataaaaaggtattggataatgtaatagaaagctccctacagta

SEQ ID NO: 20202 - DNA, 559 bp, Homo sapiens
aacttttcttcctctcctcacagaactttcactttaattggtaagtgttaaatatctttggatctccctttcaccatctgtaaaatagctacttttcaaggttgctagtgagatttataaataataatgtagggggtatatctcttatttttaaactagctttctttataaacataaaatatttataaaactaaaggttggaaaacacttgtatagtacttaagaggacaaaatgatattcatgtttctgtgttgaaacaggttacttttatgttaggttaagacaatcccagttgggttatgtttccaagcaatttcacccctaaaatgtataaacaaagtgtttcacttttcacctgaaatgtcacttctaccattaaatgccccttcctttcaaaagaactttcatgatgtagttgaaagtgatgggtcgggtgtggtggctcacgcctataatcccagcactttgggaggccgaggcaggcgtatcacctgaggtcaggagttcgagatcaccctggctaacacggcgaaacccgctctctactaaaaacacaaa

SEQ ID NO: 20203 - DNA, 650 bp, Homo sapiens
tgacttactttaaaaacaagagattgcaggaaagggagactcaaggcactgcagaactcatttttgtgatattgtatatgggcagctgtgcctttctgtgttttctagtttattttgtgtgataacagtgcccaatagcactttattttttattgtggtggcatgtgcagtttctttggggagcaaaccgtcctgacctttggatttccttttctgggtcttaattgacaattcagagttcactgttaaattgtcagagtttggattgctttttctcttatctttcctattttaaagtttatcttgcctctcttttttttttcttcctgtcaccaacaaagggagatcgttctcaagctcattgctatcagcttatcattgcctcattcagaagagcttggcattttttgtaagtgtttgggaaatctgagacagaagtgtcaactggattttaccagtctgtcaaacaccggagctctctggctctgtggaaaccccttaatgtaaccttttagttcctatggctcctcagatgaggtccaagactgttccacactgggggttgcggggaggggggttactgaaagaggaaactgctgtaacaatttcagctttaaaaaatattcacatacaactcaatagcaaaaaaa

SEQ ID NO: 20204 - DNA, 295 bp, Homo sapiens
gtttctccaagtctccaggttcatgatgcatatcatcatcatttccaaatctcagagtttcctcaagagagggcaaccacatttgtaactgtcttctttctgtcaattaagtgtgtgtattaattactagggctaggtcttttcattcctttgcacgttttaagcaggaatagatgaggcaaagcccatttgtaggttattttttagtttaactatgttaaattaaactatgttggtcaggctggtctcaaattcccgacctcgtgatccacccaccttggtcaaccaaagtgct

SEQ ID NO: 20205 - DNA, 541 bp, Homo sapiens
agcttattctcaacagcttctcctttttcatttggttaatgtcaaatatgagtcttagacagcttattctaatgctcaacagcttattctgacttttccaagatgaagatgaagagcaggccagtggcatgggccagatgcagtcagatgactgactgaccaggagggcctccgtccagtgaccagtctcagaatttaaaggacccttcccccttacttatgcttgtactcagcccaggtgagttaccagccatttctctcataaagggagtttaagcaattctggaaagagtaagccttttttgtttatgaaagttgcatctgaggtagccttgtctcctggaaatccccaggccaaggttggaaatccccaagccagtctgtatcacattgctaagtgacacttagtgtcacccctactctgtgacatactgctacgtgacatgtagtatcagcaagatgcctgaataagccttatggctatcattaatcttataaccagggtatgtctcttatagtatactacaagatgaaataaact

SEQ ID NO: 20206 - DNA, 518 bp, Homo sapiens
gtgaacataaaaacccaatcattatgcttatctattacaaaaggatcaagtttaggctcttaaaagctcccaaatcaacttgatcaaaaacaataaaagattactgtttagtttttcaaatatctgagctactaagaaacatattttggcactacatgagttattctatactaattattgtgagcctataaagctcagtaaaaatttttaattttcttgcagaccagcaaaatttggttatttgacatcacttcaatcactgacaagcagggccataaaagatgtgtgattaatgctctaataggtgatctgtcttctcctaaagtagacaaccagtagaggctgtaaatatcacagaatgtctttgcttcaaaacaactgttataccttaggaaaacacctaaaggaattgcgttcaacagttttccaaatgcttgtcgaatacaagttccacggtgcactagttggacacggcaaacatcaacacatctatgaaagaacgaaatagacaaagcagg

SEQ ID NO: 20207 - DNA, 290 bp, Homo sapiens
gtttctccaagtctccaggttcatgatgcatatcatcatcatttccaaatctcagagtttcctcaagagagggcaaccacatttgtaactgtcttctttctgtcaattaagtgtgtgtattaattactagggctaggtcttttcattcctttgcacgttttaagcaggaatgagatgaggcaaagcccatttgtaggttattttttagtttaactatgttaaattaaactatgttggtcaggctggtctcaaattcccgacctcgtgatccacccaccttggtcaaccaa

SEQ ID NO: 20208 - DNA, 249 bp, Homo sapiens
tgaggtctaagaaggtcgggaattcagagctcccaggtccgctccccatggaatcaagatgtgtcaccatctaaacatatgcatgtgttcaagcaggaggcacacctcagctatgtgtctggaggttttatgtggacaaatattgacctaattgaaacattgggcatgtgaccgaattcaatctccagctccgctcttctctgtggagaaatttgaggtgataccacctggctcacacatggtctttct

SEQ ID NO: 20209 - DNA, 596 bp, Homo sapiens
aagagagacacagtaaatcatggctaatgagattattcagatgtaatagtccaagtaaatgtttgatggtgtccatcaataaggcaacaagcaatggtggcaactgtgacaaactggaaccaacgccaatccaaatccaaaattttaacactatgctgaccaaataaaaatgccacagcctttcatattttaagtaaatatcacaacataagattttcatcagaaaacttgtctccaatttttagagccttttgttaatcttgccactaccttagcaggactttagtgttccagatatgagactgctagttttaagtcaaataattatttattcttatgcctgcctctcaactgtgttgatcaaattcataaaaccaatcttagtcttaaattccttacttcacttccttgtcttcacttcctctgggacctagtctatcatgctgcagccttgacaacttgccaagacaaaaagttgagagttacgatagtaggaagaagagctacagagaatagaaaataataataataaaaatgcatgtgatttctggcctgagacaactatcagtatatcaggagaacatgacacgctctga

SEQ ID NO: 20210 - DNA, 501 bp, Homo sapiens
ggacagaagttatttgcatctctaccagacaaaaataatttgcaaacataccaattttaacttagtttgatatctatctttgcagaagctgagtcttcattcatagtaaatagcgtaagttaagcaaaacttacatatccctaaaaaattatattcccagaaagtaaggacctaagctgacaacatagctgccctgggcaggtggggggcacaggtagaggaatatagaatcgccagtgttggttaacttggatttcaaaaccatgtgagaatgagggtgagacatggggaccacttgtggggtggaagaagttggaactgagaccctaccttaatcagggatccttgacaggcctcaccatcattgaaaggatggacgagataaaaaatctactttctagcacagggattcgatagggaatttatttttctatctcagcctggcatctgtaaggaaatttgtaaccaccattcaaattcattttcgcagtgtcactcagt

SEQ ID NO: 20211 - DNA, 577 bp, Homo sapiens
tgcctggccaaattgtaagactcttataatggatgagtagaatatatttaagattatataaaaacacaagtcacttcatgatcatcgtctgctggaacatgaaaccagctttcttgtgtagatgtgtgatcagtaatgttattcacaccgagaggatcattctgtggtttttaattcatgattttgtaatctgatagtgacttttcattatgtctcctgatttataattacatcacagccattatgattggaatcattgggaagagttgaaatgagcaatttagaattgtttctgaaatacagaaagccttattttttggtgggggttgttggaggagatatgtctgtgttctgtaatttcatttgactaaggaatttatctttggtcttctcccagagtgaggacatcgatacttccatagctatattccgtattaatcacagtttgctttgtgggtttcattaggctaaataagaaaaacgtcgttatgtattttctgctttaaaaaatgcttcttgatataaagtcttctcagatcagtcccacatgtgataaatctattcaaactattaaact

SEQ ID NO: 20212 - DNA, 526 bp, Homo sapiens
tgtttactcaagagaaacttgtaagtttgcaccaagagacatgtacaggagtgttctgatgtactgtttgtaatagcaaaagtctagaaacaacccaaatgtccactgattgtagatgaatcactatgtggattgtggataaattgtagtatattcagtagtgaaatatcacatagtagtaaaaaaatagtaataaactatggctatatgtacatgtataaccttagaaatgtaacaatgttatttgtagaaagcatttcccagaagactaaaatgttacgatgtaattatattcagaaggaaaaggaaagaatgtgttgtttaggcatgtgtaaatgtgttaggggtgggcacagtggctcactcttataatcccagcactttagggggccgaggtgagaggaacaagtactcggaggccaggagtttgagatcagcctgagcaacatattgagccctcatctctactaaaagttaaaaaaattagccaggtatggaggtgtacatctgtagtctcagctactca

SEQ ID NO: 20213 - DNA, 455 bp, Homo sapiens
acaacttggcctttgttgacactgacatttcatctgaacagtaatcactattcatttacttagggaaaacatctggaggattgtttttgtttttcttcagttttcatctggatgtctggcattgtgtcaaggttttactctgagaagctttaaaaagcgagtccagttagtgtgttacttcctctccactttgtaataatacactagagtcttgctcaaatgccacccctgggatgcatgctaggaaccatgttatagaggaaagagcaggataaattccttctgatgttcatcgcacaacagtaaattccctcgtaaacctaaaccaatggcccactttagaaatcatcctgggccttacgttgtcacattacaatgagattctaatgtgcaggagaccctgggtatccttggatttaactgtcacagtttcttctacttgctaattacccatg

SEQ ID NO: 20214 - DNA, 539 bp, Homo sapiens
atgttggccaggctggtctcgatctcctgacctcacgtgatccacccacctctgcctcccaaagtgctgggagtacaggcatgagccaccacgcccagtcaacatttatatttcaagaaatgttgataactactttctgaatatttgtaagacacccttgtggtaatacatacttaaaactaaattgttcattgatgttccctaaatgagtctgttccttaatgacccatcaccaattcatgatgaacttcaacaaagcttccaaaagtctcacaattcacttcagcgttgggagcacttgaagaaagtagccagcagatatcaggtatatgccacttaaatctgtattacagatataataatgcaattcttaattaaattgattgctttgcctagtcagttacagatggttggagatcgtttttttaactttctttaaagaaatcttcaacagttcctactgatccccatgttggccttgtatctgcttttagaataacatcaaaaatgacaaatatggaccctggctggagtgggag

SEQ ID NO: 20215 - DNA, 164 bp, Homo sapiens
cggaagttagctaaatatatgagagaaggctctgaaaagcaagtacacaaaaataatgttgagatgtgtcaccatgaagattaggaggctactgccaaacaggtaatttaccatttgtatattgtagatggagaaagaagtagggaatcataaaaattatagat

SEQ ID NO: 20216 - DNA, 592 bp, Homo sapiens
attttagcaagagggacgaaggggagaatgggcttgcagaatttgcagtgaaattttctcatgtttcctctgtgatggtttatattttctttacaaagaatttatctgtggtctggtatagttatcaggaatggtagagatgggcaaatagcacgaggggtaggcatctaaaatgaaaacatttgttcagcagttatcccatgccaggtactcaactaagagccttttacatccatcattccattcgttgctctcattaacactatgaggtgtatattctttcatgatgcctgtaacagtttcctagggccataggaaaataaccaaataccacagactaggggacttaaataacagaaatgtattttctcccagttctggaggctggtggtccaagagcaggtgtggacaggctggtttctcctgaggcctttctccttggtctgtgggtggctgccctctgcgcatgcacatccctggcatctctctgtgtgcttaatctcctctcctttaaggatacccgtcagactgaatcagctaatcacctctttattattaacttaatcacctctttaaatacagtcacattctg

SEQ ID NO: 20217 - DNA, 537 bp, Homo sapiens
gtcaagtaagttagactacagaaagcatatgttaatctactaggttgttgtatgaaaatcatttaacaaacagtacttttctttgttctcatcttttagtataggaactacttacataatttgtgcaactatggggatattcatacggtttttcttttttggtgagttacattaattgattcttgaatgctaaaccaatctacaattcctgggattcactttagttggtcaaaatgtataaaactttttctgtattgttggacttgattcactgaaattctgttaaggatttttgcatttatgttcattagagatattagttggtgggttttggctaatggttctgatatcgagacaatgctggtctcatgaaatgagctggaaattgtttccttctcttctcgtttctagaataatttttataagtttggttttatgtcttccttagatgtttactagcattcatcagtgaatccatctagacctggaatttcctttactggaaaatatttaatttttaactataaattatatttg

SEQ ID NO: 20218 - DNA, 556 bp, Homo sapiens
tggtgtgttatgtaatatttgcaagttccaacttgggaagttgaactttactgaactttaaaatgtagcaactacgtatggctgtattttaaagctatagtaacaactgagcatgttttcttgtgttttgtttttcaaaatgtattctgtgggataaagttgccactgagattttcaggtctctacaatgattaatttgaaaattttacatatggattttaaccattttttaaactgtaattagaatccactgtcaaatgtgttacagaaagtttagcccgttgagagatccccttcatactaacttgcaggttcactcagtttgggggcatgctttggggaacaaccttcttctgccatttacctttaatttaaaattgtgggccaggcacagtggcttacccctgtaatgccagcactttgggaggacgaggcaggtggatcacttgaggtcaggagttcgagaccagcctggccaacatggtgaaacccagtctctactaaaaatacaaaaaatagccaggcattggtggcgcacacctgtaatcccagctac

SEQ ID NO: 20219 - DNA, 553 bp, Homo sapiens
gatgatagtgaccagcagagggcagaggccccaggctcaacagccttattaaaaatacaggacaggggaggggaaagaaactcattcattaattctagccgtatttattaagctttcatgatgtgccaggcactgagctagatgctgggagagactgttttcattccagcgtcacgacatgaaacagaaggctttctgttttcattaaaacatgacggtttcattaaaacatattctggtggtgtcgacagggatatgcacacacacacacgccacacacacatatgtacatgtatatcattatataaatttatgttttatatgcaatataagcaacatttaattgtgcgtgaataacatatgtccagatggtgatgagcacgctcagaatcaaatcaagcaggacgaggagaggtccaggctggcaggggccagcgctttagcctccgaggccagggagggcagtgtggggcggacacacacgtgacgagaaaggcgccacaggctgggatctgagggaggctgtttcaggcaggagaaagagccagggcag

SEQ ID NO: 20220 - DNA, 468 bp, Homo sapiens
aggagaaatgctttggagattaaaacgtaaaggagataaccaaattttactaaacctctatccatcatgaccacatttcctttcattctaaaataacaatattttggaaatgttgaccccctgcccaccatttttgcctgagaagttttaaatgcgaagaacttgctcctcacttttgaagcacggtgttttctttaggaaccaatctgtatcacatgcattctattggtttgtattttattacatatcattctattacattttaaaatgcatttctgagcccatgtcattgatttcatgattcattaatgggttgcaagcagcagctggaataacactggcttaggtaatggcagtatagatgccacatggcagtgtgttacttaaaccatatatcaatcaacacagaagcgacataaccaaaatgtttttaccatcatttatagaagattatgagtttcatgcagc

SEQ ID NO: 20221 - DNA, 301 bp, Homo sapiens
attagaattttgcatctatgttatcaacccaaatatcatcactgattgtgttgctcgatgtggatgactataaacaggcccagcctcattctgttgtccaggctgtagtgcagtctgctcctctgcctcctgggctcaaacgatcctcccgcctcagccctccaagtagctaggaccacaggggcatgtcaccacacccagctaatttttgtatttttagtagagaaggagtttcaccatgttgcccaggctggtcttcacctcctgagctcaagtgatcacctgcctcggcctcccaaag

SEQ ID NO: 20222 - DNA, 510 bp, Homo sapiens
aacacctcatcgattctacttgttattgttttccatctttggttttattctgtttagcagaactgggtattctccctagttcttctaattttgacccttagtaattcaaaccttgatttagcaaaattgactcttacttttatgtccttgactttattcctgcgactaaatattctgtccctagattcagttttatgtttctggtaacttgaccttgattacggatgttgaacttgatcctgattctgatcatttggatggccactccattcacctcaatgtatgttaatgcaagcaaaaaggcttgccaacataaccactatatgaattaaaatgactactttattacccaagatgatttaaagagaaaaatataacaaatatcaagggtttatcaaagaaggatgaattctggaaaacatgaggtgggcggatcacaaggtcaggagttcgaaagcagcctggccaacatggtgaaaccccatctctacttaaaaaatacaaaaatta

SEQ ID NO: 20223 - DNA, 529 bp, Homo sapiens
aggtagaaacaccttaggagtaaactagaaccatggggctgggacttagaatcactctagaaaggtaaatgtaggcattgtctatgcagagacagtaactgaatcaaaggaaatagatgagattacccatggaaactcagtagcataagtggggaaaggtctaggattaagccctaagtaactagtatttaaacttaaaggtactacagattctacaaagatgactatgaaggatagctggagatataagaggaaaagtagaatcggatggaagagatgacaaaggtcaagctgtggtggtggggtgaaggttcaaaaagtagtgagagatcaacactatttgatatgttgaaaagtcaagatgagatttggaagataaaaggattttcattaaaatggaggagtcctgaggatgtgtaaatattgatggaaagaagccagtaggaaaaaaaggataaaatcagacaaaaataactgctaacctcaggttcctaaaccagtgttttttggtgggaggggaaagggaaag

SEQ ID NO: 20224 - DNA, 598 bp, Homo sapiens
aaggctattataatcaaaacagcatgcaaatagatacagcaaacaatagaatgatagaaaacttaagagtaacctaatatgttaacactcagtaaaaatgacttcactgtttgtcttacgaatgccaacacatcatgtcttgaactggatttaatatcaagacctaccagacagtgtttcatatattttgaaagttccattttattggtaaattatattctacggaatgtatcaaatcttttaacattgggagagataacattttcatactatgagagaaaattttcaaaatagttattttctaaaaattactgtttttgtttactcacaagaaaccccaaatgtccaaaattcaatcattgagaacacttaaaactctaacacagtaatagcaaacctacactaaataatatgaatctgctttcagagtggttggctgctaagaaaattagtaagtttagtcaaaaatttaaaacatacccatgaatataagcattgattttggtacaaacaagtgataattaaatgtgtttagagaaaagtcagagctgatcacaagattatttgaattgaaaatactcaacagtaccttgaatta

SEQ ID NO: 20225 - DNA, 513 bp, Homo sapiens
aagatcataggatttatggagtccctgaaacctaccatttgaccgcagattatttcatttcttccgagaataatatgaagacgtgatttaatgacatggtactaatttttaatattttaaatctatctgtcttctgcagtgtaacttagatgcgccttctttaagaagatgttttattagagcattcatatttgcgaaacgttgtatgagttcacttggttatgatgtgaacattcatgaagtataggcctcttttatacagcagtccctttgtacctgaggagaagtggataccaaaatccatggatgctcaattcccttacataaaatggttcagtatgtgcatataacctacacacatcctcccatatagtttaaatcatctctaagtttcttacctaatacaaagtaaatgctgtttaaacagttgttatactttattgtttagggaatagtgacaagaagaaaaaaggtttgtacatgtctaatacagatgcacgtgtctttttttat

SEQ ID NO: 20226 - DNA, 464 bp, Homo sapiens
atttctttaaaaaggcaatttattttattatttttttcaaacccagcacagaatattaacaaagtagataatacataggatggatatggaatgatttgcttggatcactccaagcaaggcatctgaactattcacatggttgtgtttggaagctcccagggtctaaacgctgtaagatttcggagatttataccagatcagactcacaaatatttgattttcctcatttttcaagattttttcccctctggcctttcatttattcatttagtcttcagtagagagaccaggggatggcttggatttaggggcttaaccacctccatcttcatcagctccattcagctgaagctgttgctgttcttctgaaaagatcccaggagcttcccaatacatatgcaatctctgtaaaagcagtgtgtttgcaaacacagctgcaagaaaagcctcctacagcaagtata

SEQ ID NO: 20227 - DNA, 110 bp, Homo sapiens
acctcacatcatgcaccaaaatgatttccatgttcattgcagatctaaatgagaaagatgaaacaatgaaattttcagaggaaaacagaaaaatatcttcaagactagct

SEQ ID NO: 20228 - DNA, 588 bp, Homo sapiens
ttcccttttatatccccagcatgaaaaacagtgactggcacagaatagacattccatcaatatctgcttaatgaatgaatgcaccctgaagtacatattaaaattaaaatttaagtagagatgtttaaaattggtgatatagttactccttttctatgggaacacatctctgaaataatacagtggaaaaataatacaatatatcaaagtttgagagcaatagttctatgaatttaatttgtaaaaagaaaactagcatttattagcttttattgaccataggcaaattattcacagtaattttaacttcagaattgcacatgtcctgagcacaactctgtggccattgccttctagcagtattttatgtgcactcatagattacaaactgaaaccaacgtcagcctatcattagataaaatgtaccctatatcccaatgtatcatctgtggtttatgtgttttctaggccaagacagtatctttggaataagaaatacctagatgtgctgggcgcggtagctcatgcctgtaatcccagcactttgggaggctgaggcaggtggatcgcctgaggtcaagagtttga

SEQ ID NO: 20229 - DNA, 573 bp, Homo sapiens
gagcgcatggacccccgagaccttcccacctgagatgaggagaaacccacgatgtgatctccttccctagatgctggaggcattagagctaagtcatgtgttaagaacagggccgggcgcggcagctcacgcctgtaatcccagcactttgagaggccgaggagggcggaccacctgaggtcgggagttcgagacaagcctggccaacatggtgaaaccccgtctctactaaaaatacaaaaattagctgggcgtggtggtgggtgcctgtaatcccagctacttgggaggctgaggcaggagaatcacttgaacccaagaggcagaggttacagtgagctaagatcacaccactgcactccagcctaggtgaaacagcgagactcagtcccaaaaaaaaaaacagaacaagtttgggcccacatacccaaaagcctgccttccccgtgttccttcggtaattaattgtcccactttaaagtcgaagctatgaagacccagcaagattacctgggcggatcacacagagtctgtgccaacaagagcctggcccagggagaccacttcctgcat

SEQ ID NO: 20230 - DNA, 533 bp, Homo sapiens
taatgcaaaaagccaccttttgatcagaaagcactgggcacggcctttcaagtttttctacacttctttccacattagccaaatgagcccgtgctctaaagatctgtagttaatgccgattctattttccatttttattctatgttttatttgtccatagcatctaggaaaacactcatttttttcccccatagtcctcaatgtcaatcttaatttttctggcttagtccctccaaagaatgaaattgttccttggacaagtaaaagaaaattctagaaaataaaattgtcaaagaagaattataattttctaaaatagaaaaagagaaactacattgtgagctttttttccacagatgttataaattttgttgggaggaaatgcataattattagaatcttaacaaatatcaccctattcgttctgcagcaaagaacagagctccatgggaggaaataatttggattatctacagtaaggttgggagatctaggaagaaggacctaggaagaggccaccactcccagcctct

SEQ ID NO: 20231 - DNA, 535 bp, Homo sapiens
ccaagtgtgtttatttgcacaataaacatggtactttacattctgaaagctctaacattcgcaaagcactcatgagctcatacgaaggagacaggtgagtatccatgcttccatctcgcaaatgtcatgttacaaagcaggaaagcaggacaggtgagatgataaactctgtttttgtttgtttggtgggttgtttttgtttctgtttattcaccacaccagagtagacaaactaatgtctccaatctccatataacttcctcttggttcagtgagcagttaattaaaataatttcctactaactccaatttggagaacctcagctctaggctggatgaaaggcaactgatgcctaaatgcagtccaacactggtgcccttttactccttcaagtactgaaataaagagtccatttcactaataagctgatgagttaaatgctagctggacccagacaggtgtgtttacccctgcttcttgaaacagaaacaaatgtgacatgtgacttccctaaaccaaacgtttaaatttgag

SEQ ID NO: 20232 - DNA, 503 bp, Homo sapiens
tatccttttctcaagcgtgtcttcttttggcttttcttttcacttgctattctttcggtcacttagtcaccatacttttaattagcatcaactacacgccagacactgtattctgcagaggggccagaaaggttcctaaccacagcagtgtaaggagaaatgatacattaacctagtcactcagtacaacatgcagggatggaaaaggatgaaataaattctctgggaatacactggcctctctatttgcctttcttttctcagtttttgctgtaagtctttttcagtgatgagtatcagatgtgttacattgaaagttttagtcttttttcttgccctacccagttttagtctttattatgaacctttagtaatcttagtcttatttccaatctccactctaaagtcttcaacatctgacataatttacttgagaagctttgggtgaaaatatctatatagacttacagagttcaagaaattgaaataattgacagtaatta

SEQ ID NO: 20233 - DNA, 501 bp, Homo sapiens
cggtgatgcttgtagaagatcattttggagcaaactatatcttgttcaccatctattccctttgtccatgacatgtcctggcatgtggtagatacttgatcaatatttctagaataaatgaaatgctactttacattcaaaaatttgttttaaaaatggatgaacacatttggaatattccagaagaaatacggaatgaaaatacacataagccaggctagaatgctcatgaggaagccaactctgatccctcctctcctatccaaccacgagtatttactccatctctgaaatccactgtggctttgctagcattccaattaaggcgcctttctgacaataatgcatttgtgttcataagtgggcatcatagcttcacaatttccttagcatctggcacaaagaagaaactcaagaaattatatcacttcctaataaaattgcttccaggcaagttgaatttgtggatgacatataaaactccatcacagcaggacactc

SEQ ID NO: 20234 - DNA, 515 bp, Homo sapiens
agtgaaagcagaaactgggtgggcccagcaatctgtattaacaagcccttcaggtgattctgatgcacactactgttccagaagcactaatttccagagttggctttcttggaggggaagtcgagaaagcctaaattacttttttctatgtaagagaatttatgatgtttaacatttggtgtgtgacaataagtgtttttgctgatttttattaatcagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagagggtaagtttcaaggtctgttttactaaaagatgggaagtgtggattagctggtgtttggtgtgtgtgctgtattactaagaaggcaaggttcatgcccagagtatgtatgttttaatgaatcctcatggtagcaatttttaaaaatatcttgaact

SEQ ID NO: 20235 - DNA, 588 bp, Homo sapiens
ccccatcacccaaataaaagcatattcctgtttatgaaatggttaaggccaagcgcggtggctcacgcctgtaatccccggactttgggggctgaggaggactgttcacgaggtcaggagttcaagaccagcctggccaacatggtgaaaccctgtctctactaaaaatacaaaaattagccaggcgtggtggcgggcacctgtaatcccagctactcgggaggctgaggctggagaatcgtttgaacccaggaggcgaagtttgcactgagccaaagccatgccactgcacttcagcctgggcgacagagtgagacactgtctcaaaaacaaaaaacaaacaaacaaaagaaatggttaagaattcaggctctgaagtcagaggcctaaattaacagccacgttctgtcactttccactatgtctcctctctaccatcttactgatgaaaatctgaggcctggaacagataaatgtcttagatataataaaagcactgtttgagtggattgttgcaaggattacggaagtgggaactgtcaaaggaaaacatcttttcatttttttatttacaaagtactatcacct

SEQ ID NO: 20236 - DNA, 505 bp, Homo sapiens
acaacttggcctttgttgacactgacatttcatctgaacagtaatcactattcatttacttagggaaaacatctggaggattgtttttgtttttcttcagttttcatctggatgtctggcattgtgtcaaggttttactctgagaagctttaaaaagcgagtccagttagtgtgttacttcctctccactttgtaataatacactagagtcttgctcaaatgccacccctgggatgcatgctaggaaccatgttatagaggaaagagcaggataaattccttctgatgttcattcacaacagtaaattccctcgtaaacctaaaccaatggcccactttagaaatcatcctgggccttactttgtcacattacaatgagattctaatgtgcaggagaccctgggtatccttggatttaactgtcacagtttcttctacttgctaattacccatgggaacacagtgggtgatcacttgtcatttttgttgcaatacatatttgagt

SEQ ID NO: 20237 - DNA, 432 bp, Homo sapiens
ttggaagatcatgatcagcccaaaggaatagaccagtggatatgtcatgaggagcttttctgggaaaacttctcgacctgattgccctgtctggaagccacagttgacaattattacctaagaacctgaagcttactggaaacgtttattgtattgctcttgaacacaaacagataaccaacaatcacgagattctaggtacagccaataacaaacacagaaacaaaaaataaacaaaacaactgaaagtaaacagagtctatacagtgtgggaaaaaagtaattattaatttcctcagagagggaagataatacaacaagaacaagggtgtgatataaaatggatattcaaaaaaatagaattcttaaaaattaagaaatttattgcagaaatatataacttaatgggagatttggaaggtaaagctgact

SEQ ID NO: 20238 - DNA, 490 bp, Homo sapiens
gatggtaacactgggaatcctatgaaagattgtcgaagtgctaggagtaaataaatccagaataagcaggtctcagaaaacaatatcaaaaaatatatataacattgaaagtgagtcatcactttggaaggcaaggcctgtagcatgcaggacaatacagagttagaaaggttgagtcttcctgcatcagacttatgtcattcacgcacgcagacacacacgcacacacacacacacacacacacacacactattggctcacatagttattgaggctgacaagccccaagatttgctgtcagcaagctggagacctaagaaagctaatggtgtagtcccagtacaagtctgaaaagaatgcacatgccatatcaatgtccacaccaggaacctggagttgttatctgctctaacaaagtctgaaggttaggaatcaggaaagtcaatggtgtaatttccagtgtaggccacgcacagtggcccatgcatg

SEQ ID NO: 20239 - DNA, 517 bp, Homo sapiens
gaggttgcagtgagccgagattgcgccattgcactgcagcctgggcgacagagcaagatttggtctccaaaaacaaacaaacaaacaaacaaacaaaaaaagtgacatttttcaattcctttatagtaatgttagtacaccttggagtttatgaaatggccattcgtggagcttgaatactagtgataccaccagactattctttgctctttcctgctgccccactcttgactctgttctcaaaagcgtgattggcatcaaatagtcttttttttcttttttgagacagagtctcaatctgtcacccacgctggactgtagtggtgcgatctcagctcactgcaacctccacctcccaggcttaagcgattctcctgcctcagcctcccaagtagctgggattacaggcacatgacaccatgcctggctaatttttgtattcttagcagaggcagcatttcaccatgtttgccaggttggtcctgaactcctgacctcaaatgatccaccttccttg

SEQ ID NO: 20240 - DNA, 377 bp, Homo sapiens
gtagagatggggtctcgctatgtcgcccaggctggtcttgagctcctggcctcaagcgatcctcctgccttggcctcccaaagtgctgggattacaggcatgagccacaagcgccggcctctctcttcttattgggataccagtcctctgagactcgaaactgtcccccaggccttggccatactgataaatatctaggccctacaggagttcgtgtccatgaacccagtaaacgcaattcctcagccttaaaatctagtcactgactcatttcaggccccagcacagacgaaaacaagccattctgtttgcccagtttacattgcgggtctccaagaagtggaatgttcaccaatgattttaagaaaacagggcct

SEQ ID NO: 20241 - DNA, 510 bp, Homo sapiens
ttgcaaatgtaaccatccagattaaaaaagagcattccaggaccccatgagatgcccttgtattcccttttgattacctctcaccccacaaaatatactatagattagttttgcctgatttgaactttatttaaattgatcatttttaattactgaactgagccttaattataatgtgaaatgagcagaaagatatttcaaaatgtttcatgatggttctttatggccagtatttttgtatatcctgtagaaatatgtcattccctttattttcaaacctcatttgtgagattttagggatacgaatgcctttttgggactggtgtggctgtgttcttcttattaattattactgaagtaaagaggaaatgatatcagcagatgtgcagagcttttatttgcactgaatacactattcatttagacaaaaagatcatttctcaattcaaatcagaatattctaatttaaggctgaaatcagttgtgtcataatctctatggaaacaaagc

SEQ ID NO: 20242 - DNA, 382 bp, Homo sapiens
gtgtgtatatataaatgcaaaaatagatgtgacttgccactggtctgtgggactcaaaacaatccacctgtttggaaatgtctgttgctgctattgtagaagtttctttacgttgagatggagtttcactcttgttgcccaggctggagtccaatggcatgatctcagctcactgcaacctctgcctcctgggttcaagcgattctcctgcttcagtttcacaagtagctgggattacaggcatgtgccaccatacccagctaatttttattagcaaagacagggtttcaccatgttggccaggctggtcttgaactcctgacctcagatgatccgcctgcctcaacctcccatagtgctgggattacaggcatgagccact

SEQ ID NO: 20243 - DNA, 551 bp, Homo sapiens
cagaaatcagcctggcattggtcttattaataacaacacaagaaggtagaggaaaatggaaaacacctcttcaaaaatttaagaggaaaaatatattcaacttagaattcttcgcccagcccaaattaatcagaaatgagggttaaacaaagaaattttccgacttgaggtatcaaaaattgtactatccatgtatcttttcacagaaagctgtgggtgaatttaatgatgatctccaccaaaataaaataagaatgtaaataaagaaaaaagataaatggcatatttgtcaaactgagatcttacactcatggagatcttacaaactgggtgaaaaggtaagtttgataaaggaataatagggtagcctgaggctagcaactgtgtgaagctattacaatcattagtcctaaaaaacaggaacaggagcaattaccaaataccgtgagttttccagtaaagtctaccgggcaagagatgtggcctttagcattggacacagtcaacctgtagtcacttctcagggcacaagctagaagaataagtgcctc

SEQ ID NO: 20244 - DNA, 546 bp, Homo sapiens
ccaccaataatttaaaaaaaagtcaattaaatatgcgtagcttacttaaccttttgtccagtgatcaaataacttagttctgactgttgaaattgactggacaaaagttaagccagtgaagaaattttgtgatatcatggggtctgtatttccaaaaaattaaattttttatgtctaaaagcttatgcaaatatgtattatttgtgttggattaactaataaattatttgctttagtatatgccgctttaagaacactgaaaagtcagtgtccaaataactatattctaaacgttaggggaaccaaagtatccatctctaaatgattattactaaaaataattgaagaaatttgtttagtaaatttataaaatggtaaatctgacttagttgtcaaaattagctttttccatttaattttgacctatagattttttaaaaagtggaacggttcagaattttcctattaaaacttttatttgccagcctgggcaacatgacaaaaccctgactttactaaaatgcaaaaaaattagccaggcatgct

SEQ ID NO: 20245 - DNA, 520 bp, Homo sapiens
agatatttgttagagcagcacccccacttcttagtaccaatttctgtcttagtctgtttaggcacgtaacaaaaatacaatagactgggtggcttataaacaatagaaatttatttctcacatttctggaggctgggaaatccaagatcaaggcagtggaagacttggcatctggtgaaggtctacttcctggtttgtagatggtacgtgggaggggtaagagagctctccagagtctctgttaaagtcactaatcccattcctaactacctaatcacctaccaatgggtccatctccaaataccatcacaatggaggttaggatttcaacatatgaatttggggggcaggacacaaatattcagtctatagcaaaagcataaaaatatttgagcaggggaatgagagcaagaatgagtcttttttcttatcactcctaagtgatcttaataagcacaagcactaaccccccatgactgtcggatctccagcccgggtttctcatctagactgattcaca

SEQ ID NO: 20246 - DNA, 557 bp, Homo sapiens
atagtgtttggaactgtggggccaaataaatgtcttcacatacatgttaagaactactgtctggtctgatcattctctgaattccaggtactaaagactatgtactttctgttgctgttgttcctcagcatatatggttacagagtgcctaattgtaaacacatattctctcctaaatatgtatcatagttttcttaaggtgaagagtaagtacccttgatctttgtgctaaccacagagactggaaaagaggactgtacacagaatatagtcactgagtgccttttggattaaatctatggtcatatagtcacaggccaggcttaatctgtccagattcagcaaaaataatttccatgcctaatgcaatgcctgatctagcatagaagaaattggaaaggagtgaatgagtattcataattcattaaggaaggttagcgctatcttcatcttttcaattcaggtatttttcaacaaatacaacaataatagtaataaataaataataataaatccatagagtattttctttgagttaggcactgtctttcaaggat

SEQ ID NO: 20247 - DNA, 481 bp, Homo sapiens
gaaagataaaagaaagttatcatatattatgttctgtagattgtttctttcggtggtatcaaaagaattggcccatgtttgaagatctgaatttaattaagtctacacagaatatagtttaaaggtgtgaagactttgctattaatatgataaatactttttcttaagacattgtttatctacagaaagactaccatattcaagatttaaaggtagattgtttttgttcacatcattttgatcttaggttttgctggaaacattcacaagaagggggcctttaatttatgtatgctttaagaatacttaatagctaatctacaaattaaaaaaaaaaataccgggctaggcacggtggctcacgcctgtaatcccagcactttgggaggccgaggtgggcagatcacgaggtcaggagatcgagaccatccgggctaacatgcagaagccctgtctctactaaaaactcaaaaaattagcc

SEQ ID NO: 20248 - DNA, 605 bp, Homo sapiens
aaagtgattaagagtgtatgtataattgacaatgatgcacactagtgcatgttatcaactcaagaaaggggctttgtcgcctgatttccgttaaccttaatagtagttaagctgcacacacaaagcataatgtcctcatgctttaaaaaaggaggggctttcatcacctagattatgaaatattgattaattcatgtatgctcagacatccatctaaaaatggaatcattcaatctgtcatccttctccctcatccacatataaaaacaaaatgcaattctgagaagaacaaaaggagtgatgagagggtaggaattaggaagaaggataagagcagacaaagaaacaggctgaaaaataaaacatgtcaaactatgcttacagacagacacgccacatccacacacaatcacacacacacaacaaccactctactaattaatacagcttgcttttgtgccagatattagggacacattaattagagagaaatctcattcatccatttttcagttcattaattatgcatcaatgacaaattcgtattggcctgctataagacaatctgttccaacaaagatctgatgctgcacatgacacagcag

SEQ ID NO: 20249 - DNA, 566 bp, Homo sapiens
gggataaattggttactcaaatcagattttctaaataaaacagtgtaaattcattacaatcaatatagtattaaaaataagtaggtcagtgaaataaaatttagaaatatattcttgtatataatagaactgaacatgatggtgacaattgattaggaaaaggatagattaagaaaggatacattatttatgagtgttgcatatttgtatctctggaattatgagtatggaacaaaatattcaaagttgtatcatcagttgttagcagttgaaggaaataaatgtgaaatctcttatgtattacaatacagtgaagtataaatgggataagacaaattaaaaataagacagaatcttggatttaggggctagtagaaacacaaactgtgaaagagaaaatatttgagtttgtcaaataagtcttttgaatggcagaagaggctataaacaagttcaataggctaagacaataataatccccttgtatatgtaatgtagatggcaaagtatttatagcaattgcatggaaaatcctcttataataaataaggaaaagatattttaat

SEQ ID NO: 20250 - DNA, 609 bp, Homo sapiens
tgaattcatttttttgccttgtactataaagcttaatatgaagtcatagctcagtctttcgggttaagattttttttttaaataaagaaaaagtaaacggcctcaaatttaccagcagcaagcaaacaagggaagggaagtagcttcatgctgtaaatgtcaagcaatggaaacagaacataagtcagaaattcatatttgttcgtattttaaaatgtatgtataaactttgcattacatttggcatgttaggggtggtgctacataatcaaatacatcaaaatgttatagcaagtgctgtgaatattcacaataggtatgataaataaataccatggaatccaacaagacacccaacagattctcattctccaaaaaccttactaaagaaaaagagtaggttgaagaaattctaagaatgctgctaatgtcctccaacttagagagagggtgactgagagctgagtagaaagacacaggaagatattcgatactagaggtcccggaggatctggaggatcctggaggatcgcacccctggaggatctcagaaagacaaaaacagatactggaacttaccaccttcagatggagaaaatagataatatt

SEQ ID NO: 20251 - DNA, 558 bp, Homo sapiens
gtgaaggtatccctagagaaggtgactctgcggctgagcttgaaggaagagaattggtaggtgacaaagaagaggtaaggacatgcaagaaagctcagggaaaagagattacatgatcctggctggcaaatgtgaatagtttgttctattggagaagggtaaaaggggagtgggttcttcttagtctcaactagacacataggacaaccattggtgacacttgacatctgccaactcaggaatcacgggtgttcctcattagcaagagcctttgcagcagctacatggcaaatagctcagatgcaaggaaggacgatgtatattggatggttcaggttccacatggcttaaaagtctcatgcctttcaggaaccatttctctctcacaagaactccataggcattgcttcttggttcttggcttcttctctcatgctaactataggagtctccataatcgggaaaacccaaagtaaggaatcttcatcaggtatctatagttatcccagtccagctccagtcctcttaaaacaggggtcattttacagaagcagtact

SEQ ID NO: 20252 - DNA, 576 bp, Homo sapiens
cttgttctcttatcatatacaaactagtgtggttttagtttctcctaaactatttctattcaggtgtttacatatgcctctgttctttccttttcttatacctcttattttaaaatgacctctatttcttatttattttatcagatgagcgcatttgactacatcattatagttctgcctaattgtgcctggaaattaacacgttagatacacatattattagattataaattactttcttctttgtgtctcctttatattacatttaggacaatgtggaatattttaaattgtgataaaaataaacattcccaaatctaccatattgaccattttaaaatatacagctcaatagtgctaagtatatttacattgttgtgcaaccaatctccagaacttttcatctagttaaactgcaactctataccccttaaacaactctctattttcccctccttccagctcctgaggataatgttgatttttaaattctctgcataagcatgtcattttaaatgcgaattttattttgagattgtgaaagaaattttacaaaatatttgtttaaaaaaatga

SEQ ID NO: 20253 - DNA, 573 bp, Homo sapiens
catgccaccacacctggctcttatttctacttttgaattataagcttgaggacacagccataccttccatttctctgagtcactcttagaattgaacacagtattttatgcacagataaattcaataagcaactgattatttcatataaacatagagtattaaatgtctgaaaagtgttacatgtgtataacaaacatgcttcaaagcttaaatagcaatatgggatctaagagttaagctctcttattacataggtaactgaattctgattttaccagataaaagggtaaagaaaatactggccaggcgcggtggctcacgcctgtaatcccagcactttgtgaggccaaggcagggagatcacgaggtcaggagattgagaccatcctgaccaacactgtgaaaccccgtctctactaaaaatacaaaaattagctcagtgtggtggcacatgcctgtagtcccagctactcaggaggctgaggcaggagaatcgctggaacctgggaggcggaggttgcagtgagccgagattgcgccactgcactccagcctggtgacagagcgagact

SEQ ID NO: 20254 - DNA, 598 bp, Homo sapiens
cacacacacacacacacacacacacacacacacacacattggttttgtttctctggagagccctaatacaacaatttatagtagagctaatccaaatgactgacgaacatatgatgttcaacctcactactgtcaacaaagtatacagacttaacaatgaaatatcacttctcacccaccagattgaaaaaaaaagaaaagatataaaacacatacatttaaaaaaaatactgctagaggaaagaatagtctcatacatggctagtgcaaatgtaaactgttactgcctttttgcagagcaatttagcaatataaaatacacacatatggttctgcagtaattccacaccagataaactattgaatagaaataaaggaccattcaattagaatgtttctacaatagtggtgatcactaccttctataaaagtagtttagagaaatatactttggagccatactgactagtttgccacctattggctatatagcctggggcgtttcttacctactcctgctcagttctctaaaatggggagaataacctaacccctcagtagcttaatacatgtagagcgcaaaaaaaaaaaaaaaaaa

SEQ ID NO: 20255 - DNA, 534 bp, Homo sapiens
gggcggtgaagcccagacacacatcagccttcacgcctgggctctcaagttctccccagcctggttttctctgaacccaacccaagtctctccactcctgagggatgatacatgcccacccctctccggaagcctccacgcccaccctctccttccacttctcccagctgcatctcccagccacgctgcctctgacctgtcttccccagacccagcctcatttctccagaccccgggcccctatctcccctttcctctgtcatttgccagatttgctatgtggccccgggaacacagtcttcagcaatctctgtctagcacggtgcagggaattaaaggtgactcacgcctgtaatcccaacaactttgagaggccggggtgggaaaatcccttgagtccaggagtttgagatcagcctaggcagcatctccagatccctttgctacaaaaacattaaaattagccaggcttggtggcatgcacctgtagtcccaactactctggaggctgaagtgggaggatcgcttaagccc

SEQ ID NO: 20256 - DNA, 577 bp, Homo sapiens
agtcttagtgcaaagatcagtaccatgcatgaaattccatctcaggttctatccaataatctaccttatgtttggtaacatattttgcatattatattatttcttgttctatcaaggaaatataagaatattaatagaataagtgtcatttggaaattttgaagtgtaccatttttaatgtatttaatattattaaaaacaaatgttttgatatatttaataatgactgaaatagacatgatctctgaaaatgagtgagtttttctcgtcatctgatagaccaccctatggcagctaaaatagacttttaaaagcaaagcaatgaggttggaagcctatttatgtaactttgagtaggataatggtacattagcttctccagagagagattaaaatatataactcctactctaggaaatgaccatcactctgaattgatgctgtgattgtgggatttattatctgtaagtctcagtaatttttcaaatgctggctgggtgtggtggcttatgcctgtaatcccagcattttgggatgccaagacgggcaggcgatcacctgaagtcaggagtttgag

SEQ ID NO: 20257 - DNA, 652 bp, Homo sapiens
caccacccaggtggtgctgcctgggaggaaaggcggcggagctgggactagtttgtttttactggagacgcgcctccccccctccccgcccctcacttcctgattgaaagtacctgaggcaggccagggactagggaaggtggcagctggacaaaggtatgaaggaaggacgagatgaggcacaggtcctggtattggaaagaggcagaggtacctcagaagcatgccatagaggttagacgggacctaagagggcatctggtccaaccggattcgtgttaccagcgagtaaactgaggccaggagagggactgctgcgagctgctccagcctatcacctataaagactacagtccctttgtaaaataccatacagctctcggagaactcccagttggcgctgcaggataaaatccaaacttgttggcatagcattccagccacttgttcacttacctttcccatttgagctcctaggaataaacagaaaaacatttcattttctaaatatcaccagataacttcacttttggtaacttgaattattaaaaaagtcctaccgtccctcatctcttgccacttccccaacattactggaggctctggctacaaataatttgttttccttgactactcaactttctttggatta

SEQ ID NO: 20258 - DNA, 594 bp, Homo sapiens
ccattgtgattatcctgtggggtaattatgctggaattactatcaaagactggtagtgaagaacccccttcccccagttgtatcgtcatgttaaaaaagcaaaaccaaatacaagcaaccaaaaaaaacaggtcactgtggaatggctaaaaacattcctttttgtattagagactaatatgaaaaacctgtcctcttttgaaagatatttgtcttctaccttaatggaagaagcttgtagtttgtgaacattcaaacacatgacacaaataattgctaagttgttttattctgctttctgccaagtacttagtgattaaactgtatttctcatttcatcttactgtagtattgaaactgtcatgttctgctgaatagagccatttgtttctccacactggttgattagtgtttttggttgtcattttacttggctggcttatattctggtatataatgactaattggcctgaacttggatgatggagagttgggatggggaagtgagtggggggcaaggtgtcagcccactattgtcagcccatatttctaaatttcttcttccaggactccactgatcactcatctcaacat

SEQ ID NO: 20259 - DNA, 650 bp, Homo sapiens
cttcagtaattagatactttaattttttttaatttatggggcaagagaaatggagtgtgctacaccctaacaggttaaagcagcagcagcagtcacatttactggcagatgctggccagaggagtggttggtcttctttgtggtgctcatggtgtttttgttttcatctgtgtagagctgtgattatggagcattcttgttcttacatactccatcctgggcatggaatgcgcttgtctaatcttagcattctgtgaaattgtagatgtttcagcagagaaacaacacagcccagctacccaggccagctcccaggggaaagctgctggggctgctttttttctttcttaaaaattactccaagaatgggaaactacagagaaagaagacagagaaaaacaatgagaacaaattatggctattgagggctctgaacagagatttatctcctagtaaagacaaatggagtaaaaacaatgatcaaagttataacaaggaaaaattatgctcgtgaagaatcaccaaatcagcattaaaagagggttccacttacaaacaaaaattatttaaaagttgcagcttcaagttttattgcaatagatactagaattttaaaaataaagacttgtttgaatatctagtcatatatt

SEQ ID NO: 20260 - DNA, 593 bp, Homo sapiens
gaaggtaactcggcaacatcacagctgaaagcgctcaagcaatccacccaattcaacctcccaagtagctggcaccacaggcatgcactaccacacccagctaatttttgtatgtttttgtagatgcagggcttcatcatgttgctcaggctggtctcaaactcttgggctcaagtgatcctctctccttggcatcgcaaagtgttgggattacagacaggagccaccacacttatttgttcttaccctcaaaatagtcagaatttaatcaaatattatgagacacagcaaaaggctaagaaacaaaacaaaactttaccaggagataaagcaattcacagaaccagcctcaaagatgacttatatgctatgactatcagatggaaatcttaaaatgattaattgacatgttaaaggtcatggagaaatggtgtacaacacacgtttcaacaggaacatgaaaatttcaatagagtccaagtgaaataaaataaattttaaaaatatcagaaatgaatagatatttcaatgaactcatcttcaaactctataatcagcaaaattgaagataaataaatatatgtaacccagtc

SEQ ID NO: 20261 - DNA, 578 bp, Homo sapiens
agtagagtaagcctactataattatgtttcttttcaaatcaccctgatttgtttctcttgttctgcaggaattattttgtatcttcccattcttgacctctatgtcaagtgactttttcagacttcacaacttaggcattaccatttagcttctacttctggtcttacactactttgtttctcactctttaattagaaatggttaatttgacttcatgtcttaaggcaaggagaaaatgagtcttaaacagtattaagctcccataaatatttcactttatgctaattcctgtgcttccagctgagccgtttgaagttctcaaaaaagtgtttctgttcccctcaattaaatacataactggaaaacagtaaaataattatcagttttactaccctgcactttattttccaagctttcattctggacgttttaaatttttcttccacatttttcttccactaacccaacccagtgtcataggtgctgcctccagcctggttagactctaagacccaggctttggaggaatcttagagctccctcaagtggacatacgtttaatgcacccttaatctct

SEQ ID NO: 20262 - DNA, 641 bp, Homo sapiens
atctgacatatgggctgacagcacccatgtcaacccagtacgtcaataatgtgtggaaggcatttaatggctttcttattttaagataagaaatacaaaaataaagattctaatattttctcctcataccttgttttgtctgcccgtcaaaatacacagactggatgttggtggatccttgtctagacagcagattctgagtttagatactgcatccgaacagaggaggagacctgtatttacacgtttgtttttatttctgaacaggttccttacctctctgcacgtgtctcccgggttatactggaaatggttatgggacaaatggatgtgtgcagctcagtaatatttgcctaagtcacccctgtctaaatggacaatgcatcgtgagtcctttgtttttcctgtggacagagagtacctgagaattagtttcacgcctataaaatgtaacgttataggattcaggaatgtcaagataatgagtcaagtttcagataaggaactgtcgagaactctcagatgaaagatagataatgattttagttcttaggaaaaaacattgagttaattttttgtctcagtggtttatgaagtactaaaactacgcctgcagtttgatctaaataaatctgacatac

SEQ ID NO: 20263 - DNA, 620 bp, Homo sapiens
ttctcctggggaagtcagcaaggaaggcctgtgctgaaggaggggtgctgtcagagaatgtctgcaagaagccagccagagttcatgcagagctggttgtcaaccgcagcagctggaatagaagacagttgaagcctagaggatctgaagagctgcccaagatgtgtccaacgcacattgcaattggcttcctataaattgtcagtctgtgcagaagcacaagtgaaacttgtctctgcaattgagaacttaaaatagtcttggaaacatggtcttgggactatgtacttatgttttaagagattgctaattcaatcctgtttgagcaagtaggaaatagagatcacacatgtttcattctgcattcccaatatgaaacacaaagtttgccacaaaacaaatgctcaacacaacttttaataataatgactgtttatgtgtgaattacattttagggccactagaacttacaaatttagtcattaaaagaataactctgatatattttatgacactagttgctgtcacatgataaatcatagtattaggtttagtctttgacatgctggggtcgtttaagaagtctgctcctaattgtcatttcaactcagaaattgctg

SEQ ID NO: 20264 - DNA, 579 bp, Homo sapiens
cagaaacatttggtttagaaaataaatggagtctaagtaagaccttgagcctttagtgggttagttgtcagcttttggacagatccctttaccttcttacccttagctttctcccctatgaaacagggccatgatcttgtaaaaggatgaaaatgacatgagtaattgcaaataattataaacatcagggaaaattcaatctacatctactacgccttccattccttttcaactatgttatacatttcttttaactttagctattcatggtgcaagggatcttccagatatctagaaagctaattcaaagactgacattagaaaactttacagaaaaaaaagattaaagagttgcaggcatgggtgcaaagagcaacatagctgctaaaggaagcttgaaatctttgtctagtcctggggacccagctggagttgtcaggaatcagcagagcaggtgttcagctgaggtttggaagaattcttagcccattgaaatactttatgggccgggcatgatggctcacacctgtaatcccagcactttgggaggccaaggtgggtggatcacgaggtcaggat

SEQ ID NO: 20265 - DNA, 485 bp, Homo sapiens
ctggaatacacaatcgtttatgctagtgatctaggagcagagtgagaagaagattgagagtcttaatactcaaaatgatactttcatttaatctcaatatttagtatcaatacaggacctctgccttcagctattcctgttgtctgcaagtctagaaacttttccctttcctaataacaagcttgtagtagagtgccagggttggggttgcttagctgctgcaagtcagggaggacaactaggagatctcacagctccttacgcagactggcgatgaatctttctcttttaggcctgccttcacccctgcttccagggatatcttgtgcaattttctttccagagtctaaaggtactgctttttatttcatcttcttgattttttataggtgtattccctttaaaaattacatttttatcattttagtaggatgtttggactgagcagaaactaatgaatgtgtacaactagttatctttactta

SEQ ID NO: 20266 - DNA, 552 bp, Homo sapiens
cctgtcctggacacagcgggttatccgagaggttttctttcaccatgtccactgtatcaatgatgtccatttctgatttacttttatgaaagacggaatgctgcatctgatccattatgtactattcgcaggcaaattctaatgataacgacctaaaatgtgtatatgtatatttcttgtaattctaggctaagtctattaaagtattgatattattgttgttttagtgcttttcatgatatattggaaatttcactgttttcataatcttgtttgctctgcaagtaccccttttactcagaggtagttacaatgtaggaaaaagaatatatttaaaataccaatagtagttatttctggattaagctggagactacaggtgacttttattttcttttgtctttctgtatgtgctaaaaatttccacaataagaatagtttatatttgttaagtgttttctctaggccaagctcagtgctaagtttttaatgttctttattacataatatcttcacaatagccccataagagaggtcctattattatcttca

SEQ ID NO: 20267 - DNA, 638 bp, Homo sapiens
attgtcacccaggctggagtgcaacggcacaatctcggctcactgcaaccttcgcctcccaggttcaagtgattctcctgcctcatatatagctgctttattgagatgtaattcacatatcatgcaattcacccattgatgtaattcacccaaatgatacaattcaatggtttttaatctatttacccagtggtacaatcattactacaatcaattctagaatgttttcatcactgcctagggatctttaaaaattccaaagcccagactatgccacaaatcaattatatcacagtctatggcggtgggacacagacatcagtagtttgcgaagctccccaggtaattccattgcacagatatgtttgggaagccatgctgcactggaatcactgtcagagtttcagggaaaataaacacagaaataaagaaagaggagatgttcagcagagagactgtcctatgataacataagcacagaagtggtggtgacaataatcatattgaggacgaatttaatgggaaagactatctaaagaattacactgcaacttttataatcgggactaaaatagcaatttttttactcgttggtaatacatctccaggcacagcatcctctgagagtatgtataagt

SEQ ID NO: 20268 - DNA, 426 bp, Homo sapiens
gcttggtaaccccttctgcatgtcttagattcacaggtagaacataccctccaattttttggacatctgtttctcatttctgctgaataatatgacattctgatggagaaaaagacaaaggaggcattttttccctattgcttcctttttacttaatttaaattatattagttaaagcagtctctgtgtgtgtgtgtgtgtatgtgattcaaacttttaaatcatagataaaatggcaaaatataaagaccaagtttttctcaataaaatgttattgcaacaggttttaaaaacacacaaatttctggctggggcacagtggctcacacctgtaatcccagcactttgggaggctgaggtgggtggatcacctgaggtcaggagttcgagaccagcctggccaacatggtgaaaccttgtctctac

SEQ ID NO: 20269 - DNA, 658 bp, Homo sapiens
attttatatcgtaagtgtgattttaaataattacttcaaatgtctacctacatttacatgtatttatttgtttatttaggtaggggtgtgtgagtagctacagttagcttcaagatttaggaaatatatattttttttatgtgtgatacaaagattttaacagtacaaatggtgtttcccttggaggcatccttggtgatgaatgtgttaatattttcaatatgggttttggctgatgacaattctgtcacatctgaaataatttggattgactacatagcattatctaaatttttgtcatgtaaatatcgacattggcagcataacgtgaaaaatacatggatttctatttatacctctgacattaatcccccaaatgatattttgatgttgattaaaaatttttattcatacattttaaatgcctgatttaaatatcaatttttcaatctatcaaccaacatttctgtaaattatgaatcggatttttacattattattcatgtcatcatggcactgagttataattcatgcaactgatttaaaagtcagtgctttatactttgaatataatgagctataaatattgtagtaggacattttccaaaggcatttaaaaaaatcatgtttataagtttgtagtctgacaccacagagt

SEQ ID NO: 20270 - DNA, 428 bp, Homo sapiens
acattggcctgattttgtactgtatttaaatgaaatcatacaatatgtactcttttgtgtctatttttttaaacattacatttgtcataatcattcatattgttgtgtgtagttgtagtttgttcattattattgctataaagaatttcattttatgaataaaatgcaatgtattcattcattatagtgttcacgaacattttgactgtttctattttgggtttatgaatattccaataaatattttttagtaaattctcacttgttgttaagtacaatttatagaggataggaagtggcaacaacaatgagtgttccccttttgcctatgggaaaagagaggcaaagggagaattagtgttagtggcccaataaggcttctggtgcctgtttcctgattcttgggacagagcacattcttcctgcta

SEQ ID NO: 20271 - DNA, 578 bp, Homo sapiens
ggggagatgtggttttggatactagtactgaggaaagttccccaagattagttaagatgaaacgtcttagctcactttcatctgagaagacggtggatgggcaaggtggaaccaatttctgtcatagtaattatgacaaatacgaacaccaacaactaggtaaagtaaaaacgtatttctttgcatcctttaaaaaagtattttaggaaagtaaaactatttttacaagtatgaattctagtgagcaggaatattttgaaaatcaagtttaaatattaaaatgtttaatgaagtatatagttggcctacttttttaataaaatttttcttcaagtatagctggagaaatatttatgctgtaagtcaagataaaactataatgcacttaatagttttgatctttggaaaatattttgaagcgttattgacagtatgttagttacacctataggatatgtaaacaaaaaataagatactgaattgtgtctgttactatagaaaccatttaaattttgtttaaaaatatgttccattgttttattttaaaagataatgaatatttgggctgaaatattaaa

SEQ ID NO: 20272 - DNA, 460 bp, Homo sapiens
tgattctcctgcctcagtctcccaagtagctgggattataggcatgggccaccatgcccagctaattttgtatttttcagtagaaatggtttttcaccatgttggccaggctggtctcgaactccttacctcggtgatctgcctgcctcgggctcccaaagttattggattacaggcgtgagccaccacacccaaccagagaataaaaacaaaattaatgacatagaaattgcttagcattgtaccaggtaaatattattttaccagtaagtggttttaaaaagcagcatcattctgtccacaagatccactgcagcaagaacaagacaaattatgccctgaaaataacacctcattaacaagacgtactgtggcgtggtggctaaagaattagagggccgggcgcagtggctcaagcctgtaatctcagcactttgggaggccgaggcaggtggatcac

SEQ ID NO: 20273 - DNA, 564 bp, Homo sapiens
tgaataaaatataaacatgttttattggtggtcttggttttatttatagctagactgtgaaggttccttcctttaatatctgggttactcccttcctctctagaccacttacattttttctaattagtctaagcaaagcaaacagaatgagtccaagcaccattcacttaagcaaaagaagatttaatgcttaaaaaaatcctgttataaccccaaacgttagagagtcagaggtcagcaaagaagagttctagtttgtggtgtctttggtggatcatcacagtgatgaaggcatcagtgtctgagccttcatcacactagtcttgtatgatcctcgattaactggcattcatcctcaagatgaagataattcaaaaactattgaattatacactttatttatttattttgaggtggagtctcactgtggctctgtcacctaggctggagtgcagtggtgcgatctcagctcgctgcaacctctgcctcctgggttcaagtgattcttctgcctcagcctcccaagttgctgggactacaggcatgtaccacctcacccaacta

SEQ ID NO: 20274 - DNA, 553 bp, Homo sapiens
aagtggtttagaggactcaacctatcgtgcaaccaaaactttgctttttaccccacttctttaatgttccctgaaggggaatggaattttttcccttaagttaagaaggcatatgtgtggtgaggggagaaaagctggccctcgtgcctcagggtttgccacacaagcaaatatagctccttcaacaaggcacagcttgggcagagacacaggggtctctggaagggaaaggccacagggatcatggagggcagctgccctgagagccggcagctagtgaaatggaacaaattactaggcagaaggaaagaaatgagaggaaaagggatgcaacttagaggactggcctgggggaacagaaggtgactgcagggcagggggttgggggtgtcaatgtatatgtgcaactttcaggttaaactgcctagtcatattttcacttttgtcttaatagtttcaaccttctataagataagattagtgtgctcttaaagctctgaaatcatagtggtttaaagacaatagaagtttatttttctcttatataaacagt

SEQ ID NO: 20275 - DNA, 413 bp, Homo sapiens
tacaaaaacaaacaaacaaacacaaacctctcaaaatatcagatctagattttttttttctcagtacggcttacttataggtggtaatcgaagctatcagcacaaaagctgatatttccttaaaaccttgatagcttttggcaaatgaagctataagcttaaaaattcaaacccattaagaaatactttcactacatagaaattttagagaaatttttctttatcaaatgattctttgctttgcaaaatggtcaacccatatattatattatgtactttccacaaataatctgtattttttaaatcttccctaaaaagcaaatttttggtaaagaatggctgatgacaacattcatgtgtaatttctttgctgtagcattaaaaatcatttgcgaagcacaaaatacatacca

SEQ ID NO: 20276 - DNA, 643 bp, Homo sapiens
atgtaagtggaccagtgcagttcaaatccatgttgtgtttgtcagctctgggacagttttacttttgtgtaatgacagttcaatgggttggcaaagttatcttttaccaatctaaaatttcatcaaaattatatcttctttaaaaaataaaaatactgtctgggcatggtggctcatgcctgtaatcccagcactttgggaggctgaggtgggtggatcacctgaggtcaggagtttgagaccagcctgggcaacatggtgaaaccccatctctactaaaaatacaaaaattagccaggcatggcagtgggcacctgtaatcccagctacttgggaggctgaggcaggagaagtgcttgaacctgggagacggaggttgcagtgagccaagatcgcacaactgcagtccggcctgggtgacaagagcgagatgccatctcaaaaaataaataaataaataaataaataaataaatacatacatacataaaatacttgtgtaatttgaaaaaaaggattgcagggtcttcaaaatagctttttcattatattatatttaccagtaacttcagaaatatttatatgtttagtgctttttaacctccaacgccttttttgataaacttcctacttcaatttcatag

SEQ ID NO: 20277 - DNA, 629 bp, Homo sapiens
agggcaagactatacagactttaactttgaattcccccaaattagtacagggtttagtacagagaaaggacttgatacatttttatacacttttgaagaataaattgatatttatttagtactcagtgtcagccaagcacttaaacactttacattcattaccccatggcatcctcacagccttctgaggtagaaagactcactgaaggttcagtaaagtggggaggaaggcacgacttgaactcaggtctgtctgactccagatgtcttagaaaggtagaatctttcacttggaagacagtatggttaagatcatgttctccgggccgggcacagtggctcacacctgtaatcccagcactttgggaggctgaggcaggaggattgcttgagcccagcagttcaagaccagcctgggcaaaatagtgggaccccatctctgcaaaaaataagaaaattagctgggcgtggtgggcctcgcctgtagtcccagctacctgagaggctgaggcaggaggatagactgagcccaggaagtcaaggctgcaatgagccgtgattgcacccctgcaccccagcctgggcgatagagtgagaccctgtctcaaaaaaaaaaaaaaaaaaaaaaa

SEQ ID NO: 20278 - DNA, 605 bp, Homo sapiens
caaagacagtgattacattgacataacaaatgtccattggggcaggcaaatttctactgagtctaaaaagcattccaaattctaggagcaaaagttctgattttccttaaaatctttgcaaataaacagcaaagggtattctggatgtcttgtcaatgcaaattaggtttgatttagagaagttttaaatttaatcgcaatgaaaagattagttaatacatgaatctttttatgagaaaaaaatcattattctggataaagtcataattgtttgtttacaatattaagagcagacacctaaacatacaataataccaaagtattgagaaaattaccactggaacaccatctcaagttatcacaccatttacctctttagagccagttttgtataagtagttagaagtggttttggtttttttgctaaaattttactttgttttagtaatatctagggaatacttttaattccattaaaataccttcatagaaagtgttaatgtgtctaccatgccatatgtttatttttactttccccaagttaggtagatagagcaagtcctgctaccataagtttaaaattattaagacaacgggctttttta

SEQ ID NO: 20279 - DNA, 549 bp, Homo sapiens
  misc_feature 216: n = A,T,C or G
tctacatatgtatttttaaatgaaaatataaatgtaaattgatacatttgttttatatgactaaaataggacacatttcttagatattattcttactgacatttcaaggcaaaaagtagtttagaatgtcttaaaaaaaagaatgtcttataattaatttggaatataaataagtataaagatttaaactgtaaaagtcccatcaattgaagtcangaaagagattaacagagaaaagagggaaagataaatgcagaatgaagacagagaaaggaaaggaggaaggaagggagagaaagaaacaagatcagccgggcacggtggctcacgcctgtaatcctagcactttgggaggccaaggcaggcggatcatgaggtcaggcgttcgagaccagcctggccaacatagtgaaaccccatctctactaaaaatacaaaaaattagcttgggcgtgttggcgggcgcctgtaatcccagccactcaggaggctgaggcaggagaattgcttgaacctgggaggtggaagttgcagtgagccgagatcgag

SEQ ID NO: 20280 - DNA, 646 bp, Homo sapiens
tttctactgtgcttaccctaatggattttttatatagtctcactttctaattcataatctgatctctagtttcatcagagcaccttagtttttaagtaaaggctcttcttctattaaccacttctaaaatgacaaatcgggcttattctatgcagttcaaaaaacagaacaaggctaagaggtgaagttatagaaaagacattttcactcacagaaggaaaaatttggacacagccagagtagttaaaacacaaaacaagaaaccagaatggacaaggttgaaaagtagtaaactttaagtcatttagtagcacttaagcagatgacaactatacctattcatttgttatattttggaggggcatcttatagtcttgattaagtgatttctgtacctctgaaatacagtagtctaggccaggcatggtggctcatgcctacaatcccagaactttgggagactaagcgggcagatcacctgaggtcaggagttcaagaccagcctggccaacatggtaaaaccctgtctctactaaaaatacaaaagttagctaggcctggtggcatgcgcctgtaatcccagctacttgggaggctgagaggaaaatcacttgaacccgggaggcggaggttgcaatgagctgag

SEQ ID NO: 20281 - DNA, 599 bp, Homo sapiens
tcccattccttcagtggaccagggatgactttgaacccaaggagttagtgtagagataatatcaaggctggatttagactgcataaatcttagtcattctcctttttactatttgtatatacagtatttgattttacagagagtgtattagaagtccacattcctagtttgaaaccattggggccatatgtggtttaaaatttttgaaaaatgtggaattcccaaaaggtaacaggatgcatgtactgtatagtaatgtaccatcactagtttagggtagtactcctgtaaacaatcacattaatatctctcgtgagggccaggcgcggtggctcatgcctgtaatcccagcactttgggaggctgaggcgggcagatcacctaaggtcgggagttcgagaccagcctgaccaacatggagaaaccccgtctctactgaaaatacaaaattagccaggcgtggtggcgcatgcctataatctcagctacttaggaggctgaggcaggagaatcgcttgaacccaggaggcggaggttgcagtgagccgagaccacgccattgcactggagcctgggcgacaagggcgaaactccgtctc

SEQ ID NO: 20282 - DNA, 531 bp, Homo sapiens
aatcttattttagtttttcttggcaactttggtgtaacagttggctataagaagggctataagatgttaggattgctattcctgctttaaatagttccagattggcaattttggggcaattctagcggtcacctattcccttatttcctaagctgggaagaatggaattttcttaaggctgaaatcctaacctgaattttactgatagaaccacaaagtggtacctagccgacagattcacacatggtgttcacttctgctgttgagtagcacgtgggtcctggtgctagtgtttcttttcctgctcagaggacctcttctctcttactgatttacagtgacgtccagatggtggagtttgctacaaagcagcccactgtatgaaagacatgacattgtattcacctggactctaggttgactctaaagaaggcaagggtcctttggtcacagggagaactgttgtgttccttcacaaggtagcagagactttgtgttctagagacttgagaccacctctataaatataac

SEQ ID NO: 20283 - DNA, 602 bp, Homo sapiens
aatgtacatcttatagctaccaagacttgctgctggtgtgaatgttcaggtaaaagagagagaaatcaagaatggctctaggctgggtgcagtgactcatgcctgtaatctcagtactttgggaaccgaggcggatggatcacttgagctcaagagttcgagaccaaccagtctgggcaacacagcaagactctgtctctccacccctcaaaaaaagaaaaaaggaaaggcatgactctgagggtaaattctaggaaggcatgtggggtgggaaatggggccagcggtgtgattaaagaatgtacatggtagtagagggatgcagatctagataatattgaaaggccaggacttggacttctgggaatgggaaacatgatagaattatctgtaattttccagaatcaatgactagttgtttttttaaaaaaagaattatctgtaattgtgttttttgagacggagtctcactctctcgcccaggctggagtgcagtggtgtgatctcaggtcactgcaacctccacctcccaggctcaagcgattctcctgcctcagcctcctgagtagctgggactacaggtgcccgccactatgcccggc

SEQ ID NO: 20284 - DNA, 602 bp, Homo sapiens
atcctttggtacttgtagactactatcttcttccttggaactgcagtatctgtgcaatgaactacaggataacaaaagatccttaacaacagaaatccagggctgtgaagcacagacctcaggccagttgtctttctactaataatgagaataatattattagtagccatcattaactaccaactgatttctaagtgccagctgctgtgctaaacaattaaatacacatatttatcttgttttatacttctaagaaccctgtgagcttgttctattattaccactttacagaagtggcaattaaaactcacagaggtggccaggtacgttggctcacgcctgtaatcccagccctttgggaggctgaggcaggcggatcccgaggtcaggagtttgagaccagcctggctaacatggtgaaacttcgtctctactaaagttacaaaaaattagccgagcatggtggcgagcgcctgtaatcccagctactcgggaggctgaggcaggagaaccgcatgaatccgggaggaggaggttgcagtgagctgagattgcaccactgcactccagcctgggcgacagggtgagactctgtctcaaaa

SEQ ID NO: 20285 - DNA, 581 bp, Homo sapiens
atagcatttaaataattttctcctcccccaagtagtagtgtttctggttgctactttttaatggctgcatagttcaagcaagtgtaccgtaattttacttagcaagtatttgttaaacatttaggttgcttctagttaccttttaaattgtcgctattattgtgctgtggtgaccatattcatgcatatggcttttctcgtattttggtatataacctgataatttgtcagtttaaatattagagattcaaacatgttttttaaattattaatctacctaattacttccaagagattaacagttgctatcatggaagtggtgagaatatttggagttttggatttgactttattttacagataaccagacttgtagctagaggtgacactaagcacctgactcctcatctaatgttttgttttcgtcttttatattaggctgtgattttagtgcttttgaccgaccagttggtatgctgaagaatgctttgtgggccttcgtgaacaccttattttgtagaagtacgttatgtcatactggcttagaagtcatgtacctgtatcctctctctcacttttac

SEQ ID NO: 20286 - DNA, 594 bp, Homo sapiens
ttcttttaacaagtatgtaccaagtgtccatgtattagagcctatattagatgaggaatatgatggcccctaaattttaaaaaatactcagaaaatacaaaatgtaataggacatcaacggatataacagatatccatgtgatacataaaggatatcaattcaaattttcaaagcatacatgcttggctattactacagataagtcagttgaaacatcaaatgaaagcagttaagtcagttcaaagagtcttcagaaaaaataataacatttaaccacaggatgtggtcaatctcctgtcagaccacaaatagtcaccagctgcagataagtctatgattagaaatgttttcagccagcaccacagtgtattggtttgtgaaagagaacaggcaaggtagggggttggtgattagaagtgaagctgggtggccatgatcctataaatttacccattacaacaaattaaagagggcttattcaaagggctgtacaatacctctctattttggctgccaaatgcttagaagagttactttcacgcagaagtcaaaaaaaaggctggccatggtggctcacgcctgtaatcccagca

SEQ ID NO: 20287 - DNA, 572 bp, Homo sapiens
tcgtgcctcagcctcccaagtagctgggattataggcgtgcaccaccatggctggctaatttttctatttttagtagagatggggtttcaccatgttggccaggctggtctcgaactcctcaggtgatctgcccgcctcaacctcccaaagtgctgggattacaggtgtgagccactgcacccagccagttctctttctatctctcctcttcttccccatctctcagctcagatgtctctgtttcttgtgtgtaagtttcattctctcctgccaaggttggactcactgcaggtggtagtagtggtggtgatgatgatgatggtgacttagctgttaactatgtgctaggcaccactctgtgcacaccactatgaggcaggtgctattaatactctcactttacagataaggaaatggaggcacagaaaagttagataacctgccccaggtgacgcagctggaaaatgctggatctgacagtatctagtaggaaagatggccactggcagccccaagccaacactcttacagctggaattgccacagagagagagagagacagagagagaga

SEQ ID NO: 20288 - DNA, 624 bp, Homo sapiens
atttttagtatatgcaggtgattcccaaatgtattctctaattgagctacgtcttccaagagtctgacctctatatccaactgccggttgagcagctctccctgggtgctgcacaggcaactttgatgtccagtatctaaggtcacacagctcaagctaagaaactgggacgcgtcttgagaggcagaggactctaccgagcctactgggtcatcacctgaatccaagagcatgcaacacacctcagaccagaggccccaatacaagacaaaacatcaccttaatgtccaggtgaaacatactcacttcttcacccgtggacactcacttcttcacccgtggacactcagagctcccgtctctgtcagacacgtgtcacctctgctaacacacccaggcatctccgggaggacagggaactgtcatcttctccaagatggttctgctccacccaacccaggctttcctaaagccccaaactccacaccggaggcaacgcctgatgaagcaacgttcccgccacagcatccaccttaaccttccaaatgccactgctgtgaagaggagccatcgcagatcgccatggcgacagagcccttctgacccaggggatccactgctctc

SEQ ID NO: 20289 - DNA, 648 bp, Homo sapiens
gctggagtgcagtgacgcgatctcggctcactgcaacctctgcctcctggattcaagcgattatcttacctcagccttctaagtagctgggattacaggcgtgcgccaccacacctggctaatttttgtactttagtagatacggggtttcaccatgttggtcaggctggtcttgaactcctgacctcatgatccgcccacctcggcctcctaaaatgctgggattacaggcgtgatcccacaattaccgtgcctggccacagtttttatattatcttgatttagggcatctatataaaacaaataattaaataaaatcagtattttaaggtaagaaccttacattttgtagtctcaactgactcatatatcctgttttcgtagtccctctttttatgattaatgttatcttttcattattttatagttttaagcctatcttgtctaacatttctttttcagatggccaagtgtgatggttgtaaacgacagggtaaactaagcgagtccattaagtggcgaggcaacattaaacatttctgtaacctattttgtgtcttggagttttgtcatcagcaaattatgaatgactgtcttccacaaaataaaggtaaaattaaacttagctaatgggatttttatgtcagt

SEQ ID NO: 20290 - DNA, 475 bp, Homo sapiens
tattctctttctgtaagtcagatgacttctcctgatatccagtctttaatatggcacctcctcttgggtattatataagaagagtagacatgtcatgtcatctgaacattcaatgaagggtcctctgcccactgccctcaaaggcaggtggctgcacactgtcatagatgtgtggtgtgtgtgtgtgtgtatgtgtgcatatatgtgcatacatgtatgcatatgtatgtgtgtgtttgtgtgttggttgggggtgattctaccatgaggactgggtcttgaaaatcagtgttcagcatccaaaactactgaaatctcatcagttcctgtcactaggaaatctctaaaaataattttaaagtacgtttttttcctattttattccacttccacttttcacaatccttaaagcctttcttcaaaaacggcaagagcgaagacctcaaggaatgttctatgaatggtacccatcaac

SEQ ID NO: 20291 - DNA, 612 bp, Homo sapiens
gatgcaaactgaaacagtggctcttcctgggtcttgagcttgccaagcttcctgttaaaggtacttcattggctctctggagtcgacagtctgccaactgcagtacagatcttgggatgtgacagtccccataattatgtaagccaaatttttgtaataaatattactctgtcttctgtcttccctctctctctctctctcacacacacacacacacacacacacataacacaaacacacactctttctctctccccccctttcttgctctatcaattaccctatggcttctctttctccagagaactctaatacacacatcataatcatagagcccacataaaagaataagcagatcatatatcatatgtaaatattaaatctatttgtgctaaatctggaatttctaagagcaagaaggaaggaaaataaaatgcttattttgaaactaaaatccttaaataatggtaatatcactggtaattaaaaattttgcttgtacattttggaactactttaaggctatcagggacagaaatatgtgcaacattctactgtattttttacaaagaaaaatttgaccatagatgcatctgatccaggcagaacatt

SEQ ID NO: 20292 - DNA, 632 bp, Homo sapiens
attactagctttgatcgctagaacttttcttctagggatgacacctccccaaatgcaaaacttgctcctgctagtgtaattccttaagcactccttccctaactacctccaaccaaatacacaacataagcacacaggaccttccctttcctgcctaggtcttgagttattttctccggaaatagtaagttggaggataggaggaaggcaacattttagctcttcttgtgtttttgtgtcttcatagccaggtttggaaaggctgcatgggatccgtggtggaagacattttaaactgatacccatcctctctccacctttttcttttttatctttgctcttaaaatgtaaaagttgaatgctttcagatcagaggaaatatttaaaggataaaaagccactttaaaaagtacttgcttttattcaacttcagagtgaatctctgcgttacttcagtttaaagttacaagcctctggatgcataactgtgagcatgagaagagaagcagagccttatattaaatcatcttgaaaaagtgatgtggatagtctgtaccttaagtatgcaaatctctgagttacctgtttaaccttatttagttaagcaaaatggaaaacaaaatatgcaatga

SEQ ID NO: 20293 - DNA, 624 bp, Homo sapiens
gggtgagggagtagagtgggcaagagcctgggtttcagcagagggagctggagaatgaacccaggggcgctggagctgggggcgtgggagagtgtcagagagctggcatgaactggcaggttgcctggaggggagggctggttccaaagccagtcttatagcaatttttccatttcttgatagtgaactttggaagagctaggggtggggaagatgggaagttgaaccacctctgagataaaactctctgagggggctgaggtggtcctgggttggggtgccccctgctactggcaagagagaagcaaactcaatatggaggtaagcttcccttggttaggccaggaggatgcccagagtgagacgaagcaatgggcttcaatataaaacttacccaaatcacaaagtaagccaccgagtgagagtcggcagaaaagaaggaagcaacagattttagaccccagggacggaatacagaatagccatatatgacacgtttaaagaaacacaagatgcaatcgcaaagatgagcatataaacgaatagaaatgaagagagacagagagatttgggggaaaacaaatggaacttcaagaaataaaaagtattatctcaagttggatg

SEQ ID NO: 20294 - DNA, 612 bp, Homo sapiens
gtgattcttaggccttaccaataatttgaataatttttcagaaagcactgatattttaattaggtctcagaaccctctagcccatataatataatgtagaaaccccaaatgatctccaagtaatttagtgttgacagttatcctgacctgagatgatctggagttggttgagccctcttaaaccctaatgcaatgttctgttctttacaccatgaacagatccttccaagggcgaaactagttattacaaaaataaattagcctcatgaagagatgaatatatagtagaaaaccactgcttataattggcccatctttcatccatgaattttgaaacaggaaaaaaattaaatatatgtagtctctcaacctaggccctcctcaacctagaattttcactctccttagggttagaaagaataatttcgtggtaagagctgaaaagctagccatacaagcaacatgaaaattagcaatcccctgaaggtcacaaaggggtagactctccgctctttgacaataggatcttgttcccttcctcaggaagtgcatataaaagtctgagcaagctggcacagataaatctcctcatccaatgattatatcacccat

SEQ ID NO: 20295 - DNA, 627 bp, Homo sapiens
tccggctgcagggcctccttaaactcaggcaggcaatgccattgaggtgttatttctgtccctatatcagtcaaagccattgaggcacccatgggctcaagtgcctgccgacctcaagcgcagcaccatcactctgggctcagtttccccatgttccaaagactcctctgaggccctttcctgctctgaaactgctgctctggggccaggagaacctgagggctgccatgtgtcagggatttcctgtaccttcctgcctgaagcattggggtgggcaagagaagatctcctccccagctccagcctgcaaagtagcattgcagacccacctcctccgttgtctgacaagactcccagctgaccgcgccatgtggggggctggccccatgcagggtgcttcccgctcaccgcctcactggcttgtcctccccaaaacgtggcccatgcatgagcccaccattgcacccctgggtggtgtcagtgtgagtcttccaagaagacaccaggacaggattagacacgcaagagagctatggaggaaatgcctgtgtaggataaggagaggaagcgggaggagcagggaggtccctcgggtgtcaatacaggtctcacctctgtgcaaggagc

SEQ ID NO: 20296 - DNA, 611 bp, Homo sapiens
ttgtttttttcctagtatggtgtatcatatgtgcatacatatacgtgtgtgtgtgtgtgtgtgtgtgtaaaacatgcccatatctggtccagtgcaatcactcatgcattcttttctctggagtataaaatctcatgtccatctaaaacatttctgcttttggtccatctaccaagaaagcagtggctaattcatttcaggtcttccaaatttcccagatggaagtcagacatcattaattaaaatttcttcaaaatgcaagtgtctcacatttggctcatactggtccacttaagatcctctctagtaaccctacctctcacctcttgcatggggctatgacacaaagttccccaaagacaccttcctcccagtttattcctgtgcttcttttgcgcactctgagtgagttggagtaaagagtgtgctgttgttctccggacactactataagttctatttggtgctctgtctcacatctctgttacctcatatgtggcactttagatcttaattatcatctctattttaataatttaacatccttatatctttttaacaaatatagtttattccttaggggaaaacaacctcttcctcagatctcactc

SEQ ID NO: 20297 - DNA, 519 bp, Homo sapiens
aatttcatacttttatctgagtagattagattgctcatttcacatcaagtcatgcaactaataaccctaggatgtgtcatcccaaactcactatcttctttagaaagtccctcttatgaacaacattcctcttgtggagagtggctgaataaaatcctaaatgtaaagatcccaaactggtaacttttcatctggaagttagcaagaatgccacctcagcagctgtaaggaggaaatacccttacagagatgaggatgcactgcccttgtcatctcagactattagagggctgatgctgaactactggactcatacaatgaggatcaattccttctcctcttgattttccttctagtaagggataagaagttttcttgcagttcatgaaatcataaaccatgaccatttagaaatctggctcagttcttttgctttacagataagaaaactggacaggacgtggtggctcaatcctgtaatcccagtacttcgggaagctgaggcaggtgaatcacctg

SEQ ID NO: 20298 - DNA, 601 bp, Homo sapiens
gtatatctcctaatgctatcgctcccccctccccgcatcccacaacagtccccagagtgtgaagttccccttcctgtgtccatgtgttctcattgttcaattcccacctatgagtgagaatatgcggtgtttggttttttgttcttgcgatagtttactgagaatgatgattaaagattttaaacattggaaagtttaaagtcttttaactccaatgaaagacctttgactaccccttactcccaaaagtttacatttaaattttaggagtaatgtagcattattaaaatgatgtccttttttaataataagagaaaatttcaagaaaagtaaaaccctatgtgtatgtatcttaacatattttttttctttagagaacatatgaagtgtgcatgtaggaatatttaaaaaaatattaatctcaaggaaatgctgttaaattatttgcctgaaattatctgttaggtcattgatacacaaacatttactactattttactgtataagacgcaggataccaaaatgggaaaaaaaaggtttcttttctttatggccttataaactaattacaaaaaaaagtatattctcagataattataat

SEQ ID NO: 20299 - DNA, 450 bp, Homo sapiens
tgggcttcagaggtatagaatcagaatcccaagggtgggagccaatatcacctagctatgcataagtatattggtgagccctaaagtatgagaatttattcctttagaacagaatttagtgggtctaacatcttccttggggtatttttgaaaaagtagattaagccttgtgcctagaaattctaattttgtagatctgggatggaccctgataattggaagttaacaataattttcccctttgccccaggtaattctgatatacatggaccttagatgatgactgcatttgcctggacttctacattgttatcttctacattccatcccattctacataccatctgggagttatttttatcaaatatgaacatggtgtcatgtctctgcttaaaatcgttggctaggctgggcacggtggctcacacctgtaatcccagcactttggga

SEQ ID NO: 20300 - DNA, 515 bp, Homo sapiens
gaaagggtgagggggatgaggcataaaagactacacattgggtacattgtactctgcttgagtgatgggtgcaccaaaatttcagaaatcaccaccaaaaaacatattcatgtaaccaaacatcacctgttccccaaaaacctactgaaaataaaaaaatatatggggaagaaaatataactgtttatatttaattttatactgtatgttttaaaaattatatttttgtttatgtttcatatatgtgaacatgtataatggattaaaaatagatatcaagagtgagtgttcaaagtattttagtcatcaaaaaagtttggatgctattgtagtgtgtcaataaaaagagtcaaactctaaaatatttgaagagatttattctgagccaaatacgagagacaatggcttgtgatacagctttcaggaggtcctgagaacatgtgcttagggtggttggggtgaagcttggtttcatacattttagggaggcatgagacatcaatcaaatacattta

SEQ ID NO: 20301 - DNA, 374 bp, Homo sapiens
gtgtttaaaccacccagtctatggtacttgatgtggcagcccaaactgactaatacaattgttaaaatctaccttccagatttcagtagacacaaaatgaaccagcaacatctcagagattgtgaccctttgtgtgtacaaaagatgagcccgctttttttctaaatcagtgtggaaactaaaagtaaaagtaagttatatcctaaaatgccaaagtttgtcgtaatccagtaatcactgccctctaaaatacgccattaaaagtagctccttagtaactcagtaaagttcaagtaattaatcacaacaacaaaatgccaaaatcctgtgtgcctatagctctaaggtatatttcagctctgaaatgctataat

SEQ ID NO: 20302 - DNA, 522 bp, Homo sapiens
cttaatcacggcaacttctgacctcatgaagaacaaagactgtagcattaacctgtgagtcttaagctcaggacacaactgtgcctgtgactgagaaccttttcctgataaccaattcatatgttcataacagatacagaaatgaagaaggcaaggtccttatttctataacaggagacaaaacctgaaaaataatcataatgccaaaatagaaaggagtgaacatcacaagaaattagagaaatctgacggaaaatatagctacacattggaatcactcagaaacattttataaaatggatacttaagtcccaccgataaattccgatttactggtctggagtgggacccaggcattcgtaatttttaagcctccccagatgctactaatgtgtaaccaggatggagaaaccctgttctaaataggtaggacttggggctaaacccatgactttcagctaggaggattagaattgcccatggagtttttctggctgggcacggtggctcacgcctataatc

SEQ ID NO: 20303 - DNA, 77 bp, Homo sapiens
ttttaaaatttatacaattaaacttttttctaacatgaaattttttgctttgtgaggataaaaagacaagctacaga

SEQ ID NO: 20304 - DNA, 450 bp, Homo sapiens
cataagttgagaagaaatctccctttgaatgattaccagatatcccaagctggtcagtgtgctatgatctattaattcccaaatcccacttaacctctcattaatttgtctatgaggacaactctgattacaggatgagtgactgagactgatgtcctccacatgggatgaggtgatgagggtagaaaaattaaaaagggttagagtaaaacatgcacagaacaatgaaaagccaaagataattgtcatattctgtctcattgaaatattggagactaataaatcaccattctttgcctatgtagagaagccttggttgcctaactgtgagaagcaaaaaagatgagtttcttacacatgcttgcaaccaaacctcatattttcaatactactactcatgtatattagagaaaaagatgagataaaagtagaaaacagtgtatttttaat

SEQ ID NO: 20305 - DNA, 587 bp, Homo sapiens
ctcttctatgtgagcaaaggctttagtagaaaatttttcttgcaattatacacctgtcctcaatggatctatggttcaaattgaccctttctctggtgtcaggaaactaagaaattaaagtgttcaaggataatagcaagccaaggaacttggaataatgaaatgcaaacatgtttggggatcaaaccctcaacacaggccacccacaattttatacaaaaattctgattgaagaagcattccccttgaaaaccagcatgagatgaggatgccttctgtcactattcctatataacacagtattggaagttctgaccagggcaatgaggcaagagaaagaaataaagggtattcaaataggaagggaggaagacaaaatgtcttcctttgtagatgatgtatgctatatctagaaaaccccattgtctcagctcaaaagcttcttaagctgataaacaacttcagcatagtctcaggatacaaaatcaatgtgcagaagtcacaggcattcttatacaacaacaggcaagcagagagccaaattacaaatgaacgcccattcacaattcctacgaagagaataaaat

SEQ ID NO: 20306 - DNA, 542 bp, Homo sapiens
gaaatgtgtgcgcactgtcctgagttttcatctataagaacttgagtgtgtatggatcaattaactggaactcctcagaaaacagggtgaagttttgaaagaaagttcaagttacataaagcattgaatcacaaattactttgtgatttctcagaggatgtcagcggtaaaggcggtaaggctcacatgtcagatctccatggggaatttttatacctacaaattaaagccaaattgattaccctgtatagataataacgtagagttggagatgccacataaagagaaaaatcttcagcaagtgtgtaattattagaaaaccatatacttctagctcatgattcttttctgctttgtgttgggtagatgcagaaaagttataagcatcaacttaatgtggttgaggctttctgaactgatctccatttaaccagttcactgcattaactggtgttctcaactccttctatgacataagtcaactgatgctcatgctgggtgggttcgttgaccatggacatcccagttgcatgccacgcact

SEQ ID NO: 20307 - DNA, 478 bp, Homo sapiens
tatttagagacggagtctcgctctgttgcccaggctggcgtgcagttcacgatctcagctcactgcaacctccacctcccaggttcaagcaattttcctgcctcagcctcctaagtagctgggattacaggtgcccaccaccacgtctggctaatttttgtaacgacaaaaatcacatgtaaccacacccaattacagcaaatgactgcaagaaactgtatcaaatttttttcttgttaatgtgtgctgcagacaatcttcagagaagtgacttatttctattggacttttcctggctaacattcctaagacagtgccatagctctacgtacctagatcaaagttgttggaattgaacaggaattctggtaaataaaagaactctgggataagttcttttacatctgccatattgtgctttgacgctgaataccaggcctcgcgcacactgtgaaacatccggtcagccaggtcaaag

SEQ ID NO: 20308 - DNA, 399 bp, Homo sapiens
ccattgtgattatcctgtggggtaattatgctggaattactatcaaagactggtagtgaagaacccccttcccccagttgtatcgtcatgttaaaaaagcaaaaccaaatacaagcaaccaaaaaaaacaggtcactgtggaatggctaaaaacattcctttttgtattagagactaatatgaaaaacctgtcctcttttgaaagatatttgtcttctaccttaatggaagaagcttgtagtttgtgaacattcaaacacatgacacaaataattgctaagttgttttattctgctttctgccaagtacttagtgattaaactgtatttctcatttcatcttactgtagtattgaaactgtcatgttctgctgaatagagccatttgtttctccacact

SEQ ID NO: 20309 - DNA, 641 bp, Homo sapiens
ctagctgaatggtaagcgctgcttgaaccaacaggtgaactgaattatggacttggtaacagtccttccattaaaagaccacaatatctgcatttagcagtaaaattctatcaattaaccccaaataaaaggaatcaagttattctactgtaaaaaagagcaacagtcctttctgtgatgatttaatttacacatttagaaattattctaacattcaaacaacattaaaaaaataacatcacctacaaacaagtaaaaatttaactgttgcaaaaactgaatggaacttaagttgttatccaatttgggcctataaaatttaaggaaaaaatggactctatgattcttccccctagtccctaagctacaagcttacaaatcttttcttcttacaatgcattatgtaacacttaaagcaaaactaaatatgaaattttcataatttttcatggttttatactttctatctttttactattacacaaggaattacaaaaattatgtatatttagtaatatcctattcaaaagtatggtttgctttttgcttaagattcctatgtgcttaattaatcattgaaaatactataataaccacaccacacacaacactaatgcctgcaccatataaaccaaactaaa

SEQ ID NO: 20310 - DNA, 469 bp, Homo sapiens
tacggctgtgggcatggtggcaaacgcctgtaatcccagctactggggaggctgaggcaggagaattgcttcaacccgggaggcagaggttgtagtgagctgagatcgcgccattacactccagcctgggcaacaagagtgaaactccctctcaaacaaacaaaaacaaaatatctatggtgcatgtaccaagccagtaacattgtgcccaacaccaactctatgcagcatccttccatgaaaccactgtattgaaactgtcatcttggactctggaaactatttgtagtatgtggaaggggccagcactgagtgcacagttctttatctcttctgtgccatggaccctttggcagtctggtaaagcctgactccttctaaaaatggtttatggccaggcacggctcatgcctgtaatcctagcactttgggaggccgaggcaggcggacatgaggtcaggagatcgag

SEQ ID NO: 20311 - DNA, 511 bp, Homo sapiens
attaggccaggcacggtggttcacacctataatcccagcactttgggagaccatggcgagtggatcagttgaggccaggagtttgagaccagcctggccaacatggtgaaaccatgttgtctctactaaaaatacaaaaattagccaggtgtggtggcgtatgcctgtaatcccagctactcaggaggctgaggcacaggaatcacttgaacccagaaggcagaggttgcagtgagcagagattgtgcctctgcactccaacctgggtgacagagtgacaccttgtcaaaagaaagaaagaaacaaacaaacaaagaaggaaggaaggaaggagagagaaagagagagagagaaagagagagagagaggaaggagaagaaacctcgaagactaaaattcaaggaaaaaaatttttaataggacagaattcaagaaataagaaatgattaatatcattaatatgtaatgattaatatgtagtaagaatataaataaagagaacaaagagaga

SEQ ID NO: 20312 - DNA, 512 bp, Homo sapiens
ggcaacagagcgagacttcgtctcaaaaaacaaacaaacaaaaaatccagccctttggattactgctttaaacataaatgctccaggagggcaacacatttcaccatcattaagacctttctgggcattaatttgtcaccttgctttgtaataccctaacagtaaagaaacttccccaaaccagaaagacttgctagggaaacagggagaggatcaggtctgatgctcaagggtagaagcctgggaaggaccccagagtcaggcctctgggaactgaggccagggggagggaattttggaacggaagggacctccgctctaaaggcaaatccccattggcccactcagaggcatttgccaatcagtggtaaggtggaggggaggctgggtccagaggtgctgaatttcagatggaagcacattcctcagcctcctccatggacatgtctcatgtgacagagtcttgctcatagcaccagagagctctagcctctatattgtcatcatgtgac

SEQ ID NO: 20313 - DNA, 575 bp, Homo sapiens
tgctgggaacgttacaatttgatgctttttcttacagaagtgacttagttagaaaaagtggtatgaaatttgtccctgactgtagctgacatcctcagtggcaccatctggaccctgaaaggcactcagatcatctttacctcactggctaggtttgttacagatgatagcacttaccaggcttcctccttgcaggccaaggtcgggtctgtgcaatcactgatgcatcctgctataagtggattaatgtctctgtccagttgagaaagtcaacacatgaacttagaaagaaatctacctggttttctaagctagattctgttggctcatggaatttattcagagtagatatgaagctgtagggggcatgactgagatcagtattgcatgtagacttcattttgttgttcagagtcttgttgacaatagtcttaaataaacgctgtatgagacaaacaaaatgcatttggtcccatgcaatgtcaattaaataaatcagaattgccaaaaaaaagtggtatgtacatgggaaaattcacaaaggaacataactatatagaaaagatgagcggatc

SEQ ID NO: 20314 - DNA, 543 bp, Homo sapiens
gaagatactgtcagtctgacatacattatgcatctgtctatccagaattcctcacactgctgatttctgaagagcattccaacttcagtggatctttttcatctctgcgtcttgaccatctcaacctggcccttctgacaactccagtgagaagaaggcagaaattaagaacagaatatatattttttggtctcagtcatgctcaggatggcgcaagatgagaaacagcctggaatttcccatccttgacaatctttaccatatcctgcccttcttgggcattaagatagagttaagagataggaaaaaccaagaaaagcaaaagagtcaaccaataagaagagtataaaaggacaaatatgtcaatagtttatgttatggagtttgaattctcacttctccactttccagtaatatgacattgggcaattacataaattcaattagcttcagtctccttttccttaaaatgtggataacaaaagggttgactccatagggttgttatgactcaacacataacataaaaagtactcaaatatt

SEQ ID NO: 20315 - DNA, 536 bp, Homo sapiens
aatcattgagaaaactagaaatacaggaaaattatgtagagcaattaatcaatttaaatatattttacagtttccccaccttgtataaactcctgaaaatgttaattagcatatttttctaaggtttctaagaagcagttgactctagtgactataagcttgtattttagagtatacaattgaaaaaaaaattcattctgctgcttattagcagtgtaatattgggcaagctactttattccaaaaaactagggataagatgaggtaaatactaggaattatcccatagttatgttgggagatttaattgggataatgcttgtaaaagcttaccacagttgctgacatatgctgaatatgatttttaccataattattttgatgatgaacccacccaaggttcatctaattataaaaaaactcattcagtgataactctggagctggactacctggagtaaatctcagtgattccatttactgttgtgtgacattgggcaggttacttgcctctcctgattcctcagtggcaaaat

SEQ ID NO: 20316 - DNA, 563 bp, Homo sapiens
gtgtttgttatactgaaggcttaataaatagtaaggagagtagttgttcagttgggtattgattaaggtgaagtaataggaaaagtaagggtagaatcgatgagtaatgatgaactcaaagcagagggtcagcaaactctagccattgggctgttttctttctacaagctgagaatgctttttacatttttggtaggttattaaaaacaaaaatgaagaatattgacagagactgtatgtggcccacaaagcctaaaatatttataacctggctctttaccgaaagtttgtcaacccctgacctgaaatacataccatgaagaaaaaagttagacttgttcccttttaggaaattggattaggtactgtaaagtgtaatatttcatggggctacattttcaaacatgtgcctttttcccacatggaggaaagaactgtcatgtatttagcctgctcttttgctataggggttttgcatacttcgattgttcttacccttgagagatactataaccactttacaaatgaagaaactaggctcatagaggctaagtaagcctaaa

SEQ ID NO: 20317 - DNA, 619 bp, Homo sapiens
gggacgaacaaccacgtctggccctcatctatctagttccttttctaccttatatgataatacacagtctaattttctctttttgactatatcataatatgaatagtagccagagattgaatattttatcttttttatactaataatgtaaggattttaaaaagtgtattgtggtaaaacttcataagaacaacattcctctgtctttaaagctataatttttaatgatagtttaatgtaaagtttattgtttcggcattaaagttggaatgattttcaagcatacttttaattaagtatttaatttatttatatgtatcaatatattcactcttcatctctctcctaggacctttgctcaatcatgtcaagattgaagtatctaagtttaatatcttcttcctctgtatcttcttcttaaacatcattcacattctagactgcaagtataattaacataatattggtatctccaactgggtgttagttaatctctttgggccttgcttttctaactataaaattatagaataaattttgatgatttctatctatgttcaattgatgacaattcttgaatgggaaatgtacaaaattgacctgaacatcttatcatacc

SEQ ID NO: 20318 - DNA, 398 bp, Homo sapiens
aaatgataaacaccaatgtaaaagcgtatgaaggaaagtatgtaaagctcaggagtaaatgtacagtcaaatatagaataacataatactgtaagggtggtacagaaataactggtaaccccaatataaaactttaaagaaggctgtgtgtggtgactcacacttgtaatcccagtactttaggaggctgaggtgggaggatcacatgaggccaggtgtctcacaccagcctggacgacatagcaagactttatctctacaaaaataaggaacaacaaaaaaattatcagttatggtggtaggcacctgtagtcccagctacctgggaggctgatgcagaaggatcgcttgaacctgggagtttgaggctgcagtgagctaggattgcaccattgcac

SEQ ID NO: 20319 - DNA, 598 bp, Homo sapiens
gattgttccaaaagtactttaggcacaactgagcacagatagtctttggatggctttaatccaagcccatttcaatatgcctctttttattgtccacacttctttctactaccactaacttaaataattcatataatcagctagaagagttttcaatgaaaactcatctttgaacacaagaaataaggactgagaagtggtgaacaacttgcaactgaggtattctgaaaatagtcctaacataatgtcccccaggtgtagccatatatggtaatttggtaaatcaacaatgaagtcttatgcaacagtgagaatctaagtatcaagcactagatgaggtactgggcaagagaaatacaaaagagaacactgctttaccccatccccaaggagatctcagggacagaaatgtcagcatctacctcaatacaatgacagctgagtgactatctcaagtgagaactgaagaacgtatcacaggagagctgatcttggagaaggaagaggagttggcttattagaaaagagagcctggtcgcgggtgcctgtaatcccagctactcgggaggctgagacaggagaagtgattgaactcatg

SEQ ID NO: 20320 - DNA, 571 bp, Homo sapiens
gtggatatgctgagtgatgaggacaaatgtgatctaaaatcagaggatcaactcatacaattgagaatcaatgtcaaagcagatggtacttgatcccacaggtctttcatgcaagaaatcaaaaggatttacaccattatactacagacattcatcatgctctttaacttgcccgataacagagaaggtacacaattacaatgacacttcagttgaatgtacacttcacgtctcttcagtggaagagtcctaaattgatcaccttggatatctgtttgctgaaactgagtagataatatttattattcctcacacccacgtggtgtaataatttgcctaagtttcttgtatccactcgtttagctttccaaaatttcttcatccattcatggcaccaaaggataatatattagcctcaataaaaatatcatcaattatcaattttgacatacttctacagagtaaaactgctacaagcgttagatattaatatgttttacattcacaaatcactccaatattcattgaaaatgaccactttaggagttaattagaattccacatacttttt

SEQ ID NO: 20321 - DNA, 154 bp, Homo sapiens
aataaaataaaataaaataaagtaaaataaaatgtgagatcctcaactaaaaacccaagaatctgaacctaattctatgttcctgacacatttgcttaaagctgggatgtcttccacatgattaccttattcaaatttatatctctagagcttc

SEQ ID NO: 20322 - DNA, 541 bp, Homo sapiens
aaatgtaatgcaaaacttgtccatgtctttcttcctcctacagcctttctctggggttttattctttttccttcaaaaatatctttcttatcattatctatgtcattagactgctgaaaatttatatctgcaatgctatctgtacacaaatcataatgtttgtgcaaacagcactgagatatgggtaaaagaagttatcatcccttccttgcaaacaaagaaatagaggagattaaataaacaacctacacgttagtaccagagtttgtcccaggtcttttgacttcccagatgaagactttttcttcaacactctcttagctgagatggacagacataagaagaccttcacagttattgcttatcttccattgttccttcagtgatggtctctgaccatatggctatattggtcttattattgagaacatgtcatctacctatttcctcacatatcaggcaaatatttcaaaatacaagtaagtaaatggctttgaaaagtcagtcgttacagaccaaaagaaaagcatacatctataaa

SEQ ID NO: 20323 - DNA, 553 bp, Homo sapiens
taagtaagctacagtttggtgttggttttgttttcccttttgcttttggtcccttgggagcacagagcctaatttttaggcctatttagtagggaaaaatgtatatggacttaaggtctatttttcataatttctatattatatttctctcttttatatctttagtcaatatattttctggctctattttattttcaattttactgtatttaaaatatttttacagcttgactcaatcctgtgaaatgaggcacatacattaaaggatataaacacacatatgtaaaaggataattatttgttttacaaggaaaaggtgtaacattttcttgtaaaatctgacttcactctcttccaatttataatgtaagcaatgcacgattaagaaaaaagtgctctgtaaatattccttatttgacaggtattattctggacacttatatttatttgacacttacacactatttaccaacaaattaagtatgtttttccattttatagacaagtcactgaagatcagagggcttaagtaactgcaaattccgattgactc

SEQ ID NO: 20324 - DNA, 644 bp, Homo sapiens
agtgcatgatgagtaggagagggaaagcgtagcatgagatgtgaaggcaaagcatgttcccaaatgaggcttgagggatggtttccaaggggaagtgacatctgtgttgcagcctggaagggagaagaaactcctgaggaagagactaggaaaatgggaatagatgaaacagccacacttgaagggaagaaagaggtgagcacctttcctccagtgagttaacagttgtaactctagtccctagaacagagttatcgaaacaaacttttagctaactcataatttcttaaatgttgatagaataacattgcttaacacagttaacgtcatccagctagagcttatgaagggcatcatatttaatgttgaaactcagaagcattctcattacaatcagaaacaaggtaagagtgatttctgttatctttgttatccaacattgttttggagacaagagttaacagtaaacaatatatattttgagacagtagaggcaaactcattcatttgtcttctttggatgatacacttatctatatagaatactcaagaccctacatataactcagaggagatcaaagttactgatacaaaataaatatataaaaatcaagaattattcttatacctcagcatacccatag

SEQ ID NO: 20325 - DNA, 556 bp, Homo sapiens
catgcttggctaatttttgcatttttagtacagacgggtttcaccatgttggtcagggtggtcttgatctcttgacctcgtgatccacccgcctcggtctcccaaagtcctaggattacaggcatgagccactgtgcctggctaaacagcattactatacattctatatttacaaatttacaggtataacatgtcttgtatgatacatatacttgtagaatacctattatatatagatacattaagtgtattatatatacctataatggaagtataatacaatacttctattaaagtttacaatgcaaagtgaggatactcttcattctatgattaccactataatggataaattctgttagtgtggtattacaacaaaattcagtacactacacatgagaaaaaccatgtacttttaaatttcttaagttttcactgagttaggatatggcaacatcaacaacaatcaaatacagagaacataacttaatctttttgttaacaaagaaggcaactgagaattttgtaatgcttcagtctcataattaagaaaaaa

SEQ ID NO: 20326 - DNA, 559 bp, Homo sapiens
caattctggtagaaaaaatccagaatggttctcagtaatggagctaaatgatttcagctctcctgttctctatagtactcaaatagaaggaggacagtcaccatatttgcttgttgcaattgtgcatgtgggcataagtttcagagatgtatgtcctgttgccccaacttttgcatttcctgtgtcattataaaccttttccaaagcataatgacacaaaacatgatcatatttatatggttcattagcaaaagggaatagctactcataggagagatgactgggccaagcccaacttggcaacagaatgaagaggggatcaatatctaggcacacctgtaaccatttgtggcacactagaatcacggggaagcactgccttagtgtacctagtatcatctatgttcacaagaggtgctcaatacatttgtcataaatgttaataaattactggttagtcttagaaatgcatggtttgggccgggtgtggtggctcacacctgtaatcccagcattttgggaggccgaggcaggcagatcacgaagtcaggagttcaag

SEQ ID NO: 20327 - DNA, 633 bp, Homo sapiens
tataaacactatacacttaggctatgctaaatttatttttataattttcttttctttttttttgaggcagagtcttgttctgtcacccaggctggagtgcagtggcacgatcttggctcactgcaacctctgcctcccggattcaagtgattctcctgcctcggcctcctgagtagctggaattacaggcacctaccaccacgcctgtctaatttttgtatttttagtagaaacgggatttcaccatgttgaccaggctggtcccgaactcctgacctcaggtaatccacccacctcagcctcccccaagtactgggattacaagcgtgagccactgcacctggcctttaattttctttctttaataataaattaaccttgctactgtaacttttttactttataaactttttaattttttttaacttcttgactcttaccaatattttgtactgcatgtaatcaaatatgggctatactgcttctcctgcaaataggtgatcagaacatggacaggaaagacacaccaatttctattcctctgagaagggtgctggggatagatctggggcctaaactgtgttcatgtgttttcttaactaaaacaatttttttaaaaaaaagaatctgaag

SEQ ID NO: 20328 - DNA, 425 bp, Homo sapiens
cagagcgagactccatctcaaaaaaaacaaaaacaaaagaaatgcacaatctcaggctcaccctgacttacagagtcagcatccacatgtttgttagactacccaggcaattcctaacaaaattaaaaggcgctgagctatttttttccaattaattgtagactgttgtcaaatataataaaaaagaatccggccgggcgaggtggctcatgcttgtaatcccagcactttgggaggccaaggcaggcggatcatgaggtcaggagattgagaccatcctggctaacacggtgaaaccccgtctctactaaaaatacaaaaaaattagccaagcgtggtggcgggtgcctgtagtcccagctactcgggaggctgaggcaggagaatggcatgaacccgggaggcagagcttgcagtgagcagag

SEQ ID NO: 20329 - DNA, 613 bp, Homo sapiens
tggcttccttactttctcatggatccttataaaccccccaccatctgaagtcacagaatttgttgttccttgaaacttgaaaaagccaacacactgattttatgaagtgaaatgtcattaaacattctctggattaatcgacaaaatcacatcttttttcccttctaaatgagaaagacaaaggaaaaattaataaagatggaatactttagtattaggaggaaatcattttattttcctgagcagaattatgttttcaattatcacagggttgaaaaatcttcagactagaaaagaaaaagtactttcagttttccctctttcccaccctaattaaataaaatatatgtgcaagggacagagtaacacaatgtttgccataaatgaaccaagcacatgacgtctatgcaatttaatagattgttcagttccatttaggtcacattagactttcatttaaaatgcatcacgttttatttattatttacaattataccactaaatgctgctaaatgtaccaagtctagatggtgcctgtagcatgcaagggtctgggcccaaaaaccagggtcacatagacctggaaagttaggcttaatatccactggcttac

SEQ ID NO: 20330 - DNA, 526 bp, Homo sapiens
ttgccagtgttggaggagaggcttagtagaaggtgtttgcatcatggaggtggtttctaatggtttagcctcatccccctagtgctgtctgatgataaagttatcctaagatctgcttgtttaaaaagttaaaaagcacctcccctgactcgtttcagccatgtgaatatgtgcttgcttccttttcaccttctgccatgattgtaagtttcctgaggcttccctataagcataagtctgtacagcccacagaattgtgagccaattcaatctcttttctttttcaattacccattctcaggtatgtctttatagcatgtgagacagactaatacactcatcctcagaaagcattcaatttagctgtgtctaaaggtatgccagctgtcctgggacattatcttagccaatcattcttcctcttcagcaagatctatttgcctatcacagcttgaccacacttcctaccatacctgtctgtaacaagtagcctataacatctggagggatttcattgaaatcacag

SEQ ID NO: 20331 - DNA, 502 bp, Homo sapiens
agacagattcagatgccacctttcctgtgagatgcaggttggcatagcagccactggggagctggtttcctgccatccacttgagagcatcctggatgttcttgggatcaatgaagatgaatttctgagcttggccaaagcattttgtgacaaacgctgtcagcctacatgggtaaagaggaaaatatggcatgaagaggaatttccaggtgagggtgcaatcatttcttcatttatttgggtgtatacttccagaaggggagctgagggaacatatgccatagcaggcctagaaaagagaggcattaatgggcaccaatgaggacaagaacaggggaggcacaagctcaggaagatcgagggacttgaccatccatgagggtgaaataaacagtattaaagaggtagaagactgagtgcaagaaggaaaggggttaaggggagaggtagtggaatagttccagagggctcaggaattatgctctggagtacagaactcatt

SEQ ID NO: 20332 - DNA, 623 bp, Homo sapiens
tcccgggacctgcgtgctgccgagagaggaagcgaagggcaccatctttgtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagtccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaaga

SEQ ID NO: 20333 - DNA, 433 bp, Homo sapiens
gagcaccgtcttttcccactcatctcacactatgctacttattctgaaattgcccaataaatacacctattaaggacacagatgattggtttgtctgaaagtccagatggaaaacagactcaacttttcttttttggtgtatatgtgtttgtgtgtgcgtgtgtgtgtgtgcgcgcgcgtgcgtgtgtatgtgtgtgtggtgggggagagaatgcacaaacactcgaggtggtttgtatatttgactggtgaatttcatagttgtttttctggggttacttagaatttgagagtccgtgagaagcattaggaagaacattactgagaaaaaaggaggggtgggaagcccctagacttctccccgagggtatccccgctgcagtcttctttagatgtttggattccccagtcctcttgttttgaggcgtgatat

SEQ ID NO: 20334 - DNA, 91 bp, Homo sapiens
tatcaaattaagtacgattgcaacacacaattccacttacacccacaaatgttcatcatgtattactcacaggaagcctcggaatctgctg

SEQ ID NO: 20335 - DNA, 521 bp, Homo sapiens
gagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaggtctctattctagctttctattcccatagtgaccatgtcaaagttacaaaatacgcaagagatgaagaaaaatggtgtaattctctacagaggaagagacttgattttgttttttgtttgtttgtttgttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctacctt

SEQ ID NO: 20336 - DNA, 507 bp, Homo sapiens
aaagcaaaagaaagagaaagaatagtaataaaagggaccaggtgtctgaaggctgagttgcagggtgccccattgctgaagaactgcttccagaatgcagctgtgtaagtctgccagtgtggccagtgtggctgggtgcaagctcttcagggtcccaggctacacacaagcgattttactttatttctaaaatggactaactcggtttgaaacttaacccaactcactcacaaaaggaatgttctctcatggccatgaatgcaaaaccaccacgagtggccacaaacaagtataaaatagacaaaatgaggcttggtgcagtagcccatgcctataatcccagcactcggggaggctgagggtggaggatcgcttgaactcctgagctcaagcccagccagggcaacatagcaaaaccccatctctacaaaaattagccgggcatggtggcatgtacctgtagtcccagctacttgagaggctgaggtgggaggatcacctgagcct

SEQ ID NO: 20337 - DNA, 513 bp, Homo sapiens
gttactggaattcttaaaattgtctaagcaatttagactatttaattagcactgtcaacacaatggaagattgagaagagaagcaagttcttcacaatgtgaaggttggattaaagatggaagtgaaaccacagtggtagtaagatattgtaatgatcctagttcttccagaactttcattttatgagtcagaatggaagggtatgctttatgtccagacttggagctccacttacatactcatgctctcgtaattttcgctatttgatcacgagtggcatatcccttattcttgaaccattcaccttattttaagtcggagtctgaagccacatctctaatattgactactcacaggtcctcgtggttcaacaagaatgatatccagattgtgcttcagaagtgctttgggtccaccacctactgcatttgtgtcacaatcccattttctgctaaatagggtaagttcttcccattcttcccattcctttacagtcttacttatgtgacata

SEQ ID NO: 20338 - DNA, 498 bp, Homo sapiens
ctagaagtatatgagtcaaaaccaagtaactaattgtttgcattattttcaatgtttaatcaatatttagagctttatgtaatgacttctaatagtaattcagaatcctctaaccagaagaatatctccccaacaaagtattttatttctaattctgcaaggtgagaattcaggcataaaaatggtaaaatatgccaagagaatgctgataactcaccttgattgagtgtcagggcaggagcatacaccaccactcctgtgtagagaatctggtagagaaacaagaatcagattggcagtgagaaagggacatagaaaggaaaactgcctagaaagttctttatcgacgttagacttgtattctcttcaacttgttcatgaaacattgcattcctgttgactctaattttgaagttgctcaccactatcagtagtctgtagaggggatgtaatcattagatggaggaagagagttggattttcaaaattgctactaat

SEQ ID NO: 20339 - DNA, 468 bp, Homo sapiens
acatattcactgaaataatttaaattcaattatttcacttcacgcttttagttttcatacgactgatgccataaagttcaattagtaggaaacttcaagttcatattttaagagaaaacctgctagaagagggactgtgaacttcacttaataatgctaggaactggccgggcgcggtggctcacgtctgttaatcccggcaatttgggaggctgaggcaggtggatcacctgaggtcaggagttcgagaccagcctgacccacatggtgaaaccccatctctactaaaaatacaaaaaaaattagcccgggtggtggtggcgggcgcctgtaatcccagcaacttgggcggctgagggaggagaatcgcttgaatccgggaggcggaggttgcagtgagccgagattggaccattgcactccagcctggcggagaagagcaaaaatccatcccaaaaaaaaaaaaaa

SEQ ID NO: 20340 - DNA, 429 bp, Homo sapiens
agataatattaaattctaagtccccagataatgaaaggtgcattgttccatcttgtggcagagaaccatttagaaaacattttgatctcattttttaaatcattagaatacgctgttgtattttttattgttttcatagcttaagaatgacccctattttttattgtacccctgttttggacaatttaacccttttgataacccatattttaaaaaaaaattttttgtttatctattttaactctgaaaaagtgaataaattgaaaaacaaaattagtatttatatggttccgactcccaggattattgattcctccttttttgtatctttatgtaaagcattattctttctactttctagttacagatacacacacacacaaacacacacacacacacacacacacacacacacacagtgactattcc

SEQ ID NO: 20341 - DNA, 563 bp, Homo sapiens
gcggaaaaaatcacaagcctaatttaaacaataccatttattgtcgaacttgagaactgaacagctaccagctttaaaaggtttccctgagtctcacacacacacactattttatactagtttctacacggacatggttaacgtgacagggttatgtgatgagctatgtggtacatcaccaagaagagaggactcttgtgaaagcagggtttaaatctctatgtcggattcaaaattaatttgaaataaatggtagacctaaatataagaaactattaaacttctagaataaaatctctgtgacattgggttaggcaaaaatttcttaagcaagacacaattagcacaataaagaaaaaaaaataggtaaaatgaagttaatcaaaatttaacatttttgctctctaaagacacaagtaaggaaatgaagccattggaaagcagcagccagggctgctcacctccaaggcggagatccttaacaaaggcttcagggtgaccaagacatgagcaagccagggtacagccactactgccaccccgccaagcatacaaagttcaag

SEQ ID NO: 20342 - DNA, 636 bp, Homo sapiens
gagatgccgggcgcatcaccccctctctgagcctcagtttccccatctgtaaagtggggagagaattgcacctcatatggctgtagggaggattcgaacaagatgacatgtgtcagaagcggggccaatgggaagcacttggtgaagggggcacccttccagtaggcacagtctgagtgcccggccccatcctcagagctccttgtctgtctggtccagtggaggagacagaacccagaaagagggggctatgacagcatttcccagacccagagaagaaggggagagactcagtggctctggccacctccccttcaaggctatacagtccagaaaggcctccgcaatccttttagagagggagaaactgagcccagaggcaagaagggcttggccaagatctccccttatctgcagccgaggttgggtgaagccaccagtcctcctgcctgccccatccatgggtctttctggtgccacagactgggaggcagttctgcagtggactcgaggcagggcagtgatgtcctttgaccctgtcccacctatcccctacccttatctttctctctcctttctcttccaccctacccaccactgttcctcttcctcagcccagcgaagagaaataaccct

SEQ ID NO: 20343 - DNA, 626 bp, Homo sapiens
gaaataccaagtgacagagtggaggccagctggatggtggctgcatgtggagtccaaggagtccaaggccatgggagtttggttccagcttagggaagatggcacaagccaggcctttggagttggagcttgaagagtaggcggggcacagccctagtcacactgtgcagaacatcctgaagacacgtggcttctggtgactgcagtcgcaccggctgaaattaagcttcccttgaggtcccagcactccttctatctggcactgttccttacaatcagcatagagtttgctcaccactgcatttttgtcccctcccctgtggattctagcagaggttagagccttctctagaccttgcaggctggactctcagaaggaaggaagaagtggaggaaggagaggtggggattgaaaatgacttgtattggccatgcatggtggctcatgcctgtaatcccagcactttgtgggagctgaggcaggcgaatcacgagacccagagatcaagaccatcctgaccaacatggtgaaactccgtctctactaaaaatacaaaaattagctgggcatggtggcaggtgcctgtagtcccagctactcaggaggctgagacaggataatcact

SEQ ID NO: 20344 - DNA, 533 bp, Homo sapiens
tggaaagggctcaattcattgacaggacaaatcaattcatttgacatactctgggtatgagtttgattctcttacctgcagtgcctgagctagcccagaccatgggacccactttaaaacaaggatgtgtccgtggacatatgaccatgggatccactggccctatcatataccacaacacccagaagctgccagtctgatggatccatggaatagttctttcaagacatagctaaggtatcaacttagagatgacaccctgctaggattgggcactgtccttcaggatgtggtgtacatattaagccaatgactgttatatgatactatgtctccaaaaggttaaacgcatgtgtgcaagagctaaaggttagaagtagggatattcatgcttaccattacttccagtgacccacttaggaaatctgtgcttcctgtcccgctaactctaggctctgagcttctaggggccatggtttccagagacagaacactttcaccacagcacccattaaactttaagctacaccact

SEQ ID NO: 20345 - DNA, 76 bp, Homo sapiens
aaatacagacttttctaatacatggtgctgactcagatacctagacaaggacatgaggagatacttactatataag

SEQ ID NO: 20346 - DNA, 583 bp, Homo sapiens
ggagacgagtggggagcagatagcagcacaaagggcccaatcagacatttcttaccatgatagatcctgatgtgcagttgatgcccaggacagacagaggtcttgggagaagctgaggttgctttctaatttctttctctttctttctttctctctctttcgctctctctctttctctctctctttcttttctttctttctttctttctttctttctttctttctttctttctttctttctttctttctttctctctctctctctctctctttctttctttctttctttctttctttctttctttctttctttctttctttcttttctttccttctttccttctttctttctttcttcctttttgacggagtctcgctctgtcacccaggctggagtccagcggcatgatctcagctcactgcaatctctgcctcccagtttcaagcaactctcctgcctcagcctcccgagtagctgggattacaggcatgtgccaccacgcccagctaagtttattattattattattatttaatagagatgaggtttcactatgttgcccaggctggtcttgaactcctg

SEQ ID NO: 20347 - DNA, 570 bp, Homo sapiens
gacacattcaccttgtacttcacattttcttctactgagtcagtctaatgtaacctctctgaatacctctagcacttgtttctataatcctcatttcatgtaattgttcagtcatctgtctccctgtctacattcaaataaggaaggcagagaccagatctattttttccattgtattctgaaaacctagcacagtacctttcagttttatttttatttttagacagagtctcgctctgttgcccaggctggagtgcagtggtacaatctcggctcactgcaacctcacctcccaggctcagctattcttttgcctcagcctcctgagtagctgggactacaggcatgtgccaccacacccagctaatttttttgtgtgtgtttagtagagatggggtttcataattttgaccaggctgatcttcaactcctgacctcaggtgatccacctgcctcttactcccaaagtgctgggattataggtgtgagccaccgcacccagcctcagtacctttcacatagcagattctgaacaaacatttgtggtaggaatgtcttgtagcttttcgt

SEQ ID NO: 20348 - DNA, 575 bp, Homo sapiens
tagtccaatgtgggacacatctgagggtggaatgagtgctatgaaacactgtgcaggctctccagcaccaacccaggagtactgtcttcttcctattaggtgggtgcaaaagtaatcgcaattttcccattactttcaaaggcaaagactgcagtaacttttgcacctaatactatagctttctattgaactgatggagcacattgaagccacatagaattgattcttcatcctttttgtcctccggccagaaggcccaggtgagcaggcactgactccaaaattgtttaatgcttgtataaaacctaaatttcctatccaaatatgcacagagcttatgcacacacacacaaacactcccaaagagggagcctatggtgcatcctctgacacactcatgttgctcatttacagccgtaccccagtgcttagtgcctggtacaaagtaggtacccaccaaatgcttgttgaatgaataagcaactgaacaaaggggaaaggcagccaaggcagatgaaaccataactgagtcttaaacccagcacttctccattggctagtggctccctcctgca

SEQ ID NO: 20349 - DNA, 602 bp, Homo sapiens
aagaatcttttctatctacagaactagagagatagcagcatgaggactctgcccactattgctggctttgaaaatggaagaaggggtcacaaagtcaaataatataagtggccactagaaaagacaagaaaatatgttctctcttagaatctccatgaaggagtgcagtcctgctgatgtattgactttggccaagtgagacccatgttagaatgttgattcctagagtcttacagttctaggagtcagacatgaacaacaatttgtgttgttttaagccacttagtttatggtaattttttatagcaattggaagtatatatatatgcaagcacacacacatgcatacacatacacaaatatgtacacatatacacaaacatatgaatacacacatgtgtataagtgtatgcgtgtatacatggatatacacatatatgcttatatttaacatccatatttacatgtatcgtgtgttatactttctcaaagtcaggtgatatctcctttaaattctctaaatcttttaagaaaggaattcattgctgatttaacacaaaatcaattttaatattgtccaaatatttgattagtaatatttg

SEQ ID NO: 20350 - DNA, 641 bp, Homo sapiens
cagcaaactcatttttgtgtcacaaaagaaggtatgagatctcctcagagaagaaaatctgaggaagaaaatcctgagattttcctcatctacaaaataggtataataatacccatcttataaagttgttgtaagaataacgtgatttaagatgcctggtacttaatagggactcatcaaacattatccctgttttaaaatttctcctagaatttctacctggtctttgattactgctgaagcatagttactcatactaactgagttgctcatactaactgtctgacatcctttcttaccaaagtcacaattcaccagggggaaaaagaaaagccagagttaacactttgggctccaggatttagcgaattttcttcaaagtgctgttgcttggaactattcacatcaaagccagcttgtagctagttctcatccagatttggattcaacacctactttctggaaaatttatatccttatgtaagtgaaatagtttgtcgttatgttttcccttgagttttagtaaaagacatttaaaaagaagtccaaaaccattttgtctgaactaaaagagaataaaaagttttctgccacatttgtttaattataacttgatcaacactggcaagactttcctcaca

SEQ ID NO: 20351 - DNA, 539 bp, Homo sapiens
ttagatttccctaattatgaatgatttgaggagcttttcatgtgcttattggccatttgggatcatttttagagaaatttctacttaactcttttcttgttaaaaaaaatttgattgttattgcttactagcggtttaacctcgtactaggtgctcagtctctctgggactgaatcttctcatcttaacagcagggacactcacctcacgaggttgctggggtgcataagatgaggtggtacgcattgatgctcaacccagtgcctgattcacgggagaaacctaaaacatttgttattattgtaccactgtgaagaccagctgattttcttgagagtattttgagaagcagcctggggtatggatggaaggtaaggaccccaaccccacccaccaaggaacaagcttcatttgcaatagatggtgatggttggtgcccttttagctcagtagtgtttcaggtaaaggccagagctgaggacaatagaatttcggaagggacaaaaggaaacaagctggctagtgcccagggaggacat

SEQ ID NO: 20352 - DNA, 586 bp, Homo sapiens
gtgatctctttgaaacacatctctaaagccaaagtatcaattgaactaaatatgtcatagagcaataagaaagtgaaacaccacactgcttcagagggatcgttttaaacatacattggctagtttaggagctcattgtttatcaaggtagaaattcgagccaggaaaagatagagactaatcagtattttttttaaatccatgtttatttatattcatgatcttctctatggatttcttagtcttcatggtgattttaagagttggctaaagaaattttaagtctcataagttgcttgttaattcaagagaaaagtatttacttctgttttgctaaaagatagccaaagcaattttgattaacaaaggttgtgatatgactctgagttaatggcatgttgaaagtaagggcaagtcagtaagatttaacccatatgttgaaagtagctcataaataaattcacagtctcttctgacaaaacgttttctgagaattggtacattataggtgtgtatctggtagtaaaatttattagagaggcagtaaaaaattcattaacataaacaaatcaaaaatccaatgcat

SEQ ID NO: 20353 - DNA, 480 bp, Homo sapiens
catcagtgaaatgaatttatatttttataccagctttcagtataaaaactatctgggccaaggattattagataatattatacctaaaatattataaaatattgatacccagatgatttaaacatttattatctcagaacacattatggttaagatcatgtatcagtcagggctatagatcaaaaacaaaagaaacaggctctggctaccttaatccataagaaaatttattggaaagataacagcattaatggaaggctagaaggccagtcttggggaactggtgggaggaatggagccccaagaaagtaggaatcacagaaaagtttatatggcaagagcaaactggtctgcttgccactcctggagcagcctctacttgaaagtttcagaaaagtgcaggtggtaaacaaggtatgtcataattaccactgactgttccaaagaggagaggatatcccacccatttggtctccatag

SEQ ID NO: 20354 - DNA, 456 bp, Homo sapiens
tatcatcttcattatcttctgggtgtttactgtgtcttaagctctaggctaaatgatctatatacatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgatttt

SEQ ID NO: 20355 - DNA, 637 bp, Homo sapiens
agggttttctttttaagacattgtggaagccattctggaattaaaagcattataatagataagcaactatatttacttttattatggaaattaacagataggaaaatagaacagaaagcaaggtttaataatcaaataagaatacttacatgtcttctaaataatattaaacacctatcatctacaaaggtaggttgaaatattattgataattgctgggttttacttgccaaattgccacaaacacacctaatacctgacagtgtcaattcaactgtccgtgattagaagataacacactggaagtcgcacaccaccataaaactgaagccacacatgcgtacaaatggcgacagtgtctggtgtacagcagcgctctgccttgtccagaatacacacttgaattctttgtcacaattcacttcacgtggcactgcaatagcgtcctctcgctctttgttagttaattttaatggcttttaatttcttcttgctgaactgtttgcaattataatgcaaattatggatactagtccattatttgtggatgtgacatactctgattacccctttccattccattgttgtctacgaagttcacacttgagaatcacatagtcaaattacaaaaaaaaaa

SEQ ID NO: 20356 - DNA, 550 bp, Homo sapiens
ccatcaagcattttgagcaaagccaaaatattatgaagaaaataaaagaatgaataactatcagaataagaatgtgtggagatctgactaaataatatctctgttttattatagaaggaaatgtaaatttatgtggaagagtgctttaaactgtaggaataggacttccaagaaggtatattttggcacagttgccaagttcatgacaatcaagtaggtcgccttggaataaatgaaggaaagaaagctctctgccaatctgcaatcgcaccccttactcctactgaactggcacatatactcacagatattgctagattttaggttactgagtgacattgatttgtaggtgggaatcattagtgtcaaaagagtatgtacaagaaaatgttttccttctgtttccctttaacacattcctgaaattgttaaattgagtacaagcattttgccacatggaaaaaggcatggccatcatcacccttcctttttactggcatacttaaacattctcatgtttttatcttctgttctcccacagtatactagt

SEQ ID NO: 20357 - DNA, 608 bp, Homo sapiens
ataataatcattattgattcctgccatagcatcatggagacccagaatcaaattaaaataagtgaatattgacagatttcaaagaaatctaattaaagtcttcctaccattttcttatacttacattgtttgtagttacaagtaatatttgccttaataaatagttatacagtatataaataaaggtctacaacctattccattgccaccgcccaaccaaagttctattttattcaaacacaagttattttgctaatgtcagcctaatttataaatgcattaacccattcatgataaatgttaaaaatttcatcatacactagcttctccttgagtctcaatgtaagatggtaacagcaatttgttttgctactaagcttctggacaaaatatcaaaaagtctcataatcctgaaatttcatcatttgtgaagctgggatttccatgcctatcccaccatgttcaggggagaattaaatgttataattgttcatgaagggtcttagcacagactctggcatgtaggcaaagatcaatagcactaattggaatagacgctaattggaatagcactaattggaatcccatccatatcccacacttctctg

SEQ ID NO: 20358 - DNA, 637 bp, Homo sapiens
atgtaaccaaacatcacctgttccccaaaaacctactgaaaataaaaaatatatggggaagaaaatataactgtttatatttaattttatactgtatgttttaaaaattatatttttgtttatgtttcatatatgtgaacatgtataatggattaaaaatagatatcaagagtgagtgttcaaagtattttagtcatcaaaaaagtttggatgctattgtagtgtgtcaataaaaagagtcaaactctaaaatatttgaagagatttattctgagccaaatacgagagacaatggcttgtgatacagctttcaggaggtcctgagaacatgtgcttagggtggttggggtgaagcttggtttcatacattttagggaggcatgagacatcaatcaaatacatttaagaaatacattggtttgggccagacgcagtggctcatgcctgtaatcctagcactttgggaggctgaggcaggtggatcacctgaggacaggagttcgagaccaacctggccaacatggtgaaaacccatctctagtagaaatacaaaaattagccaggtgagatggtgagtgcctgtaatcccagctactcaggagactgaggcaggataatcacttgaacccgggaggca

SEQ ID NO: 20359 - DNA, 565 bp, Homo sapiens
ttgctcattcattttgatggtagtgaaataatttccctaaattgaaaatatatataccacttgacttactgtgaatgaataaaatgagactgatttaaatgatttatttcatatatctgggttttccattaaatgcaagactacatatatgcttgtgacttcacatggccctgctttgaaatgacacaagctctgtaataaatattgaggatgacagaatccatctcctcatctcattgagaaatcttttaaagaactagaacatgacaaacattattctgaatttcagctctgactcttactagcttctaaccttaaagaagttaggaaatgtacctgaaatctctattagcaaataaaattttaaaataccccgttaaagattcttgaaggatgaaaataatgtttgtaagagctagacacttagtgcatgatacttattgttagcccaatgcagggaggtgccatgaactcttccatatttttaagcacaaatatttttaacttttatcaagatgtgtgacaactcagaatttgagggatttgatgaagttatttatcatta

SEQ ID NO: 20360 - DNA, 490 bp, Homo sapiens
ttatttattatctattggatgatatccctaaatatctgtaaaatgaatgaaatcaatcccagctcagaaatacattctaaacttttgataatacccaatttgcctatagatctatcttcacaatcagataactcattgtgcttgttttattttttaaatagttttcctggctcattgaaaggcactgcatgaagtatgccagatgatagtcagaacaatcccttatgtatgtaacatgcatgacaatttcaatggtactctcatgtccatcatccaatttaataatgagaaaaaggaagactaaaacattgtttctgttttcaaggagattacaatttagtgataacatattaacacagaaacatgccagaaaaaaaagaacacataattggaagccaaattgtatgatttcagactataaacagctgagttcttcagagggaagggggcttccatggggcttggagtcgttaaggagggctttgtagag

SEQ ID NO: 20361 - DNA, 259 bp, Homo sapiens
tgcttagtagattcttgctcaatgtttatttttaggaaacaatcaaatccccttgtggttattaaattaatttagtatcaggccgggcgccagtgacctcaggagtttgagaccagcctggccaacatggtgaaaaccctgtctctacaaaaatcccagctacttgggaggctgagacacaagaatcgcttgaacccagaaggcagaggttgtagtgagctgaaatggcaccattgcactccagtttgggtgacagagc

SEQ ID NO: 20362 - DNA, 441 bp, Homo sapiens
gagtgctgccatgaccatctctgttgaatttccctattctctttcatctgtcatcataatcccaccaggaacttgagtgaaattggaggttaagggagagaaaggagggagcaagagagttaaaatcaaactaatttttaaagagaactggaatattgttcattcagtgaacatatgatttgttccctgttgtaaatgaaaacttatcaattccacaaggacaaaactatgacctaatgaggtccaaagaagaagaaaatatctggaaagaaaaagaaaacatttcaagcactgggaagttgagcatgggcttaagccaaccaatcatgtcttgcactggcttctggaagggaactatggaataatctgggaactggagcccttactcagttatgtacaagaaactatccaaatctaacttccaaattttggcacacctga

SEQ ID NO: 20363 - DNA, 449 bp, Homo sapiens
tattagctagagtagaatgtgaggaatggttgattataattaaaatgcagctaatgaaagagctgtactaaatatgtatgctgtaaatcttcctttgccctcttcaattcttgatgtttttatatcttatactaatgcttttcaaacttgaatcgtctatgtaaagcacatttatttaggtttccattcctgtaccatgtgtagaataatgactcagttctcccatcttttttgtctattaaaaggactgtgaacctttcattcgtctggtgttttttgacataatttggttttcacttcatacacatgcattatgtaataagtgcacttatgttggttcctcatttgtgcatactagagtgggtgttactgggattgtaaacaaaaagtaaattcagatgcagaaattttattgtttttctctgtcatctagatgattgagaatatgc

SEQ ID NO: 20364 - DNA, 568 bp, Homo sapiens
gaaaacattaaacacagcccagttggtagctagattgcataaaaactcatactgaaagcctgttgctttgatgcctattgtcagatacatcatgtcctgctttcaacaaaaaaaatcacaagacatgccaaactacaagaagaaatacaacctaaagaaaaaaagttaatattgaaactaggctcacatgtgacacagattttggaatgtttagataaaaaatttaaaatatttacgactaatacattaggagttctagtggaaaaagtggacagcatgcaaaagcagataggtgagataaacagagatggaaactcaaagaaagaatcaagggaaatctagaaatcaaaaacactgcaacagaaatgaagaatgcctctcctgagcttatcagtagactatatatgacctaaggaaaagactcagcaaacatgaagatttgtccataataactttgcaaactaaaatgcaaagagaaaaaaagaatttaaaaaagaacagaatatccaagaatgtgagacgattacaaaaagcgtaacataagcctagtgggaatttcagaaggaga

SEQ ID NO: 20365 - DNA, 625 bp, Homo sapiens
gaggataaggtgcagaaaattaaaaaaactgagccatttgagataaggaattttaatgtcttcacacagtattcaattctaggaatagactaaggtgaaacaaattactgtgaacatgcttctcattgcaaagatttagaaatacataaatactttatatgtacattatctagtagggaagaaatgtagctccttggcattagacaagaattgggagttgaaagccaatgtggtagacttgagaaggtgatactgtggcagtcctgtacatttagagaatcgagaaataggccctttgtgttaaggggcttgggagtttaacattcacaaaaaggcagaaaaaaagacctcagcccatcatgagagacagttagaattaggacatttaatatatgtaccctaagaagctggctcagtgctctctggagaagaggactgtgaaaacttccatccaccaccatggaaagcatgaaccttatttcttctgataccttagatgagaaaaaaaaagtcttctgtaagcgatacaaactccaagctagcaatgagcaagggattatatctgaatttacaatacacaagttgcaaataaatctctaaactgaaactttaacataaaactgat

SEQ ID NO: 20366 - DNA, 605 bp, Homo sapiens
tgggtatgggatgacctcaaggatacagaaattccctgatttgggagtttgaggaggctaatgatactctttttccctgcctaagtttgaaaccaattaaaaggagtcagataaagataatcaaatatcagttttattactaattaatgctaggtggatatgatttgggtgtatagcagtgttcaataccacactcttccatcatgagaccactatcccaattccaaccacagctcctttgggaattctcctgggactgctagtgggcagtttcaaatctgcccccctcctaaaagctctgaaataacttagaataacacattgattcaatcaacttctagacgacactgacccatagctgaaaaatcattccctattccgtttcccatcccaaagtatttctcaccatttcagccagtataggtcaccaggcattttgcagtgagtttacataacaatattaacatgcttcaataatgtcagctataaagatttgctccaaaaattgaatatatgtcctctccccattataaaattcctgaaggaaaactaaagtcctaatagtaaatccttttgtaagtttattatttattcataggtaatat

SEQ ID NO: 20367 - DNA, 584 bp, Homo sapiens
cagtcagagacagtgtagagtctgagacacaaaaccggaccgaaatcctctcccataatgatgctttttgttgctgtcaccagacacattatttcctgtgagagtgacgatgagcgctgtggttaaagccagtactgctctgaatcttattctaggttagggaagaatatctaacatagtgaatatttttatccatgaaagttatacactgctacaccagcacaatcacaagctccaccctcgtctctcacatgccccgcagaaccatggtttcctccctctgtgggtgttgcagctgagctggacactccttccaccctgaaagctgggctgatctgctggtccttatggtccaagctctcagggccagttgtgaccagaaagctctacattccagggtcagcctccagccatccttgctatcggtgaactcctatccactactgtctacattttgacaggtgaattttattttagtttctgtttcagagtctttattaactgctcacaattcttcatggtccctcattttctcctgctgtggatttcagccccatgcttatttccacgtccatggctggagc

SEQ ID NO: 20368 - DNA, 599 bp, Homo sapiens
tggcacaaacatagctcactgtaaccttgaactcctagcctcaagtgatcctcccacctcagtctctcaagtagctaagactacagacgcacaccacaccacatatgtaattttttaatttttattttgtagagacaggctcttcctatgttgcccaggctggtctcaaacttctgacctcaagcaaccctctcacctcagcctcacaaaatgttgggattacaggcaagagcccccatgcctagccttttaaaaatacacattctatagttagttctctgcattatgaaaatgtaaagggttactaaactgagaaactaaatgcaaaccaataacaaccgcacacagcctactgacatttccatttcctttttctagccttggtcatgtaatgctagttactgttccacttagagggacaatctcatttgcagctgtccttaaatgaaactgtgtatgtctgattccctggacagcactagttcctcctggctagctatttaaattgcattagtatgcactttgttcattaaggcctaaaagccttcaaatgccacactttatgagtaaagaaaatattactcctgcaattcaacagt

SEQ ID NO: 20369 - DNA, 578 bp, Homo sapiens
ctatgcccagctgcatagccacactaccctacctggtcttccactctcccagtggataaagtaatatttcttccaatgagatgcatgtaatttttcattatatggtttcaaatcaagctctagtcttagaaacagaaaatcaacattgtgaagtattatagattttgcatgtctaaacagctgtgatgaattagtcacagttacaatgaactgtaggaaaaatccacaggcaatacattgcttttgcaagttttatactaaagtaaaagaaaaccctcaagtaatattatataataaattattgtaacagtggttggtagtaggagcaatttaaataagattaatttaacaacctttaaatatcaataagtaataaatatcttcatgcatgggggtccacgtttcactttagttagaaataatgaataatgccagttgcctaatataaccctaataacagaataagaatacttggcactttaacaattttcattagacgagctcaagtatcacttccattggacaaaaactgcatctgttccatattaggcacacaaaaaataagttatataaagaag

SEQ ID NO: 20370 - DNA, 632 bp, Homo sapiens
acatggtacctaagatactagaatacatttataaatatttgttgaggaactaattataaagactattccaggtgctttagggttcagccacaacctattataagtaatacctattataagtgggtgcttgtaatagatattaccatattatctaagcactcactttaatactcattgttctgggctccacctgatgttatgatatgaatctttttagctatactctgatccagaagatcacatgattagcatcaatttctaaggacagtaataaacttgatagttctgagcaaatacatacactacagaatagtcattcaacaaatatttattgcctgcctactatgtagtctatatatacctatatgtaacacacatgcaaagaacagtctagttagtagtttagaaggaaggaattggatgttaaacgggcctgggttcaagcactggtgccaccctttaaaagcagtgaaacattgaacaagtcttagattccttatcagtaaaatgggaataaaagtacctatctggaagaattgttgtgaggattacatacaataacactgatgaaatactagcccaggacctggcataattgccaatttaaaaagagcaacttggtaaagtgctag

SEQ ID NO: 20371 - DNA, 650 bp, Homo sapiens
tgatgggtcaaaaaagaaatatgaaatgactgccaaggagcaatgatctaattaaacccagaattaagttgataaaactataataaggaagtaaaaacactaattctcattagactgaaaagttaaggatagatattataatcgttacaggcatgattcttacattttagagtgtatcagaattagataaaacttgctaaactacagattgctataccccacacacagagtttttgattgagttagtggaggttgagggctgagaatcttcgtttctaataaattcacaggtggtgctgctagtctcaagacgacattttgagcatcattgcactatagcacccactggaagcataatataaaaaggtacaacaagccagcagataaaataaaatggaattataaaaaatattcaaacatcccaaaagaagatagagatgagcaaatattttttaatgagaaatattaaagagaaaacaatagtagactcaactcaaattatataaataattaaatattaatgaactccttattcagttaaaaggcagaacttataggaatcaacaaaatgaaagacacaattatatgctgtttatagaaacctcacattacatataagaatacattaataatacagataaagaaagatg

SEQ ID NO: 20372 - DNA, 627 bp, Homo sapiens
taagctgtaccatccaggtctgtgtgagtattgtatactctgatgcacgcatggcaacagaatggcctgaagacgcatttctcagaatgtatccctgtccttaggggacacatgactatagtttgttctggtgcattgttttcaaaaagagcctgtgtgtagaacactgcattttgtatattttcaaaggaacaggtggtggggtagtgtgcagatgtggaaatgggcctggcaacggccagatcccttcctttgtcccaggtattgtttggaagcatcatttgtagtgaatgactaatagtgttctgaagcattttctattgttctaagttgtttccatcattctatattattaaaagtattacatagttggctgggcgcggtggctaacgctgtaatcccagcactttgggaggctgaggagggcagatcatatgaggtcaggagttagagaccagcttggccaacaaggtgaaaccccgtctctactaaaaatacaaaaattagctgggcatggtggtacacgcctctaatctcagctacttaggaggctgaggcaggagaatctcttgaacctggaaggtggaggttgcagtgagctgaaatcaggccactgtactctagcct

SEQ ID NO: 20373 - DNA, 632 bp, Homo sapiens
aaccttttaagtgtccaagccaggtaccttgcaaagcactccatggattccagtcactgtttcctggtaagattgcatttctgagccagcttttctatctatggtgctgtgggtcatggggttggctttgatgctgtggcctgaggatcttcctaggtatttggggttagacttagagaacaaagagcaaattttgtataggtttgaagactcaaacttattaatacgtctctgaaggactctaggtttattcagtccttactcaccaccaccttaacttatacaaaatcagtcagactcgctacagaatgacctctgagatcatttctaaaattcacagcagaaaaggaactgaagtgtttgattcatttttcttctgcactgatgatgtgggctaactctcaaggcaccaaaagtaaaatagaggttgattgtagacttggaagaagaggatttgttgtttctgtcttgagtatttatgaagaaatctcctcagcctccagcttccccataacagactgaccaggctataaattgggctaagactttgaagtgtgaaatgttggggggtgggtagacagaaaaatgggctatcattgccacaagccacccagcactcagacagctcctct

SEQ ID NO: 20374 - DNA, 511 bp, Homo sapiens
gattcacaagcactttatattattgatcatcagtttccacatttattcctttgaaagaaatacatccttggatttttctgtacatattttgacatttgttactgacaaactatttttatcatcattaaaaataataataacaatgatatattttttacctgaaagcctccatttcttttaggtatttttcttcattttggagcttcaggtcgacattttaaatgtgaaatggatttattttttccttcggttcatcctctaattttactcctgcctgtttatgtcttaaaacttgatagagttaggccgggcacagtggctcatgcctgtaatcccagcactttgggaggccgagacgggcagatcacctgaggtcgggagttcaagaccagtctgaccaacatggagaaaccccatccctactaaatatacaaaattagccaggcgtggtggcacatgcctgtaattccagctactcaggagactgaggcaagagaatcacttgaacccg

SEQ ID NO: 20375 - DNA, 560 bp, Homo sapiens
tacccagccccatttaacttgtaaataagtattattataaactccacaatttggctctgaacttttttgtcaccaaggcaaaaaaagaaaaacctgataaattgtgaagtttttattgccaaaaaattttgttttaagtcatttttaattagatatttctgggtttctgttgaaagtactttctcaaattaagagaaagtataacatagtatactactgaaatttccagagcgaataaaatgataagtcagagattttccttttaatgtttttttacaatgtaggctttattaagcccaaaatataatgttccagtatttcaataattaaataacaaatgataaattaatatctattaaattacagtttatcgaagctattctattgttcgtgtgtggtggctcccggatcatttatggatacagaatgttgccaaccgatgctctggcttgagctaagaatagaggataatttgaatataaaattcaaacatggccaggtgcggtggctcacacctgtaatctcagcacttcagtaggccgaggtgggcggattatgtc

SEQ ID NO: 20376 - DNA, 587 bp, Homo sapiens
tattaaacaatatccaattcaaaagttacatttgtttttgttactgtacgtttgtagagaaatatttgctggggttatcacgtgtttatccatttgtgatacatcaaaaaaccttcatataaaagaaatagtacatctgctcctaatttctcatgtttgtttcctctccttacatctttattttcataactgtatttggaatatttatgaataattccatcttttaagcctgacagcattaattttatcagaccagagagcctccccatgtatctctggcacattctagagtcaaggtgattagcccagcaggggtctgaagaagtactcataagacgctttttcagaaaccctcactgctggagtatcattttagtccctgcacaactgtaacccaaacttgcaaggcttgtacataacattttgtcatatatacagtaaatgtatataatgaattgaatttcttaaacagatattacaaagccgtagtagcaaatactttactaaaatgctaaacagcattcaactagataagtttatcccctttagaatagttaccatgacaggctgggcttggtggctcatgc

SEQ ID NO: 20377 - DNA, 473 bp, Homo sapiens
ggtaagctagagtaggcattgtttcaaacagttaggtattttaaattagaaagttattaatagttcaggtggaacataagtttgacaaaaccatgaaaatgataggcaaataactgaagcttcaggaacacagacctataggataaagctcagagtgattagtgtgacacactggaccttctgaaatgtacctacagttctagactcatttctgctgctgcatacttcacactctgaattgctacaactgagctgcttgtaggggctattttgcacagctgagcatttatccattctttctcttgtgcctacaatgccttctcccctttctttgcctggctaactcctacctttaagactcagctcagtcttaaagtctgcctctaccagaatatcttcctaacatcacaggcataacatttaaacatttgtgccttcttctgtaccaccatagtactttgtacatatctttt

SEQ ID NO: 20378 - DNA, 618 bp, Homo sapiens
atgccccctcctctcactctttccaacctgctcttcacttcacttaaatgtagactggattttctcatgactcggtggcaagatcccacattaagtcaggtgctacttggggaagttgcttcgttttcttgtgctctaagatctctcacccacacgcctggttttggggagaaggataaggacggtgtttctaaacatgctgtgtttcctatgcagagaggcaggtgactgtgtatggctcaacttgcagactctaaagccaactactttagagttcagagttcagacaccagctttgcctcttgtccttgtaacatggcacaggttacttcaactctgtaatgcctcagtttcctcatctgtgaaatgggggtaataactgtgtatacctcataagtgtgcttggaataatgcccactaccacgttcaaagtcagctgctggggccaggcatggtgtctgacccctgtaatcccagcactttgggaggccaaggcaggcagatgaccggaggttgggagttcgagaccagcctgaccaacatgacaaaaccccatctctactaaaaatacaaaaattagcagggtatggtgacaagcacctgtaatcccagctactc

SEQ ID NO: 20379 - DNA, 531 bp, Homo sapiens
attaaaacaagtcctgcctgccacccatttgtgctgattgggggtgtcgtatgttagatagaaaaatggcaagattctctcttgtggtctgttcccaaggccaccaccttttaggtaaatactgaaaggttcttctcagatcaaattctttacaatgttgatcccccaacagctaatcgcttatggtgtcatttctaataaattctgtatccaaaatgacttagccagtagcccatgtagtcaactgagccaagcagttctgaattatttcctttcttgccaagtctgtcagaaataaatcataagctttcagtagtctgacgtttcccatttgttgtttgtggccaatacctagaatagaagtaattatcccaataacatagtaggcactcaataaattatgatgactaattaaaatcatggatggtctgaggcatgccaggaaaggtagttatctactctatgaattactctatgagttactgtgaacaagcagatatgagatgcagatctagagaaattattttttct

SEQ ID NO: 20380 - DNA, 131 bp, Homo sapiens
agtttattaaaatatgcttaaaattttttagaaggtctccaaatgataaggcataacactgttgattgctgctttggagagctttgtcctgagaggcagctaaacagtagagccattcagtgacatggacg

SEQ ID NO: 20381 - DNA, 584 bp, Homo sapiens
aatataatgagctaatgatgtgcaaatataaagggtcaggctggacagatttctttttttgccctggtatttagtatttcagactacataaattagtcaatacttctttgttgagtgaaaggatgaaagacacaagttctagcctgttgaattgttgttttctcttgggatgatctctcagttttccacttatttattttctctttctcacgatttgattctagttctgactatccaaatattatgttatgatttttgcaatggtcttttccattagttttctcactgagagagccaagtagtacccagctctagtcccattaagccatctttttaaaaaccccatttttaatatgttgccttcaaaaatacttacaaggtatgccagccttgagcttggcttccaggggtggcatcatgaggatgaaagagcagaattatctacacataggccaggcccggtggctcccgcctgtaatcccagcactttgggaggccaaggcaggcggatcacgaggttgggagatcgagaccatcctggctaacacggtgaaacccggtctctactaaaaatacaaaaaatt

SEQ ID NO: 20382 - DNA, 473 bp, Homo sapiens
tctcattgagaagaacagcaactagcattaataacctgaaaccagagagaaaacaatctattcaactagataaaatgagaggtgctgctaagaggtgacccataagaaaactagcagttattctctcaagaagtttagtcagacctgggaattattaggaaaaacctttaaaatcattctaaaaaataccgaaatttatattggtttttccatttttcttaaattacagtatattaaaagtccttgcttatgctgttaagctcactgcttctaatttgtctttataataaaatcaaatgctagtagttaacttagaactgcattttactataaaaattatctaacttgtaatcatcttattccctaagaacaagaaaagttcaagcaaaatacccatgaacatggataactcctctaaaaacaatatgtacctctgtaaaacttggtctaaattcagccattaagatagacat

SEQ ID NO: 20383 - DNA, 555 bp, Homo sapiens
gagcggcacctggagggaggggcagtggacagccatgtcaacaggaccaatccctagggatggatctgggaggctccagcacagagctgagaacaggagatcagtagcacccggagggctggaagacagtgatatgggattcccactgctgggacagggatgaaaggggcagctacctgagggcaagaggagcaggagcagagctgctggcccagcgggggaaggcttgcatgcatgggagctataagccctgagacctgattcatacccctcagccccccaggcatctgaagccacacagggccctgctactggtttgctggtgtgcctaggccttccctctgccttttcccaagcaggagaaagccatcactacaggaactcatactgaaccaccagaccacattcgcgcaggtccctgtactaaaggccagtccatctgagctcccagggtaggagagcagagctcagaggctgtgtcattcacatacccacccacctgcagagggcctctctgggtcatcagtggtcctccatcctatgaggggcaatgag

SEQ ID NO: 20384 - DNA, 470 bp, Homo sapiens
agagggcaacgccatggggctgagctgctcaatgccctcccagtgcatcctgctgcaaggatgccccccaggatgctgcctcacctaaccagccgctccaggagtggcccccagcccccaccccatggagcttcgacttcctggtgaccagtgctccagtaacctctaagtgcttgaaccacgcctgtcagccagttatggctttggctctgagagcccccctgaccaacttaaccaatgctttttttctgtaagaaattgccacttactgttggtttctgtcctacccggtgagatacttgaggcttcccctacctgtgcacacaacgaaatgaagacaataaaaagccagagtttgctctttctagtaataaccacttattgcaactgctatttccttaaaaatgtcatctcttgccagtgttcgttactttgcactcaaaggccaagtatcctctcacggtgaccct

SEQ ID NO: 20385 - DNA, 545 bp, Homo sapiens
tgtcaataccatcaatttactttgatttggttttttttttcttttcatgactagtgggtttgtacttggccaaaatgctctcttgagttgcagtcaaggccactggatttacatgtgctatctatgttagaagtatcacatgtgatcatgaagcagagagcaaggggcattatttaccatgcataccagacaaagcatcatttcttgttcactgtaagacagtaacgggaaaggtatgacctgtgaacactgcttataaagtcaattctttatatcatgattagcataatcacatttctcccctttcagaactcatttatctgctaatatatatctatacagacatacgataaatacagaaagactggatagactatctcaaagaatatagaactactgataaacaatacattgcaaagcaagtatgcaaatattttaaaaagtaactgtgtgtctataggatgctaaaaagaagcttctgagaaaaaaagagaaatattttagcaaccaagctaaattttagcacagaatttttcaagttacaa

SEQ ID NO: 20386 - DNA, 606 bp, Homo sapiens
atgctcctctaagtaactgaatactacagagtgattttggatcaatgtggccttattttgaatataacatacaaaatcattgagtgttttatgatttatcttcattttaactcaagctttgggatacatgaagacagaagataaatcaaaatgtgtcatgtattatattttctgaagttattaatatatatttagcaaaaggtaaaatagcacagatataccaaccaaattttcatgtgaagaaaacattttatataaataatgtttcttcttttatatgaaatcacttcaaaaatgagaaagctactttttatattccccaatgaatattccccagtcctgtgattccaagttcagtaaaatttagaaaattatggccaagaaatttagtagaccgaatgtaccttcactttctggaatgtacttgtaaccctacattcacagttagaaatttgcttgaatgaaaaagtgttcaaagtaattattatcttgtatttggcttctctgggtacctgtttggcttttatttctaaataaaaaaacaaaacatgcacaatgtaaatatttttagtttgtaaaattttctttccaattacatattttgag

SEQ ID NO: 20387 - DNA, 566 bp, Homo sapiens
aatggaaatgagaactctaagctctaatccatagctctgaaagtaccttgctctgtgactttgattgaggataatattactgtttcatcacagatataaaatgccatgtgacaaatatgtggaattggactaatccactagaatagcattaagtttataagtgcatgctcataaatgacttttccagttgagatattaagactattccccaaagaactacttaatcttctggtgaatatccatagcatagaaaagaccaattcactctaaacatgagagatcacatataataaataatctttcatcttatgttagacatgtctattactattatatattttaaatatatacacctctataagcaataactcacatctttatatatgatcttgaggcaagactcccatttataaagaaaagaataaactctgttcactatagttgcaagtcaagtatattttcttggttacatatttcttaagaaaagccctggccgggcacagtggctcacgcctgtaatcccagcactttgggaggctgaggcgggcggatcacgaggtcaggag

SEQ ID NO: 20388 - DNA, 579 bp, Homo sapiens
gcaggagtggggctagaggagtagggccagctgggatcagcctggcgcacaggcgtgtgggggtcctggaaatgttctattttgtgacctgggtggttgtgtacacatttttcctgtggttttgtaaacacttctactatgctttcacatgcttctgtatgtatgctgtatttcaccaatgtcccatttttattaaaataatcaagaaatccctgccaggccccaggcaggctcttggcctgggctcactggaggttcattatgcacagggaccactctcccagatctgctcaggggtctccacacagccttgactcagagagggcccctccctggcctcccctaggaggacagaagttgcctccaggtcactgcatggcttgtgtctatgcccagcattctggaacaagctccagtagggggatatacacgaggtcacctctctcccttcctgtcacactagtaggcttcaccaaacagcagcagcacagatgtggggagtggcctgggcctgcaggggtcctggtgtcagctcgtttgggcccctcaaggctggggcttcagtctgggagccacctt

SEQ ID NO: 20389 - DNA, 463 bp, Homo sapiens
tttgtaaaatcctaaagatgttgaattccaaatcattatctggtcagatgagggaccacagacaatagatcagtggttgtacctgaataacttggtattccggttttcaacactgggcctacagcttggtcatacacatatgtggaagaacctctcttactgcgctgacaaaattaggattctgagccagaaaggctggtagtcaagccacccaggcagtaaataaccctcggggaggcctgtgaaaatccgccatccgatatgctatctagatggttcgattggccatgagcaccagtgagactttttcccattaaagttcctccaagaactcagatggtctctcctgtaggagattgaaggctcttgtgttggagctggtgacctgtgaaggccacatattccaggagatacaagaatatcaatgggaagccagtgtagccacgtgcacattacagggcta

SEQ ID NO: 20390 - DNA, 388 bp, Homo sapiens
aacagcgaagagaggcgaccaggctgcccctgagagtcaagggagtgctacgttggcttccccaactctgggtctggtatctcagcctacttagaatcctatcttgcttgtcaggaagattgcctgctgtgtcctcagcctcctacggtcctaaatgcaattgggaaatggctggcaggttctagcagggaactggcatgatcttttgatctatgcttttaccacttttcttttgagacgaagtcttactttattgcccaggatggaggacagtggcgcgatcttggctcactgcaacctctgcctcctgggttcaagtgattctcccacctccgccctccgagcagctgggattacaggcacatgagaccatgcctggctaattttt

SEQ ID NO: 20391 - DNA, 403 bp, Homo sapiens
  misc_feature 94, 95: n = A,T,C or G
tgtaccacacattttacatgggcacattatgcaacacagttttctacgtacttctgaagtagaagcttatgaacatgatctgtagccaatgagnnaatcattttgaaatgtcataagtctcatatttttctttgatttctctatctgctgaggtattagtctgttagccacagcaggtcgagactcacattatctatctaacattatctatttctttgatttctgtatctggctaagccttagtctgttagctacctcaaatagagactagaagtctttgctctgagttcatgaactttacaatgactttttcagaggcaacagctggctataaggacttcacagatagctgccgtggatgctgtgcaagtgacagcaggttatcatgagttcaggctgctgt

SEQ ID NO: 20392 - DNA, 467 bp, Homo sapiens
ttaggactgccccccaacctccttattcttggagcctgggcacacgcacagctgggtggcccttcagctgatactgccttaactgctttaactctgcctgctgtgctgtccaggcttctgcaaatagcccaggtgtggccatcctccagaggcctccaacattaactgtgaagggcccggaataaaacctagtattagtaggccaggcgcagtggctcacgcctgtaatcccagtactttgagaatcacctgaggtcgggagttcaagaccagcctgaccaacatggagaaaccccgtctctactaaaaatacaaaattagccgggcgtggtggcgcatacctgtaatcccagatactggggaggctgaggcaggagaatcgcttgaacttgggaggcggaggttgcggtgagccgagatggtgccactgcactgcagcccagggaacaagagcgaaactctatctc

SEQ ID NO: 20393 - DNA, 407 bp, Homo sapiens
caaaaatcaaaagatgccttaattcccccatgggtgggccccatgctcttgaagtaagtgctgtgctacttgaagcagtagtaggaagaacccatttacaccatctccccactacaacttttatgccttcagaaagtgttaaaaaactgttacaaatagccatgttgtgtcttggaaaataagttctccagaaaacacctctctgagctaggcaatgtgtgtttctttctgtggttggcagaaataagcccaaatacagattctgatgcttaggaggaagaatgtggtagaaacataacagatttgcaaagtctatcttgtagcatgatttacacttcctcacaagcatgcttcctctgaccttagcctctcagaatgtggggatgataaagggatgcctcatcagc

SEQ ID NO: 20394 - DNA, 531 bp, Homo sapiens
tagagtcctgcccctactgttctaagatcctgacattttatttgaaatagtaaaacaatgattaggaatagactttggtcatcttaatggactcttttttaaaaaatatcaaggcatagtattaagaaaattctattaaaatgtctaaacatttgtctcattgctaaaatatacaagaaaattaccattttcacacagattggcattggtgtgagttgccatatctatggtaacttgcagtgttaacctaactgcaaacaaactgtgagctctaagagcctttggtacatttcaatcaattaaaatgatttattcgtcatataaagctatatttgtaagtagtataattgagttccttatagtttataactttggaatttcaagcctagtatgcaagatttgttcattttcttcatatagtttgcatatttaatcaacttatttcccaaactaatggacattggtgtttttattctggccttgtgatccaaacagggttcccaaaatagagacttagaggagggtgcaaat

SEQ ID NO: 20395 - DNA, 680 bp, Homo sapiens
gaatgtagcccatgcatttgttagctcagtggtacttgtggtcacagataaaccccacaataccagtgttttaaaacagataaaattcatttcttattcttacgaagttgaaaatatagttatgtgcttgagctgattcacaccagatcacaaaaactgactagttaattttcagtaattgtgtgagccaattgttagtcatagtcattattttaaaataaacacataattaaattatattaaaaacaaatctaattaataatcaaaatccatcacatcctaataatgctactaatatctctgctgtagtggttattaacttctattgtatttgtataatagaaattttatgaaatggcgtgatatgcacatctcttcctaactctgtattcagtgctgagaccttagcatgaacacggtccaatttaaaagtcatcaaaggcatcctacttactaaatattttgtcacataacataggtctccatcttcccatcctccaacatcaatttccttgtaatctgcaccccagtgcctaggtcaatattaatcatttttaggttttggccggcaatatcacattctaactcatttccatattagttaggataacaacatctacagcaactccaagacatcagtgaactaataaatttgcactttatttctggctcacataaat

SEQ ID NO: 20396 - DNA, 426 bp, Homo sapiens
gagacaggttggttgggaactctttgttcttaaatatatctagttcttaaaaaattcaatcatgtctttccaacactcagtattaataatactttatactttcatagcaccttttcttttcctactgccttcgaaatacattaattcatcctctaaaaacatctctttctagtgaaaagggcactgcacacaaaatcgaaagaggtagtatcaaggcctggcactgagccatactggtatgactttgggcaaaccatttaatccccatgaatatgctttcccattttaccactctgagaaattaaatttaaaaataaatattaaggaccctcttccatcataaaattaattcgttaatctattcaaaagtattttagcattaatatgtgccagccatgtgataagtgtcggagataccccataaac

SEQ ID NO: 20397 - DNA, 490 bp, Homo sapiens
taagtcatacagagagtagggatgtcaagcaaaagatgatgtgtgaaaaccctgattgcacatttactcagcatgaaactggggcacatgtttgtagtaattcaaatctctgcaagtaaggtatgtgtggcaacaaatcaatgaggcaattgaatttattttgcagaaaacagaaaatactgctgacagacggcaataattccatgttaagtaggtgtcagatgtttcctctctcctttctcttcttcttttccacctcagcagtggcacagtggcctcagaaagggaactggatccctcatgccactaactagctgtgtcactcagtccttctgggcctcaattttatatctataagggagtccttctgttatggtctaggtgtctttgccaaaactcatgttggaaccttaattcccagtacaacaatgttgggaggtcatcctttaagagatcattaggtcattaaaatagattaatatctttctca

SEQ ID NO: 20398 - DNA, 590 bp, Homo sapiens
ataatatgcctaggagagtatatgctaccttgggtgaatagtacatattgatagtaacatattgatcatgggtagctattttgcaagtgacaacaagggcttcagatttgttagatatttgacgtcaaaattcaaggttatcaggaagcattaggccaattatcagttcctaaagtgcgtctcagtaccaagaacatcaaaagccatgaggcagtttcagcagctactgcaaatggtctcctgggttctgtaagaataatttcattccagttagcacatttaacaggtaagttccaaatatacggttttccccaaatttgggggaagagaaaattgagaagaacttgctcattttcttcctgctcagtatatcatttggcttcctcttccagttcaccaggaataaatacaaaataaatatattggttaaatgtaagtcgagattaagaataaggggaatgtagaagcgatctttcctttactttaaaacttcaaatttaagcaagtgtcactttctaagaaacctctatcgtgtggtgacatcatttgaaagccctcttccttcataacaaattccttatgctctctct

SEQ ID NO: 20399 - DNA, 582 bp, Homo sapiens
aatctaaataccttttgtttatttatttattttagacagagtcttactctgtcacccaggctggattgcagtggcatgatttcagctcattgcaaactctgcctccagggttcaagtgattctcctgcctcagcctcctgagtagctgggattgcaggtgcccgccaccatgctggctaatttttgtatttttagtagagctggagtttcaccatgttggccaggctggtctctaactcctgacctcaagtgatccacccccttcagcctcccaaagtgctgggattacaggagtgcgccactgtccccagccctaaataccttttacctttgttaaagagaaccacacaaaagtgctaaccctaattactgtcaattatttcaatttcttgaactctgtaagtctatatagatattttcacccaaagcttctcaagtaaattatgtcagatgttgaagactttagagtggagattggaaataagactaagattactaaaggttcataataaagactaaaactgggtagggcaagaaaaaagactaaaactttcaatgtaacacatctgatactcatcactg

SEQ ID NO: 20400 - DNA, 563 bp, Homo sapiens
gatagtcaaggtggaaggatcccttgaggctaggagttcaagaccagcctggacaaaagagcgagatcctttctccattaattgattaattaattaatttttaaaaaacaattcatagtgacaagctagtacaagagaaggaaacagaaatttggttagatgactatgagttgaagcagaagaaaatataagaatatcaatctccatatagtaccaaatataaaatgcaatattcttagactttctgtaaacatcagtctgtgagatccaaattatttttcttcttttatagtgtaaagtgatcaatttggtctgattatattaaagatcctaataaagcttcaaacaacaacattattttagatcctatatgctatattatctcctgctaaattttttcttttaaatagatatagtatgtatattagtaacataatacagtatttgatatagataaacattatttgtgtatatttcactaggataaccaatttctactcaatagacaataggggaaaaagaacagatttgcaatcaagtagatatgtctaaacgtaggatct

SEQ ID NO: 20401 - DNA, 233 bp, Homo sapiens
tatgaacccaggaggtggaggttgcagtgagctgagattgtgccattgcactccagcctgggcaacaagagtgaaactctgtctcaaaaaaaaaagaaaaagagggagacgttaataacattaagcatgaaaagaaagagtttacacgaatacaacgaatacatacagatactgacaaaattagcattgaaagaacacctgggtaaaggtgaatttttttttttttttttttt

SEQ ID NO: 20402 - DNA, 479 bp, Homo sapiens
aatgaggaggctgagattcagagggattatggcctggctcagagtcagaggtacagaaaagatttcactcaagtcttttgatttcagttcagctgtgtacctctcagactatagctgtctcctgtctatgtgtatatagcactgaactaagtctttaggaaagtaatatgaaatttagtattcaggtaatcatcttaatgaagattccagttttattgggaccactagttaccaatggaacaagatgttgaatatgtgcatgaatatatagatattaaatatgattacaaacaagagggcatatccctcaggtgttggctccctcttctcatatgcagccctgaagacaccacagggtacaaatatcaaatatagcatgaatttataaaattatatataaagatataatttactgaagcaacaagagtgtctggtattatagtaataaagaatgtatgaatttttactgagaaaaacat

SEQ ID NO: 20403 - DNA, 495 bp, Homo sapiens
gtttcaccatgttggccaggctggtcttgaactcctgacctcaggtgatccacctgcctgggcctcccaaagtgctgggattacaggcgtaagccaccgcgcccagccaagtaaaattaaatattcttgtattctttttatatctctggaaaagtattaaatacattcttccagaaaaaccttcgctgaagggcttggctggactagtttcccacagcttatcctagggcctctgggtagaattgtttttctttattgtgtggatagatcagactcagtacggagaccaacaggctctctgtcttctcctcagaagcaactgggattctccagagcagtcataaggtgacagaaaggccccagaacagatgtttcgtgtgtgacagagcctccagggagacgactctgttgctttaacagtgctaatgaggccaggttgccagtgggtcctcacctgagccagttacttatttatatgactccatcttattcctc

SEQ ID NO: 20404 - DNA, 471 bp, Homo sapiens
catctctgcccatgatgggcaggcgtcatcgtccctactgtatttgcagaagctactaggttcttggtatatgtcatctctctttcacaacaacgatgctgaaatatattttacttgccattcttatctcacatttgaggaaaatgaacctcacagaggcttgtggaattatccaaagccgcctcacttctaagtggtgaaaccagcattggacttctatatcgggctgcaataaccggttccgtctcatgcgccactttgcctctttctcagctcccatggtgttgagtggaagcctttattacagcactctttacagtgattgcatttagctgtgtagaaacatgttctgtgccccacacttttgctagaccttggacttattgggaacagggcacgtgctttttccatcactatcccatgctccatggtggctgaatatatgacaagtgcttgtcatccctgagaacc

SEQ ID NO: 20405 - DNA, 413 bp, Homo sapiens
agtgtccttcctaaaacataatctccatgagagcagggaccattctaggtacaggggatatgcaaggagcccctaagatatacctttgcatatcccctatacctagaatgatgtctggtacataataggtattcagcaaacattcattgtaatgaattagtgagttttactcaaaatgcaagaaagatgaattgaaactacaagatagtattttttttaacctaggaaattaggaaaactaaaagaaaaatggataacacactagatgaggaagattgtggtcaaataggtgttttcatgcattgctggtggcagtgtaaattgcttaaccatccatggagggcagtttggaaatattaatcaagattacaaatgctggcagggcatggtggctcacacctgtaatcccagca

SEQ ID NO: 20406 - DNA, 597 bp, Homo sapiens
gtatcctaggaaaagcagctatgcttcaagataaagggcagaactaaataaatctgccctgaaaagcctgaagcaagtttctaaggaaacaggccaatctgaaggaatttaacagcctcagcttcagaggaagaaaacaattcagagtatccgtaatgtattttcaccaatgacaagtgtataaattttaaggttactattaatttaaaaaattactacacaaccaaaaaggtaagaacatattaaccataatatgagagaaaaacaagaaacaaaaagaagttactaggaacaaaatgacagtgaaaagatattagaataagacagagggacaaaaatggctgttataaatattttaaataatctacaaaaaataagataaatagaaatggtgaagaaatgggtcatttcaacagacacatagaaattctgaaagagagtgagataatattctgaaacaaaaaaataaatacctaaaataaaagattcattgaatacaactacttccgattataaaggagtcactggtatcagacttagattcctaccatacatatatgctcacacacacacacacacacacacacacacacacac

SEQ ID NO: 20407 - DNA, 543 bp, Homo sapiens
tcgacttagtatttgtactctgaaatcgaatggcatgaacacatgtgttgtataagtgagaagaagtattctcttgtgtgatggactatagccttcagaaagcacctactattaaacagaatagagattggattttgaaatatgtaggccacatcagtaggaaagttgacacttcaaattgctcacaaggactttaaactctacaataggtaaaatgtggagtaccttatgttttcagaccaaatgattttgtaatttgaattcaaaatttttttagtcttcacagtagtcttagcattaaaagcatagttatttttaatattttgataaaatattctatttcattaattttgtataagggcatgtgtgagaagcattgatatttttaaaatataaaaatacagcctctttctaataagcaagagcaattgttgatttttaaattttgtgtttttggaggcttccattcacaaatctgattgtttaaataaatctgtctccagtaaatatgttggcacttagactacgacttcagtttctcat

SEQ ID NO: 20408 - DNA, 157 bp, Homo sapiens
tactctgtgtggcctctgtattatgacccaagacaatagcacctatgttcaaacagcagaattgatgaagggatgaaaagaagaggcaaattgtgtgtgccacttgtctcttaagaatgttttccagctgggtgcagtggctcacgcctgtaatcct

SEQ ID NO: 20409 - DNA, 502 bp, Homo sapiens
aaaattgtattgtttatctatatatattgtcacacagatagttaacagtgatcccacccaatacagtgaaagccatctccaacttaataatttttatccatatgtgacaaagttataagttcagctaaaaacctatttttctaatcataataatcttcatattcatggtattattgcaatatctaggaatattcaaattatgacaaagtcaaataagttaaattttcatctctaataaaccatgtagttattacatctaagaaaacattttaaaattctagcaataaaatcaagacagcacctaattctatagtcttacttcttataattcaaaacattaaaaataattctgtcaagacaagcaccataaaaattgtcaatagatacattataatttattcatatagcaatcctatttgcatagtattttgcatttattaattgtaaataggaatcaagttattttaatcttaattgtgtgtggctagggaagataccactc

SEQ ID NO: 20410 - DNA, 449 bp, Homo sapiens
gctgaacctcattttccattttaaacatctgtgacaagggtaatgagagcgcactcattgaacatctagtgcctgtgccaggaactgtgctcagcactttatatgaattctctcatttaatccccaagactgtcattacccccattttatctgaacccacatctgtctggctttattatcctggcagcactcgctggtggaggctgcaggaggatgttttgcaaagcacccacattcaagctttcccatctgtcaccagaaatattctgcaagcatgctgaggccaaacagccttcccccttcctccttccctgccggcaggcagccccgcctttaccaatctggcagagtaggcccctgggacaagaatcccagccccatctcactcacggctcttagaaaagacagtggctggccaggcgtggtggctcacacctataatcccagca

SEQ ID NO: 20411 - DNA, 585 bp, Homo sapiens
tttgttgctgacacatgactaagtggtctaattttgaatgtagtttagaattcttgtatcttaaacatattattctatagccacaagtatttttgttttgcctactcaaatatgtacagatttgtaccaaacaatctcttcacacagatgagaaacaggtgaacattggaaaggtttcaaaatgttactggcaacttcaatttaatattaaagtgcagttcggctcagtggcttacgcctgtaatcccagcactttgggaggccaaggcaggcagatcacctgaggtaaggagttcaagaccagcctggccaacatggtgaaatcctgtctctactaaaaatacaaaaattagcctggtgtggtggcaggcacctgtaatcccagctagttgggaggctgaggtagaataattgcttgaacccgggaggcagaggttgtagtgagctgagagtgtgccactgcactccaccctaggtgacaaagtaagactgtgtatcaaataataataataataataatattaaaggtgtggtataaatttctagtctggccaggcgcagtggctcacacctgtaatcctagca

SEQ ID NO: 20412 - DNA, 558 bp, Homo sapiens
atacattcctctgtccttctctttcctccctgaggtgattttggaagccttgtgagagatggtgctgttgcaaaatggaggaagactggatctctgcatcaccgcttggaggcgagcccctgctaactagcttacaggaataagaaacaaacttgtgctgtataaagctaccgaagtttctgatttgtttgttattggtactgaatatagccttatgctgtctagcaagcatcatttctggaaaaaggatgaattctcagggaatcttgcaaacattacatgtcattatccccagctacaatttgcataattcattttctgaggggaactcacagaacttagcaaagaactaccaaagataggtaggcagcactttgctgatcccatttgtttgagaagaaaaacaattttgagacagagtctcactcttttgcccaggctggagtgcgatggtgcaatcacagctcactgcagccccaatctcctgggctcaagcaatcctcctgcttcagcctcctgaggtagctgggactacaggcacacaccaccacacccagc

SEQ ID NO: 20413 - DNA, 457 bp, Homo sapiens
gactaccaaagaaaaagagctaagattccattagtttgaatccacataaagcttaaagccaaatttgggctaattaaagtcaggctctgggaaaacaaaagcataaaagcaggaatcatgtctgagtaagatgaagtaacctgtgggtatgaagaaaacaaagaccaacaacagccagaaggaaggcagaaaaagcactttgggaggataggagtagatacaggcatcatatcaagttgcctggacgagtgttgtcatccagtttctccattttgaggtttgagtgtgtgggattgaagttggggccatcagctgttgtttgtctgaatttaaatgttctttggtcctggaaacgttcatgtggtctaactcttcttttcatgtcatcatttgagatgtgttctatttcattgattcatttatttagcaactttaattcaacattaactatgtgcca

SEQ ID NO: 20414 - DNA, 532 bp, Homo sapiens
atgatacattcacacaatggaatactgtgcagtagtaaaaaagaatgaggaagttctttctgcatgtatataggatgatcttagagttacattgttatttaagaaaagcaagatgcttaacaggatgtactgatgctactatgtgaaaaaaagaggaaaacagcacatgcatattgtacatttgaatgtgtatatatacagacgtacaatatgtaggcatatgcatatacatatataaaatgtctctggaaggagcacagttgctttcaggagaggctggggtaaaaagggacttttcacagaatatcctttggtatctttgagttttaaatgacatgaatgtgtgtatatatattgatgagggaatctagagatccactgcacggagtaagaaatatgaagataagtgcagtgaagtgacttagaagggagagtcagagagaggaggcagtggtggttgaccctgttgtttggagtgataaacgctgtagaaagatcaagcatggggatgatgaaggaaaggtcatggtga

SEQ ID NO: 20415 - DNA, 574 bp, Homo sapiens
tagtaaactacgttcatataggcatatatgggctaatatgctgtaggtgcctatgtgatttagaagtcttaatgttatatatcatggccattgaataggctaatgtgtttgaaaatcagaattatgtcatgcaaacaaatgcaatgaaactgcattttcattaaattcaatttttgccccaaagaatgttggaagagtgtatcagaaattactctaatgtatataaagctctatgcatgaaatctcctttgatctttgctacatttttagttaacagaattgttaacctttgtaggcattgactacctattttattcatcactttttagctgaaaggttaagaaagcttttgtgggatcatgtattatgcagtagagagtattctaatgaaggctacgtaaatattgattagaatcaaaaatcaaaacttccttgaattggccgggcacagtggctcacacctgtaatcctagcactttgggaggccaaggcgggtggattgcctgggttcaggagttcgaggccagcctgggcaacacagtgaaaccccgtctctattaaaatacaaaaaatt

SEQ ID NO: 20416 - DNA, 484 bp, Homo sapiens
taatttagaagccagtcttgcaaataaggaggtgacatatgggatttatcatgagggggacagcagttacactgtgtgtccagaagttgcaggggttctatcaagaggatccagtgctcagtgaccgaggtgagagaggcaattttgcgtggctggaccctgtggtggaggcagtggtgtagccaggaaaagatttctgctggtcatttggactttgtttctgtctgcatgcactccacatctaatcatctggccctcctggagggtctacaaactgtctaatatcatttcatttaataggatcgtttcttattaaactagctaaagtcagttacatatagattttcattcaagaaccctgactaatacactcttctgtagcatcacaaccatgttagcttttgtactgtaaccaaccaaatccaagacttattgtcttcagaaaataataatttcttagctaattattctgtgaatcacattt

SEQ ID NO: 20417 - DNA, 605 bp, Homo sapiens
gtaaacacctgggaactagaaatctgagaaagaggacaacacccaacaccacctaactatggccctcgatacagtcatttaacttaataaccttccgtgagagtaaggtcattatgaaatatgctcggttttacacaaagctttaaaaaaagccacataaaatagtatatgaggtcacctctgattcctatgtaaagaagattcctcctcccttccctcattcattgttctccacactctactccacacctcccctcaccctgcaatccaacttatcaaaagtttaattttccctttccaaaagcaatgtacttgaaattcctattcttagttatgtgcattttggtttcctctttgattttcctttttttccaggtttcctgttgataccaacatgaatctcaagggcttccctttgcttcttttggaaaaaaataaagaaaagagactgatttagagcctatagggtggaaaatcacagccaggaaaaggcaggcatagcatgcagcagttcagagacagggctcacccgcccatctcttccatcagccacctccctggtagggcatcccttggaacagaagccagcaatggtcctgcaggga

SEQ ID NO: 20418 - DNA, 487 bp, Homo sapiens
accacagctataatctcaactatcttcaagaacagaaaaagttaagtaaaagagcaaagcatgctgatgtaaaagcaaataactatgcaagcctgctgatgaactaacttgtaaaactcctcctaatgtcaaggagaaaagggaggaagaaatagcctgacgctggtgagctggagggctctcttgggccagttggatagcataggcattagtcagctcctagtaatggttttgcaagtatgttgaccatattcccaaaccttcagataatttacaagaatacaggcatctgggccgggctcggtggctcacggctgtaatcccagtactttgggaggccgaggtaggcagatcacctgaggtcaggagttcaagaccagcctgaccaacacggagaaaccctatctctgctaaaaatacaaaattagctgggcatgatggtgcacgcctgtaatcccagctactcaagagactgaggtaggagaat

SEQ ID NO: 20419 - DNA, 444 bp, Homo sapiens
agcgcaaatcaccacctggagtacaggtgtgcccctcgacctcctgcggtttgttggcatgaagtctgtagaggtgccaagagagctgcagatgcacagtcacctgctgaagacacatgttcaggtgggcagcctccaaatggctggttattgcttctgcttcctgctcagcaaaggagctgacgttggtctggtgttttcagttgtctgattcatttgacaaatatttattgtgtgtcgttaggttctagaaactgatcctagtgttgttttggtactgatagtcagttacctcagattttcccttcttttctttttcctccatgtatttatttatttatgcatgttcatacattacatgtacctggaatacatgcacactataaaaaatacagagatacaagaatgtctgtttttatttttccaaccagtgagtagaaaaca

SEQ ID NO: 20420 - DNA, 622 bp, Homo sapiens
ttataccttaataaaaggcagaaagagagggagggaggcaaggaaggaaggaaagaaaagtgggtacagtgatccttgcctggcctggcctccaggacaaagtgaagaggctggtacccaggcctctctacaaatagtgggcagaatggcaccaagatatagtgttgacagcagacagaagagggagaggctggtgtcgggcctgcctgtctttctttagcccccatcctaggcgtctcccaatgggacattccctccatagtggaaggcagatagtactacctgatggaagacagaaagtgggactttggaatcacacctactggctgtgtgaccttggccatgttgctcgccttcgctgggcctcaggctcctcatctggaaaatgggaacagtactctcaaagaacttcagttgactgggcatggtgtctcacgcctgtaatcccagcactttgggaggccaaggcaggcagatcacctgaggtcaggagtttgagaccagcctggccaacatggcaaaatgccatctctactaaaaatacaaaaattagccgggcatggtggcacgtgcctgtaatcccagctactcaggaggctgaggcaggagaatggcttgaacc

SEQ ID NO: 20421 - DNA, 598 bp, Homo sapiens
ttaccagttgtcattaatgcaaagttcaatgatctctaaatttttctttccatttccatagccatccttgcttgtctcccctttcaccacactattttctacaccacatatttattgctgaatctccagaaatcctcacaagacctgacataaagtaggtatgtaataaatgttactgcatgaaattgaactaatataaataaaaacatggagaaaaaaaatgaatgaaccattcctgccctcatcttcttctcccttggcttcgatgacactacattgctcagcttcttctcaacccatgcttgctgtcttctccaaagtcttcgcctcctccctctaaatgcacttcctccacaagtcagatattttctcttctccctctcacacctttggataactcaatcttatgacatcaaccatcacatctactcaaagaacccacagatttcatcacgagtatgaattttctcctgagagtcaaggtcaaaactatgcctacctgtgtccacttgcatattccaccaacaattcagttggtctaaagctaaagagtatcactccccacagaaacactgtagctctgcactccttaccatgt

SEQ ID NO: 20422 - DNA, 75 bp, Homo sapiens
aacagatcgggagagtttaagctcttggccgaggacagagccagtaatggctctgtcattacaacatacaagggc

SEQ ID NO: 20423 - DNA, 612 bp, Homo sapiens
ctgtctgaaactgatggaaaaataagtaaagttatattaaagaccaggagaatacactgatttaattataattaatttgttagtgaacattaattagctgattctaaaatttatagaacataaaaagggctgagaagaaccaaaacaattaaaaagaatacttagaagacttacattgtcagagatcaagattgagtatagagttacagttaattgagtcagtgtacaaataaacaaaccaataaaattaaaagtagtatacagaaacagacatatatgtggttactcaatgcataacaaaggcaagactagttcaatagagaatgaatggtctttttagtaaatggtgccatgaaaatcctgactccttattttataatacacacaaaattcccaatgtaccataaatctatatgaaaatagcaaaacacagtagagcttctacaagaaagcctagaaaaatatcttcatattttgattagacaaaaatttctgaaacagaacatacctgcaaaaaactaaccatatagaaaaagaatgacaaattaaaatttaaaatacttgcatcaaaagaaacgatgaagagcatgaaggtgagccactgtgtgcaag

SEQ ID NO: 20424 - DNA, 142 bp, Homo sapiens
agacagggagaaagaaaatgaaaaacatggaagcagcttcccaaagcagggaggtgttgaagtgaatgataaaatctgaaatgatgagcagttaggagtggctagcatgtagggtatgtggtaggagaatggcagtcgagga

SEQ ID NO: 20425 - DNA, 442 bp, Homo sapiens
gaatactcgtgaataaactttgcaaaactatttgtaaagtactataaggaattctgagaagttactataagatagaaaagaatataggagcatgcccaagccatatatatgatgtttcacgtaatatgcttggtagacttgtaaaatattttagatgtggtgtaggaataaatctttgatgtaatttgtttttttgtatttgtttttgtttttgtattttgagacagaatctcgccctgtcgccaggctggaatgcaatggcacgatcttggctcactgcaacctgcaactccctggttcaagtgattctccttccttggcctcccaagtagctgagattacaggcacatgccaccacgcccagctcatttttgtatttttaatagagacagggtttcaccatgctggccaggatggtcttgatcttctgacctcatgatct

SEQ ID NO: 20426 - DNA, 628 bp, Homo sapiens
atgagtactttctatctatttgtctgaagaagcagggtatggtagagaagcctcaggcttcagagactatcagacttggattgcatccagccacctggaaactctcagaatgtcagttcagttactccagactcccatagaagaggaacagaatccctttacctgtaatacagatgcctcctcattactctctggcatctcctcccccagggctagattgaaaggcaagtagacctcagaaacagcatctcactgtccagggacacagatacaggacaaaacatcagaacctcactgcggccctctgctcctctcctactcaacacttcatcagccctgatgacaaagcagccacaggaactgttctttgtccttcctcagcccagtgtttctggaggtgctaatgagccctgggataaactcccctgacatagacagctggaaggagatgggaaggcaggagaggaaagcggcaggataatttataaattaaacagagaagcagaagcaacaccgcagttatagcccaaacagccttagagacacaaactacttaagatatagatacctatatgcaggttcacaaagctttttattttcttaccatcaagtttatttaccctgggct

SEQ ID NO: 20427 - DNA, 116 bp, Homo sapiens
aattcttttgaaaagatgtatgtgtggacaacctatagaagaaatgacctttctatttctcttctcaattccactagctaaaaccctgcagtgatattacttatcaatgctatgat

SEQ ID NO: 20428 - DNA, 609 bp, Homo sapiens
gacagaagggtgaattattttcctcttcgtttaacctctggacacttgtatgccagcatacagggataccctcggttaaatgacatccagaaatgtctccaagttccaagttccaggttcaaggtcatgaccgcttgaagacttgttacatgctgtagcacctcattacacctgatgggaatgtcaccatccaagctcaggctgctgtgtattctcatgggggtgttttctccctttgcttcaggtgaagccacaaacactgccccatctaagtcccctgagtgactgtacttcctgtgaagaaaagaggaggctcattaggaatatggatgaaatgttcaccaagaactacacctacctggagtctctagggtcacaggaaaatcctctattcccatccagcagatcttatattcaccaaatgggagaaggttgatggatttgtaaacgtgctatggtgcaaaactcacatgtagtccataacactgcaatagttatttcagatacaataggctatctattgcacatcttgatgcaacctggatgggtaattcccacaatcatgctccagtgagagaggacacagaatcagaagtggagacagggagg

SEQ ID NO: 20429 - DNA, 533 bp, Homo sapiens
gcatgtgcacatgtgtgtatttaatagagtagcatcaaactatataaactattgtcctactataagctgcattgtttttaatggaacaaaactattttgggcatctttctatgtcaaatacacaaacttacttcattctcttagtagcaacacaccattccactgcgttcttaaatatatcaacgttctctttaactctgtaaaagcttcattaaaattttaattataattgacttaaattgataaattaatataggggagaatttacactttaaaaatacttagtatttctttttttttttaaatttttttaagacaaattctcactctgtcatccaggctagagtgcaatggcacaatctcggctcactgcaacctctgcctcctgggtttgagtgattctcccacctcagcctcccgagtagctgggactacaggcacatgccaccacgcctggctaattgtttgtaaaaatatttatttttcctatcaaggaacatggcatatctttccatttatttaagtcttctctt

SEQ ID NO: 20430 - DNA, 552 bp, Homo sapiens
gtgatttagtagacttcagtttctataacttaatcaagatagcaagtcaactgatactttcattaggatttaattttgagaggtattcccatcattatactactcttctgctggagtgacactaatcagtcatagcgttggaatcctgtttcttcctggcagagtttaggttttaaaatgataaacccctacattttatgaccctcaattcccatggtggcagcaaaaccatggaagtcctggttaagagagattaatggacttcctaaatgtctgcatctggttttccagaatgacttttttctctagatcaattttaaggtcacagcatgaaaatcacacatgtatacatgtaatccatgaaccaagaaaacaagggacaagagagaagatatgggtcatcccaaatcaactgtattagttaggaatcttcattgcaagtgacagaaactcaactccaaacagcttaagttagagtttattgacttatacagctgaaaaagaatggatgaacaagcatgtctgcacccagggacccaaatgatagtacca

SEQ ID NO: 20431 - DNA, 561 bp, Homo sapiens
tggactctacgcatatcatcccatttaatcctcacaatagcactgtgaggaaggtactgttattctctctgatttacatacaaacgaggaagtagattttgaggtaaggaaaagagccaggctcaaactggccagcccgctgcagagtctgggtcagagccactgggctgacatgtgccccatccactaggcttaaaggatactttgttgcttcctaaccaagacaggctacgtcaaaggtcagtaagaccttggccacttaaggataaaactggatgactaaggccgggcacggtggctcacacctgtaatcctagcactttgggaggccaaggcgggcagatcacgaggtcaggagatggagaccatcctggctaacacggtgaaatcccgtctctactaaaaatacaaaaaattagccgggcttggtggtgggcgcctgtagtcccagctactcaggaggctgaggcaggagaatggcttgaacctgggaggcagagcttgcagtgagccaagatcaggccactgcactccagcctgggcgacagagctagactccgt

SEQ ID NO: 20432 - DNA, 571 bp, Homo sapiens
gaagtaccagtccttgtcttccacagaaacactgatttaacaatatatgcaccaaaatatctttatgagaaatccagaatccagttaagaagttgcaccaccataggtgagcacaaagccaaaaatagatgcactcaaatggtcaagaagaagaatttcattttatatgcatcagcctttgccacaagccaacacaactcagaacccccagaagagaacacactggctcgcaatttcttcatcaaggggaaaaggaaaagtggaatgtgagtccaacaatctggctctttggaggctgcccaaatgattggtttctgtctcatctcacctagagtgttaacagaactggccttgtttgagtgtcttgggcaactgagaacacagaagcatggaaagaggcagcttgctacagcttttgtagtcaggaaagagaacacaatttgaggcttctcttttaagagagagtaacagagtgtgtgttcagtgttcaagttttcagagggtttcctgaggaattgataggtataatgcctcactcacagtgctggcagaaagtcagcatactttggat

SEQ ID NO: 20433 - DNA, 647 bp, Homo sapiens
accttaagcctattcttcctatagtccattttttatttgcacagtagacataacattaatagttctattagctttttgatggctaaatgaggtaaaagagagtgcttagaaaaatatctggcacttgataagctctcagtaagtgtttgctataattatttctttatttgagttgttatatgaggaataattaaaagattacaaaaatagcaaatgaagatgattaaagccccatttttaaaatgcagctggatatttgaaatgaacagaattatcctgcctagagtaaatcattctcttaattctctcttgacaatagtcccactgaaaatgtgcccatttactatgctttaattcaatttttttcattaattcaaacaaataaacatgtactgaacacccactaagttccagagcagatgcagtctaatgtggagatgcaaagaaaaataaggcagagtctctgtcttcaagaaattaatgatgaaaagggaaattgatattggcacagaaccagcccactccctgattcacaggcttacttaaaaaatgttagtgaacatttcatagcaactgataatgcaggtaaaactaagagcaaagaactgtagcttgcatgcatttgtatatgaagaactccttttatg

SEQ ID NO: 20434 - DNA, 602 bp, Homo sapiens
gaataacctcggtggaccctgggacaaagggctgtccctagctgcttggtggctggacctggggtgacgagagcaggtgcacagtggatgaaacacagagggggccgagggtgtggacgttggattgggtggcttgcacacgtaaggcatgctgcagcaatgctgtttgctatctctaggaattatctagccctgggagggcctgtccctccggaggcagcaaggctccagatgtcaaagcaccacacaagagaaaataaaaagacatccttagtacatgactgaataagcaggaactgagtttagatgtcactgcatgcagtagttgggaacagagccaagaattacagacaccaccctccctccttctacgccttctccaagtcccaagggcgcattatgaaggaattcccattaagtctggccagacgctttacagaggaattaacacaggatagtaaactgaaatgagaaaaagagaaaagaccagaaacggaggaatttaaccgtgatcaaggaggagcacggcgcagctgcaggactgagctcaactctggctctcacctccatgccagagagaacctgagggtctctgtcagcat

SEQ ID NO: 20435 - DNA, 442 bp, Homo sapiens
aaactatctgaactgtctttattcactcttcagcatatttaagttggttttcaacctctgtcattccactgaaatcactcttgtcaacaaccttcatgttgtcaaattcaaaacacagtcttctgtcctccgtgctcattttttcaacagtccctgcttgccctttaaaggacttcttttgcttcagttacccttttaggtattgtcatagtcctttctcttgtctttctacttattttaaatgatgttatctacacattttttttaaagaaaatgatgtttaacatttttataatatgtatatatgcctatggttccctgatatctctgaatttcaattatgttcaactaatcacttaacatatctgcctagaaatctctaaatcttctaaaatgtacaacttcaaaactgaactctcaattattctccagaaatctctgg

SEQ ID NO: 20436 - DNA, 445 bp, Homo sapiens
cttcctctttcatatgcaaccaattccagaataaagagaattctgaggtcttagagaatagaagagccacctaaatgcctgcaccgatatgcatcagactgttaggtaagcgcacacacacacacacacacacacactcacacacacacaaagacgaagaagattatgttaaacttctaaaactctgtagttttatttaactaattaaccattaaactaattaaccagctgcctaatacagacattggaataaggagtgagaggctgctgtaatataactaaaatatgtggttgcttagcgattatcagcaggctagaattctagggattcatattatgcagtgcctaagacaactcaacaattaggaaggcaaatcccattccaatggaggctgcagctgtagagaatggggtaaaaaacagattatcatcagtgtaattggat

SEQ ID NO: 20437 - DNA, 552 bp, Homo sapiens
tatctcagagagtactgggattctgaaagtgaaaggtttatacccagtaaaagtatgggagtgctggaccaagctaacatgtacaagaagaaatatggtatatatttatggaaatagataatgaaaatgctgaattgaagagcaaagtttggacaatggagaatttttcagtttatcaatattggtgcactcttccatgaaggagtatttaactctgtgataagtaccctggaagaatgaagttatattacgactatgttggagcttgggcactagaagcatgctgaaagtgttttccactttaagtgaagtagaaatgctaagaggtggccggggatcacgaggtcaggagatcgagaccatcccggctaaaacggtgaaaccccgtctctactacaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactc

SEQ ID NO: 20438 - DNA, 558 bp, Homo sapiens
aaaccatactcctttacaaattatagaggtgctctgtgaaataggtgctactcagctttcacaatagcactgtcaccaccagctatgctaagcacctttttttttttaagcagctgcatccttctagggatgagccgtttttgtttctaaattttctgtcctaaataataatccagtctgactggatataagaaatatggtaaataatagtacctagcatacagtaggggtcctataaatatttgttgaaagaaatttaaaaaagaatggctttcctttcttttctttttttgagacagggtctcactctgtcacccaggctcactgcagacctggggtcaagcaaccctcccacctaagtctcccaagtagctggcactacaggtgtgtgccaccatgacctggctaatttttaaaactttttgtagagatgaagtctcaccatgttgcccaggctgatcttgaactcctgggctcaagtgatcctcccacctcagcttcccaaagtgctgagattatagcatgagccactgcacccagcctgctttaactttttat

SEQ ID NO: 20439 - DNA, 586 bp, Homo sapiens
gcaatacaaagaattcagaggaatctaaatccagttaaaataatataaactcgtatagtttcaccaaggaattatttctatgaagtcttggaaattgtccaaggtccaaactagaaagtctgagtctgaaacattactatcaaaagtgtaacattctcaactaacatgcaaataggtcatgcagagaaaatttgcctaaaatgtttgattagtgtaacctcaaaatccctaaaaaactttgttcttgggttttcttgacacaggcaaaagacattttgggggatgacaatagagttgttaagatcagattagaggggaaaaaaaggaaaaaaatagtgcttattaaaaggtcagtaatcacagtgtttattatttacatatgattttaacaattgtattaaaatcaagtatctattcaatggtgctggggaactgaattctcatatgcatatccacatggatattcagctggacactgacctcatactgtacacaaaaatggattcataatggatcatggataaaaaataagaggttaaactatatggttctttattaaaaagcataagactaaatctttatgatc

SEQ ID NO: 20440 - DNA, 573 bp, Homo sapiens
ggaagggtgagattttctactgcattagttgaggcaatattagctataacaaaacagatcaaatagtgtataatgactcattccaaataaacatttgtttttcatttatgtaactattgcaggttggtaggggactttctcctccttgcagatattttggaatccacctttgaagatgggaatacaacatgtgacttataagatttagtaaatagggaatacagagggcaaatggaaattcagtaggcaacaaatggtgtccaatgttataatcattcatgtgaagtttggtaaatatcccactccattgttttatagtctgaacacttgattttacatatttgtggtggctgtcaaagtgtgacactcagatatccttcaagatagaacatgaagggaaaataaaaaagacttatgcgtgtaatgattttatgggtgaggcttagaaatggcatgtctccacgttccaaggacctcttcaaggagaactacaaaccactgctcaatgaaataaaagaggatacaaacaaatggaagaacattgcatgcttatgggtaggaagaatcaatatt

SEQ ID NO: 20441 - DNA, 576 bp, Homo sapiens
gaaactaatgagcttcaattagtttattttgaggaaatggtgtcattgttattggcctgagtttccttactgaaaagggcagtagctggcaaagataaggtctagagctaatagagagaaatgaatagaaattctagatttcatagctattattaaaaagtcaaaaaataacagatgctttcaagattgttgagaaaagttgacatatatactgttggtagtagtgtaaattaattaaactattgtgaaaagcagtatgatgattcctcaaacagctaaaaacagaatgaccattcaaccccaaaatcccattagtggttatatacccagaggaatagaaatgatcctaccataaagacatgcacaagaaggttcattacaacactattcacaaaagacactcttcgacaaagacatggaattcgccagttcgctattcaccaaagacatggaatcagcctaaatgcccatgaatggtagactgaataaagaaaatgtggtacatatacaccatggaatatatacagccataaaaaatgagatcatgacctttcaagggacatggatggagctgga

SEQ ID NO: 20442 - DNA, 349 bp, Homo sapiens
acttggatcaaactactgagcctagggaagtgaccactaccccattttaaggatcaggaaaaggaactgtatgtgggacacgatggctcatgcctgtaatctcagcactttgagaggccgaggacaggtggatcactagaggtcaggagtttgagaccagcccggccaacatggtgaaaccccgtctttactaaaaacataaaaattatctgggcatggtggtggctgcctgtaattccagctacttaggaggctgaggcatgagaaacacttgaacccagaatgtgggggttgcagtgagccgagatcgtgccactgcactccagcctgggcaacaaagagagagtct

SEQ ID NO: 20443 - DNA, 619 bp, Homo sapiens
aggcaagaaacatagaccagtaatttacaaatgggtaaaccacatggttaatcaactcagggagatgcacatcttcacagtaaccagggaaatacaaagaagaactacaatgaggttttattttatgtttgtcaggttggcaaatacttaaaaatgtggctgtatccagagttcttgaggatatgaacacctataccctgattcttggagctattttggaaaataatttggaataaaaagtaaatatgaagatgagaatatcccataataataattatttctagttatatatcctaaaggaattcttgaacattaaatattttgtaaatattgtttgcaatagtaaataaaaacaacataaaaggccagccgacaagagtggaaaataagttgagctatggttatacaattgttataaaatatttgaaaataaaacaattagaagtatatttatgaaacatgagtgaatttcaaaatcagaacattgagtagaaaatgcaagtaagaggagcatttaatgcatgatgtcacttttgtaaagtttaagaacacagatatcaataaaatattctaagagttgagaaaggagagtagaattagaaaatgacataagcttgac

SEQ ID NO: 20444 - DNA, 569 bp, Homo sapiens
ctcagcctcctttgcagctatctgttgcaaagcgaacaagtgggagtggtgctggtggctttgcagttagcctaggattgagcaattgctgcaattgttgctctctgcatcttcggtgttacttcttactggttgtgacagtggtttcctccctggatgagttctacagcatggtttggggtacatttcctggctgcctagctttgatctggctctctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagctaaagaccaaatatatattaagcctggctggtcttaaaaatgtaactggatacagccaggcatggtggctcacgcctataatcccagcactttgggatcctgaggtgggcagatcacctgaagtcaggagtttga

SEQ ID NO: 20445 - DNA, 552 bp, Homo sapiens
aggtcaaacagctgacagtgatgaagccagacttggagctcagctctgccagattctggaatgcatctctttccatagtccttgtctgaggcctgcttaaaatatggcattcccatgtattctccaattcaattgtcataataaccttagaaattcaggtattgttgttagtgcctccatttcacagagagaaatttcatcaaggaggttaaatgctttgactgagacctcacaacttttgagtgcatggtagaacttgcacctgaatttcatagacttgaacttccgatattttttattatactatatttaaagagcataatccttcatctttccatctgcccatccatccatccatccatccttccatccatccatccatccatccatccatccatccatccatccatctttccttccatccatccacccatcaggccattcactcctcagcgctttagtacaatctgactctatctcatagtttttgccttcctcttctccattccaccctcttccctaccactagccaaaaaaaaaaaaaaaaaaaaa

SEQ ID NO: 20446 - DNA, 508 bp, Homo sapiens
agtgctccctcccaagcaagcccttgagcccctcatctctggaggcttctcctccatgctgcctgcacccccaccagccaccagaaccccttcaggtatagacagaaacagattcagtcaaattccttggtgtcccaggtgacgtctggccaggggagccagcccctttaagttacactattgcatggctcacacccggaatcctagcactttgagaggctcaggcagaaggattacttgaccccaggagttccagaccagctggggcaacaacatagtgagactctatctctactaaaaatgaaaaaaaagattagccaggggtggtggtgtgcacctctagtcccagctactcgggaggctgaggcaggaggatcacctgagcccaggagtttaaggctgcagtgagccgtgatcgtgccaccgcactccagcctggacaatagagtgagaccctgtcttgaacgaacaggccaggcgcagtggctcacacctgtaatcccaggac

SEQ ID NO: 20447 - DNA, 450 bp, Homo sapiens
tatttagactactgaacctacacaggaattgggtatttacttttagaaatcagtgtccatctagtcagagcccaagtggaaatctcttcagattacctatcgaatagatatgaagagatatcgaataggtatgaatacatgtcaaatcctgtcttgacatgtattattgcaaataaaacttagagagctagtgccttactcattccaagcttagatatcctgatctacaaagtgtggttaatacgaaggttaaatgtgataatgcatgtggagtacttatcatgatgtctgctgaagacagtagtgggagttttatttgtttaccactgtattttcttcttctgttctactaccaagtgttgagagaatccctgtggaaacttacataatattttttcctctagacagacagacatgcacacctacccacacacacactcacacatacat

SEQ ID NO: 20448 - DNA, 400 bp, Homo sapiens
tttgcttcttggtctcatttcttatttttggtgctcatatttattttcctggagttcaacaactctaagtatcttcttcaaaaagggttccagagcagcaacattttaagatgttgtctttctgaaaagaacttcattttgccctcacaatcaatttaaaaattggccaggtttagaattttaggttctaaattatttttacctccaaaatttgaggcatagaatcactttttagtgtatactgattctgattttaaaaaaaatctgatggcaatctgatttacatttctggagatcccattcttgaagaattcctttgctttcatatctgctgacttctttattctggctcctttcactcttagggttgctactatgagtttagggggaaaaaggagac

SEQ ID NO: 20449 - DNA, 91 bp, Homo sapiens
aaattatcgcaagaacatacaacaggaatataatacagtctagcctggacgcattaaggaaaagaacagataaggtagggaagagacatct

SEQ ID NO: 20450 - DNA, 117 bp, Homo sapiens
ttggggtatttgatctaagtttaacatattctttacaagttaaaaacaaaattaaacatttaatttgattagggtaggaaagtagaggaaaattatagaaggcataatttctacata

SEQ ID NO: 20451 - DNA, 609 bp, Homo sapiens
atttaaagaaatgaagatatgtccctatttctgtactgtataatttcaattgtttttcgtttgctctaaagttcttatcatcaataattatgtaacactattatatactcactatgacacttttaagaatggaaaaactattcttaggcatattttatttttaaaaacttcttaactatataataaaagagcagagatttttgtttcttttttaaacatttactggctgaatattttgaaatgaaacttactatttgtataagtttcaaaccagagttgtttccaggccaccagaaagaaatctttacctgattcaacagtattacagaaaggcactaccacagcagggagtttttgggtaagataaggaagaattcaggctctgcaaaaataatcatcttggctagagtagtaaggtttttttcgtgtgtgtgtgtgtgtgtgtgtgtgtgtttgagacggagtcttgctccgtcacccaggatggagtgcagtggtgcgatctcagctcactgcaacctctgcctcgcgggttcaagcaatactcctgcctcagcctcccaagtagctgggaccacaggcatgcaccaccatgcctggctaattttt

SEQ ID NO: 20452 - DNA, 606 bp, Homo sapiens
gctccgaatcatatagcaagctagtgacaaaaatgaaataattctaatccaattatttccagtttacttcagtttctactatctcacactgtgtttcattatgggaatggatgtcctgtctttgaacataaataatttgaaggctatctaaatgttgttatttttagttttaaaggcattctatatatgtctgtctgtatttatccacacattataaatctcatgtgtgtgaatatatttatgtctttgtttatgtgcttattcatgtctccatgagtcttacatgtgtgtatgaacctgaatacttgtgtttatttatttacactctaattataattgaagaaaaagcagtggtaagaggatcattttaaacattctatattttgatgttgtctagcagggaaaatacacagctctactgggtacagaaatagcttctctggaataaactgcattatatcattaaaacatttagggcaaatctcaatttggcaaaattgattcattcagtgtctcagacattaattctattaagtataaacataaaagattgggaggtggaattaatgagcaagtcacatagctaaggagatggcatttcttttc

SEQ ID NO: 20453 - DNA, 511 bp, Homo sapiens
tgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtatacatggcctggtcctaccagagactcacccaatgccagcctccagccagggagagccaagtttgcattttcacacgcatctcacactcctctgcactctcaacttggagcgctccaaacagggaaaccccaagccttgctggcttctgccaaccccctgagcagaagcatgggtccccctgatcaccacctcaccaccctcatcctgatctcactgtacactccctttcctggtctgctaagtagcgggtgtttttccttgacactaacgctacagctagaccacggtgggcttggcaacaggtgtcttcccagatgct

SEQ ID NO: 20454 - DNA, 541 bp, Homo sapiens
tgaccatgtttttgccaacaaatgcaacactccattacttgcagaattcctttgctaggtcctggactacccaggtctccctgcttttgaccccttgtcgtttattggctgttctataatttcactgatggaggtggaggggatttagaatctatcacattagaacatggtgaaatatttactggagggggaaaattaaaggccttggtaagcagacgtttaaaggttgcctggaaattttgtttctgcatgtattataggaaaacaaaacaaaataaaaactctgcctagtaaggattttgcctttgcctaatagttattgggccttaacatacatatctggccaatgggtgagggcttgaactgaaaagagtttgattggtttacaatgggaagggtcgagagtacgtaacttcaaggaagagaaaagagattgaaaagaaatggggctttcctcataacgcaatagttgtgatgatgaagttatgatgaaaggtgagtgaagaggaatttggctgagtgctatgaatggaattccctc

SEQ ID NO: 20455 - DNA, 559 bp, Homo sapiens
atcatagatgacatcaacaatggcatagtggaatgtccagctagttaacaactacaaaggaaaatatttaaatgaatgatcatttgacaacaacaacaaacaaaaaaacagtaaaaggatgaaacaagatacaccaatgtaacactgaccaaaagaaagctggagtagctatattaatatcaaacaaacaatccagagcaaagaagagagagataaagagggacattacacatgataaaaggtcaattcactaagaacacaaaacagtcctaaatgcgtatgaacctaataacaaagcttcaaaacgcatggaccaaaacctgacagaactaaaaagagaaacagacaaaaccacaattatagttggaaacttcaatacttctctctctttaattgactgttagggcaaacagaaaattcaggaatattaacattttagactggataattatggtgagagttgtggggtaaggctcttctgtgtattgtaggatgcttagcagcatctctggtttctacctaccaggtgccagcagcatcccctcctaagctgtgatta

SEQ ID NO: 20456 - DNA, 587 bp, Homo sapiens
cataaattggatggtaattagcttctctaagctgaagtctaaattcaagagcatttagaaatgagtctgcaggtaaatacgacacaagagactagactccaagcagagaactccatgtttgctctccttcagtgagaattctgttgatgtcagagggttaacagaacttttaacagttgactggggccctggagttttcatgatttggtccacattcaaaaatataaaagtcagtgaagcaaatgctgtacaacagaggtttttcagggaaaagggataagcttgatccaaaaatattttggagggtggagacattccaagcataccattccgtgcctgtgccaatggaacgtgggcacagcacgggaacaatgttcaaggctggagagctttagagtaccggggcaattttgagtgaaaaacacaaagaagtgaggaatatccatctctgcccccatcacacacacacacacacacactcaaacacacacatacacacgcacacacacatacacacacacaaacacacacactcaacgcatacacatttccctatttacagtagaattataaattctgagtaaatt

SEQ ID NO: 20457 - DNA, 468 bp, Homo sapiens
ccgtttctcacaattctttgcaaactgtatattcatgtgttgaaaaatttaatatcttttctgacttctttggaatacactaggctaatcttcaaggattgtaaactccatgtaggttactggttttactctaagggtctccaggctaaacatgtagtatttgcttaaaaagtgcatgaaaataaagtgtggagactccataagataacattctgcttcggtgaagtaaccaaaacagaaattaagaaaacaattttatctgcggtcgtgtcaaaaataatatacttaggaataaaattaaccaaggatgtgaaagattattgcaccaaaaactgtaaaacattgatgagagatattgaagacacaaataaatggaaagatatctcatgatcatggatcagaaaaatgaatattgtcaaaatattcacactacctatggtgatctacagattcgttgcaattcctatc

SEQ ID NO: 20458 - DNA, 558 bp, Homo sapiens
gaactcccactgcctaattgaggggggcaatttgagcattaaaataaataacagtgttaatagattataatccatggaatggtatggaaaatgattagttgacagaaatatttaaaaagttttatgaagaatatgatctatacagaatttcaaagtatttctctacaaaatacttcttaaatacaaatggaaaaagtgcaactttactgtggagaaggctgaataataacacctcagtcaaatgagtaaagataatcagtaataaggaaaatagaaattgtgaaccacctgatagagtgcaatgagttgtccataatatttctgctctcccactatagctaaacatggacctcatgggagacagtaagggggaaaaaatattaaaaccagagcctaaaataaggtgacagacaaccaagctaatcagctatgagaataaatgcaagtaggttaaacttccctatcaaaagatacacacacacacacacacacacacacacacagagagagagagagagagagagacaacatatactctatgctatgctcaaaagtgac

SEQ ID NO: 20459 - DNA, 552 bp, Homo sapiens
ggaggatgcgtaagagaaatgggagggtgtgaagatgaagtaagattgatcacgagtaggccgagtgtgatggctcatgcctataatcccagaactttgggaggctgaggtgggaggataactcgaggtcaggagtttgagaccagcttggccaacattgtgaaaccctgtctctactaaaaatacaaaaattaaaaattagccaggattggtggtacgtgcctgtagccccagctacttgggaggctgagtcaggagaatcacttgaacccgggaggtggaggttgccgtaagccgacatcataccactacactccagccttggcaacagagtcagcctccatctcaaaaaaaaagaagtgtcagagctgggacccaaacctgggtctcattctggagtctatttggttctgcctttcacataaggtgggtgggcttgtcagatgcccataaaggaatcaatcctgtaaggcacctggcacagtacctgacacattacaaacacccaaaataggactcgaatcaggtgaagtaaactacagctccacacca

SEQ ID NO: 20460 - DNA, 573 bp, Homo sapiens
gtgtgcctgtttgggtctcagagaggttagtgctgagttgaggagtagggacagaccttagataaaatccttcactagtagcttggctgcaggagtgtggtgtatgggagctatgccctagagggctccctgaattcctttgtctatagggtggtgccacatggtgtttacaaaacatggattctgggatcagagtgcctgggttgaaatcctcactctgcttttagctttggcaggtcacttgaacctctctgtgtctttagatgtttcttcatctgtaagatggggacaatgactgtacctatcaacttagaacggtatctggcaaattgtacatgctatataggaattagccattatcactactactcctatgaaggaagccccttcctaaggtgaaatgtggcctggttggcagaggagctgtggttggttctctttggggagatctcctaaggtcaggctagccagagggagaaagaattgtgcttccttgttgagactagtctttaaaaggaagctgggcagtaagtgattggtgccaaatgtcaaagaaactatttctcatctcag

SEQ ID NO: 20461 - DNA, 541 bp, Homo sapiens
agcttgtccagagtggcatctctgatgcataaccagtactcaaaccagtatttttctgacaccaaggcctgtgtgtaaactgtaaaagggctgtttggtacctgctttcctaaagttgtctgatcccttctcagtccaggtcttcctgaagcttggcacttctgaagtcacctttctgaaaacattctggtaactgttagatcccttgttgtagctattcatatgttctgtgtggttaaacaaggttcacagtgggccacctggcctttggaacttggctgaagaggctgccttcagttcatcctccccacccccattttcaaaacatgggtttccatgtgttagttgtaaattaggaaacataaccatgttttgaggcttcatagaaaacaaacgtctggggtcacacaggttaaaggaggaaccaaattcagcactatcactgttctattcagcaggcaattctggggccttcctgtgtctcaggttctgtactagttgtttcaggactttgggataaacacaaactatccctgccctc

SEQ ID NO: 20462 - DNA, 540 bp, Homo sapiens
tgcgcccagtcccagccctggatttgaaccagtgttcactgaagcatttccaagcctgttgttgtgccttcaggtatatgaaattcaacacatattctaaaaaggaccttgccaatgttcagtagaatggaaggccatcccatgagtttcagaaacactgatgctgctttaaaacaaaaaactcccggtgattataaggcttacctggagtatctcaaatatttcagtagcgaaaattcaaagacaaggaccagcaggaatgccaattccatgttgcaatcacgcctccccacccacaagcatgttattagtgtgtgcttccaatgcataattacctttcattttcccatagaatttcaggaaaaaagagcacagggctcagatggtttgtgaaatcaataggtgatttcatctcttacatgcaaaaataatcagttctattgagaaggaaatgtatacacacacacacacatacacacacacactacacacacacacactggaaagcccacattcaacagtcaaggtcacacacacagg

SEQ ID NO: 20463 - DNA, 409 bp, Homo sapiens
tgttgcccaggctggagtgcagtgtcatgtctcagctcaccgcaacctctgcctcctgggttcaagcaattctccctgcctcagcctcccaagtagctgggattacaggtgcccgccaccacgcctgggcatacatgcacacataagaagaaagcaaaaagcaagcgcagcaaaagtttaacagttggtgtatttaagaggctaattgtactttttaaaaaacctttctggaggtttagaccttacaaattaagaaattggggcagccggcagtggctcatgcctgtaatcctagcactttgggaggcaaaggcgggtggatcaccagaggtcaggagttcaagaccagcctggccaacatggttaaaccctgtctctactaaaaatacaaaaattagctgggcatggt

SEQ ID NO: 20464 - DNA, 465 bp, Homo sapiens
cccgggattaagttgacagccgtttatttcctaaatataaggtctccttgaaagagtggccaatgagctgagactaaatatggcagccaaggggagtcatggaaggcttttgagcaggagaggatcccaagctcagattccagcctggtcttgagggtaaagcacactggataagacttaggagaccatggagtctcttgaaaactaggctattgcctctgggctctgtttcccttgcagggagttcataagaaggcaaccacttcatgtccgttttcttccttcttggtcttcttcctctttcctctattttcttcccatccctccccagcttctctcccaccttatttttattttccaatctgaattcttcctcctccaaataccttgtgtgagttctcctctgtcctcccacttctttcttcagctcctcatgggcctgtcttccagggagaccttatattt

SEQ ID NO: 20465 - DNA, 526 bp, Homo sapiens
tctcatttgtaataagtcgtaggggctcacgagaaaaggaaagataattcaattttgaatgtatgtttacatttcctaaacagctcacttagcatctgaacccgaatgcacacaaaaaaataaaacattgtctttaaggaaataaaatgcagtgggcctaacatggcccccaattggccaagtcctcttctcaactaggaaactggccactgtccactctgggcctgtgactaacacagaggaggatctcttgtccttaaccttttccgactcccctcccagaagatggcagggctcaagaggcctgaacgggaaagccccgtgtgggctccatggcgacctcagcaggcgagcccacccctctcccgggaggactaacagtgggaagacttctgtgggtgggagatgaggaccccagtctctcagcctggtgtctgtaaaactaggagaacgggcccatctgcgggtgctggggagcctgtgggacacacaggaagcacttgtgtgtccaggcccagcggtcctg

SEQ ID NO: 20466 - DNA, 505 bp, Homo sapiens
gttaacagatactcaaggtagaaaggtcaaaattctgtagtcttctgaaagacttgaaaatagaatgactttatgtggctttaaaatatcaattaaggggaaggaaaattagtgataagattttcaagggggctgaattgtgcacatgccatttttacatttatttttaatttacatagaagttaaatggactagattggatttattttttcatgtatttgttttttttgttttggttatattagtagctttctttttgttttttaagcatattatcaggcccgtccccatcttgcaagatggttgtggaaacaactgagaagctggatactaaggaaaattatttttatagaccaatatctttatttaaaagaagctaaaaacactttcttatttacattaatgaaagtctgtgaaagtagggggaaaagaagcatgccattaattttagttcatgttcctttatattttgctcttctgtcctgtgactaccagcctttaatct

SEQ ID NO: 20467 - DNA, 598 bp, Homo sapiens
atgctaactgagttaattagatgagattctgtagagaaaatggacactataagaaataatagtgtccagaactgagttataatgacctctaatatttaatgataaatgaaagaagaggaactgatgactgaatctgagaagaaaccaataaacttgtaataacagaagaacaaacccaggtggtgctaaagaaatcacagttcatcaaaaaggagggacaagtggacttgccttgttaaagatggactgccttaccaaatatgacaaatattaaaatatgtttagatttcaatgatgaccaaatatgtaaataagacactggaatttattcgtcaaattcctgataatattaaatgttacatgagcaattggatgttaaagcacaacttttcggctgggtgcggtggctcacgcctgtaatcccagcactctgggaggccgaggtgggcggatcacaaggtcaggagatggagaccattctggctaatacagtgaaaccccgtctctactaaaaatacaaaaaattagccgggcgtggtggtgggcacctgtagtcccagctacttaggaggctgaggcaggagaatagtatgaaccc

SEQ ID NO: 20468 - DNA, 601 bp, Homo sapiens
cacagagaaagacagagacagagagaaagacagagatggagagatagaaacagagagacaaatgggaaagaacaaagtataccccaaagtacagtctgctagcagtagcctgaagtctttctgaccacttggcagcagcttggaaaatgttcctcactaccttcatggaacctatcatagcataagaaccagcccaaagtaaatggatgggactttgaatttttgtttaaaaatgatggcttgtgcctggtcaaaatggtgtgtgaatggcttatgcattgatatatatcgattggcataagtcagagcgcttcagacctggtctcggtctaagagatcctcagtggagacgtggcgtctttggtcatctaaggtccctgcagcatcacaaagggaaagggcggcatcttctagtgtttacacagcccaacagaaatcctgtgttcttgtaaggaggtgaccaaggtggacctgaacctggattttgtctggttttatctgaaactaggcaatgctgttatgtaggttgtcagaccagcagctctgcagctggctatatgtgtctttgagtaataagagaatcactagaggaattaaatga

SEQ ID NO: 20469 - DNA, 603 bp, Homo sapiens
agatgacctctatatgcaatggtcacctcaataacgctatttgaatgtcccataacagtcatcttaaacttaacacatttaaaacgaaatccaccatctttcccatccaaaaccactcttgtggtctcttagtgaatggtattatcattcatgccattgaccaaatcagaaacctaggcattagttttgcatcctctttggttctttcatctcttttgactccacccaaaccaccactccatcatccaatcaatcaccaagtgatgctggtagaattgtaaatctgatgtcacttgttaaaaaagaaaaattaaggaaaaacccatcacagccgagtttcatctttttctactttttatctcctttccctattctctccttagacctctaaattctacctataatgtacttctttcagttttgtgactataattccttattgctctgaagtatttgcacatgttattccttcagcctccaagtgtcttcctccactcccaactccatttgacttggttcactcactactctcttccaggccatttacattctctaactacccatcttatttccttgctaattctctaagcgcatctttctcta

SEQ ID NO: 20470 - DNA, 452 bp, Homo sapiens
gaaaagaccatcctttcctcaatgatttccaatgcgttcttgaccctataattagaattaacttctgtaagcactcattagatcgttccactttcctgcctgtctttaacggcagaccattgctcttatggacaataatcagataatggtcagttccttgcgtaacaatacgcagcttgatctggccacctcctgtctctcctgccaaatcttgccttgtgtctgcctttccactctgaacatagagttctttggacaggtcacaccctcatcctcaagcccttcccatatagagtgttttcatgcccttagactagttactcaaacttcaggtctcatctcttccaggagccttctcaatagcacagtccctgtcccttaaatataggttgtgtgacttctatatatgcattcatggtcaggcacagtggctcatgcctgtaatcccagca

SEQ ID NO: 20471 - DNA, 485 bp, Homo sapiens
ctgaatgggaaagaactcagagtctaacataagatctaaaaatcaacttaagtacttttataattctaccatatttttcttattttaggcaaaggaatttttgtccattcttcagctccagttttaaggagagtagtaggaactctgaagacagaggcagcagtaatcaggggagaacgatacaaagaaatgaagctcaaaaagacagcaccagagtcctctctggccagccgcaggcctggtctatgaaaaccctgagtggttttaggcatcatttcaccatcctaagattcaaaacaaatcaagcaatcaaaggcagggctgctaagtaagcagctgcacaagcagagcagtgggagaggtgaatgggaccagggcctcgctggggtgggagactagatgggggtagcaaggggacccaagggaagtccaattaaaaagttttattggccaggcacagtggctcacacctgtaatcccagcat

SEQ ID NO: 20472 - DNA, 599 bp, Homo sapiens
gaaaagtgtatcaagtagaatgtgataagaaaccaaacagttaccttgccagataagagaagtactgagaagtatcctcctagatttagcaacaaggttactgttgactttggtgagaaatttcagcaggggtagtgagggtcaattccataactggaatgtattattggaaggaagagggaaaaaataaagaaagtcattagctaatatttttaaggaatcagcctatgatgagaagcaagcacagatggtcataaggaaagttttattaaaatagaaatatcttgagtacgtttacaatttgttggtaaggagggagatactggtcgggtgcggtggctcacgcctgtaataccagcactgtgggaggctgaggtgggtgagtcatctaaggtcaggagtttgagaccagcctgttccaaactgcgaaaccctgtttccactaaaaatacaaaaattagccaggtatggtggcacatgcctgtaatcccagctacaagagaggctgaggcaggagaatcgtttgaacccgggaggcggaggttacagtgagcggagatcgtgccattgcactcagcctgggcaacaagagagaaact

SEQ ID NO: 20473 - DNA, 511 bp, Homo sapiens
tgcatccggaaggtggaggttgcagtgagctgaaatcacaccattgcactccagcctgggtgacagagtgagactctatctaaaaaaaaaaagaaaagaaaaagaaaatatcttttcctagtttattgtaaattattttattaaaagtggatggagaattaattgtatcatcagaaaaatatcttttaaaagaaaaggtatcacaggagccatccatctcagaaaagcaaggaaaaaaaatatgagactttcaatattaaaaatgaccaaatatttaaattggcttctctctctttcttttcattaactgacgcttaccattagaggagaggtgactctagggcctagcatattgctgaaaacacagaagggaataaataaattatgtatcgtcggaggttttttactggggagagagctgtaggtaattgttgcaccacacagatgctccctccaggactgaaggacttacccctccagctgctgggattatagttggctgacactctcc

SEQ ID NO: 20474 - DNA, 595 bp, Homo sapiens
atgagcacattttagaacttggatagcttctctcctgtgaatgcagatattctccctttggttatggaatagcaaacccttagagaataagaaaactcagatagctaacagatgaaagctgagttgctttcctgatattatagagtatactgcagttgatgaaaatacaaagtttttgtaattcagaacaagtgtttgaggaaggtggttcatttcctttaaacattttttttaaattgataagtggaccctaatcaagctgaagagcttctatagagaaagagagctatcaaagatgtaaacagacaacctaaagattgggagaaaatattcacaaactatgcatccaactaaggtctaatatccagaatctataaggaacttaaacaaatcaggaagcaaaaaccaagtaatcccattaaaaattgggcaaagaacatgaacagagacttctcaaaaaaagatgtgtaagtggtcaacaaacatgaaaaagtgctcatcatcgctagtcctcagagaaaggcaaatcgaaaccacgagatacatctcatgccagtaagaatagctgttatttaaaagtcacaaaataatagat

SEQ ID NO: 20475 - DNA, 103 bp, Homo sapiens
ggaaaaaaaaacagctactgaagacaaatttcattctggaaaaaatatcccatggaaacatatactttccagcaaaaaaacactggaaaacatatacatcgga

SEQ ID NO: 20476 - DNA, 581 bp, Homo sapiens
ccttatctttataattaaggtcttcaatcaatcccttttctggaaactactatagtttcccagagaaagcaatagttgtttagcaaaaacctctgtccatgaggacatttgaattaataagtgcctgagtgttttaatttgctgagagagaaaaaaaaaaatcgggactaggaaccaaaacttagttccatccaattaggatccttccatgacagcacaaaacccttaaaatttgtgagacaatttcaagatttcttcttccacgataccgaagtctgacaatatatgctgtacatgatcaaatacacaataatgaatatgtgacttatgtttaatactagattgaattttaacatacatgttctttcttccaaattccaaaagcttattccactttcccccttctctcccctagccatcccctgcgtaaatatacaaatcttagaaatattggagagaaaaaaatgggaataagtaggaagaaatgcattttgtaaatgcagccaggcatggtggctcatgcctgtaatcccagcactctgggaggtcgaggctggtgaatcacttgaggccaggtgttc

SEQ ID NO: 20477 - DNA, 624 bp, Homo sapiens
taataatttacattgtaaagcacaagacaagtcttcccattaacccttacctcagcatttccaattcttacaacacccacttcatatcaaatttggaattacaaacacatgtcaagactaataatcattaaaactatctgaagttaatgattttacctttttactcttattataatgtccaggtcacaattccaatagacacatattctaaaattttgttgtgccacacattatggctacctgatttttgtcaagggtcaaacaattcaataggaaaaagagagtcttttcaacaaatggagcagaaacaaccagatatccacatgcaaaaaaatgaagttgaagacaaaaattgactcaaaatggaccagagacctacacataagagctagaactacaaaactcataaacgaaaacagctgtaaatctttatgaccttgaattagtcagtggtttcttagataagccaacaaaagcacaaacggcagcaaaaaaaaattgaacttcattaatactaaaaattttgtgcttcaaaggataccttcaaggaagtgaaaagacaactcatagaatggaagaaataaatatttgcaaatcatgtatctaataagggacatgtagcta

SEQ ID NO: 20478 - DNA, 557 bp, Homo sapiens
tttgggggatgccttctctggaggggttaaatctagggcactctgcttgccctactcaagattgagcaagttctcttggaaccaaggggagaccctgggcacttgagggtggagactgtcagcaggcacagggaatggcgggtgaccttgaaggtgagccaggggaatatggggcgtgtttgatcaaggtcatacctgcccagggtcttgctgagaggagaaggagccaaactgggattcaaatgcaggtctaggccgggtgcggtggcttacgcctgtttttccagcactttgggaggccaaggcagatggagcgcttgagcccagcagtttgagaccagcctgggcaacatggtaaaacactgtctctacaaaaatacaaaaattggccaagcatggtggctcctgcctgtagtcccagctacttgggcggctgaggtgggagggtcactgaggcctgggaggttgaggctgcggtaagctgcaatcacgctactgcactccagtctgggtgacagagggagaccctatttcaaataaagaaataaaagcaaaac

SEQ ID NO: 20479 - DNA, 429 bp, Homo sapiens
attgagctctgtgaggtaggatcccagatcatccaagtaggagggggaaggtgaatgggtagggtttttgagaaaaagaacattattgtgaaaaatgagaggaaaaactgacaaggaaacaagtgctgagtggcagcgagggtccagttaaggctggaaactgtgaatttacagcagcagcgttctgtctagttgtgggattttcctctaggaatacggttataggaaccaagatgctggctatttggaagggtccagaatcgcctggtaagacacaacagtggggcaagggatctaagcctgtgggctgggcagagtttgctgtgctacgctagggttctggtctgagaagggaatggaagggtggagttctgatagggagaaaactgtcaagggctttttgaaagtgaagacgtgggaggaagtgac

SEQ ID NO: 20480 - DNA, 352 bp, Homo sapiens
attatctcctttttctcctcagttttctgcgtctcctccttacatggacatgaaacatcgtggaatcaattcttcatggccattatcttttctcctctattatttttgatctccttgttcttcaaatctgttattagagatttacttgacttttactatcaaagtactggcttgactattagcctcatgtaaccaatacattatctttttctttggtttcttcatgtttcttttaagaaaggaggctttcccaattctttctgttagattgctcttttttttaaccacaacaaaaaggtgtctacaaaagaaaaaaggggcccttttttcccaaaaccccccccggaaaaaa

SEQ ID NO: 20481 - DNA, 559 bp, Homo sapiens
cagtacaagatagagatttgccacaggcctttcaaccaagcatactgaaaaaacaatttatttgttttaaactttctctcttcttgcaaatacaatattttgctattattgggaaacagaaattgataaaccactagaagtcaagtgatagtccttgatggctaggtgttatgacattatttgcttgtgtttgatggaagatggagtttctggtattcctacacacgctgtctatcaaaacacagagatggcgctagtgaaaaatcagaaaactaaaacaagaaacaaatttaccaaaggtgaaaaaaatcaccacgctttaaaactgcatttatttaaggaacataaatttaaatttaccgattcaatttatgttagaaagtgagatttaaaataactgctaaagggaaaacagtgatatataaaatgacaagcaatataggctagaatgttgaaaataaaactaaaacccaagatactaaaagaatcgaactggccaggcatggtgctcatgcctggaatcccagcactttgggaggccgagtcgggcggatcatta

SEQ ID NO: 20482 - DNA, 414 bp, Homo sapiens
ctatagttgtactttaggtacatgcaccttaaagcaatgtaaacagtgattaatatttaagaatcaatgaattttattctttttttaatttatttatttttcttctgagacagggtctcgctctatttcccgggctggagtgcagtggcatgatcatagctcactacagcctcaaccttccagactcaagcgatcctcccacctcagcctcctgagtagctgggactcaggcatgcaccaccgcacccagctaatttttgtattttttgtagagacagtattttgccctgttgcccaggctggtctcaaaccctggggctcaagcaatccacctgcattgacctcccaaagtgctgggattacaggtttgagccactgtgttgggctaaattttatacttatacttgctttcat

SEQ ID NO: 20483 - DNA, 454 bp, Homo sapiens
tgtccctgaattgcacctggagaacccctgctacagcttaataaaatctctaccaattaaatgtgatagccattttgtttcagtttgaattgttttcatgtttggctatttatacttcttttgtggtaaattgcttgttttttcttatgtgttgatttgtacagacgtttcttacgttgttattattaataatcctttttatgggttacctttaaatagtttttactattatgtatgtgttggttttaatttttacacatttatcagttatgtcctttatgaagtttctgcctttgtaacatattgggaattctcttctatagctagattatacagtgctttcctctttcactgataataccaactattaagcatccacagtgtgccaggaactgtattaggtagtgagcacaaattggtaaacaatggataaaggtccctgcccttatttgac

SEQ ID NO: 20484 - DNA, 578 bp, Homo sapiens
cacacaaaatgacctttatacttttattcttgtgagctatggagcttaaaagcaaaccacttcaaccagatgttgatccaataaatttatcaatatttggggtttttagagtttcagtatatattcttaggtagagggaactttcatggcccatcaaaatctgctcaagctgtgctgggtgaaacagcactcatctataatactcatgtaacatgagccaatctgcagtcggttgttctgaattctacatcactcacagcgcaggttgatgtgtgaacactgtatttacaggaccaaaactgcacatttgctttgcagctgtgtttaacagttatcagtttggcacacagcatgactgctttggagggagaatagacacttctcatcccttttggcatttatgaagtaaccaaagtacctactgctgaagtgattcacttgagcttaattaggtttgctacataattagcatttgaagaaacctaaagaaaatccttgggggttggttatttgttatgtcaattgtaagcatgctcatttgggggggactaggaattgaaaatgatgaaatttaatgc

SEQ ID NO: 20485 - DNA, 627 bp, Homo sapiens
ctttaccaccgccaggacaactctcactcatccatcaggtcttactaagtgccttctcttcctgcctcctaatactcttcccaagaataagtgagatgcctccaatttcaccagtgagaggaaccagtcagttccttgagggaagaatagcatctagtaattcaccactatcttgtcaaaaaataacaatggcttcactgagtattaactatgctgagcactgcactaagcagttaactcgaatgacctctttcagccctcccacagcattaagggtaagtattatttagtcacccacattttacagaggaagaatgtagagtcgagagagatcaagtacctgcctatgatgacatgactagcaagtggctgagcaggaattccaacccaggccttaggactccagagactgggctcctcaccttccttccctccctggtgtccccatgcctgggacaaaataatatggaaacatagcatgtgctcagcaaatattttttgagtaaatatttatgcggatagctaagctgtcgtggcttgtggtattcccaattttataaatcaaaacaaattgattacatctagtatatcataaaacagtctgtgaattacttgcagtactagtct

SEQ ID NO: 20486 - DNA, 570 bp, Homo sapiens
tagatattggagttctttctctacagaacttcctcttatcaatattctgccccacaaactccagccacctcaacctccccaaaccctgttcctcttctttgtgctgtggttcagatagaaaccagggaaattgcagggcttacctcattattttctttctctcaaggatgaaagtcttgcactacctgttgtttaatatgtgaaaacttgttccatacatttaatctagctttctagttgcttatagagatggggcaaatttgcttccatgcattccatcatggccagaaggtggaaatctctggagattttattggaatcatactaaatatgcatatcaaatcttccatcccaaagatattttctgtctgtccacacacttggtatttctttagtgttgtttatttaagagctaatgcataaagccaagcgtggtggctcatgcctgtaatcccagcactttgggaggccaaagcgggcagatcacctgagctcaggagttcgagatcagcctggcaaacatggcaaaaccccatctccactaaaaatacaaaaaattgatcaggcatg

SEQ ID NO: 20487 - DNA, 440 bp, Homo sapiens
ttttccaatattgttggacatgttcttaaataaacatgagggctatgagatcgtggggcaatggaaattattgtgatgttcacgaaaatacatccatcaggaaagtggttacagaatgaatcatcacatctccttggctacaaggattgggttagatatgggcatatagttatattagcatcaatactcctcaaatcaagcactttggagaactattcagaagaaagggttcctgatttttccgtaactgtaggaagttcagatacaaacatagggctctttggtatcaccccttgtaatgtgaccaaaaagaaaaaaaagcataacaggagaagatagaaataatgactgcatggagaagtggacttctctgaaatatcatatgggcatatacataagtcatgcctgaatctgctcttggataatcagtcatctttaat

SEQ ID NO: 20488 - DNA, 490 bp, Homo sapiens
ggattcactgagggcttcactgccttcctctgtgtcctgaaagactaactttcatggtcttccttacttaggctcccataacctctgacttctggttggatttgcagttggagaccatgaaaagagatagataagaggagtgagatcagtgtatcgctcactactactatgagtgatggtctctctcccatggctctattgctttgtctagtaataatgcttcctcccatgccttatcagtcttcatgtaagtcatctaggtaggttctggtgattcaacactccttgttgattcctttaacactatttacatcttcgtcaataatacctctatttaactcttcaatgaaatgtttgagagcaccacttatttgcccatgggatcacaaacagtagagtgctgaattgtgtagtttaaaataaatatgaagttatttctttcaagtcaataaaatatcaacagtcataagaatgggaatttcaaaatttt

SEQ ID NO: 20489 - DNA, 528 bp, Homo sapiens
ggtggaagtaatgctgtgtctgttttgagcatagccttagctgtcttggcagcttcatgtttctcccccttggaagccagcaatctgatatgaatcatgtctatcttgaggctcccatgctgtgaaaggcctgagctagtgtggagatgcaatgtagtgagaaagagagagacagaagtccaggtgcaccaatgtgtcagagtgtgagtaaagagtccttgacagtgaattcttcagccccagccaccccagctgatgccacgtgattcaaattcaaacagcttagctgagaccttgttgaattcctggcgcaaagattctgagcaagataaacgtgaacaaattaaatcacaacgtttagaatagttgtgcaggaatagctaacaggaatgggctctgggcaattcttttgagcttgtgtattctgtctgcaatgctgtgctcactgcctaatgacctttataaaaatacaagtttcgaatctccaatgattgaccatatggccacagtatttctggagtcacagag

SEQ ID NO: 20490 - DNA, 602 bp, Homo sapiens
tgaggacatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatc

SEQ ID NO: 20491 - DNA, 506 bp, Homo sapiens
actccatctgctggaaattgtaagatgtctacaatgtgactaccatgcgctgggattataaagagaatcctggtcagagatgctaagaggcacgtggtggcaatagtgaggttcttgttagaagaacctaccagggtggttccctagttcaaagctggtcccctagtcctctcagaaatgcattagcaggctgggcgtggtggctcacatctgtaatgccagcactttgggaggcagaggcaggcagatcacttgaggtcaggagttcgagaccagcctggccaacatggtgaaacccgtttctactaaaaatacaaaaattagccgggtgtggtggcacacacctgtaatcccagctattgaggaggcggatgcagatgaattgcttgaacccaggaggcagaggttgcagtgagtcaagattatgccactgtactccagcctgtgcagtgagtcaagattatgccactgtactccagcctgggcaacagagcgatactccgtct

SEQ ID NO: 20492 - DNA, 504 bp, Homo sapiens
aattgtaaactgaaaataattttttttctgtttataggaatggacacattttttccttgaattttcactttagtttgaataaatttgtgacaattgcagggttttttctaacagatatcagtgttacagtttttattcttgcagttggtatgttaaaatgtaatcatccacaattacattttaatttatcagcagtacaccctagtaagaagggtagaagatcattgtttagggatcacagactcacaaccagtaagctaaatggtaattgacattgggcttcagtgtttagaagacaacagggagtagtggacatcatggcaaataagaacaacaagtatgttagtggctgcctagcttcaagccattgttgcagtgctggtgtgcctagcatttttagaactccatttttttttttggaagccagaaatccagattgctagacaaaacctctctctacaggtatttgtaaacgttggcaagtcggtagctaccgttgacaac

SEQ ID NO: 20493 - DNA, 89 bp, Homo sapiens
tgtagcagtttggggagaattaacagctatactatgttgcatcttatagtccataatcatgggatatctctctcttagaacttctttga

SEQ ID NO: 20494 - DNA, 556 bp, Homo sapiens
gcagtgtagtgaggtattttcaaagagctcaaggaacgacatagagggtgaatggttacaggatatgtgacaaactagtcaggagtttgtgacaagagcacagagttcgttgtgataaggaaaagggggtatagtttgtggtgtggaacaaagttagtcaaaaacctcaaagttgagaactgatatttcatccactgttggtggaagtagctgacattccagttcccctaacaatgtagtgttggtgttaccaagcagagagctgatcttccatgcttcatctgacagaaaacaggcagtgtttttattcccctggaagacaaatactggtgatgctgaacaaagagctgatctactacctctctggcagaagcaaatggtactctgattcccctgccaggatagtgtcagcaaggtcaaatggtaagttgctccaccacattcatctggtagtgtgaggtagtgctagtaattgttatgatacactcacaccccatataaacctgacagcaatgagattgaatacagtagagcaagtcagggctagtcagcactc

SEQ ID NO: 20495 - DNA, 596 bp, Homo sapiens
tttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatcttttctgtaacacttaaag

SEQ ID NO: 20496 - DNA, 583 bp, Homo sapiens
cggctgcgagagacgacagagggacttattttatcagaatacattagtagtgcttaattgtctcattcaactataaaattttaacccatgttgggagttaatatctgggagtgatagaacccatctgataaagcactggagaggtgtggccagtgaaacaggaggggacccatcagggaagaggggcagcttggtcagtggaaagcacagggcgccacggcaaactgcccgccaaatccagacaaaggcttggcaagcaggaggggaaactcagataaagcccaggtgcatttcattcaaagcgtgggcagacgataacaatgacaaatgcagggcaggcggaccacacttgaaaatgtaaagcatgtaggccaggcatggtggctcacacctgtaatcccagcactttgggaggcagacgtgggtggatcacttaaagtcaggagtttgagaccagcctggccaacatggcgaaacctggtctttactaaaaatacaaaaattagccgggcatggtggtacacacctataatcccagctacttgggaggctgaggcaggagaatcacttgaagctgggaggc

SEQ ID NO: 20497 - DNA, 636 bp, Homo sapiens
actaccacctagacgcggagaccagtagtgcccgcgaatgcctggctgtgctgttatttactggatacaaagcaagagggcagggtaaggagtgtgagccatctccaatgataagtaagatcacacgagtcacgtgtccaccggacccgggggtgggggggtgtgccttccctgtttagtagccaaggcagagaaagagaggggacggcttatgtcattatttcttccacgcatttcaaagactttagtactttcactaattctgctactgctatctagaaggcagagccaggtgtacaaggcggaacatgaaagtggaccaggagcgtgaccgctgaaccacagcatcacagggaaacggttaggactccggatggctgagggtgagactgactgttgtcaggccttccacaagaggtggtgcagcagagtctttctctaatccctgggaagaactgcaaatatcctgccagggaaagtgtatcatggtattgtgtctaaaaatgaatgttgtctcagagcctcattcagaagggtagctatagctagggactcattcactcaataatgtgaggagcacacaggtctagaaattctcttatcctgcccaaaaaaaaaaaaaaaaaaaaaaaaaaa

SEQ ID NO: 20498 - DNA, 316 bp, Homo sapiens
gcctacaaggtgcctgcagttctggtatcaacctggctttctcacgcctctgtgcctttgatgctctgttctctatcaggcagagccatcccttcgagtaacttctatcttaatgtggagaacaggcactgaaactagtcattttaatataatacggcacatgataaaaagggatagacaaggtcccatgggagtccagacagatgctcagtgccatggagggtctaggaaggttttcagaaggcagtgcctgggtaatcctcagtgatgagtgaggcagggcaagtgggtgaaggcgggatgagcattcctgaca

SEQ ID NO: 20499 - DNA, 522 bp, Homo sapiens
ggcgcaatctcagctcactgcaacctctgcctcccgggttcaagtgatcctcccacctcagtctcccaagtatctgggattacaggcctgtgctactaggcctggctaatttttgtatttttagtagggatagggtttcgccatgttgcccaggctgatatcaaactcctgacctcaagcgatctacctgcctcggcctcctaaagtgtgggattacaggcgtgagccattgtgccccacctcagttcatctatttctctgtgatatttattctatagttgcagaagaatatttctcatatgatacgtatattaagcttactggccagccagtttgggtttctggatagtgaaactgtcctggaagtgtttgctgagcttttcttgctggagaagattcttggcaaagcctggatggaggatggagatgagaaaggtagtgtgagggtggcacacctgttttgtgctaattccagtcttggcagccctggacctgccgggagagggatgacagtgacatgtg

SEQ ID NO: 20500 - DNA, 560 bp, Homo sapiens
gtgatcacagcttactgcagcatcgaactcctgggatcaagtgatcctcccacctcagcctctccagtagctgggactacagtctcatgccaccacacctggataattttgtatttttaaaatttttgtagatacagggtctagctatgtttcccaggctggtctcgaacttctgtgcttaagccatcctcctaccttggcctctcaaagtgctgggattacaggtgtgagccatcatgactagcctaaatatactttatttttaccccagacctataaatgataactaacgaaaaattaaaccatgatatagaaacataatatttactctttgattaagctaatatactttaaattcacactgtgtttgtaaatgagtcttaatatatacctgtgatagttattattttcctctctgtggatagcactcagtagaaagagaaacgtggaaagtgctaccatgggaattctgaagcatcgctctactgagagccagattggggaagtggagtattccaaggggtgatagccattagcactcttcacaaacattctaattc

SEQ ID NO: 20501 - DNA, 484 bp, Homo sapiens
cttggggaacaactgaagactacagttcaggtttctgaacccaagggcaccactgctgtaaaccgcagcaatattcaggagagagacggctgtcagacaccaaataattgactcttaggtggttttattcattgttgagaaatatggtagattgggtttcatttaccgaatgagaattcttcattttcactttgtaatttttcttagtatatagtcagcccactgtatttgtgtgttccacatctgtggattcaaccaactgcagatcaaaaatattgaagaaaaaatcgcatctgtaccaaacatgtacagacttttttcttgttattattctctaaataatacagtatgacaactatttccacagcatttacattgtattgggtaatataagtaatctagtgatgatttaaactgtgcaggaggatgtgggtaggttatatgcaaatactgcaccattttttatcaggggcttgagcatctg

SEQ ID NO: 20502 - DNA, 509 bp, Homo sapiens
tgatgaaccatcattttcagcagaggagtgatacagtcaagtttgtatttttgatgagtcactggctttttagataatggatttgaaaacaaaaaaatttggagaccggaagatagattaggaagtggtatcaatcatataggcaataggccagacactgtggctcacgcctgtaatcccagcactgggagaagccaaggcgggtatattgcttgaacccagtttaagaccagcccgagcagcatggtgaagcactgtctctacaaaaaacacaaaaattagcctggcttggtggcacccgcctatagtcccagctacttaggaggccaaagtgggaggattgcttgagctcgggaggtagaggttgcagttacctgagatcatgctactgcgcttcagcctgggtgacagagtgagaccctgtctcaaataatgataggccgggtgcggtggcttacacctgtaatcccagcactttgggaggccgaggcgagtggatcaccaggtca

SEQ ID NO: 20503 - DNA, 470 bp, Homo sapiens
aggggttcctgttcattaccaccctaactcattagagcagcaccaggcccaggaggatgaagaaagagagctgtgcaaattaatgagtgaccaaattaaacatgttccctcagccagcaagaggttccagttgatcagctgaggactagggatttgaaagtgggaagtccctgccccatgggccagagaccctgaggcagccatctctcactgttccttaaggcagcccatcaggagcagggttgccaaatttagcaaaccaaaatacagggcacccaattacaatctgaatttcaatacttgtactgttagtacaagtatatcccatgcaatatttgggacatacttatacgaaaaattattcattgcttatctcacattcaaatttaactgagagatcacctgaggtcgggagttctagaccagcctgaccaacacagagaaactccatctctactaaaaatacaaaa

SEQ ID NO: 20504 - DNA, 121 bp, Homo sapiens
  misc_feature 1, 2: n = A,T,C or G
nnagcatgtagctaaaatgaagaagatggagatggagatggagcaggtgtttgagatgaaggtcaaagaaaaagttcaaaaactgaaggactctgaagctgagctccagcggcgccatgag

SEQ ID NO: 20505 - DNA, 518 bp, Homo sapiens
ttttgcagtatgtgcatgcattttctattcacaaaaatgaaattttttaaaaaagggggcagtacttagcacaatgcctagcagtggtggcggtggtggtgatagcctttctgcagctctgggcagatgattcactgcagaaatgcagcccagagatatctagaggctggccatagcctccagactgtcctcctagcctctcggtctcccttcttcattctatatgatccatgtttccccatcggagaatctttgcattttagagatgtaaaggggcttcagattttctagtgcaactgttttaacggtgaagaaactaagcccccaaaagatgccataaccagtccaaggttatcaacagggttcaatctagggcctcttttacaccatcctaagttttctaaaattctgctgtcattccatcactgctctgcccgtgaatcctcaacctggctattaagactagctgtggtctaggccaagcacagtggcttatgcctgtaaccccaacactctga

SEQ ID NO: 20506 - DNA, 573 bp, Homo sapiens
ttcttctctcagacattctttctggttctttaaaacaaaggccaaggaaagtaaacgctatcagcatgctggatcttagaccaacatggctctaagaagattatcaattttatcaagagagttttaatttcatgtcctgatgtcaagattggtaagagtccagaatgtggccattttccacaggtatggaaaggtagcctccatttctcaattacctaatggttctggtactggtctgtggcctgggggttggggacccctggtgtaagaggatgcccttattcttaggagatacatttcaaagtacttagggatgaagtattaaaattacctatccttggaaaaggaaatatttgtctagataccaattggtcaaagataactcgttcatttcaaagaagtaccaaaattggatagccacacatagaagaatgaaactctgtctctcaccgtacacaaaaattaacttaagatggattaaagacttaaatctaagacctgaaaccataacaattccagaagaaaatgtactctttggatactggcataggcaaagaatttatgactaagact

SEQ ID NO: 20507 - DNA, 115 bp, Homo sapiens
taaagcataaatctcacaggacctataacaccacacacacacacacacaaaaaaaggtactcagataacaactagcacaatgaatagaatagtacctcacatttcaatactaaca

SEQ ID NO: 20508 - DNA, 585 bp, Homo sapiens
cttaccatgggccagtcactcttttaaatgccacagcaaatttatgaagtaggatatattattatcctcatttgcacatgaggaaactgtgcacaaagacgttaaatggactgccaaaaatcctaaagctagtaagtgccagtaccagtattcaaacctaggcagtctagctcttaaccgctatactatatcttccattgaaatggacagctggttattttgactaaatatcctaagatatgtttggaagggaattaccatcactgacctcttaaatctcctttttctgtacttccaagctgatcaactctttttttgtgaaagactcaaattgttgtgttgtattacatgaatcgatatatgggataattgctaaacattatagacctgagagtcattctatctcttttagaaatctttttctttattccataatggataatgacaaattcaaaagctttaggaagtaggcagataacataagtgagggagatggcttggtataagacaatttgaaatggcgagaactgtggcaaaccactactcactcgtcacttggctccagctgctctgtgcaaatgtgga

SEQ ID NO: 20509 - DNA, 614 bp, Homo sapiens
gggatgggaggataggtggataaatttgggaaaagctaccttgggacaggtcagccaggtgtcatctcaaagcaggtctactgagctgaagtttcctgtgcaagtaactaccactttttagttgtgattagttggatactataagtatacattttagtttttattgtcaagaatggaattgctgtccaaattcaagtattaattaagtttgaaacaaatattttttttccatagaaatctgttactctgatatcatcatcagaaattcctgagacaaatggtggtggtggggacagaggatgactcagtattaaagctatggaggaattacctcattagcctatatatatactgcatcttggttatgagcttaatcctattgcttatactgtggtaagaagctaaaaccaaatgaagtgaaatacacacatacatacatacatacacacatacatacaaatacataaatctctaactttgtggaacttctaaagctggataagaacataggacataaactactaaagatgaaataaattctaaattaaatgttaacatgagagcagatttctagaggcaggagataccatgtagattgagctcatggagaaact

SEQ ID NO: 20510 - DNA, 503 bp, Homo sapiens
  misc_feature 155: n = A,T,C or G
taattacatggtgagtaccatatatttacgattatttatgttttctagattggagtacaggataattatttttggtcttattaagtgcaaattaccaagtagtcttcaggaacatgtaattactatgtactgtagtcacatgccacttaccaagnacaagcaaaatgatgcatatggttttatgaagcaaagcacagaggcctactttcctgccttgggagaggaaacagaagcagtccttcttaacatagggcatttcctcaattaactacatcaactctttgcaaagcttggttctcattaagaatacagatttctggctgggcgtggtggctcacacctgtaatcccagcactttgggaggcctaggtgggtgggtcacctgaggtcaggagttcgagaccagcctggctaacatggagaaaccccgtctctactaaaaatacaaaaattagctgggcgtggtggtaggtgcctgtaatcccagctccttgggaggctga

SEQ ID NO: 20511 - DNA, 442 bp, Homo sapiens
gctcagagagtgtttgcatctcatgacagtagcataatgcccatgtgcttaagcgtagccaaaaatatgacaaaaggcctctcagagattcctgtgaccccagcagaccatgagactggcagaattttgctcagagatgcaagagggggcctggaaaggaagagaaaaagaaaaaaccaccagtcctgaaccgttttgccaggcaggatccagaagcagcccgtgtggactagtgggtgaagaccaggacaccagacatctcagaggttcccattcaggctgtgaccttgacacttgatgtccttgcctgaagccttggctctgcgtgagacccggtgctttgacatatcctgttttgggtgactgttgccccactttccctctcccttacacattttcaatgtttattttccaactttctgtacacctccccaggctgaga

SEQ ID NO: 20512 - DNA, 554 bp, Homo sapiens
ccattaattgagcatgtgtatgctaagcactaggcaaacactatcttatttaatttagacctgcgaagtcagtaatgttctctagactatatgggtagtgggattttatttatttaatttttaaattttatttttccataagttattggggtacaggtggtattcggttacatgggtaagttcttcagtggagatttgtgagagcctggtgcatccatcacctgagcagtatacattgcatcatatttgttctcttttatccctcaccccctctcactcttcccaactagcccccaaagtccattgtatcattcttatgcctttgcatccatttgcttctgccagtggccttcagtcactaccagtctaggatcatttgtgtttaagaattagttggaggaatcacatcacctaacttcaaaatatattacaaggtgatagtagccaaaatggcatgatattaatataaaaatagaaacatagaccaatggaacagaatgaaggacccagatataaattcacatatttacagccaactgatctttgacaaagga

SEQ ID NO: 20513 - DNA, 563 bp, Homo sapiens
caaatacctggagtacactgcctcactatccttagtcatgctagctttctcttccctgcagtatagatctgccaattcaaatctgtatggcaccagggctggcaaacgcagaatgattcaattagtaatatggtattgttaaattattataaagcgggccaggcacggtggctcacgcctataatcccagcactttgggaggccgaggcaggcggatcacttaaggtcaggagttcgagaccaacctggccaacagggcgaaacctcatctcttctaaaaatacaaaaagtagccaggcgtgctggcggatgcctgtaatcctagctactcaggagggtgagacagaaggatcgcttgaacctgggagacggaggtggcagtgagccaagatcataccactgcactccagcctggggaacagagcaagactctgtctcaaaaaaaaataaaattataaagtgaatgaatgactatgggatgcaatgaccgactttacggtgaatagaaaattcaaaacggctctgaaatcaactccaaagaatgttgagatcagtgctgaaat

SEQ ID NO: 20514 - DNA, 589 bp, Homo sapiens
cggctgcgagagaaacagaagggaagttgagtaatgttaacactaaagtaattctgttctggaactgtaaaccaaagcttaaaagtaggaataaagctgtttctgtgtaacttacagaattacctacagctaacatacttgctaatgaatgactaaatgcttcatctcaaaaaagaaaaaaaggagtaaggcaatgacatctattttcacccatttctgttatcattgtacaggaggtactagtcaaaatagtaaggcaagaaaacaaaataaaaggtattcaggttggaagagaagaagtaaaactgtctttattcacagaggccatattcaccaatctagaaaatctgatgagaattacaataaaactattggaactattaagcaaaattaccaaggttgcaggatacaagattgatatacaaaaatcagccatatttctatatgctgaaaacgagcaatcagagattcaaatttaaaaaaatcaattgaaatagcatacaaatatacagtacttagggataaatctgacaaaatatatgcaaaccctatagtctgaaaactataaaacattgcaggaatataaatc

SEQ ID NO: 20515 - DNA, 596 bp, Homo sapiens
tagcttttgcgaacagctctctctctccatgaacagaagcaaaaaatgactttttaaaacacaatcaacataactacttccagcggtgatggcataagagagaccagatttatgctcctaccttaaacaactaaaaatctagggaaaatgggaaagaatggttttctgacactggacaacaggtagtatagcattgtaatctccaaaaaaggggaaacaaataagatgattcccgtgattgccttgattactgacttgagagagttcccaggccacagagtaggaggggaaacacaggtagagcccggtagactctttgaaataagaagataaagttgggagttgggaagaacaaggcagatagagttgaaagattagtactgaataagagagtactgcagacagaatatgattaagacatcagttcttcttcaagcaaatccatagattcaatgtgattcaagttaaaaaaacattaacctaattctaaaaatttatatcgaaaggcaaaggaactaaaatagccaaattacttttgaaaaggaacaacattggagtatgtcaagacttgctattaagctacaattatcaagaca

SEQ ID NO: 20516 - DNA, 585 bp, Homo sapiens
gttgccgtgagccgagatcatgccattgcactccagcctgggcaaaaagagcaaaactccatctcaagcaaaacaaaaaaagcccagcgagttagggacagaatccagttattaaataacataattaaacctattttatacggagcacttattatgtactaagtgctttaccagatttgatggtcacaattctaggggtgggtgatgttatcacctccatttcaggaaggaaggaggctcagaggaagtcacaggtcaaggttccggagtgggtaactaaacccagtccttgctagccctgtatctctatcacctactcccatgcatacaggtccacaagcatgcctgtgcacacgtgcaatcaatattgcactaacatctccaaacactctagttgaaatacccagagctcccgccttatatcttttctcttcctcaagaaggctaacccagcctccaatcccctaaaccttcatgagccagggaaggaaccctcttctttccctctaacacctcagttccgccacgcggccggccgaggtcggcgctgtaaaatgctcctgctcctctaagagaatgaacagt

SEQ ID NO: 20517 - DNA, 109 bp, Homo sapiens
tttaagggatatatttttaaaacagaaagggaaaaattgtaagtgtaaattgcttcccatataatctcttgagttcatatttaataaagataagttaataaacaattat

SEQ ID NO: 20518 - DNA, 546 bp, Homo sapiens
atgggagataatgtggaacatgatctaacatttctcattatgtcaaattcagcacaaccaaacataaactcaagccagcaaaaatatggaattacatcttcattattttccggaaatgcattttggagagactgctcaaccagtatgagacaatgtacactgaatcctaaattaaactcatattctggaaaattgaagccaatggctcagtgtgctcagtgaaatggtgaagcacacaaaggcacacttctggggtgctagagcatttcaaaagtgggacattcatcattacttgcttaagcaatatttacaaatgcagatggccttctttttataaaaatagattactcagccacttatggattattatttgaggtgctataaactgtctatatgtccctgatatcgatcccacactcctctgtcaccatgccacatttctaggaattttcaccattttagatgactctactgttccttccctgggtaactgtgtcactcaataatagtagcatatcagccattaaaggaaattaaggcatagca

SEQ ID NO: 20519 - DNA, 629 bp, Homo sapiens
cctttctattggttaataacttttttcaaccaattgccaatcagaaaatttttaaatctacctataaactggaagcccctgtttcaagttgccacacttttctgaaccagagcaatgtatatcttaaatgtatttgactgaaatctcctgtctccctaaaatgtataaaaccaagctgtgccctgaccaccttaggcacatgttctcagactctcctgaaggctatgccatgggccaaggtcactcatagctggctcagaataaatctcttcaaatattttacagagtttaaatctttgtcgacagttgcataaaagttacttagttccacctaggtccttcaccacaatatccattatgaaacaaaagtcttaaactattgggcaaaaaagaacgcataatttttttttgttagaacacagctgaagactcattgtagcttgtggaaagcaacaacaacaaaacttctctacttgtggaggagaaacagagttacactcagaccctgaccgttagaggtcttctgtagaatcactacggaggctcaaaccatgagattcaaggacacaaggctgcctaatactgaggcagaatgacaatagtaagaattccgtaccttttatgcaaca

SEQ ID NO: 20520 - DNA, 258 bp, Homo sapiens
ctttccttgataatagagcacttgatgctgttgccttagtgactgagaaatgctgcctcatgctggctcatgcaggccattggcaggctgcaggctgtgggtagtgctgccctgcagggtgttagcatcatctggcaattgcttttatttggggcagccagtcagttcttcacattctgggcctctggctcatagtgtgtttgatgacaaccctgagaggacatctctggttgctgtagtcaccaaagatgccacttc

SEQ ID NO: 20521 - DNA, 527 bp, Homo sapiens
tgctgcagagtcagtgaccctgaatgactgttcattgttccatctcgctctgagcagttcttacctccccttccttccttccctctccatgtcctcccctcaccttccaacttttatagagtgttttctttctcaagtgtatggtgctttttatggccccctcatctggcctgccactctttgccttccccacaccctgtctcatgccgagtcttacttcaaacctccccttgcatctcatgaccttagctgtggttcctcactcccaccccctgcacacacactgcagagatgacctgccttgtgctgtcaaacggccctgtgctcctcccctttctagggcttggatctcttcctcactgggaaacagcagcgaagacaaagtctttcttcaccttgcaatttccagcatctcccaccaggctgggcaattcagggtaattattcaatgggtgagtggatttcttttcaccttttctttggttttccttctgcctcctttccatccctcccacctaacatactct

SEQ ID NO: 20522 - DNA, 490 bp, Homo sapiens
ctctgtacaatcttcataaattgacaaaaatgcacagtatatctcaccacctaacacaggcctaaacaatgtgacatacggtatagtaccagtaggtacttaggactatggagaaacaatggaagacattaattctgcttgtcttgatggtaagggtggggatgaaaatacagatcgaatttgggggagcatgttaaggttaggggaatagagatagcttatatttagaacaagttagtagagactgtatgattttccaaatagagaagggtaaaaagacattccatagaggaagaaaattacatgcaaaaccatagagaccttagtttataaagagtaactgggtatggccgggtgcggtggctcacgcctgtaatcccggcactttgagaggctgaggagggttgatcatgaggtcaggagatcgagaccatcctggctaacacggtgaaacccgtctctactaaaaatacaaaaaattagcttgggt

SEQ ID NO: 20523 - DNA, 419 bp, Homo sapiens
aatcccagtgctttgggaggctgaggtgagagaatcactcgagtccaggacttcgagaccatcctgggcaacacagacatcatctctaccaaaatatacttagctgggcatgacatatcatgcccaactaattattaataacatcccagctacttgggaagctgaagtggaaggattgctggagtccaggaggttgagtgagctatgactgcaccactgcactcgagtctaggcaacagaggaagacctcgtttccaaaacgaaacaaaaacaaaaaaacaaatacctttataacatttccacaaatgataacagtagacataaagcaactgataaaactaattgaactagagaactagacagaactagttagcacagatagaactagaacactgtcaattaccttgatctaattgata

SEQ ID NO: 20524 - DNA, 480 bp, Homo sapiens
aaagcgctgggattacaggtgtgagccacctcgcccggccagtccctactttcaaacctggttttcccatgctgtaactcgttaatccatgtgtctgagaaaatagcagttcctctcctctctgaggctaagctctctgctacccgggcatggcgcgtgaatcccttctgcttcatttgccacagccactgcctcctatgctaactgtgagagccctcttttctgaatattctattgtttcctctcctttagctccctccttggagctgacaaacatgtccatgtctccttaaacctaaaatcatctacatgcccgtactgtcccatctcaagatactactctgtctcctttctatgttgggaagtttcttgagcaaggaattcctttctcttttcgtccttgggtcatttaatgcacttatgtggctttgaccaacattgaaatctcagttgtgacctctccctgtcatctgctcctga

SEQ ID NO: 20525 - DNA, 542 bp, Homo sapiens
catcagtgaacagaatacatctagtgctgcatgagggagcttcttttttagtgaaggaggacattagacacagatgtataaatgagtcattgaacaagataattgcaggcagagatggattctatgaaagaaataaatcagggtgatgagagggaaagtgacagagagacagctttaggttggaggctaaagtgaggcctttgaagaaatgataattcatgtgtgacttgaatgacaagataaaatgtagagagttagaggctgaggattacaggccaaggaaatagccctgtgcatatgttgtgagacatagctccaagacatagacatgcatagtttaattcaacttgactcttccagaaatgaattgaaggtcgctaggcctggagtgtcaggaagcagaggagaagttgtgagagaagagtttgaagtgagatgcctgtgtcatttaatgaagcaaatcacatgaaaaatatcactggcattttttattatacgacttatttaaaaatagcaataaaatttacttcctactttatcct

SEQ ID NO: 20526 - DNA, 605 bp, Homo sapiens
tgtcataatgctctcctttcccttgcccccaacccctggatagaacctggtgtgtgatgttcccctccctgtgtctacgtgttctcattgttcagctcccacttatgagtgagaacatgaggtacaaactgcagatatttatacattactttaaagtaattaagttaaactaaactaaatgtaagccaactacatgtaaataaataaaaccaataattaataacaagataaaaataattaatacttaaataattactaatttatttctcagctaaaaattaaaaatttagaaaatgtggaaatgtgtttcataataggaggatatttaaaatgaaagggcatttctgtagtcaaaggggtaggagactcacccaaacaagacacaacctcaaaaccaaaaggaaaactatcaggtttgattatacgaatactgaaaacctctgaatacatgaaaggcaaattctatatcccatgaaactacccttcagaaatgaagagagaaataaagacattctcagaggaagagaatataggaatttgtcactggtcaatttagaaatgctaaaaagtggctacggaaatatgttctgtcttttccacaatac

SEQ ID NO: 20527 - DNA, 567 bp, Homo sapiens
agaacactgaacattaaagagtgaagataaaattcagtttactactgtcttgtccatacaaccacagaatgctagctatgattgaaagatcttgtatctgcgagaatcaatatttatgagacctaacaattgtcttagatagatggacttaatgaactgcatgcagtaacttaaattgaccaaatattttgatagatttgtcggagtccaaaatcaagtaaaataatgtcatagagttttatattaacttgtaaaatggattagtttcaatccttttatgacattgcattaaaaaataataacccatactcatctaaaatttctgttcatctgatcacagtgagcctcatcccctaccacactcttccatctctgtgtgctgttctagaagggaattctctctgtgattttcacttggcaggaagtcataattaagataattagtcttatctaatttttatttgacttcaaatacttatttttcccttcaaactcttaaaataattgcagtattgaactccatctgaaagaattattgggaaggtcatgcagtgtctcgatttgtca

SEQ ID NO: 20528 - DNA, 641 bp, Homo sapiens
gtctcatttcaccaaggaatcacactgaacacttccgtgtggtcacagagctcaggcagacttcctcagcaagtaagtacccttcataaagcagtaaatgatattggcctagaagcatgaaaaatgaaatgcaaggttctaactgaccagggcaccaatgaagcttgctaacagagtgtctgggcccacagttaccctgttcactgggcagactctgcttcttctgtgttcccactctgggccccaccccactggagaatcctaatgcctggatgtgcctgcagagaacacagccagctgtcagtgctgtcatggctcaggacctcgccaggctgctcgactctctcactctccagggaggctgaagccacgcctgaaagatgggcctgctggaaacctactcgcctgaaaaccacggccagctatgggcctggaagtgactctggagaaagaatactccctaacggctaggcgtggtagctcacgcctgtaatcccagcactttgggaggctgaggcaggcggatcatgaggtcaggagatcgagaccatccttgctagcacagtgaaatcctgtctctactaaaaatacaaaaaattagccagcatggtggcgggcacctgtagtcccagctatgtggg

SEQ ID NO: 20529 - DNA, 556 bp, Homo sapiens
tacttgtagggcttccaatccagggcagtgtggacctttgtgggatcctccatctgctttggggcttgatgtactctaagaattttgcaaacttaaggtaaagacatatcttaagttttcctggctttgcaagtaatctttgcttgaagatgggccagctagaaatggatggtaggttcaatggggtctcaggggaaagtggactatggtctaattaatgactgtcaaatatttttactctgacccacagcccaaaatacattctgcatggtgacctagcatatatacacatacacacacacacctgaaacaaaagttttattaggcagtacctatacttaacatatgtgatgcattctggtcttttattttctattttattctatttcattaagttgatttcatgatatgctaatggattgcaacatgtattttgagaaacattggtctaatagatgacaacttgtccttgaaggtgattgaggaagatgttgtccatgaataatgaaattcagatgagcagtgccaaaagctgagcaacctgactgtgtacttt

SEQ ID NO: 20530 - DNA, 593 bp, Homo sapiens
taggcaatgcatctccttgagaatgaaaacttagcctttaagaagcatcttgttataaattactctgttaggtcaagtcctggacattttcattcttagtacataaatataaaggacaaaactgttagcatgcaattgtcctttcctttttccgggattcccatgctgtgagtacaatgcaataaaatattaagaaattaacatattaataaactaagccataagaaatgctatgtgaattagaataatagtctactcaaaagaaaattttgtcttcgacagtgatagagaccatattaagacagtttgtggtatacgtatgcattacaaaagaaaattgacttttaaacttaactgctgcagtaaagaaaatgtcttggctgggcctggtgcctcacgcctataatcccagcactttgggagggtgaggcaggtggatcacttaagctcaggagttctagagcagcctggccaacacggtgaaaccctggctctactaaaaatacaaaaattagccgggcattgaggcccgcacctgtaattgcagctactcgggaggctgaggcacaagaatcgcttgaacccaaaaggca

SEQ ID NO: 20531 - DNA, 547 bp, Homo sapiens
aagctctccctctgggatgatgagggacagcacacactaaggacatctggagaaggaggtttcaattctgaagacctttgtctactgcagaattcatggtccacagttacaaaaattagctcctggttgtagctactaactccacaatagaaaagctcttcctgcagatgcctaaaagtgttttctctttcctcctgggcttccaacagatcaactcaaatgtctaaaccagtcctggaggagtgggtggctttttttattttaaatttccctaaattctcttgagtaggttcttctcctctctaaatttagtatccagcaataaagatccatcatagggaaaaccttggcttgtaacttaaaatggtttaaaatttctgatatataatttctactactggcaatttgaatacttatcttatttaatgtgcacaaaagaagaaattgtttttttttcagatgaggaatctaagtcttagtgaatttaagtaaatttcctaaggccaaatagctctcagcagaagctcagtgattcaattgaatatct

SEQ ID NO: 20532 - DNA, 102 bp, Homo sapiens
cagatcctcatctctgctgtagaggagatagagcctgcactcagggctctcttcctaggtatcacagcatgttgtgaactagaagagagccaaagagtcagt

SEQ ID NO: 20533 - DNA, 545 bp, Homo sapiens
aaagcttatctagtccaggattggcaaactacctcctgcctcctattttcgtctaactcacagataagaatgatttgtaatcactgaattgttgttgaaaaaaaaaccaaaaagataataataatattttgtgatgcatgaaaattatatagaattcaaatttcaatgtttataaataaacttccattggaacacagccacattcattcatttacatattcatctaggctgcttttacagtaaaacagcagagctgaggaggtaagacagaggccatatggcccaaagcctaatgtatttactccttattcctttaagaaagagtctgctgatccctgacttggtccaaaggtattattgtgcaaatgagaaaaccgaagcccagggacagggaataaacatggaaatcaggcaggctttgtgacctcagcaaattgaattatatcttcgagccttattatcctcatttgtaaaatcctaaaacctacctcaaatcccagcactttgggaggctgaggaaggcagatcacaaggtcaggagttca

SEQ ID NO: 20534 - DNA, 566 bp, Homo sapiens
cagggatgattccctcttacaacattttgttttgttcattttgcttttccaagaggtagaaactgaatttacatctaaattcttggtaagaaaaattcctgaataagatttgagggtgtcaggtcttagaacagagatgctcatctcaggcaaaatggatcctaagggggagcaagccacactagacattcaacaaaaagcagcatcatgaacattttcaacagctcattgttaatgttcctcataaaaaggacaggttcacttgcactgaggattcttttagggtaagagccattgaatagcccttcttggggccaggcgcggtggctcacacctgtaatcccagcactttgggaggctgaggcaggcagatcacttgaggccaggagttcgagaccagcctggccaacaaagtgaaaccccatccctactaaaaatacaaaaattagccaggaaccggtggtgaacgcctgtaatcccagctactcgggaggctgaggcaggagaatagcttgaacccaggaagcagaggttccagtgagctgagatcacaccactgcacgcca

SEQ ID NO: 20535 - DNA, 599 bp, Homo sapiens
gtttggggccccttgatcttttattaaagtcccctctgtcagcactgtgtgtagttttacagactggattttttttttttaatgcagtggtgatttgccacatgatctcacagagaaacatggctttggagtgacagaaactgggtttgactcctgtttctttcactcactatatccttgagaaagttgtttaactgttctgaggctcagaatccatatcagtaaaaaaggtttgatactcacttaaaagcattttcaggattaagcacagtgcctaacaggtagcagtaactcccttttctaaaatgatttagattttctcaacaaatttgcctattgaagcaaagatagaagacgctaatgcatttgcaggtatcacaaaagtttcctcacccttccaggttctccccattcaaatctgtccaatgaaatgttcatgatacaacacattcatcttctactcagatgctcaatgttctttccttgcctaagtcagtgattctgaaccataaatgcacattaaaattgcctgagaagcatttaaaaaatcgtttactggaccccatcccagattaaatgaatcataacctctggcatta

SEQ ID NO: 20536 - DNA, 405 bp, Homo sapiens
gctgtagcccatgtacacacactgcggtcttttctttgaggttaccagaaatcgtcaattctagtggtttgaacattgaaagtcacaacaggaagtatctttatcttggcacagggggtgaggagatttctatgaagagaaaaaggaatatctttttaattgtttatgactggatatctgaaaacagtaagcatcagctagtactgagtttagagtaaaaaggggatttggtatcttggcagtgacaagctcaggtgctgtacattaaagtatttagccaagtcctacttgcccaagtatggaatttccacaatgtttcattatcttggaagtccaatacttaagaacaaatttaaccaagaaggtgaaagatctatacactgaaaactataatacactgataca

SEQ ID NO: 20537 - DNA, 543 bp, Homo sapiens
gtgtttgggcaagcaatacagaaataaacaaaagtgcaaaattatagtaactgttaaaatttgatggctttatctataactctactttcttatgataatagaaagtgaggaaaagctagtcaggtagactctgcagttagccagagttcaaaatctagctgtctcttacaatctctgtcaccctgaacaagtttttaaagctctctatgtctcaattccttaaatataaaaagtaagaataataatagtgctttgagcagtacctcagtaaatgctagccattattattgctttatccttataatggccatctacttcaagtactgggtctaggccgggtgcagtggctcatgcctgtaatcccagcactttgggaggccgagacaggcagattgcctgagctcaggagtttgagagcagactgtgcaacatggcaaaaccctgtctctacaaaaaatacaaaagttagccaggtgtgtttgcttgcacctgtagtcccagctacttggggaggctgaggtgggaggattgcttgagcccggg

SEQ ID NO: 20538 - DNA, 568 bp, Homo sapiens
cagctgtgttttactcagtagcttaggaaataatcacttttccatgccaacagatgtttttattcaaatatttaactggttcatcagtttctccacctgaaaaatagtgatgataataatattcgcaatggacctatagcgacagggttggaagtaacattagagatgatctctgccaacccactcactgtagagatgaggatattgaggcccagtgttctgggtgggaccaggaccagcccccaatgctgctaaatcccagtgtgccactgagaattccagaaggagaggtgagacccttattaccaagacatggttatttgtaacagtcaagctataacctaatgtttctacatttaaaaaaatttttggagatagggtcctgctacgttgcctaggccagtcttgaactcctggctcaagtcatcctcttgccccaacctcccacatagctgggattacaggcatgtgccactatgaccagctaaaattctttttttttgagactgagtctcactctgtcacccaggctggagtccaatggcacaatctcggctcactgaaacct

SEQ ID NO: 20539 - DNA, 120 bp, Homo sapiens
aaggcatcaacataaaaaaagagatatcatatttagatgcaaattattaattatggaagggaaaaatccaaactagtctgttgtggtagacacgtgccatgagatatatgactaatttga

SEQ ID NO: 20540 - DNA, 615 bp, Homo sapiens
tgggattagaggcgtgtgccaccatgcctggctaatttttgcatttttagtagagacaggatttcatcatgtttgctaggctggtctcaaactcctgccctcaggtgatccatctaccatggcctcccagagtgttgggattacaggtgtgagacaccgcacctggataacagtctgttgttgatcaccagtttttatataatttttcttttgaacacaagtatattataaaaatacttgaaaggagtattcaaaaattgattttgaataccgggttaaagattcaggtatggtcgttttcctacttcgaaatgcaaaggaggtaaactcacagaagaaaacgatgtccacagaacaccaagagattggggattgtggcatatctctgggtgaaaggaagcagatgggaggatgtttactgacgaaatagtatgagaagttgtagttaaaaacacaaattaggccgggcgcggtggctcacgcctgtaatcccagtactttgggaggccgagtcgggcggatcacgaggtcagcagatcgagaccatcctggctaacactgtgaaacccctccggctaactcagtgaaaccccgtctctactaaaaatacaaaaa

SEQ ID NO: 20541 - DNA, 548 bp, Homo sapiens
aaaatgaaatctctcagaacctgatggtatttggatagcatatacccaccagaggaacaggcttttatctagcataccacaggtctcccctttagcacatctgtgctcattttgaaactgtatagggaaggacattagatggctgggagaactctgaaggacagacctggatctcctgccatcttccaaaggtgaaacaacaaaaatccgccaggctttcagtcagaagcccggaagggccactcccaaggaacagaggcaagagcagaagtagatggagtcttactgaaactgaaacccagctcaattcctaataggttgaagatatgattacctcaatgcagtctgcttatcagaaaggcatatcatatcatccggatgttttatatacaatgtttggcatacaacaaaagactgttagatatggaaggaagcaagaaaatgtgaccaaatcaagagaaaacaaaaccaaagaaagaatatccagataattgagttagcaaatgagaaccttaaaataactgattaacaagtttaagatgataaaa

SEQ ID NO: 20542 - DNA, 136 bp, Homo sapiens
cagtcattctaggtgtgaatctgattgctctaataatgcaccacagtgactggtttagggaagcaggttgaagccaaatagtacaaaaccttcccttggccagtagagattttgaccctgaggacttctgaacaag

SEQ ID NO: 20543 - DNA, 558 bp, Homo sapiens
aggtttcagtgagccgagatcacgccactgcactccatccagcctgggcgacagagcaagattccatctcaaaaaagtaaaaataaaaataataaaataaatagaatgcacacctaaaatgttgatgcataattccagctctctctcttgaccttccctagttgggaaaaactgtactgatttaacacccttaaaagcagaatggatgtgatggctcacaactgtaatcccagcagtttgggaggccaagatgggaggatcacttaagcccgggagttcaagaccagcctgggcaacgtagcaagacccagtctctacaaaaaaaaaattaaaaattagccaggtgtgctggcacacccctatagtcccagttacttgggaggctgaggcaggaggatcacttgagcccaggaggttgaggatgcagtgagccataatcacaccactgcactccagaccaggcgacagagtaatttaaaattttgatgcacagttctaacttattctttctattcccccaaggggagaaaactctactgatttaacacccttaaaagc

SEQ ID NO: 20544 - DNA, 636 bp, Homo sapiens
accctatctactaacccatagtttggtttttcatgaaatcatgaatgtctacttagaaaatataagagaaaacctcattcattagaaaattatacccaaaatgcaactaagaagacatacatagaaagtaggaagtttctatgaagagagtaccaaatgtgattaaaatatacttaaaaatgaatagagagatatgtcaaaaatttgaatatgacccagttatgagaaaatgtcaagttctaaccaaataaattaaaagtcttactgcagttgtaactaaactcctaatgtaattttattttataatttaataaaataactaatcaaggtaattttaaaatgactatttatggggacaaatagccctatggaatatttaaatgtgaaaaagattatataaccattaaactctgtggtattgttcaaggttgagatagctagaaaacagaaatatcagtagatagcaacagcaatcagaaataaaattgaaaagatatctcttacaatataattttgaaacatcaaatccacaaaatgaatctagcaagaaggtgtctgataatactacccagaagaccacataatattgttgaagcaaattaaagaagatgtaaatcaatagaggggggcatacct

SEQ ID NO: 20545 - DNA, 597 bp, Homo sapiens
tactcacatgcagccgcgaaacctactcaggtcgttgtttggcttctcgcattcgatcacgctggtgaacgtcaaaggattgaattcggagacctaaaataacagcacgtagacattagagaaatccgggctcaggctgcgccgttctaaaaggcactcgcttttctgtcttgcatccgcggcaggcacatttcacgggggaagaactctgcctatgaatctctctggaaagccaaagcaccgccttctccactgtataataaataacagttaatcattttataacgagtgacaattgggggaccggtactggttactggttagtaagtgagcagaaatgactgcagctctattgcaaaatgagagaacaggcgataaagcaaaggaggccatcaatgaagcaaagggatgaatgagttttttaagacacacggcacttgcccatttctacagacttagggaagcaaattccacctggaaaacaggagcttataataaattctattttttcaacgtacactacatgatcttcatggatctttgatgaaaaagatttacatagccaatgagtgagccaacaacttctttagtattctg

SEQ ID NO: 20546 - DNA, 621 bp, Homo sapiens
agagagaggaggaggcaagataatgaaaaggtaagccacagactgggaggaagtatttacgatacacatatctgacaaatgacttgaatccaggaggctggccagagaaggaaagcagaccaaggagaaagaagtctcatataatacagccagtttatactctctccagaaagtatatggcataaagcattagaaagaactcattttcaaggctgggtgcagtggctcatattcccacccatattcccaacactttgggaggccgaggcaggagaattgcttaagaacaggagttgaagaccagcctggacaacataggaagaccctgtccacaaacaaatttaaaattaggccaggttggtggctcatgcctgtaatcctagaactctgcgaggctgagatggaagaattgcctgagcccaggagttcaagaccagcctgggcaacacagggagattagctgggcatggaggcttgtacctgtagtctcagctatttgggaggctgatgtggaaggatcgtatgagcccaggaggtcgaggctgcagtgagccatgatcacaccagtgcattccagcctgggcgacagagcaagaccctgtctcaaaaaaaaaaaaaaaa

SEQ ID NO: 20547 - DNA, 443 bp, Homo sapiens
tggcccatcttttaccacaaggcacctcccgagtagctggggttacaggcgtctgccaccacgcccagctaattttttgtatttttagtagagacaaggtttcaccagattggtcaggctggtctcaaactcctcgcctcaggttatccacctgcctcagcctcccaaagtgctgggattataggcgtcaaagtgacttttaataataaattttaaaatcaacaataacagcgctaatgaaatgcttcctctgtgccaggctctgtgccaagccctctatgtgtattgtcttattccatcctcataaccactctatgagggaggtatcattattagttaagttacttattcatggttgcacagtggagagctagaattaaaactcattaaaagtcagctatgggctgggcaccatgggtggatcacgaggtcaggagatcgag

SEQ ID NO: 20548 - DNA, 486 bp, Homo sapiens
ccctaaggctgcttagagcataaatttaaatggagtatgaccacagtgcaaatatgtgccactgaaagctctctatatgaacgcatcatttgaagattaatgttgatagagaattgttttatttaaatagaagctttttcattagaaagcaaagatataggcagcaaactctaggattgatttcccagagtggcaattgtttgtttttccttcaaagctattgtcagttgcaatctgtacagatttttgtgttaacttttagagattatattagatggcatatttttgctggaaatgtcaaataattctaccgaatatatcatatttaaggcagaattggatttgttagcagtataagatataatctgagactggttaagaaatctaatctagaaataaaagaaaaagaacagagaaagaaagaaacaaacagaaatgcctgaaatgcctaaaatgaaaatttcatggaatgggattaactgcagt

SEQ ID NO: 20549 - DNA, 561 bp, Homo sapiens
ggagtgcaggaggccagatcccagggaggtggcagtgctttgcttcgtaggtgcccatttggcttaagatcctaaggtctctgttgccagaagggtcgggcggaggcccgttaaaatcagagcaggaggatcatctgcttttttcttttttctaaaagcagtcggagtaaaccaatctgagacaagaggcttttgtttgtgataattggtttctcctgcaaacaagttggcatgcaacattagctgtttgcaattctaatgaccttttggttgagtacagacaaaattgccaaatggctctaaaataactatgtattctgacctcttcatcaattctctcctgggcaatatttccataagaaaatgggaagaatggtgctcatgcctaggagacctttttatttctccaagttatttgctctcactgtaccttgcaaaggcaaggccctgttttactgacttcaccttcctgtcttcaattttcacatcagatctaagggatacctggttcacacatgttaaaatcccagctcatttttcacgtcagtttattgacatcag

SEQ ID NO: 20550 - DNA, 523 bp, Homo sapiens
taccagggcacttcccagcctttggagagacggggatctctctccactttggtgtggatgcagaagcacagagactagagttgaggcagaaacaagtaagaggctctcccagcccagggcctgtttgggaaggaggaagctgagctgccagggccatcttccaggcccagtacaggcggcacctcccttcctgattgctgccaacatagactctctctgcagttccactctctgatcccatcctgcacaactggatgcacttttggaccacgcactgggacaaaactgaatttaaaaatttaaattaggccaggcgcagtggctcatgcctgtcatcccagcactttgggaggctgaggtgggcagatcacctgaggttgggagtttgagaccagcctggccaacccagagaagccccatctctactaaaaatacaaaattagctgggcttggtggtgcatgactgtaatcccagctactcaggaggctgaggcaggagaattgcttcaacccggtaggtgga

SEQ ID NO: 20551 - DNA, 650 bp, Homo sapiens
gggaggaggtattacaaggtgtgtccaagctctcactccatcttggccaggaactcatttttaagctttctctggggtccccttggctgagaggggagtctagtcattggggggaacaggattttttccttctcagaacctaactgaattacacattatgacataacctcagtgaagtgactgtggtgataaggaagctaactaactttggaaatcagtgaaatgactgaaaactgtatggatgataaaggaactgtacatcgacagtgtactctatcaacatggcttttcatggtagcgaggagcaggtaacaattctgcaactgctttgcatatatactaggtttaaattagtaagtaatggagcctggctctcactgtcaggagtagagttacagatagaacaagaagggaaagacagaatgaaccctgacctatggtactggattaaagacaaagacatcactatgaactcatgtttagtttaatacacatatacagaaaaagtacagaaacaattagagatatgcatgaatacatgggtaagtacatagtgtatatgcattctattacagatacatacattaccctagctctatcctctgagagaaagccatgacactcagcagcaaagagcactcccagagtct

SEQ ID NO: 20552 - DNA, 413 bp, Homo sapiens
ataacattttaaagtactaaattcatattagtatattatcaaatggatatattatcaaatgggtttaagcatcctacacattttaattcaattgattcattttctttttgctttggatttctatcatgatttaaatatttacatatgggttactttttagatttttcatactatgaaatataagaaaaacctttaaggctagttttatgaccaagacgaaggacttcattgaatacacaaaacaataaatatactgcaacattttgtctttccttttgtagctgcaatttggtttgcttatactttctctttgtctctttgaaaactgagtcagtttcactttctcaggacaggatttaataaccataatataatttagtataattccttgatttaggcaaattatgcaattt

SEQ ID NO: 20553 - DNA, 569 bp, Homo sapiens
ggagtacagatgagggtcttttgaaaaatggcagtagtgaaagcaacatttctggttttcttcttggaaggaggagaaaggatagcttattctgaaattaagcaacaacaacaaactgttatgtaaatggagataaaactgttgttgaaaaatattggcttatattctagataaatacatacgcccacataatcccatacagggcaaataagtatgtgtgtctctgtgtgtgtgatgtgtgcatgcatgcatgcatgcttggtagactttatctgctcactgaatactttttccaacccaatgtatggaaagtgacagatggatcagcaatggctgagaagcagttacacatatctggccagcatggttttgattgtatgttgggttgtcagccagctacacaccagaactattattttaggcggctggaagagaattattcaatgtcaatgggaagagagagatacagaaaatgaaatagacactctgtgttttcaataaggcatcagtttgtttgaagccacatctaactgtctgaattcatatgagaacttactaaaagcaatgca

SEQ ID NO: 20554 - DNA, 300 bp, Homo sapiens
ataatactgcggactcttaatcatttgttagatactattagctcatatttcactgataaaaactatataatcacactactacgtatttggttgaataaacattttgcattatgactgtttattatagagactgatggatcctcatatttcataaatcattatccgttttttaaatgtattaattatatagaactagctgaaatttccttctgaattatgacttgactggaggaacttaggtagtatcccgctgggtgacctaaatttgaaatgacagttctgactcaatcaatgacatct

SEQ ID NO: 20555 - DNA, 101 bp, Homo sapiens
tgacagatactaagatctaacatagtctaccaaatgaagagtgacagttaaagacagcttctgttattacctgaagtatcaaatatttagtgatacctttt

SEQ ID NO: 20556 - DNA, 610 bp, Homo sapiens
aaaattcttcttgtgagatttaaggtaatgatacgtggccaaagttgatgtgtattcatattactaaaaactttttttttcacactgttgtcagatgcttatgtatatctttttggctactcattgttatatttcaaatacataaaatgtagattttattcaatttacattgatacttttagaagactttgagaataggatgtaagggacttgcttttctgtttcatcattaataatgtgacccatgactggatgacattaataaatgatgttccatactaaaggcaattcttgataagagacattatattgctctagtacacatgaaccatgaaccaataatttccaatttccaaaagaattcttctccacaaagaccacaatgaatttcaagtgagatttaggatctgatttaaatgaacttagaaaaacatttacttgtattttgtcttatttctcgtttcccaactactctctaaatcatagaattcataggaaatattaactgctttttaatttctccttgggaaattcaccaattttatacgttctgaactaggaatttaactagctcctatacatttacagaaagaaattgactgccacatat

SEQ ID NO: 20557 - DNA, 517 bp, Homo sapiens
agagagtgagacccaaatgtcatagacagacttctgttcactgatgtgtggttcaatatccacttccaggcatagaggggattatgacccatcctcttgagggttggcaaagccatgagtcttgctatttattggcaaataaaatatcagtatttaaaaccttgtgtgtttctccatctgtccttcccccagctcaggcaaatgaagacattgcaaatggtgaaccctgggcccctgagcaaagaggggctgacacagaccccatgccatgccattatggactactgcatgagtaagaaataaaactttgggccgggcccggtggttacgtctgtaatcccacccctttgggaggctgaagtgggtggatcacctgaggtcaggagtttgagaccagcctgatcaacatggtgaaaccctgtctctactaaaaatacaaaaattagccgggcttggtggtgtgcacctgtaatcccagctactcaggaggctgagggaggagaatcacttgaacccg

SEQ ID NO: 20558 - DNA, 544 bp, Homo sapiens
gccagtgtggtaatacccaatttgaattccagactatcagaagatgtgcaattacatttcagaaaggaaggagcccttctattttaacttgcattgtattcctcctagcagtcatgcatcggaatgatgatgatgttcaatctaattagacacagacttactactttctctactgcctttccatattgctaatattataaatagtatctactttaaaaactataataagctcattgcatctaccaaatttaaaatgctggaaatctatttgttggggcaaaactgcttctaatcatttgaagaactggaagagatacttttactgttaataaaaagccaccacaggccgaggcaggtggatcacgaggtcaggagattgagaccatcctggctaacacggtgaaaccccgtctctactaaaaatacaaaaaattagccgggcgtggtggtgggcgcctgtagtcccagctactcaggaggctgaggcaggagaatggcgtgaacccggaaggcggagcttgcagtgaggcgagatcatgccact

SEQ ID NO: 20559 - DNA, 586 bp, Homo sapiens
ggtactggagattatgagaataatataacaaagggaatctccccctctttgatcttaggctaatactgtaactagctcaccctaatataatgtacaaactggtaaatcctgtatgtacatgtctataaaatgggggaaaatataatgatatattttatgttttgtgaccccaacatttttgtaaagtctatgtagatgccacaattttattagtattaattaggcaatttgacgtaaatagagaaagcagttttcttacaattacacaaaggcaagggaacaacgttttgtacaacaaaaacaaaatggttttcagagatttttagtgaatccagattttctctaacgctgccttatgagcaaggcttgcagtcagactctggaaggctattccaataggtaattaaattcaatctgtgcagtgactggcacagaaggtgagaagacaagaagttttacctgccagagatgctcacagttgctgtgacaaccagacttgagaaactggatgtaatctaacacaaagatttcccactccagagcttcccactttcccagtaagagatatatatgaatgactcttgct

SEQ ID NO: 20560 - DNA, 136 bp, Homo sapiens
ttttgagataccaatatggggcacttaaagaataaaaatttcaccactttctactaaacccagagcatatccctatcaataactagccttctattacacatgttctcatttctaaactcggagcaacagcaacaag

SEQ ID NO: 20561 - DNA, 551 bp, Homo sapiens
aggtgtgagccactgtgtctggtccatgcctggcctttttaacagttaaatgtcatttcgttcatctagtaaacaactatgtagtaagcacctactgtgtgtccccgtggtgtgtaggtgctgggcttacagcagtgactcagcagaacaaaggcctccatctccctttgtagagtattttaatcaggacctactgatggacactagggttttgtgttgtttttttttccaacaaatgaagcaactaatagctttaaatgtatattttattacataggtatatttatgtaataaatgggccacctccctaggagtagaagtgttctatttaatcctagagcatgacagtgttatatgtatgtaattcacaagccagagcaggagattcaaactgcccctgatgacagcattcaccagtgggccattttcttagttaacacaggatcagttaactctcaacagctgctttaggtctgcttctccctgccttagattaacatctgtgcttgcctgccctggattctttaagacacatcgaagagttatgctaa

SEQ ID NO: 20562 - DNA, 121 bp, Homo sapiens
aataaatcggaagcaaattttctgtttattaacagtggttgcagaattagaggaaacagaattagagaaaactaggtcaataacaaacaaatagaaacattaaagcacttttaactgatga

SEQ ID NO: 20563 - DNA, 493 bp, Homo sapiens
ggagaccaaataaacactgtcaaatgcaacagacaagaggaaaaattgaactaggataaaaagtcaaaatttcaagtgaagctaacacctacatagcagttgtgtgccaggtacagttcgaagtgccatatatatatgttaataactcaccacagatctataagtggatactattattacacctgtgttacaaatgatgaaataagaggccgggcttggtggctcacacctgtaatcccagcactttgggaggacaaggcgggtggatcacctgaggtcaggagtttgagaccagcctaaccaatatggtgaaaccctgtctctactaaaaatgcaaaaaaaattaggcgggcgtggtggcatgtgcctgtagtcccagctactcgggaggctgagaccaggagaattgcttgaacccaggaggtggaggttgcagtgagacaaggtcacgccactgcactccagcctgggcgacaaagcgggactccatctc

SEQ ID NO: 20564 - DNA, 563 bp, Homo sapiens
cttgagcctgggaggtggaggctacagtgagcctgattgcacgactgcactccagcctgggtgacagaatgagaccctgtctcaggggggaaaaaaagtcagggagtggcaccctgtggtggtggaactgatgttagcttctaaattacacaatctggaaactgctatagggctgagaaggaacttccccttgcctctcacatacctggggaggcaaaggattgccttgttcctccacacatggtgcatggtaaagccccagcattgagaattatccagaaaccctgggtagctcttgggtttcctgaatccattctaggctttcaggtaaatgtgttgtttaagaaaaaacttgcagctgggcatagtggctcacacctctaatcccagcattttgggaggccgagtcaggaagatcactggagcccaggagtttgagaccagtctgggaaacatagtgagacccatttctacaaaaatatttaaaaattaaccaggcattggtggtgtgtgcctgtagtcccagctacttgggaggctgaggtgggagaatcgcttgagcc

SEQ ID NO: 20565 - DNA, 412 bp, Homo sapiens
tctgtctcaaaaaaacaaacaacaacaacaacaaaaacacaactcccaccaaacgtggcttctgcatggtggttcatgcctataatcctagtgctttgggtcaaggtaggaagattgcttgagcccaggagttcatgagaagcctgggcaacacagcaactcacctaaagtttcaggtgactgaaaaacagcagtttccttgccatcactcacggcaccgaattcaaagtcaagaaatcctgattccagaccgtgtcaggtaccatccaatgccttacagtttattttccatctcaaggaggaaaaaaggccttttcatgcttgcctcatgacagatgtgggaaaatgatgtatgtgtatgtaacgttcttggctgtctaggcatggtggctcacacctgtaatctgagcat

SEQ ID NO: 20566 - DNA, 433 bp, Homo sapiens
tgaggcaggagaattgcttgaacccaggagatggaagttgcagtgagctgagattgagccagccttgccccagccatgcagaccagggctcctcagctagtctcagctcttggtccatctttaccttggccttccccattccagctccaccccactcacccccactctgcccagctaccctccctttgttgccccagatctctttccctaaaaccctgcaagttctgctgccaacacagctggtgttgatccccgtattcaagagccacacattcactttcagaatccacctctcacaaaagagttcacaaccagtgagtgagtattttaggggaagccagaacctctcaccaacccttaggctttatttgcacaacaacatgaaatagagttgagtatccttagggtagatgaacattgacggtcacactga

SEQ ID NO: 20567 - DNA, 565 bp, Homo sapiens
ctattccttggtaacatgacttacagtttaattaaggagactaattcaactgtgacataatttacatgataaaagttgtcaggaggattaaatgactcaataccttagaacagtccctgtcacataaaaagtactcaatacatttcacatgaaactcagtaagtttcagctattgtcataattattactgttattaatcatatcgttacagaaaaagcaaaagtgtggatcaaacacagctagattctaactcaaagtctacacttagagcatttcacgtaacttaactgatccttatttccctcatgtgtttaaaaacaaatggtaacctacaggtgtggtaaaatcgcatagcacggccaggcataatggctcacgcccataatcccagcactttgggaggccgaggtgggcagatcacttaaggtcagaagttcaagatcagcctggccaacatggtgaaaccccatctctactaaaaatacaaaaattagcccagtgtggtggcacacacctgtaatttcagctactcgggaggctgaggcaggagaatcacttgaacccc

SEQ ID NO: 20568 - DNA, 568 bp, Homo sapiens
taaaacattatgattataaattttctctgaataagttgataggagattattcctgttcttataatgaggtttttccattagcacttttcaagtgtgcctttcaaccaatgatatgtttttaaaaaataatgtaacttaagtaccttatgattaaccatcatggagtctagaaaatgtggagattctaaaacagtattgtctgaaaacatagaatagttggacttaatgttctcttcagaaaatctaactgtaaacttggtactttcctacagttcacttgtgaaaaataatatctatgaagatggagagattcctaaaggaattccactattttaccatagagcccaaagtttccttgacccaagcaagaccatcaaggagctatctggattgtatgatactggacctcagtagaactacttttactgaattgctggagccaaaactaggctgcagcaagagaaggcaattagggtacaaaatctaaggaagctgtcattctgaggatcatatgatagatgctgggttaagacatatggctgggcatggtggctcatgcctgtaatcc

SEQ ID NO: 20569 - DNA, 325 bp, Homo sapiens
ttgggaatctacttaagtaaaaactacatttctaaggtatttttatataagtggtttcttgctaattagtagaagatattctttccaaagagaggccttctttactcttcatctctgcatgttaagctgtttatgaaaaatacttaatatttcaaagatttctcaaagtctcagaaataaaggtcatcatgaaaatcaacaaaagtaattatggtccttatcaaacacatcaaatgtccgtgcttgcttttttgtccatgttctggaatattaaaaatgttagtcggctgggtgcggtggctcacgcctgtaatcccagcacttt

SEQ ID NO: 20570 - DNA, 97 bp, Homo sapiens
tagcttgtttcatatacattcagatgatgatccttctaaaatttcacatttatatgaagcacatccaagagtaaaattctatagttctgtacctaat

SEQ ID NO: 20571 - DNA, 492 bp, Homo sapiens
cctggaggttataacacaccccaaactatagcaagtagaaaatcaagacttttgtcatggaataaacaggtcagcatctacatttccaacactaggtctttgactactgtctggttatgaaacatttactcagcatagtgaaaatagatctctttacaattttgatgacggtactggtattgactttatgaagtccagattgcagggagcaatgatatactggtatgctggtttcagtggaagaagggatctaactacatatatggatttagagtaaggaagatgttggttgggctcagtggctcatgcctataatcccagcactttgggaggctgaggcgggtagatcacctgaggtcaggagttcgagaccagcctggccaacatggtgaaaccccatttctactaaaaatattaacaaaattagccaggcatggtggtgggcacctgtaatcctagctactcgggaggctgagacaggagaatcacttg

SEQ ID NO: 20572 - DNA, 625 bp, Homo sapiens
ttttacaatatggaaaataataataattattatttttttaagacagtcttgtgtcttgcttgttgcccaggcttggagtgccatggtgcaatgtcagctcactgcaacctccgcctcctgggttcaagcaattctcatgtcttagcctcccaagaagctgggattacaggcatgtgccaccatgccaggctaatttttgtatttttagtagagacatggttttaccatgttggccaggctggtctcaaacgcctagcctcatgtgatctgcccacttcagcctcccaaagtgctacaattacaggcgtgagccaccaatgcccagctggaaaataattattcttaacttttaaaaactaaatagaggtaatgaggagaaataaactaaattaaaaatgcagaactttgaatcctagcttcacaaaatatctggtttaataattctgttaaattcttttattcagtaaatactgacttggtacctacagagtacaatctatttcagaataaagtgtttcaattgttgactcatctataaaatgtgaactagaaacagattgttttttcaaagagccaatttcaaacagtactggaaactgtatggatcacgtactacacatactta

SEQ ID NO: 20573 - DNA, 646 bp, Homo sapiens
gaacctttaaagaagcacctacacatgtgtagagcgttattttacttcacttcagcaacctctaactaaccaattatattaatgataatcatgaatcaaggatctcagcagtgcttacctgtctcataatgaaggatgtctgcttattcttcatccccaaagaggtctgcagctcagaagggctgaggcatatagaaaactgaagccagcttgccttgatgactctgaggaatatgccaggctaagagataaaaatgatcaaagaaatacatgattattctaattcatattagcatgagaaagaaagtaaattaattcatatattgtgaatgaaagaatgttattgaccatgattagtctgcaaacagtatctcatgctgtttattcattaatggctctttttagcacttttttctgccacatttagtaagcacttcatgtaaaagggtgtgcctctgagtattcataacacacattcgtgaaccatctagtcagattcacgttgtacacttttccaagttgaagtctccggcagccaatttcacaattctttgtcctataaaattcttactttatccctacactgtggtatgaagtatcatttccttaatctttattttggcttatctctcatatgctctatact

SEQ ID NO: 20574 - DNA, 580 bp, Homo sapiens
catccctgatccaacagcttctacatgatgtagcagcttctacgtttcagtgaaaatgagctttgtaaaggatagcctcatggtatcaagtaggctatatctaaaatcaaagtatggcaagactgaaagagtagtatggagtactccaggtatagtaggtctttgcctagtaagagaagtcttctacttgttcaaagagctgtgatagtcctatgccatttcagagcctcactggaaaatgttattaaaggccactgtttgccctcaacctggtatatttcgctcttcatttataaaatatatctgattattagaaagctgggatagggaatgcacaaattaataataaattatgagaaaagatcatcaaaattgtggtttttaaaagagtatctgaagccacgtgcagtggcataggcctgtagtcccagctacttgggaggctgaggtgggagggatgcttgtgattaggagttcaagactagcctaagcaacatagcaagatcctgtgtctataaaatgtaatttaatttaatttaaaaacagagtaaataccacacagatactaataaatgataca

SEQ ID NO: 20575 - DNA, 580 bp, Homo sapiens
atgttaaatgttcttactacaataaaaataaaattagaaaacacatttaggatgatgatgaggaagatttttgaacattgtctgtcatcaaattatgggataatttcccaagggaaatgtgaaaaaatgccatcattgaagacatttgaaaccagactgaagaaaaacacatgaacacataaagttggccttgttcttctgcctacatggatgacaagacccaaacatgacctaagacaccattagattttacagccgatgagcaccttctgaccacccactactgtgagggatgaaaggggaaaattgggctggaactgatgactcacatcaggaagacttgctcagtgtgttcctggctctgttacaacttcccgagggtgctaggaaaggagcagtttgcaccaagtcatcatactcccagttcatagaagtttccagggaatacaggaggctcttctctactgcaccccacttttttaattggtctgtgttttgttttcttttttttaagtcataaataacccctgtagaagaccagaacatacaatctatacagaacaaacaatctatacagaac

SEQ ID NO: 20576 - DNA, 560 bp, Homo sapiens
gaatgtcaggaagttcagtaaggctagaggatatgatgcaattaaggtggaggaggaaaaaggaggagaaagaagtctgagaaaaggcaaaatgttaaactattcttacactttcaaatataacacatatacaagataattctaggagaaaccccaataaacccaaaatagatttattttaatacaaaaagcaattaacataatttttgaggagtttttaatgcttattttggggctaaaagtgtatgtaaactttaaatgatgaggtgatgtaaagaaaactatcaaatgtataataatgctcaagtatggcacacaaaatttggaaaaacattgggaaattaaatttatgtacaaaataaggagcttaacctttatctgaagaatagttaagagcagttgaaagattaaaaacatttttgtgttagagtttttatcttggaaatattcgcttagcctgagtctaaggaaaatttggttcctagtaaagtgttggaaggtaggcaaaagatactgctgaggatggctgggcacggtggctgacgcctgtaatcccagca

SEQ ID NO: 20577 - DNA, 444 bp, Homo sapiens
catttttttaatggctgtattcctggaagagccacttattccttttcttttaccttgtattcaataactattgagtgttattgaatgtgccgtgtttggttgagtgcaaaagatccaatgagaatgagttctagttctttcaaagaatttataggcttgggacttgggtggactaatacacaggaaattatcaaaagggaaagagagagaagtgctatgattggctgatttaaaaacccatagaaaggacactcaacctactcttgatggcatagcagatacaatcttgatggtatagcagattaacaagactaatcttgttcatcctcaccaaatattctatattgccccctatattttccacctttctctgcagttacaatggagtcatgtgactaattctgaccaagagaccgtgagcagaagtaacacatgtcacttcct

SEQ ID NO: 20578 - DNA, 540 bp, Homo sapiens
tttcaaggcagaaatgggatatgtgtgggcgatgcttttgcattgacggatggtttctttgctggaggctggcagatgggtggcaatgtggaaagctatagattggaatgaaacagcatggtgctcttccctgccttaaattcctgcatagctttgttcactcacttgaagaaaaccccccagaggacgtgaccaatagtataaacaactaccgtgttaactctggcacctggttgaaattcaacccttgtacgatacacattgaaaagcacaaaatgggctgggcatggtggcatatgcctgtaatcccagccctttcggaggctgaggctggtgaatcacgaggtcaggagttcgagatcagcctgaccaacatggtgaaaccccgtctctactaaaaataccacaattagtcgggtgtggtggcagatgcctgtagtcccagctactccggaggctgaggcaggagaatggcttgaacccgggaggcagaggttgcagtgagccgagatcgcgccactgcactccagcctgggtgac

SEQ ID NO: 20579 - DNA, 560 bp, Homo sapiens
catccatgagcctacctactttatcatagtgctataattctccagatgtctattttaacggtgccaaaggtaagcaactgggatcagacctatacagatacagtttacttctgccaggtttctgttcaggttcacaagctcaaaattagaggtttaattcaattgcaaaaatagagtttgacattgaaatttgtaccctaggacaaatttgctgttttcctttaagagcttattgctctgtttgaagaatgctcaaacaggtttagcctagaacaaaatgcgggaaagataaaggagccacaaaggtttaggatgctgcccttggagaaacttatcatgagctgataacttctaagcaaatagaggtagtaattggatgagttctcttaattgaatgcaatagagaaagcgcaaattctggtcttgcttctgatatgcattaatactacataatttttgaacaaccttgagacaagaagtgacagacgtaagactggaaagctcccagatcatcctcaaaaagagaatagtgtattcaaatactgctttcagaatagcat

SEQ ID NO: 20580 - DNA, 499 bp, Homo sapiens
attgcctgttgccttggaggtgggctgcggtccctctgcccaggcaggaaggggctccgaggcctctggaacctcattttaccttttccctgctgccctcagtcccgtccccagcctcaaggggctcagctttttccaggctcaccccttccatttataatttggagacaagcaaggtccactgacgctaactccatttggttctttaaaagatgttaggccgggcgcggtggctcacgcctgtcatcccagcactttgggaggccaaggcgggtggatcatgaggtcaggagttcgagaccagcctgaccaacatggtgaaacaccatctctactaaaaatagaaaaattagctgggtgtggtggcggacaccggtaatcccatctactggggaggctgaggcaggagaatcgcttgaacgtgggaggtggaggttgcagtgaaccaagatcgcgccactgcactccggcctggacaacaagagtgagactccatctc

SEQ ID NO: 20581 - DNA, 500 bp, Homo sapiens
ttaaacttttggttagaattaaaccacaatatccacataagataagacaataatactcctaaattgcactctaaagagctctcaattacaatctcagaaaaaaggagctccaacttcccattcatgagaggagtccattcaggaagcagacctacttacatagcagccaaggaaaaccacagcagctagtcaaataaaccaagtcttttttccttcaatctgactcaaaaaacaaacaagaaaaagctaatagaatgaagtagagagatcaatttaaacagttagattaaaacaaaaataatcaaggagaataaaaatgaattgttaaaggaagaaaatatgcattcataaaaagcatgaaaaaggatacgataataaggaagagtcaaataagataattgtcaaggaaaaacaaaagacttctaaagataaaaactgacataagccttcagaataaaatgctttgtattattagtatatgaatttgaaaaagacaccct

SEQ ID NO: 20582 - DNA, 613 bp, Homo sapiens
atacactaaaagccttacatgaagttacatctacaaggttttttccagtatgaattatctgataaaccttatggcaggatgctcattgcaggcctttctaccaaatgacagtgttttataaagttaaaagtaaaacacagaagtagaaaaaaaaacagaaaacgcaaaaaagctaaccagcttcataaagagtttgtaaaaaaaaagaggctatcatatttttaataattaatccatttgaatagtttgctaatattaaaatttagaggtaacaaaaaattatgtaaaatttatatacaagactttagccttaaatcttttttttcttttttttcttttgagacagtctcactttgttgcccaggctagagtgcagtggcacgatctcagctcactgcaacctctgcctcctgggttcaagtgtttctcctgtctcagcctcctgagtagctgggactataggcatgtgacaccacacctggctaattttgtattttttgtagagatggggtttcgccatgttggccaggctgctctcaaactcctgacctcaagtgacctgcccaccttggcctcccaaagtgctgggattacaggcatggaccaccatgcc

SEQ ID NO: 20583 - DNA, 625 bp, Homo sapiens
gttgaccatgtgcctcacccctggctgccctcaggaaaaggcatgaggatatgtccctgccagggaaggggcagagcctatcagggttccagtggtaaaacacgcctgaattttaactcaagtccatctgccctctgtccccatggctgtctagggcaaccctgaggacaggtgcctcttcaggccccacccttcaccctggccccatcttcacctggctcccaagcaccagctccgcccagcacagctggcagccgccaagcccctcgggtggtttccactctactctctggcagatgcctgtctgtcctgggctaggcctgggctggagctaccaggcctttgtctggaaggtgctcggtagccccgtctctcctgcctggctgaactcaggtatgaagcctaaaaccccttaggccctgtcttgagcctcaacaccttggctttgcctcccagactctgatctctcagccattaagaagggaggaggaggccaggagcagtggctcacacctgtaatcccagaattttgggaggctgaggcgggtggatcacgagatcaggagttcgagaccccgtctctactaaaaatacaaaaattagctgggcatggtggcgcacacct

SEQ ID NO: 20584 - DNA, 613 bp, Homo sapiens
gtgcaaaaaccagatagccaggattatagcctgtgcttgattttaaggtcttgtttctttggatgttgttgattatgataactctgttgtaaaaaaataatgaatacgttttaggctatttgcagaaaggcgagagaattaattttgaatctgtgagtgataacagtgggttatcaagaaaaaaatctggagcaagtcctactaggcttctaagaagtaattcactcatatgctatgttaaaatttttctgttcttatctttctttctttacctttcctttgttctttaccatgtgctcccaattctctattctctctcttagcagtaactttatgcacctgccattttttttttgtacccattgcttccttgtattctccatccatcaatcaataagccttgggcttccaggactctgcttctttggatctaagcctggcctgctctctctgttatttgtggtgcatccaacctctaattttaactttgcttggccctatcatgtaaaaatgactatttagaacaaatcattttagcctactcaaactataggattagcacatattgaaaataggtctgtattaggacaatataaaatcattctggcttgag

SEQ ID NO: 20585 - DNA, 544 bp, Homo sapiens
atgttgcccaggttggtcttaaactcttgggctaaagcaagccttccatctcagctttccaagtagctgggacgacttgtacgtgccactatgccctgtgatttttatcttcttacctcacctgtagaaaccttaagtctgcctttcattagatattctttttgaagaaaaaacttagccacattctacaattaattttataaaaagaatttgagttttgatgatatagtatatgccaccatagttcggtgtcaggtgagtttacttactgttggttttgtttcagaaaagtaaaattatgcttttgggtatagagattgttaatggccaggcactgtggctcacacatatagttccagctacttgggagactgaggcaggaggttcacttgagctcaggagtttgagtctagcctgggtaccctagcaagaccctgtctcgaataaataaatatattttttaaaaaagatggttaaggctgggcatggtggctcacacctgtaatcccagcattttggaaggccgaggcggatggatcacctg

SEQ ID NO: 20586 - DNA, 605 bp, Homo sapiens
ctgactcaggtgatctgcccgccttcgactcacaaagtgctgggattacaggtgtgagccaccacacctggccagcctgtgagagctttaaaccatgaaatagacatatggttttgcaaaagtttctacataaatcagaatggttcccagaacagaaaggctcctctgtcactttttttatctggttgcttaaccataagatgccaacccaattaacagtcacacccatatttgcattatatctgtttcatatgttccgtgtaactgcctcctttcaaagtgttggtatatttttcaagtcaactggaaccaaaagtatagagaaactgaatgcaagccagtttctgcatatgtaacagtgtaagaatccaggttgtatagatgggtttttgtttgacacagatgtttctcccagtaaagagaggataaggagctggaactcgtgtcacagttccctacaaaataattaattgatcatgtctactaattaaaatttctttttctgtactattgcagatacctggttttggctgggcaaggtggctcacacctataatcccaacattttgggaggctcacttgaggtgggaggctcacttgagccc

SEQ ID NO: 20587 - DNA, 533 bp, Homo sapiens
caagtaggaacagagatatggagaatccaataaaccaaatcactgagaaaacataaatactttgtagtgtgttcatacaatggaatattaccaaaaataaaacagcaataaaaaataatgaactgctgacatagtcacaacatagatgaagctcaagaacattatgttgaatgaaaaagccacatacaagagtacatactatatataaaatccaagaacaggcaaaactaaattatgctgacagaattcagaaagatgattacttcaggggaaaaggctattagactggaagcggggaaagcacaaggaactttccaaagtaatgaaatgttctatatcttgatctagatggtggttacacatatgaatgtgtatgtgaaaagtcattcagctctatacctcaaattttatgttaccatatatatgtaaactataccataataaaaaagaaaaaaactacatatataagcatggtgaaaaataaggtcagaataagttaaaccagtgtcatcccacaagcaatatcaaacata

SEQ ID NO: 20588 - DNA, 555 bp, Homo sapiens
aagtaagatgaagaagtataatgcgtactcatgaaagggaataacacttgcctgtaatgacaaagataacaaaggaggaaatccacaaaatttaatagtatatcctcctctttcttacaaatatttgcatgacctaatatctcatttttaaaaatgctaggacatcatactccctacataagtcctgcttcatgatatcagcactattaatgcaatatatatgtcaagctttattaaaactccttttgatgtgtaaaaataaggtagaaggaagaattaatgaaaggaaaatgataaacaatatatacaattataaatatacacaattggccggggatcacgaggtcaggagatcgagaccatcctggctaacacggtgaaaccccgtctctactaaaaatacaaaaaattagccgggcgtggtggcgggtgcctgtagtcccagatactcgggaggctgaggcaggtgaatggtgtgaacccggtaggcggagcttgcagtgagccgagatcgcgccactgcactccagcctgggcgacagagcgagactccgt

SEQ ID NO: 20589 - DNA, 578 bp, Homo sapiens
gaaactcagagccaaattcacacttcacctttagtaattttgtgagaacctgtaatgtgcatgtttgtgacccagtttccccttagtctcttctctggccttggcttttactcaacatttttcctattttagtatttgtaattttggaagttacttccgatccacctttgtagagaacaagaggatactgccatgcggaatcacagtgtaaaataaaaaatgcttttgcaagcagacggaagtgaggttgactaagcaggagtgaggttattggggtcaagggtgtggagagggaaggtgaatgtgaggggtttttggtttttttgtttgtttgtttggttatggaaacaaacttgccaaggactaggagggtggtgccccagggctggaaataatccctcctgtctagaagaactggggctcctttggggatatccgcagaggccagaggcagtggcagtgctgacctgggtctgattcccctgccagaaacaggaaggaatgccaccctttctcctcaactggagaaagttcgttggattgcaagtaaatgagaatagtggttctatggaactagc

SEQ ID NO: 20590 - DNA, 590 bp, Homo sapiens
cagttactttcaaggctgaggcagaaggatcgcttgagcccaggaggtcaaggctgcagtaaactatgatcacaccactgcactccagtctggggtacagagtgggagcgcatctctaaataataatgacaatactaagaaattcagcaaatggatgtttcatatgtgtgcatttcattgcatgcaaatttataaaatctcaaagataactgcaaacattgaactccagttggtgatatgaatcctgaaatgtttaagggtaaagagtactgatgtctgctttaaaattctttaaccttctttaaaaatacatttttaaaaaatcagatgacttgatagaggaatggactgatagatgtgtaataaagtaaatacagaaaaatgttaacaattgtagaatctagatgatggggccaggtgcggtggctcatgcctgtaatcccagcactttgggaagctgaggcaggtggatcgatcacctgaggtcaggagtttgagaccagcctggccaacatggtgaaacaccatctctaccaaaaatacaaaaattagccaggcgtgacagcgcatgcttgtaatcccagctactc

SEQ ID NO: 20591 - DNA, 435 bp, Homo sapiens
gactccctgtgagtcattttcctacccacttaggcggtatatcctggagaaatccttccaagtagtagtccaatcgcaattccccagaatatctagaagaaaaggccagaatttctttctcaaatgcagagataatccctcacagttcctcctttcttctgcctccatgcaaaaattagcaatttaaagtgacccaggtggctgcttctctcacctcatctcaccttgagacctggcagtgagaaaaaccacaaatgataatttccatgttgaaccaagactgataccaacatggagaaaacttcctagtctcccacccgctaggaagaaatcaggcttgaaccatatatgttcttagtggtcctaggactctgatggttttttccaagcaccttaggtgtgcagtacccagatcacatatacctgtacctctta

SEQ ID NO: 20592 - DNA, 545 bp, Homo sapiens
ctgatcctctccatcctcccaccctccaccctctggtaagccctagtgtccatcattcctctctatgtgtccatgtgttaagaatggtttttatctttgacacactcaagttttctggaattaaaatgggtttgattaaataattttcagtaaattaaaaatattaccaagataagacagacattacatttgcttccttaaaaaaaatcaaggtctactcaggcttgaatgctcagttgtttctgtgatgaagacaattgtactaagaagtacacttccagaaaaatactgcgtgaaatatattttagttacaaaatattaaaaatttaaagaaagaaaatgtttacaggctatcttgacctcagatacatatacaaacatatacatcctatgtatagtggttaaaacctcacaatccaggctgggcatggtggctcacacctgtaatcccaacacttcaggaggctgaggcaggcagatcacttgacgtcgggagttcaagaccagcctggccaacatggcgaaatcccgtctctactaaaagt

SEQ ID NO: 20593 - DNA, 630 bp, Homo sapiens
tccaatattaatcccctggaccaaatcttcattatctcttttctgtaggatttaaataatttggtaacattttccccagactcctgacacaatccctctctaatttatgcacaaaacagagtttataggacaactctgattatattattctgctcttcaaaactcttcagtaacttcttcatttttactaacacgaatacaatctacttagcccatcacttaaggtattatctaattggattcaatctaactttttaggcttttttccctctagtcttcctcagaaatttataatttcacccaacttgactacctatggtcaatccaattaccccagctagaactctgaatatcaaagataatttttttccttcttttattatcatcccatctccatccagttcatcaattaggatttttatctttaaatgcatcacaaatacatccacttacctccattttcattgctaccatgcgtgctactacttcagtagtcttccaatctgttctccacataggaatcataataagcttccaaaatataaatagcacaatcctactacttttaaaagaaaaactttacacaaattaaacttagcagagtttatttgagcaaaaaaaaaaaaaaaa

SEQ ID NO: 20594 - DNA, 583 bp, Homo sapiens
gatgcattctaatacagccttgctactccacgtgcagcctgtgggcctgcagctttgacgtctcttggagtttgttaggaatgcagaatctcaggctccactccagacctactaaatctgcatcttaactagaccccagatggcccatgtgcatgatcaaagttgagaagcactaccacagcactgttgaagtgactgtgtagcgtgtccatagaccccttcctgctggtatgaacatcctgcccacccaccaggaagtggacagtttcccctccccttttatctgggctctcgccctatggcttagttagcccggtagaaggtgataaaaatggtgctgccagttctgggcctggcagcctctgcttcctctctcagaagccagctggggacagtggttcacacctgtaatcccagcactttgtgaggccgaggcagaggcctgaggtcaggagtttgagatcagcctggccaacatggtgaaatcccatctctactaaaaacacaaaaattagctgggcattgtggcaggcacctgcaatcccagctactcaggaggctgaggcaggagaatcgcttgaac

SEQ ID NO: 20595 - DNA, 548 bp, Homo sapiens
agcgattctcctgcctcagtctcctgagtaggtggaattacaggcatgcaacatcatgcgtggctactttttgtatttttagtagagatggggtttcaccatgttggccaggctggtcttgaactcctggcctcaagtgatttgcctacctcagcctcccaaagtgctgggactacaggtgtgagccactgtgcccagccaacaccatttgtaatatctttactgtccaaacaatggaaaccatgggtgacaccatttgaccacaagacgaatgagaacaagatatgtgagaattggtagcaatatgggggcagggcagttaacatgaatgattcaaagtgaggaacaaagataaacaccagtgatggactaacaaaacatgtgaacacattatgctgttcgacagaaaaactcgatatgcaagacataaactctccctacgataagccagaaacagtgacttcaagaaaaatattgagtggattaatttttcttctacaaaactaaaaaataagaataggacaactctgaaaaagaataatagggca

SEQ ID NO: 20596 - DNA, 638 bp, Homo sapiens
agttattcaaattgagttcttaatgaattacttaaacagcagattagatattgttaaaaagaggaatagggaattaaatgatatatgtgatgatattacctagtgtaaccatcaaagatgtattgcaaatgataaagaaaaaaatgctgccatggcaatattaatatcataaaaatatactttaagaagtaaataaatgcaactaggaatagagaaagctaatgaataataatatttaaaaaaaagtataacaagtatacataagatgtaatatcctaaaccggtgacacatactgttataagaccaaagtatatgaaatgaaattcacaaatttatcccccagaaccaactaatgcacaacataattaggaattttaacatcttctatttataataaccctttttcaaaatgttttaaaacaagtgatccacacagacatgaaaagaattaaagaatataaaaatataattagcaaggtgaaagagagattgttacatcacatataaaaacatgaatataattttgaagtgtagatagataattccaatcaccaacataggacacaaaaaaagtctcaacaaatacaaagacagatgacatatcatgcacacaccataaaatgctgaattcatattt

SEQ ID NO: 20597 - DNA, 628 bp, Homo sapiens
gacagcctgctagaaatgggaaagcagagcatgcatagcacctgctgtagcagaccctagaaagctgactctttggccagcatagaacaaacacagccggagttgcccctaggcggcctcagagactcaggaacaaccggcagcagtgatgcttggcagtgagggtaaagcgaggctaagtggctcaaagtctgcctaagagtcagttaggccccagctttcctttccactccacacaaccaggtgcctgtcccccactactctagcagaaaactatcattcagttatctgaagaggtcaatgctgggggtttctgaactgggggcatcaggcacagtttagggcaggagtattatactgaaaacaagaggtttaaataaacatttatacatgtgaaagatgagacccagcctactcctcaaccttcctcccaaactggctccaagaatggggcagccaagcctatatactccaggtgggaggctgcagcaaccttctctggggaacatgggcagcctaggagggcagagtgaaagacctgacatcagtgatgcctgcagggaaactgtccagccggatggctccatggtgaaccccatcatctccagtatctccagtaacaactgat

SEQ ID NO: 20598 - DNA, 591 bp, Homo sapiens
aagtcctccaaaactccttcccctcagcatttgcatagccagaggggactccagcagaatgagaataggacttttaggaaataaggtagttctctaaccaggaccatctctagctccctgagctctagccgaagaaggggagtaagtaaggaggtctctctcacagtctcacacaaagcagattgctcacaaattgactgaaggtaaagcacccaggaagcaactgcctacaaaagctgctccggctgggcgaggtggctcacgcgtgtaattccagcacttcaggaggccaaggtgggcggatcacttggggcctggagttcgacaccagcctgcccaacatggcaaaacctcgactattaaaaaaatacaaaaactgggggccaggggcatggctcacgcctgtaatctcagcactttgggaggccgaggcgggtggatcatctgaggtcaggagttcgaaaccagcctggccaacatggtgaaaccctgtctccactaaaaatataaaaattagccgggcgtggtggcacgcccctgtaatcccagctactccggaggctgaggcaggagaatcacttgaacccggga

SEQ ID NO: 20599 - DNA, 451 bp, Homo sapiens
gctggtcattgttcaatgctcttataaaccaaagttatctacattccttaaattaacatttggatagaaactgagcaaataaaaggaattactgtcattgtcatcaatttcacattttaaaaaagaaatttgacaattactatattctctatatttttcaagaataatgaatttggagccgggcatggtggctcatgcctgtaatcccaacactttgggaggctgaggcgggtggatcctgaggtcaggagtacaagaccagcttggccaacatagtgaaaccctgtctctactaaaaatacaaaaacttagctgggcatggtggcgggcacctataacaccagctactagggaggctgaggcaggaaaattgcttgaacccaggaggcagaggttgcagtgagccaagatcgtgccattgcactccagcctgggcaaaaagagtgaaact

SEQ ID NO: 20600 - DNA, 630 bp, Homo sapiens
agagtctggctcaggaaggctgagtgactggcctgacaagcagggcctggatttcatccaggactacaggcctcgtcccaacagggccccgccaccacccctggggctcaggaatcacatccctcacactctgggtgtctccccagagaggtccacagccagtctagcactggggtactatgcccccagaaaataactctcctaattacttgccaggaagtgtgctaagagctttcaagcgctgcctgatttaactcccacagcgatcctatgaggcagatatcatcaccccaagtgaaaagatgaaaaaactggtgcacagaagtgaagcatctggggagcctgggtctgaacctaggtggtctaactcctgggatcaagcctagcgatcaagccgcccctacagcactggttcaagtttggccacaagtccggcatggtggctcacgcctgtaatcccagcactttgggaggctgaggcaggaggatcacttgaggccaggagttcgagaccagcctggtcaacatgggaaaaccagtctctactaaaatacaaaatgttagttgggcatgatggtgcatgcctataatcccagctacctgggaggctgaggcatgagaatcacttga

SEQ ID NO: 20601 - DNA, 593 bp, Homo sapiens
acatttgccacacggttgggagtccttccttccttgctctgacactaacacggctcttatactcgacctttgtcccctctgtcttttttctctctcttttttttaactaatggagacacaggcataggttaaaatcagagatatcttgctcaggttttcagagcaaacactgtgttccagcccacagcatacaatagtatatgcagaatttagacactatcttcccaaactaaagagtgaacacctttcagtactttctagaacaactctagaaagaaatatatagaaacagcaaccaagtatttagcagtttttctaatttgtaagaccctttgggaaaaaaagaaaaacaactatatatgttaagaaaaataggtaaaaatcggctgggtgcagtggctcacgcttgtaatcccaccactttgggaggccgaggcaggtggatcacctgaggtcaggagttcgagaccagcctggccaacatggtgaaaccccatctctacttaaaatacaaaaaaattaagctgggtggtggaggtggacacctctattctcagctactcgggaggctgaggcaggaggatcgcttgaac

SEQ ID NO: 20602 - DNA, 575 bp, Homo sapiens
acagttgggattgctggagcctttggtgggggcagacctctctgccttcccttccctgtggccccaggagacacagtgggctcagaggatgggctgaaagtatatagacagtaactctcattcttgaagggctctcaataccaggaatcatccagataatatcagataaaaaggaatctcaaaagcagtaggaaagcatagctcagtttcctttaaatattgcttcttggccatgtgctaactcggggctgcacatggggcagcaggcagacagatcacagagttggctgtttcttggcattcctggacatcagggtccagaaacactgctgggcacctggagccagggaccactggcctggggatgagaattcctgagctgaatccatcctgccttgtactgagtaaccctggagaaggccctttggggcttcagttcctcactaagctactcaggatcaagggaaacctgcaaagagccaggcttaaaaagcagcaaaaccagggaggcaaatgttgcggtttaagtctagacaagttaactacctaccagaacaacaacaacaacaaaagac

SEQ ID NO: 20603 - DNA, 602 bp, Homo sapiens
tcacgcctgtaatcccagcactttggaaggccaaggcaggcggatcacaacgtcaggagatcgagaccatcctggctaacatggtgaaaccccatctctactaaaaaaatacaaaaaattagtcgggcgtggtggcgggtgcgtgaagtcccagctacttggtaggctgaggcaggagaaaggcgtgaacccgggaggcggagcttgcagtgagccgagatcgcgccactgtactccagcctgggggacagagcgagactctgtctcaaaaaacaaaacaaaacaaaacaaaaaactattagagatccgtacatatgtgttttgcccaatttatgacaaaaatgacaatacagtacaccttcatttcctgctccatcaaccgcagactgtatcccttaacttcctactttgtaaaaatgaggacatttgcccttcaatcttttctctctccatggctacttccccacctctatcagctgtaccttttctttcatattgtctggctgagaacattcacattctattttgtaattacagataagtgttctgtaatagcactatgggttgattctaaaattgaaaagtaagtgcattcacaaata

SEQ ID NO: 20604 - DNA, 573 bp, Homo sapiens
taaagatttagattgatgtcaaagactggtggactgtgggttgataagaacccaccaacatattttgtttaatctgcagtgtttaaataaaattgatattttgtgaagttaaaagtggggaaacttcaccaaaaaatttcacacacaaaagtaagaatatctggcaagtacgcccatgttgccacttcacaagaatctactggagcttcacaacagctgctccctttggccaagctcatttgctgtgtacactcacatcactccagtgtattatctacctggctgtggcaggcactttagtttgcaacccttgcattaaggcatcaccctattaaggaagaggcagtgggcagacacacttcactttaggtgcgtaaaagagggaagggtctcaatatctcacataggtctgctaaccttccagaaataggattagtcaacaaatagggtcttagaaacaaacaaacagaaaacaacccagatgagcactgaaggttacaataggaaatgtaagtagaaaaacacaattaaacatgacatgtgtactcatataagtcattcagttcgagagca

SEQ ID NO: 20605 - DNA, 576 bp, Homo sapiens
ccagcagtaaataagggagtgtgatgtgacctaatgccagcaggtaaccttcatttgctgttgctagactatttaacatattctaatttatatctgtaatttacttcggcttcgctctagagagtttttggctcctcattagtcctggagtgactgaagcaatatacttgttccctgaagaagggtcctacctagttcttttccatcactctatctccttggctatcttctgtctacagtaccctgtttctgtggctcctttacaaactttctcttaagttaaaatctcctatgtacttaaacacaattaccacatccctcccttccatccagaaattgcttatgaactaatgagcacactaaaaattgcaggcaaatgactagctataggaagcagctcaaaatattttaattattcttggttataataatatcaacattcattggcaccttacttgtttccaaccatcagatatttgttatctcattttattttcacacctgaatgaagtagggcacatattccacactccatagatggaaaagatgaggcagttgctacctggaaaatgaaag

SEQ ID NO: 20606 - DNA, 568 bp, Homo sapiens
gtttcagtttatatctattttctttttttccaatctgttgcagtgcaatagaagtggtggtttgttgtgttgttgttttaagatgttgttttaagatctgttcaacagtactctgaacagcaggcactgtatgctttattgaacagaaaagctttaacaagccttatcgtgtacacatgttcattgtgcctgtgtctgcttatgttctcaaacttcctgaaaatgtgggtacaacaacaaagcagtgtttagctaccctacttaacttggccaggtggttgattatatggtttggcatattttttgcaggtggtatacaaaatcatatgtacgagctgttcagcccactgaaacagtttttttgtaacattttttttgctaaatgacacagccccagccacacataacaacataaaatgatgccagagtgatatcttctctggattcatttagctttgcaaagaattctctaagaaagacattttcctgctttcgtttctgtttcatgctgggtaatgttggcaagaattattcatggcacatgtgagcaattcaaaaaaaaaaaaaa

SEQ ID NO: 20607 - DNA, 522 bp, Homo sapiens
gtgcaatctcagctcactgcaacctctgcctcccaggttcaagcaattctcctgcctcagccccctgagtagctaggattacaggcgtgcgccaccatgcccagctaatttttttgtatttttagtagagaccgggtttcaccatgttggccaggctgatctcaaactcctgatctcgtgatccacccgcctcagcctcccaaagtgctgggattacagacgtgagccaccgtgcctggcctgttttgcattttatcataattttagtagactcatgggtttattatgattaatttttaaatgactttctagaggcaggaaaggtataaataatatatgggccaagaatacaatcaagcgtggcactcgttttgtgctgccagatcaaccttttaaaggatcaatcaagtggctgtctgtaatagatcagctcatgtctgtctagcaatagattttatgcagtattttgctaaatagataggtataaaggggttatttgcggccgggcgcagtagctcacac

SEQ ID NO: 20608 - DNA, 609 bp, Homo sapiens
gacagaagggaattgtaactcaggggctgaggggtctaaagaaagaatacagcagagcctgtcaaatcctttgtctatttcattgactgatagaaagactgaactcttatcaggtgaaaatatggatttgactgaaagtcacacaagtaacttaggaagtcaggttcctcttgcagctgataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctga

SEQ ID NO: 20609 - DNA, 597 bp, Homo sapiens
cttttagtttaaatactagattccaattatccaaaataactaaaacaatacgtgaggtgcttaacgtatcaaagtaagaaatggtttagtgtacccagaaacaagattcctgaaaattttatctctgtaaagtacaatatttttaattgaatacattaactttttaaaataaccacaagggactgaaacatatattttgaagatatactctcaggtaaaatagatgtcaaaatttgttatggttttacatttaacattttttacaatttatttgctattctttccatcataacttgttaattcttgaagatatctcagggctgggtgtggcagctcacgcctgtaatcccaggactttgggaggctgaggcaggcagatcacttgaggtcaggagttccagatgagcctggccaacatggtgaaaccccatctctactaaaaatgcaaaaattagccaggtgtggtggcgtgtgcctgtaatcccagctacttggagggctgaggcgtgagccttgcttgaacctgggaagcggaggttgcagtgagctgcaccccagcctgggagaaaaagcgagactccaaaaaaaaaaaaaaaa

SEQ ID NO: 20610 - DNA, 565 bp, Homo sapiens
taatgtaggccagggtcagaatttgaactgttgaaagagggcaactttgaagaaatttttaagggataaaattgatcacaatttcttgaacaatggatactttttatagaactgaaaaccaaagaactcccagcttccactaagaggactacacaaatctgggggcatacgctaggaaaataaatgggatagagaaaaattacgaaggcactagaaatggaacgtctgggacagtaaagaggtccatattaaaaagtaagttgaaggccgagtgcggtggctcatgcctgtaatcccagcactttgggaggccgaggcgggtggatcacgaggtcaggagatagagaccaacctggctaacacggtgaaaacctgtctctactaaaaatacaaaaaaattagcagggcctggtggcacacacctgtagtcccagctactcggcaggttgaggcaggcgaatcacttgaacccgggaggcagaggttgcagtgagctgagattgctccactgcactccagcctgggaaacagagctagattctgtctccaaaaaaaaaaaaaaaaa

SEQ ID NO: 20611 - DNA, 562 bp, Homo sapiens
attgtatttgaaagaatgaacctgtattttgaatatacatattattcagacattactccacagtacggtctgtgtcaaagcttgaaactgtaggtaatataggttaaggcctcaagtgtctacaatttaaagtgagaatatgtaaaatgtgaagatataatatatgacaatttacacatgccaaatataagattatagcatgtccacaattttctgggctagatgtgatttcaaatattctgccccacttgcactgaaagtatacttgctattattgtcttccacatttcattaatagaggattaagaaattatattcatggcatcccagaagaggtcacatgtggttgaaaatgcttaatagagtagctcaccttcaaggacgggctacaaacacaaagagaattttaaccgtaatgcatgaatgagatagccagtacaggcatgaagcgaagatttccataacattgaggtaatgacagaccgaggagatctgctagagtggccacatacatatcttgcttattgtacacaagtaacgtttatggattttataaaaactt

SEQ ID NO: 20612 - DNA, 615 bp, Homo sapiens
caacctccccctccagggttcaaacaattcttgtgcctcagcctcccgagtagctgggattacaggtgtgtgccactgtgcctggataacttttgtattttttgtagagatagggtttcaccatgttgctcagactggcctcaagctcctggcctccgataatccaccctgctcagcctcccaaagtgctgggattacaggtgtgagccaccatgcccagcctcttgctatttcttacatcaagtgaatttatttgtctgcttaataattattatccgtaatataagtgttcttacatttctaagtatatatacatttttaaaccaccaactcacttctcacccctattggaaatctgtaaaataatcactctctgcatttaaaaataataataacttcagggaaaaatgttcataagttaatgaaaatattaattttgacaacaaaaatgacagaatcgttacaaatatgtttgtacttatggccttcccaaataaatgtcaaattgttacaagctcttcactatatgagctatgtttatttattgttgcattcatcgcatgtaagagaataacatcaaaatattgtttctgatgttaagactatataaaagga

SEQ ID NO: 20613 - DNA, 566 bp, Homo sapiens
ctgagatttcaccattgcactccagcccaggtgacagtgccagactccatctcaaaataaataaataaataaataaataaataataaaataaactggggaggacagagagtggcctaggtagttaaatccttaccatccaatggtaggagtaaatacaggactaaaattgatgcatggagaaatattaacataggaggctgggtgtggtggctcacagttataatcccagtgctttgggaggctgagccaggaggatgactcgaggccaggagtttgaaaccagactgggtaacatagtaagattccatttttacaaaaaaaaaaattgtaattagccagatgtgatggcacgcatctatagttctggctacggggaaggctgaggtgggaggctctcttgagcccaggagttcgaggcttcagtgagccatgatcacactactgcaacagagtgaagagttagagaccttgtctccaaaacaaaacaaaacaaaacaaaacaaattaacatagaaatattactcagagttataaagtgactacctgcaaataaaaataaaatgac

SEQ ID NO: 20614 - DNA, 557 bp, Homo sapiens
aagcaacccagtggcttcatatcacggctttttttctacttctgcatcaaatatatctttccatgtatctgactttagccaccaactcccacatttactttgaggagtgtttttcacccttcacctgtgttagtgacattaataaaaatctttgttaatgattaaataaacagaaaggattcctgactgcttgaggagcttttaaaatattttgtaactttcttatcattgacatttttctcttgaggaattcaccagtatctaaaatgaatctctaaagatgaaatagtgagtgtacttttaaaatagctctatttgggggttatcgtttgggggggttttgttttgtttgatagagagtctcactctgtcacctaggctggagcgcagtggcactatcttggctcactgcaacatccgtctcccggctcaggcagtcctcccacctcagcctcctgggtagctgggattataggcacatactaccgtgcccggctagaggattatagtttaataatggatttatttctaagtgtaaaaccagatgaaaagcaaag

SEQ ID NO: 20615 - DNA, 586 bp, Homo sapiens
tttccccctttatattaccaattcatcatagaccaatacttaagtaaaacaaaataaatatgagttccaaggaaagtaaaataaaaaaatgaagacacccaaaacagaagccctagcttttcatgattagtttcgacatacataaaattacttggtgaagttttcctaacagtttctagattcataatctccatttctatacttacgtcatgatggccaagtttcagaatccacagactgccacagacatggagcctcctgagagtctcagtagttgaaaggagggcagaggagagctcagatttgcatttttgaaaagtgtacctggccagtggctggtgaagcctgaaagaatggatacaggtgaggagggagttgaagtaacccaggtgagagtgtgtgaggcctcagcttcagcagcggtggtggggatgggaaggggatatcaggatatgcgctctggagagccattttcccagtgtagacacaaatgggtgtggtgatttattgggtagggatgtgtgggtgaaggaccacaggggtattgtgatggttcttcattttcaggcttatacaacttaatgga

SEQ ID NO: 20616 - DNA, 592 bp, Homo sapiens
tgtgtggttaaagaggccaaaacataagactgatgaagggttaatttagagatgtgtagtgaataattaactttacccaaagggaagtttggcctttgttctttgctgctgttgggtaacctctaggctctgagtgtcctgcctgagaggaatatctttattctagaatttgtccacaggaaatctaacaatgtgacatgcaatggaagctttgaaccatgccctataagttcagagttccagatgaagtagagacaaaatgcattagtcttatctcttggctgaggatgggaactggagactaaagtttagccacagagacagtatgtgatcaataaaaattctgaacactgggctgagcgcggtggcctgtgatcccaacactttgggaggccgaggtgggcggatcacgaggtcaggagatcgagaccatcctggctaacacggtgaaaccccgtctctactaaaaatacaaaaaattagccgggcgtggtggcgggcacctgtggtcccagatactcggaaggctgaggcaggagaatggcgtgaacctgggaggcggagcttgcagtgagccgagatcgcgccactg

SEQ ID NO: 20617 - DNA, 526 bp, Homo sapiens
ttttatatcacagatgcctctgtaaaaataaatttacatgatgagaccctgtctctaaaaaataaaaataaataaaataaaaataagctattttaaaagttagttatttaaattgaagaatgtggacaagatatactaacagtttctctaggactgatcacccattattccatgaataatagaaatttctgataaggatgttgcttaatggagattttcctatgttatctctgcggttctagtgggtggcaaaggcagctatccgggtagggcactgtaaaggtgtggccttagtcatttacactaggacaataagagaccctccacaagtgtgtaactggataaagtgtaacggcttcccttgatgccttctccactcacactttattgcaaaagatcacgaggtcaggagatcgagaccacggtgaaaacccttctctactaaaaatacaaaaaatcagccgggcgtggtggtgggcgcctgtagtcccagctactcgggaggctgaggcaggagaatggcatg

SEQ ID NO: 20618 - DNA, 616 bp, Homo sapiens
aagctctctgagatcacaagatgaaaggcctgatggcagttcaaagccttccttttgattattattctagtcaacatattttggggggagaaaataggcttaagatcacagtggagtaaatttcataaagagcagagtacaagcaaaccacagaaatggacccaaacagagagtcatgttgccctgctaatggaagcactcaggtcttacgggggtagggagtgcgggtgtgttaagaatcaggccacctggagagtgatatttgctgtcttggattagtaaaataaaaatgcccattagtcttccacagctaccaaaagccagtgtgagtccaccttggccagttagttagggccagtgaccaagcacacctgcagcaggggttcagggccaaaggagacattgtgacgctcatggatgagtcaggaggtgcttgcttgggatgctgaaatcatgtctggaaaggtgaaaatgcagtgagtgacctggaactatcaaattctgagagatacaggttctgaagaggaggcatcagctgtcacatggcctttgttataggactttggtcatgaattatgagtcactagtacctgcatagatgtggtagctcaactga

SEQ ID NO: 20619 - DNA, 505 bp, Homo sapiens
ctctctatacaaggggggtgggggggaagggtgcgtggaagaaagcctgggtcaagagctctgagaacgctgctgccctggcatcattacagcaatgacaaaggagcagaaccttcataaagcaaattagaaaacttcccatgctaccaggtagttcttttatttgtaaatgaggagtggaataattaaagaaaaatcacaactgcattcttagaatgtgaatttgctgatttaccaatagatacttattgattatgcaatatgtaccaggcattattccaaggacaagttgtaagcaggacagataagctactttctcttatgagtcttgcattccaatatagaaacagagataataaagaaataatgggctgggtgcagtggctcatgcctgtaatcccagcactttgggaggccaaggtgtgtgggtcacctgaggtcaggagtttgagaccagcctgaccaatatgatgaaaccctgtctctactaaaaatacaaaaatca

SEQ ID NO: 20620 - DNA, 500 bp, Homo sapiens
accttacatcttgatatacccaatggtcaagaataaaaggtcaaattctaaatggcttccaaattgctgttaacatcaactgtatcaaagcacaatgttttaaatattaaaaacataatcttcatacaaatacacagcacaaactaaagttttgtataactcgtaaatgtgagaaaaagatacttgaccaagagagttcagaaaagaatttgagttaggcaaagccttcttagatatagaagatatgtatcttagaaacaacaaaaataaattggacttcatcaaaataaaaaacttacatgcttcaaaggacatcatcaagtaagtgaaatgacaatatacagaaagaaagaaaatgtgtttataaatcataagtcagataagggacttgtatctagaatatattaagaaaaatgttacaacttggaaataaaaagacaaacaacccaattaaaaagtgaacaaaggatctccatcaacgtagttccaaagaagacagc

SEQ ID NO: 20621 - DNA, 435 bp, Homo sapiens
ggctcacactggtggctttctagggtcacttcctcttacaggaggttgtcgtgaccgctgggaatgcagccaatgcatctcaaagggcagggcatcaccagggcccttggagaccctgtgtatctgtccccatcagcacggcactggtgtcacccacacacgggggctgcctgggctgggcccctctgaagccacagggacgtgagccggggggtgggtgacaccgggaggggacccctcagccctggtgagggcgtggcctgcagggtcggcttcccctggcctgtgggaccctcccatgagccctgactggggtaactcgactggccgcttgccagggtggccttcagctccaggcttttcatcctggacttctgcctttggtcactgttgctatagtgaatgttgaatggaaacaccatgtgaatgtacttt

SEQ ID NO: 20622 - DNA, 582 bp, Homo sapiens
gctggtcatgaactcctgggcttaagcaatcctctagcttcagcttcccaagtagctgggactacaggcacgtgctactgtgcctggccaattttttaattttttgtagagatgagatcttgctatgtttccccggcttgtctctaactcctggcctcaagtaatcctcctgccacagcctccccaaatgctggcattacaggtgtgagccacccatgcctggccttatgcacccttaagcacaacacaacactggccttgagatatatgcaggtttcttggtatggatacatacccaagctccatgtactgagctactgataaagaaattatggccaggtgcggggctcacacctgtaatcccagcactttgggaggccgaggcaggcagatcacgcggtcaggagatcaagaccatcctggctaacatggtgaaaccccgtctctactaaaaatacaaaaaaattagccgggcatggtggcgggcacctgtagtcccagctactcaggaggctgaggcaggagaatggcgtgaacctgggaggcggagcttgcagtgagccgagaccgcgccactgcact

SEQ ID NO: 20623 - DNA, 470 bp, Homo sapiens
acttgtgagggtggggtgagggactgagaagatgagctaccaggagtacaccagactatgagtaaagtgtgtataagttgaactaaaagcaaaagcaagagaagaaaaaaatggaaggttaaaacaagtggacaattagaggcaacctcatttctactaaagcaaagacctttggcaataaaaaggattttcacctcaggtataccaaattggctcatttataaattaaacatctttatttcattctcaagtatgcctcaaccttgcctgaccacaattgataaagaaaatatatggcaaaaggagacatctggtcaagagtcctaggcttccacaaagggatccttcagttacttagagacacttctgtcacatagagagggaaacactctaaaccagtattttataactatcaactgttgctacagaatggtgtgtgtatgtgtgtgtatgcacatgtgaacatgtga

SEQ ID NO: 20624 - DNA, 561 bp, Homo sapiens
cctctcttcagactgcctccttagctctcttctggatcactataacagcctaacaattgtatcaccttcagttttgctcttccttccatatgactaaataaatgaaaaatttgatcagacattaacgagtagggagagtgaattggtaataaaaggtccacttattttgtcttacagtgagagtggcttgctattatctcccattattgatgcatttctatctttgtcttcctgcatcccctgcagtttttgcttcataagaatgtttgcagtgttatttggtaccatacatattcatgttaggtctttattgtgaattacagattttagaattaaaaaggagatttgggccgggcacagtggctcacgcctgtaatcccaacactttgggaggccgaggtgggcagatcacctgaagtcaggagtttgagaccagcctgcccagcatggtgaaaccctgtctctactaaaaaaaaaataccaaaaattagccaagtgtggtgtcaggcgccataaccccagctactcaggaggttaaggcaggagaatcacttgaacctg

SEQ ID NO: 20625 - DNA, 483 bp, Homo sapiens
tacaatgactaatcttagacactcttttaactggtgacactcataacaaattgtcatcaacatcctcattgtcatggcaaattgtgagtttatctttgccagtgtcagatagttcatcaacttccttttagccagattgcaaaaagtcccatgactctatttccaactccaatgccatctgacatgagacaaaatcagagtagattaagatagtggtcttaactgaatgtagttaaagtatgctacttgtgcaaatttttcagaaatatatgaccatatgaacatgttgctgaggccttgccaggccttgaaaggggcctgtgcaagtgaggggcacagagattaagttttattagcttctcagaaattctacctctgaataagatttttgagtactttgcatgccaggatgaggagagtgaatctaagagatgtattgaatgaagaaggataaaggatgtaaagtaaagaatatagagtgct

SEQ ID NO: 20626 - DNA, 509 bp, Homo sapiens
ggatgttcatgcctcaactgtgtataatacataaaataatctcataatggttagtgagcctgacaatcttatggtttatgctagctcagtgaagcaaatcctatcctatggtttcattttctccaaaaatggccagccagctatatatagttattttggtacttttctgagcttaaacactaaatttgacttggtatactttctctctctctctttttaagaatgctaagtggttaaaattgaaaaatatgttgatatcaagttgaatgatatgtaatttcagcactactcaataatgttttgaaaaacagagcaaggagataatggttaggcctgacctagattaacatatggaaattggaggttgccattgtttctgttacaaaatgttgccagcataatttgtagtaatacaagttaggctacaaattaagaatggctaacaccaactacagtgtctttgcattgtctcagttcaattttgagtgtgacctataactataaaatct

SEQ ID NO: 20627 - DNA, 416 bp, Homo sapiens
gacattaccattgacaggaccaggtgttgcatcaagaaatctgggggttaaagtaaattttgattttaatgtgtgtgtgtgtgtgtgtgtgtgtgtgtgtaagaaaaattactttcatctccttaaaaaataataaagtggtaagtagagatgatctgtgcatgtgtgttatgtatatcaagtattaatcatagcatatataccagagtgcatgtgcttagtaaatgcttatacaaaagctgagtcatatatgatagcacctcaatcctagctttgttctttcaacaacgaaataacactatttctttgcttcattagctttctgagatgagtagtcttatacattaaatccctctaatagtccgaatggttttcaacagtttaatcactcattctattaaatgttaagcatacat

SEQ ID NO: 20628 - DNA, 536 bp, Homo sapiens
gacagcttccctgtgatttcgggtccaacccaaccaatcatcatttccccactcccaggtcccctaccttccaaattatccttgaaaaactctagtttccaaattttcaaggagactgatttgagtaataataaaactccagtctctttttagctagctctgagtgaattactctttctctattgcaattcccctgtcttaataaatgggctctgtctgggcagcaagcaaaatgaacccactgggtggttacatcttcattagcttagtcctggagattcttttcagcttgtaaccaagatctacctttcagtttaacttcctgctccatgttgcctgccctacagataggcacaaaagataccccatacatgggctcctggttcctttttgtctttctttttttccaggaattttaattgtacacactggctcctcctgatttgatctccttctgcttgggactagcaacttggatccagctcagctgccagaaatagcctcctctggtaaagttctgcaatgtttattgacat

SEQ ID NO: 20629 - DNA, 603 bp, Homo sapiens
tattgatcactgtgtcatccgagagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttagctgggatttgggttaaaaatcatggaaacccaattattagacggaatcatattcatcatggacgtgatgttggtgtgttcacatttgatcatggcatgggttactttgaaagttgcaatatacacagaaataggatagcaggctttgaagtaaaagcctatgctaaccctacagtgtttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggggaaattctatatttaatggaaatcaaggaggagtttacatctttggtgatggacgaggccttattgaaggaaatgacatttatggcaatgcattagcaggaa

SEQ ID NO: 20630 - DNA, 568 bp, Homo sapiens
cacccatcctgtgtactgctcatgggaatcacttacaccgctctgccctgggaccatgttccaataagccctgtcagcggttctcaaacttagtgccttgcaatccctggagggcttcttaaacacagattgctgggtcctacccaagagtttcatctgcatttttaccaagttcccaggtgacactgatgctacaggctgaggagccacactttgagaactactggtccaaagaaggctgctcagagctgcttctagtcagattcagtggcctgcaggtgaaggggtaggtgtatctggagccccacctgaagtctggcctggttttcagtgctctaaaagggatgatcaagactaaggattttaaagttaagaggaggctggactcagtggctcacaccagtaaacccagtgctttgggaggcccaggcaggaagatccttagaggccaggagttagaggttacagtgagttatgattgcaccacggcactccagcctgggcaaacagaacaagccccatctggccggatatggtggctcacgcctgtaaccccagaactttggga

SEQ ID NO: 20631 - DNA, 526 bp, Homo sapiens
agcattcgagataatggaagcgaagtgcctctctatagctattattgttcttcttaatattttcatgcatttggcaccaggcttcccaaaatgacaaagacaaagtctcggctcttagaaagctcaaatcagtcaggcagatgctaagataaaaaaaggaaagcaacagttgtcatttggtgtaaagggtacattgctaaaagtaagaagagggtgccatggaaaaaatgataagcagtacccaactcaaccaggtcactcttatatcacatggcagcatctcatgtctggtgtgcagttgtagggtccaagaaataagcaaccttatagctgaatcaaaaagaattcagggccaggcatggtgactcacatctataatcccagcactttgggaggctgaggcaggtggatcagttgaggtcaggagttagagaccagcctggctaatatggtaaaacctcgtctctactaaaaatacaaaaattatctgggtgtggtggcacacacttgttatcccagctactga

SEQ ID NO: 20632 - DNA, 545 bp, Homo sapiens
acgactaagggggagctgcattcctaccctaggagggtatagaagccgcacccaaagcacaggctcctgccttcagattttgctcagatcaccccaatggctccggtggctctaatttgtcctttcacatccctgagtccttgaacagaacttaactcctttctagcaccacttgcagaaggagaggttggttcttacaattgaaaggcactatcaacatttacagcattcaggccacagatgcaaaaaaatcatatggggctggggcacggtggctcatgcctgtaaccccagcactttgggaggccatggtggatggattgcttgaggtcaggagttcaaaaccagcctgcccaacgtggtgaaaccctgtcactactaaatatacaaaaattggttgggtgtgatggcgcacgcccgtagtcccagctacttgggaggctagggcacgagaactgcttgaatccggggggcagaggttgcagtgagctgagatggtgccactgcagtccaggctgggtgacagatcgtgctattgcacactg

SEQ ID NO: 20633 - DNA, 614 bp, Homo sapiens
aagtaagtagtcaagtgacaccttagcattctgatgaaaagagctttgacctcacagagcttctggaagggtctcagagacatccctgagggtcccttgactgcactttgacaaccacaggtctacatgatctgtatagccttttccagttttcacatcctatgattccaagagggaaaacaatcttccttgtaaagagagttaagtgacattgtgtccttgtctacactcagctgctaatatgctatgggacctcaggtatgtcacttaaaccttgtgttggagtttcctccttgttacatggaggtcacaagaataacaaactatgcatagatcacctaatttagtcattccaactgtgtggagagatagaggattaggatggactttatttcctaagtgagaaacgttggctttagtaaaagtgtagtggtttgtagggtcatccccctaaagatatcccgccccaccaaagatatccctaaagacatcctgctggtttcagtggctcatgcctgcaatcccagcattttgggaggctgaggcaggcggatcacttgagctcaggaattcgagaccagcctggccaacatggtgaaaccttatccgtaaaa

SEQ ID NO: 20634 - DNA, 568 bp, Homo sapiens
aagtaaacctaggctgggtcctggtgatcactatgttttattcttctttaatttttttttcctagctgggatttgaactatattcttctttttaaaatgatatataccattccttttctgctgtctttgttaatgccgttaaattggaagaattttcagtgatcagtgaaaagtctcagttaggaattattaaattaacacaggcttcttgcctacttgctgttggctgaaaatagtttaaaatacttaagtgaaaacttttctctaccacaggaaatttgctttctgagtgaatgaaggttttctataggaagataaatgttcaaccttctcttctgactcattataatcgtggaatggtaaaattcaagtaactgctgttttgtaatattgagtcaaacattcactttaaaaaaatgtaacaatactgtcttaataaaagcttagctgtatatgatcacgaggtcaggagatcgagaccatcccggctaaacggtgaaaccccgtctctactaaaaatacaaaaaattagccgggcgtggtggcgggcgcctgtagtcccagctac

SEQ ID NO: 20635 - DNA, 588 bp, Homo sapiens
gggctcagaggagagaactcccagagggtctgggccctccccattcagagcattgagccagaccaggcctgtcgtggtcacctgcatggaatcttctccctacttaggcactgccaggcggaccatcttctggatgagaagggcagggcacaatgtctcctccagagagagatggtacagtctctggagcagcaggtaatgccagggcggtggagggtaagggatagggatagtgcgcaaaaccttctgtccaccatgtgccagaaaccaagttcacctgggacgagggctggtataaaggaaggaagaggagcgggcactcccagggaagaccgtagcctgggcaaagatgtggcagagaagggccaggctgaggcctcatgtttgtgccatttcacagctggtgctggagaaggagaagctgagtgccatgcaggcccacctggctgggaaaatggcactgaccacggcttcatctgtggtgagcgaccccaggactggtggtggcagactcagactgctggggggcagggaggaggtctgcacggtgcagggaacctaacctcacattcaggtcctgagagctag

SEQ ID NO: 20636 - DNA, 604 bp, Homo sapiens
aatactcccatcaggggactgtgtcaggtatcaaaatatcccttcctgtatgtatcaaaactcatgctgaacaatgagttctgggttgcaaaagaggatttatttgttgcacctatccataagtctttgtccacaagttaaacaaaaacatacataagtgcagcgtgtgctgtttttaagtacattagtagacatactactgagaggccacactgcacggggttaggtaagtggactctggagccagattgctagttcaaagatgtgcccttccatttactaagtgactttaggcaaactccttctcttggtgtctcagtatcctcagctgtgaaatggggatgacattaagaccgatttcggccgggcatggtggctcaagcctgtagtcccagcactttgggaggccgaggcgggtggatcacgaggtcgggagattgagaccatcctgccgaacacggtgaaaccctgtctctactaaaaaacaagaacttagccgggcgtggtggcgggcacctgtagtcccaactacttgggaggctgaggcaggagaatgacgtgaacccgggaggcggagcttgcagtgagccgagatcacgccact

SEQ ID NO: 20637 - DNA, 604 bp, Homo sapiens
agaaggggagaactggcagaggagtgggagggagagaggggtcgaggcagaggagagagtcaaggtgaacgctaagatcctgccggacgactgggtgggtggtagtgctattaacagagacagggaatacaaagtaggcagcaggtttggcaggggaaacacatgcttacttcaaacctgtttaatgtagctgggtgttctccagaagacacccaggaggtaggggactttaaaataagaggtagaggctagggacatttagcacaggtggggacacacctatagatggagaatcaaaatggaccctatcggccaggtgaggtggctcacgcctgtaatcccatcaccttgggaggctgaggcaggtggatcatctggggtcaggagttcgagaccagcctggccaacatggcgaagcccgtctccactaaaaatacaaaaattagccagatgtggtggtgtgtacctgtaatcccatctactcagcaggctgaggcaggagaattgcttgaacccaggagatggaggttgcagtgagccaagatggcactgctgcactatagcctgggcaatagagtgagactcagtctcaaaaaaaaaaaaa

SEQ ID NO: 20638 - DNA, 563 bp, Homo sapiens
aacgtgtcatactctaggacccagctagtaccaaggccagcagaaatttgggtgtagtcctggctaaccccaaagcccatgatacttctcttattcttgcctcccactgcctctggaaggcagaatgcagtgtgtgaatgactcctgaaacccactcttctcactcaatattgggaacctaatttgttattctatcaggactatgcaaggaggtaaggcttcaaagaatcagtccaaaaacaaatttccaacatctcctatacatatgcagataattgaagactagaaggtaggcagtttgttgcacatctataaataacgttgaccctggtcaaccattttccacagacaactcttttggtgctgacttcaagtagtggttttgtgtagtcccatgttggtttctggatagttcaagatgagatggacaattttacagttaaggaggtaggggcagcggggggtggatatcactgtcttcctccttcctcagggcttgtcagaccagttggaaggggatgaacttgtcagttgctggaagcaattttcaggccctgtggact

SEQ ID NO: 20639 - DNA, 551 bp, Homo sapiens
gtagcttcttagaggttgagggggattcaaacttctaagagtttgatggagacttctttaagtacaggataggaaggcatcatacaatgggaatggtacacggatgcttgtgtggaggtggtggacaagtccagcggtcttggagcaatggccaagttcctctgtggacgaccctacaaccaatgcagagtgacatcactcacaaggggttgtagagtgcagtgattagagcagggactctggagtcaggctgatgggtcaaatcccagacttaccagcaccctggtggttacttaatctctgtgccttggctttcccacattcaaaaaggggctggtgggaatagtagcagagaaggaaaaacaattttccccttatccttctaagttctcgactggggtctctgcaacaaaagatagattagtaagagaaaaacaaacatgtttattaacatgttgcattgtgcatgtgacatatgagaatgcccaaaaatgagtacttcaaagaggtgatttagaactttggctaacacagcatcttctgcacagaac

SEQ ID NO: 20640 - DNA, 572 bp, Homo sapiens
ggctaagctctgagtaggggggggggctgtcattacatcttgataaaggaggaattgctctgctcccatttgacagatgcacaaattgacacgctccccacaggaccctataaaggagatacattatcactgacattttacagatgaagaaactgaagcccagcagagagatgaggcagcttgcaaaactagtaagaggtcataaaaccagtaaggagtggaggtggaattctaacccagatccccatggcccagtctgttaccagaaggagggcctggggtctaagttgtctattttgaacaaagaattggacaaaacgcacaaagtaacaaaggaacgaaacacaggaacgaagcagcgaaagcagggatctattaaagcaagaacgcactccacagggtgggagtggccccagcaagtggctcaagggcccagttacaaagttttctgggttttaagtactccttttggggttcctattggttactccttatctgaataaaggattcggtctgtggctaattacaggctgaggcgaactggtgccctatgcagatgaagggatagtccc

SEQ ID NO: 20641 - DNA, 587 bp, Homo sapiens
tcgttgttctgtgtgtgtgagacctccttgcgtcattttaccttggtcacttcaaatcctataaacaaacatttactgagatctcatgtgcagcgggcacggtgctgggggcttggtctcaaggctaaggaggtggaggagattgggcttccaaggaacaggtgaataaatagattcattgagttgtggtggttctatttcctcttcccaccaaaaccacatgcgggaaacatatttcctcaaagtctgtggtgtgggttttaagttttttcgtgttcttagatctaaaagaatcaggccgggcacagtggctcatgcctgtaatcccagcactttgggaggatgaggcgggcggatcacgaggtcaggagatagagagtatccttgctaacacggtgaaaccccgtctctactaaaaatacaaaaaacaaaaacaaaaatagccgggcgtggtgatgggcgcctgtagtcccagctactcaggaggctgaggcaggagaatggcgtgaactcgggaggcggagcttgcagtgagccgagatggcgccactgcactccagcctgggccacagagcgagactccgtct

SEQ ID NO: 20642 - DNA, 398 bp, Homo sapiens
caattaacaattattaattgttaacaacattaacaatactaataaccatccattaaaagaaagcaaaaacgaatttatttattcatgttacgataaagcccaagcattacatgttcattgctaaagaaattgtcctggctaggagcactcagtgttctcaatggacaggtcaggttcacgtcctgtatgcacatcctctgggaagaaaatagggtcagataccttgcagatgaatacttaaaataactaattaataaataaaaattgcagtggtcatatttctctggttcacaatgattaatttaacttattctccactaattaatgatgtccaaattgaaatgatgtcaatttaatttttttctatgaaaaatgaacaagttttcattgagtcagtc

SEQ ID NO: 20643 - DNA, 536 bp, Homo sapiens
ctaatatcagaaaccggggggagagccttcattctcagccacatcaagaagaaaatttgtgttttgaaaattccttttctcttataaaccttttgcctattaatgctgtagagcctacttcttcacagcaaatacccaacagagaaacatctgaagccaataaagagagaaggggaatgacatcaaagtcaagtgaatcaaatatatattcacctttaacctcttttatcactgctgattcagaactccatgacattattaaagatttggaggattgtttgatggtgggtctccacacttgtggtgatctggctccaaatactttgcgaatatttacctccaactctgaaatcaagggagtttgcagtgtgggttgttgctaccacctcttatctgaagaatttgaaaaccagcataaagaacgtactcaggaaaagtggggatttccaatgtgccactatttaaaggaagagagatggtgctgtggtcgtaatgccagaatgtcagcatgtttggcattggagcgggttgcagct

SEQ ID NO: 20644 - DNA, 559 bp, Homo sapiens
tgtggctttgtcattgactgggaggaagaatgctacagtgattttgataggaaattgggagattcagaggatattcctggttctgattgtgtctgtttggctcctcaggaagagggagagcctcacctgcccatgtggaatcagtccaggcctctgtttaccttgagcagtgtcattggggcttcctctgtggtgcttaggaaagtgccttaagacctgggtttgtctcactgatctcataaagcactggtgctggtgacagatgtcttctggtggaaacacattttctggttataatcatccctatttgttaaggatttttgtttcttttgaaaataggctttaaggctgggcgcggtggctcacgcctataatcctagcactttgggaggccgaggtaggcggatcacctgaggtcaggagctcaagaccagcctggccaacatggtaaaaccctgtctcttctaaaatacaaaaattagctgggcatgatggcgggtgcctgtaatcccagctacttgggaggctgagacgggagaatcacctgaatccgagagac

SEQ ID NO: 20645 - DNA, 436 bp, Homo sapiens
tcatatccggataaaagagaatgttcaatgaattgcaaaatctttagaggcagaaggcacccaagagacaggtcaccatgcagaacaattctaggtggctccattcacatttagcctatgtacgtggtggcccctgggattgtgcagtgcgcaacttacacaactgtgtgcagggattctgctgaatccagtcattaccacccttgcccttcctcacacacagatttaggatccttttacagaggaggcaagtgaggcccagaggaggaaagcaagttgttcaaagccacccagctaaccacagagccagactaaaatccagattattgaattttagagcaatattctttcctctctacaatgatgactggaaaggatattgtcacccaaaacagccacctccaccacagcaataagttcattcttaaaagtattt

SEQ ID NO: 20646 - DNA, 617 bp, Homo sapiens
acctgccaccatgcccagctaatttttgtagatttcttttaatacctaattttgacacgggtatggggaaaaagcataaaaatactgtagatgggagtgtaaaattgttaaatctttccaaatggcagtcgggtaacaagcatcaaaatgttaaatgtgaggaacatttaacccgacatttctactcttggaatttatgctaaggaagcaattagacaagcaagactttgagtatacaatagaaaaattggcaggtacctatatgtcatacaccagaatcttgatttgaacaaatggtggttcatccacatgatggaattgtgtgcaaatattttaagtgatatattttatacccaccagatggtcaaaaatgtagaagtctgaaggctgggtgcagtggctcacgcctgtaatcctaagactttgggaggctgaggtgggcagattgcctgagctcaggagttgaagaccagcctgggcaacatgatgaaaccccatctctacgaaaatacaaaaattagctgggcatggtggtgcgcgcctgtagtcccagctgcttgggagactgtggtgggagaaccacttgaacctgggaggcaaaggttgcagtaagccga

SEQ ID NO: 20647 - DNA, 440 bp, Homo sapiens
gcttacattttagcggagtgtgagcaataagagtaatcagtaagtaaattaggtagtaaattaaaatgcaataaatattgtagtctgcttcattaataggatgttgttaattaatgtatcatttcatagcaaaaattaatatggggtaaggagctaaaattttatatgaggtgactgaggtaggcttgagaaggtaccctgaagacctaaaggacaggaaggagtaagcccagcacagattcgaaggacaagatttctaagcaaaaggaacgagtgcagaggccctgaggctggggtgtacctatgattgaaagaaaagcaagaaggcaaatgtggttggattgaagttgtggggggcagatatcaggggatgaagttaggaaggacatggggaatgttggacagataatgtaaagtcttgtagaccaggggtccccaac

SEQ ID NO: 20648 - DNA, 581 bp, Homo sapiens
ctttcctcagccatagcagccatgttagtatcattttcctactccatggcagtgactggaaatggtttattctctgaaaagtttgaaaccaagaggcctcaagttaaaggatactaaatgcagaaggtggcatgggagagatgggacactaaaagggaatataaatgaacctttaaaatctgaattaaaggacctcagctcttagtataccagagaccaggtgtgtttactattcaggagctcagagaaacaaattcagtggctccaaaggagagactttaaggttctaaaatctgtgggtatcctaaagaaaagcctggcttatagtctgatcacttcaagctcagcagtcaacaaaccctgtcaatgtacataataagatcccccctaccccagtaaactttcttaaacctcagccttaaatggaaattgacagacaaggattatcagacatctgagaagagcatcctccatgaaattataaaaataaatcagaaatatacagacagaggaaacagagacataatcaggatcagaataaaaggtacctgatgcaggcttattcatacatacaataagta

SEQ ID NO: 20649 - DNA, 542 bp, Homo sapiens
gtctggggttcaggggccggggcgccagtactggggctccttcttcattatgccaaacaacaggagtggctgaaccccacaaccccagtggcacagagcttgggcccaggatcagctgtgactgcggacctgcacagcaaggaaaccaactcccactactgcacttcgagattgcacagagcacccctggctccaggacttggagtggggatagactgcagtagaagtggttttgatgtctaagggatgggcacacatggtgtgatgtgcagcttaagtctgaagcttggacatgcatggagcagctgccactccagggtctggggcatgcataggtttaagaaggtgctggcttgggttctgggcagcacaaaagttgcccttttttgggaaaggaatacacagcatctccctctctgagggttttacggtagcaataactattggttacctcagtggtgaaagctatcaatatcctctgcagaagaggccactggggaccatggtggcatctgccacatggctgatcctgagagcccctg

SEQ ID NO: 20650 - DNA, 473 bp, Homo sapiens
ttcaaaagagcacaaacaatgcagcatgatctggtatattttgcaacactgagaaggcagtattctaccccccttcattctgaggtggctcacaataagagatcttttaatttaaaaagcagaacagggaaatatcgtgctatgtgggtagcacaggtaactatagttcacaggttagaacaactacattcccacctggcgatttcagcctgcaagaatgggcaccaggtctctcattccttcatagatcaacttgagctttgagcatacaagagattgtgctgatagtgtgtcagtgccagaacacactcacagtcagtcggtgctaaacggcaagtctctaaatgagggaagcattcccacacatgggatcagactgacctaaatctctatttagattgctggtaatgggtatttgactattcagtttagttactgatgcagtctttctcatagttatttttaccatttat

SEQ ID NO: 20651 - DNA, 520 bp, Homo sapiens
gcataactattgatttgtctattttcccttttagctctatctgtgtgtgtgtgtgtgtgtgtggaaactgttgtttggtgcatgtacatttaaaattactatgtcaccttggtagattcgttcttttatcactatgtgatgtctctttttcttgctggtaattttcttttctctgaagtccactttatctgatattaatatagctactcgagtatctatatttttaagagataaggtctcacatgatttcaaatggttaatttaaataaaggaactgctttaagttgattatgtgatctacttctacaccaccaacccacaccattgcgtaagagactgtttatggaaaattatgtcatcccgcagtcgggaatggctaattgacttaatgaacagcaggacagtaacatggcttctttctgtgtatcctaaggaaagaatgcagcaaaataaagatttaatcttctttatttatttttatctagctatagcctcataataaaaaagaagtacaagatat

SEQ ID NO: 20652 - DNA, 93 bp, Homo sapiens
ttggatggttaataaaattcattctactttccatttattacaagctatacttgaaaaaatttattgagcactgaaatacatacttgatctact

SEQ ID NO: 20653 - DNA, 623 bp, Homo sapiens
aggaaggtgaatgtgggttggaaaactacatattggttactatgcgtagtacctgctgtaatatatccatgtaacaaacccacatatgtaacccctgtatctaaaataaaagttgaaaaagaaaaaaagatagtatttttactgattaaaaagaataatctaaaaagttagattcaatgggatttactttattcaatgaaataaaggttaatattagagaagattttattaaggagaaatgtatgaaattacaatcagattttacagaatttatagagataaagataaccagcttaaaacaactgactgtgataaataaacttatatttaaaaaatagcatttttcctctagagactgaaaatatacctaatataaaattgatttccaaaaattaattacattcatagccactagtaaagttacaaaacattttaaagtagaaattgaaaggaatataaagcaaataaataacacatgaatgaacaaacataccaataggcaaacttctgatgacttaactggaaatcatttcacttagattgtgtttggatcatagagaaacttcaaagttagaattttcagaccacttagacaatatcgatagtgactcttgaggacaact

SEQ ID NO: 20654 - DNA, 609 bp, Homo sapiens
gtatttggctgtagtatattaatgcactgttctgttgagggctcctgagaagtttccagatacctccctgaattttctatcagaaggagggaaacaggagaagcatttatctatctgctttcttcccccaattagtcaaaagttttccttgggggtattaactcactcacacttctgagctgtgcatgggttcagaccaaccaagttattaccagcttccttggtgatggaggaaacatgaggcagaaagtgaagtgagacaaatttccattccagctgcatctcaaatcaaagataccagtctcttctgcaatcctcttataggacttgccacagcattcgtatcttccatagacactttaagcaacatgggagccaaacagtttagctgtttacactgcagcctgggccatcaggaaagccctcccttgttctgggccttaatggggaagctttttaggtcattcagttaataaattaggcagcacacacctatacatgggataagttgcctacaaaatctaaaagataccctaaacattgaaggatggacaaggttcagcaaatcattgctgtagagcatggtagctcacacctgtaatcccaaca

SEQ ID NO: 20655 - DNA, 414 bp, Homo sapiens
tcaataaaatactattatgtcattccttaactttggaaactttttccttgttaaataataacaacaatagcaataataatttcagcaataatctgtggctatttttacttagcacatgcaactataggttggtgcaaaaataattggggtttttgccattactttcaatggcaaaaaccacaattacttttacactaacctaatacattgaaaggatccatgttgttggctcaaactgtcatcactatcagttagtgagtaactgagctgcctttaaggagttgaagggcagagaaaagtggaatgtatgtaacccaatccttccagtgaagctgacccacagagcgcatgcagttgccgtagttgaggccatatgtccaagtcttgtaactcaataactttgtcaagctaatt

SEQ ID NO: 20656 - DNA, 617 bp, Homo sapiens
cacccccaaggtcttccactctctcacacggactagtataatgttcaaggctccaggttgaaaagccaaagcccctaagataaaaaccatgagaactctaagaattggagactatgtgattcaactgagcaaaagaaggcccttgactcagcccaagatagacatttttgggagatctgtcatcaagtatcgaatttagaagtatcacttgaggtaatcaatctttctgaggatgcaaatttctttgtataggttgaaagaagaaacatctccaatgcacacagatacatcagttaacaaattaaaaacccatataaaaccctcactccatctgaagagtcctgagactgtatctagaaaagtgatcacatcagaagaatcttcaaatatcaacagcactttgaagagaaatataaaaacaactgctgtaattccttagtaattatagttatggaggaactaaatcctgcatctgtgagcagagaagagcctcagcctggattcttggagattagtcagggggaaaggcaaatccctctgcactccttccatccagaaagcaagatccctcgggaagttccacaaagcaagtatattcagtattcctaattacaggg

SEQ ID NO: 20657 - DNA, 509 bp, Homo sapiens
  misc_feature 154, 155: n = A,T,C or G
atcaccatgcctctgtacgctcatcttgccttatgtttctctagtgttatcactcatatatgcatccttcaacaatacagtgtagtgttgcctattatttgggcttttgaaaatcatagtatatgtattttttcatatctttgttgtgctcaanntcctattgtgtgtagctatagttcttttgcattgctgtatttactccattgtttgaatacaccataccatttatccccttgactagatacagacatgtgggtggtttccagtgttattaggaacagcgattgctgctatggtcattcttgtctgtatttcatggtacccttgtgccagcatttctctggggctcatacttaggagttggatgactgaggcatgaggatcaatttcttcttttacccaagagttatctagaacaaaaaaatttaaaaagcattttcaggtggcttttgaggtatttttagtgcatcaatatggtcagagaatatggcctgtgacctttcagtgag

SEQ ID NO: 20658 - DNA, 631 bp, Homo sapiens
tgtgaatattcccccacatttgtgtgcacacacatccacccttgttgggcatgcacctagggacgaaattgctgggctcggggtgcagcatggatttagcttcagtacatactgccgaatggttgcccaaaatgattgtaccactctcaccccccagcttcaggctatgacagttttgcctctccacacctggatgcagaggcgctggctcttttggaccgaggccccaagtcttgtggtcaattgcacttatgcatactcaatggctcatttgaatatgttaatattaaaaaggagatgtggctggggaagagggtcataccagtaatgtatatacataagtgaattacttttcagaccatcagaaagaataatgtgttttcagccaggtgcagtggctcacgcttgtaatcccagcactttgggaggccgaggtgggcgatcacttgaggtcaggagttcgagaccagccttgccaacatggtgaaaactgtctctattactaacaaaaaattagccaggcatggtggtgggtgcctataatcccagctactcgggagggtaaggcaggagaatcactggaagctgggaggcagatgttgcagtgagccgagatcatgccactgcactc

SEQ ID NO: 20659 - DNA, 568 bp, Homo sapiens
caaggatccttaaaaatgtaagacaggctatgaaagacgatatggaagagacgcaaagagatgaaatgttactggctttgaagatggaagaagtgggccgtgaggcaaagaaccctagaagccagaaagggcaaggaaacagattctttcctagaacctccagaaaggaacacagccctactgacaccttgattttagcccagcaaaacccattggttgcagcagcaataaaaactaataggctgtcccacctcactcatttctccctagaagtaaaggtggcaaaaccaacagtatttcatgctaagttcttccagggtagtttttaaagactccatggaggcccatttatgatctgggtatagctcctgggatagatttactcctaattgtccttgtcctgttacattagtgtgatcacacaactccttagctctatcttgccttactatgaaatatactaattttccctcaaaaaatgagttatctcatcctccaagagccatgttaccttaccatttaatttggatttgacctctaaatacagttaagttttaacagtacctac

SEQ ID NO: 20660 - DNA, 574 bp, Homo sapiens
ggtctctcatgcctgtaatcccagcactctgggaagccaaggcaggcagatcatttgaggtcaggagttcgagaccagcctggccaacgtggtgaaactccatctctactaaaaacacaaaaattagctgggtgtggtggtgcatgcctgtagtcccagctacatgggaggctgaggcaggagaatcacttgaacccgggcagtggtggttgcagtgagccgagatcacgccattgcactccaggctgggtaacagagctagactctgtctcaacaacaacaaaaaaaagaatcgggtcaatcattaacttgagggatcaggcaaagcataaaactcaaagggagactcctgcttttgaagagaatgattaaacatttcatttgaggtttgtatattaatcctcaggctcaattacaaatgacacattctttgaaacctttgctgccaggcatggtggtagacacctgtaatccctgctactcaggaggctgaggcaggagaatcgcttgaatccaggaggcagaagttgtagtgagccgagatcgcgccactgcactccagcctgggtgacag

SEQ ID NO: 20661 - DNA, 575 bp, Homo sapiens
cctccgcgccccacctgctccatggaaccccaggccacagctcggttcctttcaagaaaaaaaaagtgggaaataaataatgtaagcctcagcaaagacaagagggcgacctccttccaggcaccccgctggtttcaggcgcctctacctgcaagtgttggtataaaactgaacatgtcgcgggcatgctgggtttcctagtgccccagctggttccatattatggtcttttggggcacattttaaactgatgggcaaattccatccaggaaaaattcagagcccaaaggtcagcctgcaactacagaaccatagagttcctggccaggcgcagtggctcacgcctgtaatcccagcacttttggaggccaaggcgggcggatcacctgaggtcaggagttcgagaccagcctgaccgacagagtgaaaccccatcactactaaaaatacaaaaatgagccgagcgtggtggcatgcacctgtaataccagctacttgggaggcttaggcaggagaatagcttgaatctagaaggcggaggttgcagtgagctgagatcgtgccattgcacccca

SEQ ID NO: 20662 - DNA, 503 bp, Homo sapiens
ctaagaaaagatgttgaaatgacacacaaggaagacagatttgccactaggctggagaacgtgggtgaagcgtaagatgacccactctccagaacgaggaggcaccagggacagtggttctgtcatgttgaatgtcttgctatttattaacactatcattcctaggactggtgaaatgtgcgctttttatatggatatttaagtgtattccaggggcagcttcatcctttctcagtttcatgatttttagaagtagcaagaaggttgggcgcggtgtggatcacttgaggtcaggagttcaagaccagcctggccaacatggtgaaaccccatctctacaaaaatacaaaaaaattagctgagcgtggtggcacacgcctttaatcccagctacttgggaggctgagacaggagaatcccttgaacccaggaggcagaggttgcagtgagctgagatcatgccattgcactccagcctgggctacaaagtgagacttcatctc

SEQ ID NO: 20663 - DNA, 487 bp, Homo sapiens
aaatcccaagttctttgccactcaattctggtcaaaagctgagttgaaatgaacatctccttatgtggaagaatttctaagagcagacatggtccctccactcttccaatacatccctggattcgagtatgtccgcagatagctaggcacatagatgtaatcatcctgcccatccagcagaatgtcttttcccaaattatgctttggaatgatactacacctttaacctctattaagagtcgtggtggccagcttctgtggctcaggcctgtaataccagcactttgagaggccaagacaggaggattacttgagtccaggagtttgagaccagtgaaaaaattactcaggcactgggcatagtggcatgcacctacagtcccagctacttgggaagctgaggtgggaggatcaattgagcctgggaggtagaagccacagtgagctacgatggtgccactgcactccagcctgggcaacaaagtga

SEQ ID NO: 20664 - DNA, 576 bp, Homo sapiens
agtggctgttattttgatagagataaaaaaatagcggctaccatttattgagccctttgattgttccatgtctcaaataagtaattcatatgctttcatttaatccacacattcattcaacaaatatttattatgtgcttacaatgctgcagatattgttctaaatgctggagatacggcagtaaaccaaaaaagtggtggtggttgagcagacgtggggtctctggtcttgctccattattctatcctccacagagggttccttctaaacattaaatcagatggtctctctttgcacaaatgcctctactggcttcttgtctcattcagagtaaagctttcctgacaatagtgctaaaggttctggaggatctttagtctccctgtcctaccccattttctaccactctctcttttgcctggcccacttctgccatcataaccaccttgctttcctttgaatatgtcaagaatattcttgcttcaaaatttttatacttgctacttccctaccagaaatgctctttcactgaaagattctcagtcaaggttttgggtctctcctccactgtcagt

SEQ ID NO: 20665 - DNA, 621 bp, Homo sapiens
tcttctgtttaatattcagtttgttttatattcagtttgttattaaatattcagtttcttttatattcagtttgttaagttccaagtaaaatattattgagcatttaagtagaattcctttgagtctattgatcagtgtgaatggaataggtatccccatgataataagttctctagcccattaacatatatcacttgatttatttgcagcatctttaatgcctttcaataaaatgttttaactttatcaataaagatcttacaaatatgtattagatatttccttagtactctgtatttctcaggttaatgtagatcaaatcttttatacctgtgtgctgccagaatataaaaatgcaattgagttttgtgtgctgatttagtaggcaagcttgttaaaaatactttttgattctgaaaaattatctgcaggttatgaataattacaagttttttgatggtaaataatgaaaacttttggctgaattattcatgcttttaatttcatttttcttgccttattacacaagctaggaattctagaacaatggtgattataagcagtaatcaactaagcagacatcactgaattgtatttttataggaaataatttcaatatt

SEQ ID NO: 20666 - DNA, 588 bp, Homo sapiens
ggcgcatttaaattccaaataaaatgttaattgcctgacaagcccgttttccttgtcatttataaaaatgtatacatcctgaataaaaagtgggagaatacttaaaagagtaggagaagaatcttgattttaacaacaaataattgtcacgctacggagttcttggctttaattgctgtttttgtgatttgttttggaagttgggctgatgacaatcacagagcccagtgttaaaaactaataatgatatagtatttcattcgaaacatttttggatcttgatagtattgatttgaaagaacaagtttaggccactcattgttagtattagttccaagagcaccctctagtgcccacagctttgaagaaccctgtggaaggcagaaaagtcatttgtatgcagctcaagctcattgacacttgctttataggccaatattaagaacctttaaaaagtatatctgtcatcaaaagtgacctaaatgtgctcttaaacttaaaaatgttttaatattattctgtgatcaagcatactgaagaaatttaaaatgatctaagattttctttaagttataatagtgcattaac

SEQ ID NO: 20667 - DNA, 595 bp, Homo sapiens
aaaaactaccatgcattatgtgccagatattctcctaagcgcctttacatattttatatcttttgacttcagatttattaatgccacattacagaacactatagttcaaagagtttaagttatgttcccaacacctccagactagtgatagctaagtaagagacctaagtgcagaaagtgaaacttgatctgattgtcatgttgactgttctgtacattgttctaagggggaaatgtaggacaaggtacaaagtattataaggcaaatattggggcccatttctctctagaaaaaacaaaacaaggccaggcgcggtggctcacgcctgtaatcccagcactttgggaggccgaggcgggtggatcacgaggtcaggagatcgagaccatcctggctaacatggtgaaaccccatctctactaaaaatacaaaaaaattagccgggtgtggtggcgggcgcctgtagtcccagctactcaggaggctgaggcaggagaatggcgggaacccagaaggcagaggttgcagtgagccgagattgtgccactgcactccagcctgggcggctgaccaagactctgtctccaaaaaaaa

SEQ ID NO: 20668 - DNA, 571 bp, Homo sapiens
ataaaagttgtattacaaaagaaacctgctggaataaaatgtaatctttataaatacaaaaataaattttaaaagaggcagagaaggcacatcaaatgaacgcagtaactataacatcatacagacagtaattataccacacaataatacaacagaattgagacaaaaacagtcatatcaataaatcaataggcctaacctatctgttaaaagaaaaagattttcaaattgacttataaagtgaaattccatgcaatgctgtatatgacaggcacacttcaaatgcagtggttcaaaggactaaaaataaaagggtggacaaagatttatcaggcaaacaggaaaaataagaaagcaggggccaggcacagtggctcacgcctgtaatcccagaactttgggaggcagaggtgggtggatcacttgaggtcaggagttccagaccagcctggccaacgtggcgaaaccctgtctctactaaaaatacaaaagccgggcatggtggtgcgtagctgtaatcccagctactcaggaggctgaggctggagaactgcttgaacctgggaggcgc

SEQ ID NO: 20669 - DNA, 599 bp, Homo sapiens
aggctgggagtggtggctcacccctgtaatcccagcactttgggaggctgaggtgggcagatcacttgagcccaggagttcaagatcagcctaggcagcatggtaaaaccctgtctctacaaaaaaatgcaaaaacagttggatgtggtggggtacacctgtagtctcagctatgcaggaggctggggtgggagggttgcttgagcccaggagattgaagctgcagggagcaatgattgtgccattgcactctagcctgggcaacagagagactccacctccaaaataaatacatagataagaaacgtaaacctaaagagtaattagaagatgcctttaaagtgaaaagcaaaggtttctcctctaattctggcagtacattttagaagaatttctttttattaacattcagagctttcaagtgaatctgagtgatattcaggtagtataaataggaaaagactagtgcatcatgctaattgctatataagcattaccatctgtgagaccttgtcgatcagtgttgcttcgtctataaaaagcatagtcatatattccttgagtgggatagataaccacaaaaaaaaaaaaaaaaaaaa

SEQ ID NO: 20670 - DNA, 565 bp, Homo sapiens
catttttggggccaaggctgcatccacctaccttttcccccagcccccagtggaacactaaagcgcaaatggtatttgaaaagtcaagaaacataaaatcgatttctttctaaacagtattagcatttttacataatatgctcaatatatttttttcagcctccagatgcctcttcagatgaaataccttgaaatttaaagcaatgagttcacttgttcacccgacaaaagtaaagcagatgcaccattttccctgtgtgtccgagtctggggacactatgatgtgtgtactgatctcatccacgatcatggcttttgctgcttttttcatgccggtgtctcactgctgccagccccacctcacctggtgttccaggcttcctgggcatctgcttctcaaactccacgtgttcagatggcattcattcctgcgcgtgcatgcacacacacctacacgtgtgcacacatatgcatacacatgcacacagagacacacgcacacacacacatgcacacacacacgcacacacaggcatacacacatacatgcatatcttcttcaccc

SEQ ID NO: 20671 - DNA, 579 bp, Homo sapiens
acacgcaggcaggactgttcttctggtgcaatccctgggccttgtggtctgggatcatttcctgtggcctaaagtacttatttgcaagttgtaaggactgcccggtttctggaagcctggctgaatgcttccagctgggaatttaaccttctcagacccagctgtggatcttgagagctctcttagttcccaaccattttcctggagccccctgagataaattagttgtgtctgggtggggacaatggaggagtactggactgggatccagaagacctggcctgggcctggctctgacacccacttgctctgtgaccttgggcaagtcccttcacctctctgatcgcaaatcaaggcttagaaagtgtgcttccctgcctgagtttgcaagcccagcctcttgttttcactggagcatgaatggaattgaccttcccttacgcagctcctccacagctcaaggtcttgtgagaaccttggaattgttgcacatgagagctgattaggtaggcccctgaagatagtggaaaccacttcccccatcctccagcatcggatagatgggcaaactgaggcaca

SEQ ID NO: 20672 - DNA, 578 bp, Homo sapiens
cacatattgtacgtgtccatttaatttaaaatgtcaagaataggcaaatccataaacacagaaagtagatgagagtttacaagaactggacaaaggaggaatggatagcaactgctaattaatgagagatcctgtgtgatggcttgaaatcattctggagttggtgatgattgcacaaatatgtgaataaactaaaagccactaaattgtacactttacaaaatggtgaattgtatggtatgtgaatcatattttgattttttaaaaagagaagaaaataatttttgattactggtacagtagttcccctctccttgctcttatttccgaggatttctgggctgttggtggacttctgatcttctgtttaatattcagtttgttttatattcagtttgttattaaatattcagtttcttttatattcagtttgttaagttccaagtaaaatattattgagcatttaagtagaattcctttgagtctattgatcagtgtgaatggaataggtatccccatgataataagttctctagcccattaacatatatcacttgatttatttacagcatctttaa

SEQ ID NO: 20673 - DNA, 605 bp, Homo sapiens
agagggatagtagatcaatcttgaaagtataatattattctagaatttatacaaactgtgggtaacaaatactggatggatgttttttgagaagaggatgtaaagagaacaatttttacaactctacaaaatattaaatgagcttaaggaaagcataggttttcacactgaaaagtctgctgaattaataaaaattataaataacgaaaaagctctctaacacacacttgtgcaatttccatgcctcaaaaagaagataaaatcataaaagcatagagggagaaataattgaaagatcaccaacaaagagactgaaaatagagaaggtataactttctaattagcgccataaaaaaggatgttggatcagtgctttaaattgctgggggaatgttttaaaattgcatattcagagatatttttcatcagtgaaagcaaaacaaatgcattatcaaaatgttcaattgctaaggtgtttttcctcccataaaactgccatggaaactacttaagaaaaacctgcagtgaaacaatggagagggccgggcgcggtggctcatgcctgtaatcccagcactttgggacgccgaggtgggcggatcacg

SEQ ID NO: 20674 - DNA, 544 bp, Homo sapiens
aatccctttctgaaatgttttccttcttaagtgaattcctcttgggtatatcctggttatttttcactatttgatattctttgaaatgtgtatccttgcattgttgccaaagcacctccctctggaacaactacagaataaataacagcagtatatatagtaaattctttccttgtgctcacataaagttttgcacaacttcagttaacatgaacaagatattagatgttctgttacatattaaaatctaggaagtaataagagaaaaaaaaagcttttaaggctttgctttcatagctatggtagggcatgtttaagaattactcagattctataatgtttgcttgtgttacttcaccaagccacttgtttagtgttaactgaatgatgcaagcatttgtgtgatgcttcctgtccttgaaaggattcatctgaatgacagctaagccatcatgagaaagacagtcatctttggagatagactcacaaatcccaggtgtgaagaagatagcacagaccacagagaaactacctcaggtccctg

SEQ ID NO: 20675 - DNA, 551 bp, Homo sapiens
tagcccttcgctgctgctttggaaaatgtagaggggctgagaaacgaagctctgcatagcctctcctgctggctcctcagggcccctctgcaggctgcggtttggcctcagggagcactgagggtgcagaacgggggctctggagggctccaggcctggtgggagccagggcagccaggccatcccaggaagacagagcaggcaccgtagcctcatagtgaggtgttaaaataagaaaaccatcaaaacttgggctgagtcaggaggaattcagttgtgccttatacactcatgttccatttttactctaagacatgtactttaccaaatttgaaggtgagaatacaaattctcccccactgaataaaatatcagtaaacacaagtgaggctctgtgctctcaactgctggaggccacaagggagagtgagacctggtcctaaaggtgacttcgctctaagtttatttactgaatataaaatgttaatgtagttttcacagttgtctggccaggtgcagtggctcatacctataattccagcacttttgga

SEQ ID NO: 20676 - DNA, 605 bp, Homo sapiens
tagctgagattacacgtgtgctctaccatgtctggctacctttttttaaaaacttttttttagagatagggtctcactgtgttgtccaggctggtctcaaactactggcctcaagcagtccttctgcctcagcctcccaaagtgctgagaatacagacatgagccactgcacctggcctcaaatattcttattactcgggagtaaagcatctaatactttatttgacctgaggatttaaaaatagcttttatttaaagaatatgatgtgactcattaggagtttgttggctcatcagatcttaagttttactttttgaaatagacaggtttggtcatctgcaaagaaatgatttcagtcttacatatttacttagaaatcatggagatgttggataatttattagtcataaaataatttgccaaatttttaaatggctaacttgtacatatatatcatttaaaacatacacaatgcctgaacgttatgtttgcaactgggttatatttaattttatttttagtatcttctttcactttttccaatcctttgatgaatttaatccatttgcatttaaatgagattttctttgtatcacatagaatg

SEQ ID NO: 20677 - DNA, 623 bp, Homo sapiens
ttgtaaagtggaacaaaaatgtacacaaaacacataaaatacaaaataaaattttcacatatcataggttaaataagagacaaatcattttcggcctaaagcaaaatgatgtgtctcttcatgaaaaagattttatatctcattcaaaggaaataggaagaaagcccattgactgataatggtaaacatcataaagagacattttgataagtcactttacccttccctcattgaaaaggatagataatggtgtgtttgtgatgtcagaaaaagacaaggaactatagaaatgagggaataactaaataatatattattcttaaagaatactaattatgccacttagaggctgcctaaatattgtgatgttgtgctttttcaaacttttttattatattttaaattgtctttatctcaaacacaaaaataattgagacaatattaatgtcaacgtgtattcagcaaacacatacacactcatacacaaacccacacacactctgtacttgtatgattggaagttaacttggacttaagaaaacttctgttgcagtgagctgagattgcgccactgcactccagcctgggtgacagagtgagattccgtctccaaaaaaaaaaaa

SEQ ID NO: 20678 - DNA, 585 bp, Homo sapiens
agagaaaccttataaatgtcatgaatgtggcaaagtcttcactcaagtttcacatcttgcacgacatcagaaaattcacactggagagaaaccttacaaatgtaatgagtgtggcaaagtcttcactcagaattcacaccttgcaaatcatcagagaatccacactggagagaaaccttacaaatgccatgtgtgtggtaaggcctttaggcacagttcatggtttgtacagcatcagagaagtgttcatgagagagtccttacaaactgagtttggcaaactctatcataagttctagcagtaatcaacatccgagagtctatactagaaagaaatcatttaaatgtactatatgtggcacaggctgtatcgagacctaccaaatcactagacatcgaaacattcatctttggtgaaaccacacaaatggattgtgtgtgccaaggccaacaagtcaaaatatgttgaacctaatgatatgatgtgtataaagggtgcaaggacacgtggaaatgatctgtaatattcgggttattaaaaatgtaattggctgggcgcagtggctcacacctgtaatcctagca

SEQ ID NO: 20679 - DNA, 635 bp, Homo sapiens
gacaccgctggaggaggagaatggaggggccgccggggctgcaggctttggggaccgaggcttgcataccgtgctgggaagcagagtgggagcctgggttcaggggtggggagtccaagcctcctcacctgagactcagttggcccccatgccctggtttccaggcccctcacctgtacaggtggtccttgtcccccgaggctcctgaagactccccagaccctgtctacagagcggagacgcacaggtgggatgacaggcctgcactctgccccactgaggctgagatccccatagaccaggccgagcctggccctagtggctgccccagtccccaacatccgatctcacctgtggctggtggccataggatgggggaggggtgagaggctccgcagggcgctctttgggagcccctgaccttggcatgtgcgaggtggtagtctccaggtcagagagcagggcatctgcaggaagaggccatcagggagagagacaagggtcacggttagatcagaagataaggttcccagtgggcagtactggagaaggacagaagccagtattaagagaagaggtcacagggccagagccaggcagagcactgctcgaagggtagcaaggaatatttatga

SEQ ID NO: 20680 - DNA, 585 bp, Homo sapiens
gaggtgggcggaccacctgaggtcaggagtttgagaccagcctggccaacatggtgaaaccccgtctctattaaaaaaacaaaaattagtcaggtgtggtggcaggcacctgtaattctagctactcgggaggctgagtcaggagaatcacttgaacccaggaggtggaggttgcagtaagccaagattgtgccactacactccagcatgggtgacaacgtgagactctgtctcaaaaagaaaagaaaaagaaaactcatggagaagactccagactaaaaacactgttggttatcgggcaatagctggattaataatgaaagggtttgatttgcttcagtagcagctgtggatggcatcacatcagggactctctgtccaaattttcattttatttttcaggtttcaatataatatatatatgtgctttattcaagcccacacctgaaaatgcctttgtgtcaaattatgaaatatatgtattaggttttaatttacaattatagttttttctattagagaggagtaataatttatttttaaaaaaatggaagaaaaggaggaagcaattctttcctatagcct

SEQ ID NO: 20681 - DNA, 543 bp, Homo sapiens
tttcccgtgccctggacacccagctatatttgaggatggtcctttgcctccaggtgtgttgagaacttacaagactgaagatgttagctgaggccttgagctttctttcccctagctgtgtgaccctaagaaaactgcttaacctctctgggcctgcatttcctcaagagataaaagtactgccctacctatctgctaaggatttgaggcttagaacactggagggatgtcagtgtgcttgggggtaacccttaaggcatgtaccctcagtcactgtcatgccccttcctaattaagtgactttcttccaaaagggaatgcaaccacataatgtccctgcttaagcccctgagaggcatttagagttaaatccaaacaccggccaggcgcggttgagatcacctgaggtcgggagttcgagaccagcctgaccaacatggagacaccccatctctactaaaaacacaaagttagctgggcgtggtggtgcatgcctgtaatcccagctacttgggaggctgaggcaggagaattgcttgaatc

SEQ ID NO: 20682 - DNA, 457 bp, Homo sapiens
gttaaacataggtgaatcatgaaaacagacttcccttaactagtgagttttcctaatacaaagaaccaccaattaccctgaattcattcaacatcacttcccacacccacacatttttttaaaatagcaagactacaaaatagtttgagtatatttacagactctgtagtcagtaactggcttatgaagctttctatagaagaacttgtctccaatattgtttgtttggatacaaattgggtttggcatgggaattgggttgcaagcagcaaaataaaagagattcatatacctttacccatggcaaacagtgacacagcacaccgaaaacagggatatgaaattctttacagcagggtgcagtggctcgcacctataatcccagcactttgggaggctgaggaaagattgcttgagcccagaagtgagaccccaaaaaaaaaaaaaaaaaaaaaaa

SEQ ID NO: 20683 - DNA, 610 bp, Homo sapiens
tcttcagaaagctgtaaagatctctccaaaatgatgctaactgtagttattcaggaagcttttcagaaggatacataactcattatttacatgtatttttaaatattattattgatatagtcatacccccatattttgggggtgcatgtaatatttttcttacatgtatacaatgtgttattattaaatcagggtaattggcatatctatcacctaaagtatttatcttttctttgtgctgggaacattacaatttgatgctttttcttacagaagtgacttagttagaaaaagtggtatgaaatttgtccctgactgtagctgacatcctcagtggcaccatctggaccctgaaaggcactcagatcatctttacctcactggctaggtttgttacagatgatagcacttaccaggcttcctccttgcaggccaaggtcgggtctgtgcaatcactgatgcatcctgctataagtggattaatgtctctgtccagttgagaaagtcaacacatgaacttagaaagaaatctacctggttttctaagctagattctgttggctcatggaatttattcagagtagatatgaagctgtagggggcatgactg

SEQ ID NO: 20684 - DNA, 578 bp, Homo sapiens
cagaaaaacaacagaagacttagagtgagaagtcttggttttaaagcctggctccaggaccttggttgatcaccttaagcttcaaattcgtcttctgtgaaatgggggtacataatgagatgagaatctgtgtaaaccataaagatatacagcagagtcgatggaactgagtagagttgttttgtggatgagggaggagtgggtgggtaggggtgaagttaatatcagcttttgatgaaaaataaagcacaatggaatattatttgtccgtacaaaggaatgaaacacggacatattctacaacatagatgaatcccaaaagcattatgctaaatgaaacaagccagacacaaaaggtcatgttttgtatgattacatttacataaaatatctagaaatacttaaatcatagagacaaaaaacccagattacttattgctggaggctgaggggaggattaagtcactgcttaatggttccagggtttccttttgagataatgaaaatattatggaactagacaaagatgatagttgcacaacacgtcgaatgtactaaatggcactaaaatgcacacc

SEQ ID NO: 20685 - DNA, 533 bp, Homo sapiens
gcataactatagatttgtctattttcccttttagctctatctgtgtgtgtgtgtgtgtggtgggaaactgttgtttggggcatgtacattgaaaattactatgtcaccttggtagattcgttcttttatcactatgtggtgtctctttttcttgctggtaattttcttttctctgaagtccactttatctgatattagtatagctactcgagtatctatatttttaagagataaggtctcacatgatttcaaatggttaatttaaataaaggaactgctttaagttgattatgtgatctacttctacaccaccaacccacaccattgcgtaagagactgtttatggaaaattatgtcatcccgcaggcgggaatggctaattgacttaatgaacagcaggacagtaacatggcttctttctgtgtatcctaaggaaagaatgcagcaaaataaagatttaatcttctttatttatttttatctagctatagcctcataataaaaaagaagtacaagatataggtgccatggag

SEQ ID NO: 20686 - DNA, 578 bp, Homo sapiens
ggacaaaggaggtatttggaagttcatgtagctgaatttgtttgttgaaagaatttaaagagataatcatgggggaaaagaagcacttcaaatcgtgcctgggacgtattattcaatgattcataactcttctccattgaaaatatctctttaacccagaagggttaaacaaaaccagaaatctaggaaagcaatctcctactctaaccaaaatcgattccataggagttgaagaaatgtagttcacacagacatttcacatccatgtcaaagtcctctgcctcatagcctctcctagcccaaacgtcacattttcagtcaaagcagaaaacctatttcctttcaatttccctattgttctcttttcctaagttggctgcaaactttctcttattggcctgggaacagctgagcagcagctggaaagaccatggtaatcagcaatgggcaaatgaaagtcaggatgaagaaggatacaagaggattctggcaagtcagtgtcccagagtagtggaattgaccttagacaagtctcttgctagtgtgttagctcaaactgccagcattggcagtgtagc

SEQ ID NO: 20687 - DNA, 590 bp, Homo sapiens
tctaatacacacgcacacacacacacacacacacacacacacacacaatctctctctggcagagtatcctgtaagaaagctgtcatgcaatagtatagaagaaaaagcataggaaaagatagatctagatttgggtccagactgctacttaaaagctgtgtggacttagacaaatctcttagcttctgtttcttcatgtgtccaattggaataataaagcctacctcatgaagttattgagaagattaaatgagattattttatcagctaagattgcgctgtctttgcgtaacagaaattctttcacctagagtggcttagataataagggctttatgtgtgtcactaaaaaaaaaggatggacttaaaccacagaggattggaacagtggttctaaagtctttaaatattaggttcttaggattcttggccccccaaatccttagcatgtatatttcttccttgcgctctcaaggtgcatcacattctaggcatgaaaggatgaagggcaaaaggcacaggatgagtgccagctcaatctatcattggccacagtgggtcacattatcacacctagttgcagggagttt

SEQ ID NO: 20688 - DNA, 554 bp, Homo sapiens
gatttgtctttggtttttgagaagtctcatgacaatctagtcatctttccatataagttatttaatctttttccctgaaggccctaaagattctttgtctactagtcttatgaggatataatattaaggtgatcattaagagttagttttcaatgataccagcgagcactttaaatgtgtagatttaagtatttacacccagaaaggttttttccataattacaaatattagttctattctagtttctgttgtttttctttggaactccaattatatagatgttactccttctttggttatcttccaaaccaattactatctctgatttttttacattttcctttatcccattttcattcccttagtttttctcctacctttttccaatgtctcttattatgttgttaacttttttctttgtagacaactatttttatttttttctattcttcccccaaatttaattattatttcatttcttccagttattcatccactatgttctgagtttttgaactttcgtttcaaggtattctctaatatccccaaatgc

SEQ ID NO: 20689 - DNA, 629 bp, Homo sapiens
agccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagt

SEQ ID NO: 20690 - DNA, 610 bp, Homo sapiens
tctgatggcaaggagtcatcagatgcttaaggactgaacaacccagctacaggaagagcatatgcaaagggcctggggaaggaacatctctggcagtttccaggacccccagaaggtgatgctggtgtggctgaaatggagtgagtgcaggaagtgaaaggagatgaattcacagaggcaatgaaaacacattaaacatggcattgtaagccacaaacagtctttggtttttagggcgagtgacgtggaaagcgttggaaggttttgagctaagaagtatcatgatcacactagggctggtctgttgaaaatagactacagaaggtaagggcagaataagaaggagggcaccgcagtattccaggcgtgagtgatggtagcttgaggcagggtggtggctgtgccgactcagcatgacgggttagctttattcatcctggtccttcccatggtgactggtttgctacctctgggccttggccctggaagccattgaggtgtcagccaggtgtgagccagcatcactttctccatctgagttttctgagggagaaagcaggagagcaggtggctgaggagctcttcaagtgtgctcctaggggcactctta

SEQ ID NO: 20691 - DNA, 622 bp, Homo sapiens
ctataggagatgatcaggaatggtagaaagagcatgggttttggggtcagatgcttccaggtgtgaatctcccaaaccttagccctcttgcaagtcaatttctcagagcctccagttcccgatctgtgaaactagaccatagcatctcccttgtagagccatagtggggattagatgagctggtgcgtgactcacaaagttactggcatggcacaagcattacaaaaatggtatggtgcttcccctctttgcaattctccagcaagcatgtttgaccttcagtaacctacttttgctcaaaaactggttatcatttcacttcaccgccaggtggcagtatctgaggccattgggatttccttccagcagctaaagcaataatggaaaaacaacacaatattaaaacacagctagtaagtgataactggcttccaaaccagagctccaacataataaatattttctcatcaagcagaacctgccagcagtatttgatttgctttgtagctgggtgttacatgataaagtgactgagcagcctgctaattccggagccgcgctctcagtgaggaggagagaaatgatttatggagaaagcaaaaagcaatggtaggaatcatgc

SEQ ID NO: 20692 - DNA, 512 bp, Homo sapiens
gttaactcgttctttagaggtaaattttagatgcacgtggtccatccatgtaaagttgtcatgtcgttctgtatttttatattttttttttttaaatcttaaagcaaattattataaatcccttaagtaacctcacttgttacagatgtctcatgaatgtcagatccaaaacctagtatttgatcatgaaacttgatttaaaagcagcaatttcttcgccatttccggagaattacatgtttaggggaaaataaattaaactcagtgtattgcagaagcagaataattcttttcaaaaccttgtgtcagtcaagtagacaatcttcttgattggtaggcttttgtttggtccagctggactcaaaatatgaccatgaggctgggagtggtggcacacgcctgtaatcccagcactttgggaggccgaggtgggtagatcacgaggtcaggagatcaagactatcctggctaacacggtgaaaccctgactctactaaaaatacaaaaaaatt

SEQ ID NO: 20693 - DNA, 583 bp, Homo sapiens
atcacttgagggcaggagtttgagaccagcctggccaacatggtgaaatctcgtctctactaataatacaaaaattggccaggcatggtggcaggtgcctgtaatcccagctacttgagagtctgaggcatgagaatcacttgaacctgggaggcggaggttgcagtaagccaagattgcgccactgcacttcagcctgggtgatgaagtgagactccatatcaaaacaaaacaaaacaaaaaaaactcacaggtagcaagcctcagttgtcgccaactagactgacatccccataactggtttttccattgctggttactattacatgtatcttttgttgttacaactggcacacagagtttacaggaaacagtccttaagtccttaggggtggcccgagcttctgttgcctccttctagattgattataggctcagaaatgggagagacttgggccgggcatggtggcttatgcctgtaatcccagcactttgggaggctgaggaggacagatcacttgagctcaggagttcgagatcagcctgaccaacatggtaaaaccctgtctctactaaaaataca

SEQ ID NO: 20694 - DNA, 344 bp, Homo sapiens
gtatggtctcggctccctgcaacctccacctcccgggttcaagtaattctctgcctcagcctcccgagtagctgggattacaggcacccaccaccatgcccagctaatttttgtatttttagtagagacggggtttcaccatcttggccaggctggtcttcatctcctgacctcagatgatccacctgcctcggcctcccaaagtgctgggattacaggcgtgagccaccgcacctggccagggatgacagcaactttgtcaggtagcaagtgatgcagaaaagcagatgccatccacgctgaatggttgtgtggctactccattgtgtaggctggtgctacgc

SEQ ID NO: 20695 - DNA, 611 bp, Homo sapiens
acactgctggtgaggctgtgaggaaataagcactctactctcatacactgctggtaggaatgcaaaatagtataaccccacaggatgaggagtttgacagtacctaacaactctacatatgcatttatcctgaagatgtatctctccaacaatacaaagatacatgtacacaaagtttttcactgtaacatcatttgtaattgcaaaatattagatattacttaaatgttcaaacaggacattagtcgagaaaactatggtacatacacgatagcagttaagaatgaaagttactgattttagtttatgtaatttatcttttcacacagctactgacttgttaggagatacatacttattaagttgttcagacctaattacttaataaattaaactggccaggcatggttgctgacgcctgtaatcccagcactttgggaggctgaggcacatggctcacgaggtcaggagctcgagaccagcctggccagcatggtgaaaccccgtctctactaaaaatacaaaaaattagccaggcatggtgccgcgtgcctgtaatcccagctactcgggaggctgaggcaggagaattgcttgaacctgggaggtgg

SEQ ID NO: 20696 - DNA, 589 bp, Homo sapiens
attctccctgagcatcctttggaagcaaacaccttagatattgattttttaaagaaagaaagaaaagaaaaaagaatacattagccacaaccttttgtttcattttgagacaaggtcttgttctgtcacccaggctggagggcagtggcacaatcatagctcactacagcctcgaacttcttgcctcaagtgatcctcccacctcagcctctcaaagagttgggattacaggtgtaagccaccacacctggccaactataactattttggttacaataggggagaaaatattcaaactggcttaaccaaaaaacaaaacagagacatatattgaacattccagaggtaaagctggctagggtgcaactggatcctcatataataaaatcaggacttgagttcacaccgtctcttggctctgcctctttctctcttggctccattgtcaggcacactcttcaattgtgacaagatggctccaacagctccaggcccaaattctctgctctcagcaatcctctcaaaacacacaaacacacacacacacacacacacacacacacgctattcaccaacaattttttataaa

SEQ ID NO: 20697 - DNA, 622 bp, Homo sapiens
ggtgcttgcttccccttcactcttccaccatggttgtacatttcctgaggcctccccagccatgcttcttgaacaccctgtggaactttgagttatttaaacctcctttcctcataaattacctagtctcgggtagttctttataatagggtgagaatggactattacacttggaaaatagtgtgttatccagagagagaaactcatgttgtaaataaacgaaggaagggctgggagttaacatgatgagctttgataacaggttgttgctgacatagataaaattagtatacagagtagatctcttagaaagtcttcccagaagaaaaaacttctggccaggcacagtggctcacacctgtaatcccagcactttgggaggccgaggtgggtgaatcacctgaggtcaggagttcgagaccagtctggccaacatggtgaaaccccctctctactaaaaatgcaaaaattagctgggtgtggtggcaggcgcctgtaatcccagctacttgggaggctgaggcaggagaattgcttgaacccaggaggcagaggttgcagtgagctgagctcatgtcgttgcactccagcctgggcaacaagagtgaaactccatctcaaa

SEQ ID NO: 20698 - DNA, 538 bp, Homo sapiens
ttgtgccacgtgtactccagcttaggtgacagggtgagatgctgtctttaaaagaaaaaaaattaattaaaaaatagaaatacatacatatatagaaaaatgggaagtacaatcttagtccatatgactactttaaatgtatgatacatcacttgatgtactaagtatactatctaattaagtatgtctaattaataatagctgtctcaaagtaaactggaaaccaaaaggctactttgcccaatgtctgtttttaaaactactgacaaagaacatacagaaaggccgagcacgatggctcacacctgtgattacagcactttgggaggccaaggcgggtggatcccttgagctcaggaatttgagaccaggctgggcaatagggtgaaaccccgtctctactaaaattacaaaaattagccaggcgtagtggtgcatgtctgtaatctcagctactctggaggctgaggcacaagaatcacttgaacccaggaggcagaggttgcaatgagccgagactgcaccactgcactccagc

SEQ ID NO: 20699 - DNA, 478 bp, Homo sapiens
ttgttctctatgtccctccttgtgacaaatagagcaataaaattctaaaggcttttgatgttgaaagttgtttaagatttttttccccagtcttttggcttcatgtcacgtttgagtcctcattacaatcatagtcactagattagtcatcaagggtaccttgtatttttctccattaataaggtcatcatggtttattttaagaaccaaaggaaacctagtcagaggacataataataaacaatgtagttccctagcatcatttgattaaaagggccaatttgcattaaattaatgttttcatcttttctgccattcattttaattttaattttctcatgtttatgagaaaattatgtttactatgaattttatgatgtttatgtagttttcttttgttattttctcttttcattttcaagagtgttgaatttcatgaaagaggaaagaatcataaggaaaatgtggcaaaaaggat

SEQ ID NO: 20700 - DNA, 398 bp, Homo sapiens
accaaacagcaaaactgacaagtataaaattttgtagctgttacacactgtcacatgtttacaatgtgttcaatacatttgtttctaaattaatcatatttaaaatgtaggagaatataatcagattacttaatatattcaagatgaaattagtacacactaaaatagcacatctagtctcttgtctcggtccctcgatataatacaagcttcctgaaagggaagattattttgtctgctatgttcactattgaagctttagcacctagaacagtgtttggaaaattgcagtgttcaacaagtatttagtaaataaatgaatgcatgaaaagtagatgttcagtcaatgttcatcaaaagaaaaaagatattcagttgttattgagaacaacaacaac

SEQ ID NO: 20701 - DNA, 539 bp, Homo sapiens
acagaagggcttagtgattagcatgtatgtggtctttactttggagcctatgtcacaacattctgatgacacttaaaaacttcagtgatatgggatgctgctgaatttgtgttgtttggtggcatccagagaacttaccatttctgctcccagatcctcagccaacatgatggtaacaatattacagatcaatgtgactcccagaaaaatatccagataatcaagttcccttcagaatatattgtctaaagggtctaatatttagccataaaaatgaaggaagtttgaacatattctacaacatgaatgaatcttgaggacattgtcaaataaaataaaccaatcaccaaaaataaactattatatgattctacttatatgaggtaatcaaaatcatagaaacagaaagtagaatagtggttgccaagtgctggggataggagttaatcaggaattgttttgcaagacgaaacgttataaagattagttgcataaaaatgtgaatatatgtaacactactgaactatacatttatacat

SEQ ID NO: 20702 - DNA, 556 bp, Homo sapiens
ttgtgccacgtggctccagcttaagtgacagggtgagatgctgtctttaaaagaaaaaaaattaattaaaaaatagaaatacatacatatatagaaaaatgggaagtacaatcttagtccatatgactactttaaatgtatgatacatcacttgatgtactaagtatactatctaattaagtatgtctaattaataatagctgtctcaaagtaaactggaaaccaaaaggctactttgcccaatgtctgtttttaaaactactgacaaagaacatacagaaaggccgagcacgatggctcacacctgtgattacagcactttgggaggccaaggcgggtggatcccttgagctcaggaatttgagaccaggctgggcaatagggtgaaaccccgtctctactaaaattacaaaaattagccaggcgtagtggtgcatgtctgtaatctcagctactctggaggctgaggcacaagaatcacttgaacccaggaggcagaggttgcaatgagccgagactgcaccactgcactccagcctgggtaacagagaaagcc

SEQ ID NO: 20703 - DNA, 602 bp, Homo sapiens
tttactatcaggtgtggtactgtttggtgggaagtgtgaacttgaaggatgaaacccacatggaaatgaaatgattataacatattgagaaatcctgaaagcatttggttttaggaagataatgaacaacagcaaggagatactggaccttcactgctctcccactcccatccagcaatacccagttattactaaataatggagtacaagattgtatttctgcagtccatcaagttagaatctcattcttggttcagtattatggaatgggtcactgcgtcagatgagttgggacatccagtctacacacgtatctaagctagagatttcttcatagtattaaatgagataaaatgtttgataatcttgtatacactcagaacatagtaggatcccaatgtatgaatgtgatagtgagcaatatttcaataatatttgaagaaaaaagactgggtggattcaaacatgaatacaaagctgctgtttggaaaaatatacaacttcacagaaaacctcctatctcaaccaatacagctttatcatccctgtaatgcatgtcccaggaaaatgttgcaaggattttaagagtttccatgtggaaa

SEQ ID NO: 20704 - DNA, 631 bp, Homo sapiens
cctaaatcttggcattatttcctcatttttctgaaacacatatattcttataacatgatggttaaattatttagtccctgaatgcttaaaatatctctataatatttttttgttttggaaaaatttcaaatttatagaagagctgttaagaataagaatatacatgtaacacttgttaccctttacccagactcacttattaatattttactcaattttcttcagcattttctttttcttcctttctttctctcttgtggatgggtgaatgaatacgtgatagaagattagatagacaaataatcattttttctaaaatatttaaggataagttacataggccgggcgtggtggctcatgcctgtaatcccagcacttaggtaggctgaggtgggcagataacctgaggtcaggagtttgagaccagcctgaccaacatggtgaaactccatctctactaaaaatacaaaattagccaggtatggtggcgcatgcctgtaatctcagttactcgggaggctgaggcaggagaatcacttgaaccggggaggtggaggttgcggtgagccgagatcatgccattgcactccagcctgggcaaaaagagcgaaactctgtcccaaaaaaaaaa

SEQ ID NO: 20705 - DNA, 404 bp, Homo sapiens
ctggagtgcagtggcgtgatctcggctcactgcaacctccgcctccctggttcaagtgattctcctgcctcagcctcccgagtagctgggattacaggcatgtgccaccacgcccggctaattttgtatttttagtagagacggggtttctccatgttagtgatgctggtcttgaactcccaacctcagatgatccacctgcctcggcctcccagagtgctgagataacaggtgtgagccaccacacccggactaacacttgatatttttatcttttaaattttagcccttctgattggtccagggtaactctccaagtaaagaatcaacagggcatcatctcctttcttcatcttttataatctccaaggccactatgttcccacattctttccaaaactgac

SEQ ID NO: 20706 - DNA, 410 bp, Homo sapiens
cattactagtgctgaactattagagcatgggaatcaggggtgagatcttgcctcactaaactgcccaagatttctgcaatgttgttatacttcttttagatataaggaaatacaaagggcaccagaaaaaaaatcatagacttattacctcataaccttaagattttcattcatcaatctaagcatttgagaacttcatctcttttaatgtttatgagaatgttgtgttggaagtggggataagatagaattcatttaatgcttataaatcataaataataaacatcattaataagtgttttaagagtctaggaaaaaagactgcctcatatcactatgttatactaattatgctgtgaactggttgggcttttcctgtcaattttttctgtgaattttccaatgcattt

SEQ ID NO: 20707 - DNA, 617 bp, Homo sapiens
gacagactgactgcattgtgactgaactagagagggaaaaataaacttttctaactataaactatttttgtgccataaagaatcattcaactctaaaagggaaaaaccccaatttaaaaaatatcattattattttgaaaggtgttggactggatttaattcttttcattcccaaatattggcatcagttcagttttcatttcactgaatgcaattaaaaatgtggcaaatccttgatcaattttttacccttaaacagggtcagttctgaagttgttgtcacattttaatgggttcagactcagtttatgcaagagacaatcaaatgtttgcttttaaaagccctataaaaactaagagcttttaaccttttgaatgcgttaataaaatgctaatgacatcatggccaagaccacatttggaggtcccaaaaaattccaaatgactgttgtgaaaagaaaacagaattttaatcaaatgatctgttattttaatggccacttacaaaacaggagatttattgagaagcataaagtttgtttgcatgagtgaaggcaaagcttttaagaattaaccttctggttttccccctcagtttcttgcaacataatactacc

SEQ ID NO: 20708 - DNA, 572 bp, Homo sapiens
cagtctgatgggtactgattgtgaagtcaattgcttatcttctctcctctgttgctaggcttcatccacaccatgaaaagacaaagtttcaaactgtgtttaaaaacattccctgggccaggtgcggtggctcatgccagcaatttggaggccgaggcgggtggatcacttgagcccaggagttcgagaccagtctgggcaaatggtgaaaccccatccatacaaaaaaatacaaaaattagctgggcatggtgacacacacctgtagtcccagctactcaggaggctgaggtgggaggatcacttgagcctgggaggttgaggctgcagtgagtcaggatcatgtcactgcactctagcctggacgacagataagactctgtatcaaaaataaataaatagcccaggcgtggtggctcacacctgtaatcccagcactttgggaggccaaggcgggtacatcgcaaggtcaggagttcgagaccagcctggcccgatatggtgaaacctgtctactataaatacacaattagccaggtgtggtggtgtgcgcctgtagtcccagctacatg

SEQ ID NO: 20709 - DNA, 551 bp, Homo sapiens
ctcagtctccccttctgcagcaccaggggtaggcatgggagacctagagtgacctcagccagggcagagcacagactgatggtgaccaagtgcccagcaactgggagaggaggacctggcctctctggggggcactgccagaaggcctcggaggtgtgagctttggggtagtgtcgggacagccagcattccctgggctacaaagtcaatctggccgtggccaaggctttgtgactttgcatttattaattttccaacttgcttttgtagtcccaggctctaatagtcatatcctgaccgggcgcagtggctcacacatgtaatcccagcattttgggaggccgaggaaggcggatcacctgaggttgggagttcgagaccagcctgacaaacatggagaaactctgtgtctactaaaaatacaaaattagccgggcatggtggcgcatgcctgtaatcccagctacttcggaggctgaggcaggagaatcgcttgaacccgggaggcggaggttgcggtgagccaagatcgcaccattgcactctggcct

SEQ ID NO: 20710 - DNA, 548 bp, Homo sapiens
gactgccaaacatttgagatgtatgtttttaactctgctcaacacacttactctaaggaacagggccagacgtttaaagacatcattaaattatgttgagttgaatgaattataccatttgccatgccaacatggtgaggagatccacagtgtgtgctggtatactcaaagtaatacactattcttataaaacatatattttattcacacgtggatgtttgaaaagcaataaattatacagagactaggtgactgtttcttttgtccttttaaagtaacactataaagttatttttaaaaaaagaaaaagaagaggcagtgtggtacagaatgttcagtagaatctggaaaaaaattatttctagtccttgtttcattaactaacaacataaccttggacacacattattttctccctaaagcattgttctcctctatttctaataaggatatgtgacttatcaacatctttgatcactttcactttaaaatcatagtctaagaatgcatctttgacttagtaaaatattacagatacgttcactaat

SEQ ID NO: 20711 - DNA, 496 bp, Homo sapiens
ctaccaccttgggaagcagctgattcacaccttactctctgcaaatccctagccttccccgagcgactcctttctcaattggtggattcccttctattctactggggacaatagaatccaacagtggagagctttctcattcacccaccaccaaatccactaatctccttgaatctgtagtactgtatattcttagctttccttcttgtaactttgatgaactgtcaaaaaagtgacaaatacaaaagtgaaaaacgcttgagtgcatggatcccacttttctcctctacctatcattatatataactccctgtcattctgtttgtctttttggtctgagaatgagcacatgctgtcagattttttttttcttaaaacaaaacaggagacttctgcttctgggaagatgtaatagacatactttcccctattcctccagctaaatcaaatgaaaacctcttggcattacatataaaagaaatattgaaacattgaa

SEQ ID NO: 20712 - DNA, 568 bp, Homo sapiens
gcttcttacctctagccccacaagaaaactgccaatccagcctctcaaagaagctgctctgtatcccccgccctcagaggattacagattgacgtacggctgccgcctaggaaattcagaagcaaacggatcagctacttgcattagcaagtgagcactgctgctgggtaggaattggcctgtcccctccaaataaagaactcaggagtgttcccctgacagcaggatgggggcaagggagatctcagatcctgacccattggtcaagtagagcagacagcaggtgacagacttcaaaagagaagccagagggacagggcacagaggagggactaagcagccatcagtatacttcttggacaggtgcagtggctcatgcctggaatcccaacactttgggaggctcaggcaggaggatcgcctgaggtaaggagttcaagaccagcctggccaatatggtgaaactccatctctactaaaattacaaaaattagccgggcgtggtggtacgcacctgtaatcgcagctactcaggaggcttacacaggacaatcgcttgaacctggga

SEQ ID NO: 20713 - DNA, 473 bp, Homo sapiens
cactagaattaataagtcccaggagactccttctcctccctccagggagatggatccctgcctgggacccacttggcgtacagtggcctaagtcacatatggcaccttagccagaacaagtcccaaggtgccgttggactctgtcctcctgtgccatcacctgtggcaggaaagagtcatcccattcacatatgcacccagtcctcaagtgcctgtctaattggggacctgtggcaggaaagactcatcccattcacatatgcacccagtcctcaagtgcctgtctaattggggaaagggaatcaaaggcgtggagactaaaaaggtagaaaatttacatttggctttgaaaagagcacgtgaaattcctcccagatttgcttttctcactttagtattaaaaataaaagctggatgattgggtgcttatcagtgcacgggtgtaagtaagttacccattgtcacgaaaatac

SEQ ID NO: 20714 - DNA, 588 bp, Homo sapiens
tattttagtgcagatatggtttcctccaacagtttctcaaacacagcaagcatccttctttaataagtaacatgcaattacggttgtatcatttagaaaaaaatttctctatacgttctacattgttcacaccagcactctttaatggttttgttcaaacagcaccttttcagagacagcatccctgaccaccttagacgaataatattatttcttcaatgtctttattctaccctttttcccgcagttcttacaaccacttgaccttatttatttatttgctcaggtgtttattgtctttcttacccaataaaatgcaaagttcttgaggttaaggactattttactttcagatccatgtatattacataataggtactcagataatatttcatgaattaatggattaatccatctgaagttctgtctttacatgatcaaactccacttgcaaataaaaagtctgtcagaaagccaggaagcttctgctggcattggcttctgtaccatgcttctttgacagtgattagattcctgaaataaacattgacttagaaatattcttagtgtcagaaaatgaaaaaaaag

SEQ ID NO: 20715 - DNA, 620 bp, Homo sapiens
tatcttctttttacatattcacaaaaataaatgcaaaaaggtgcttctagtaagtttctgatttaaaataattagaatgctcataatttttaagttaaaacataaaaatgaagttgtttttccattccccagtctattccaaatcctcatctagaaaccctatactaatttgtatgagtgggttacttgaatctctttgataaatgtacgaaagaccattacttacgttttttgcttttgtaattgggttctttcctccttggtactgtcccagggaaataacccagaagaaatttccatgcttgctttctcaatgcatgactaagtccctgaagaaagcatacatattaaatacatgaatgaaaaagaatgtaatactgtaagttcacaaaacttgcatataaaaaggaaaactaatctttaagaggtagtttcatatatgtaaatagttcaattcagtgaatatcatcttgtttttttacttctagatccaaaagatgtaagcagctgccagaaagtttaaacagtgcacagaatacagtagactacagcagacagacagtgtgactggtgagtctaagcccaatcttacagaataaggcaaatgccactggaatgca

SEQ ID NO: 20716 - DNA, 128 bp, Homo sapiens
aacataaaataaaataaaacaaaataaaaagtaaaatttaaaaatgaaatttaaagattaaaagaatcaatggagacattaaagaataggattgacgatattgtgaaagttgggcagagagttatttt

SEQ ID NO: 20717 - DNA, 430 bp, Homo sapiens
  misc_feature 375: n = A,T,C or G
gacagaagggctgatccactccaagtgttctcagggcattgggtttttatcctatgacgatgttaatttgacaggcaatttgtctccacagcactcttctcttcctctcctatagtggggacagcatctagtgcttcaattaccttttcagtccagtcatttgcacagggcttcgatcactctgggccaagcactgtgctaagggttttacatgaattatctagttcagtccttacaaccactctatgagatgggttttatcttcatcattctcatcttacaaatgaggctcacagtagttaagtaagttatgcaaagatacccagccatcaagtatcagagcaagaattcaaacccaactttaactcacttcanaactcaagcttggctgggtgtgatggctcacacctgttaccccagcactttggga

SEQ ID NO: 20718 - DNA, 555 bp, Homo sapiens
catgaacattactaagcccctgaaaatgaagaacagttattgtttgcactgtgacaaagccaacattcctccttgcaaacagcactacttatttatgaacagcaactgacataagggtagcagttttctttttctgccctataaaatacttcatggatgattgcccttagaatatagtgaagtcccaggtcataatcatgagtccttctaaaaacagatttttggccaggcatggtggcttatgcctataatcccagcacttcggaagaccaaagtaggtggatgagttgagctcaggagttcaagaccagatggggcaacagggcaaaaccctatctctataaaatatcaaaaattagccaggcaaggtgtcatgagcctgtagtcctagctactcgggaggctgtagtaggagaaacactttagcctggcaagttgaggctgcagtgagccatgcgatcacaccattgcactttggactgggcaacagagtgagaccctgtctcataaattaaaaataataaaaaaaatgaaaataaataataaataaaagca

SEQ ID NO: 20719 - DNA, 545 bp, Homo sapiens
agtacacactcctcagttatgtagattaaacaagaaaacaccagtagtttagccacttgtcaagtttcaacttaacttattatcatcatgatatgaataggaatgtataaaattctcagtttggggtagatgacgctatggttaaaactggaattttgtaatataaagcaagggggaaacaggtataagataacaagtggcaaatgacacaggattaaagaaaaatgagaaaagaaggggagaataaatgaaaatcaaattgaagagggaggaactagaaaaactgtaggacaaagtgtaaatgaaagaaaatggagccgggcgcggcggctcacgcctgtaatcccagcactttggaaggccaaggcgtgcggatcacgaggtcaggagctcgagaccatcctggctaacacagtgaaaccccgtctctactaaaaatacaaaaaaattagccgggcgtggtggtgggcgcctgtagtcccagctactcaggaggctgaggcaggagaatggcgcgaacccgggaggcggagcttgcagtgagc

SEQ ID NO: 20720 - DNA, 594 bp, Homo sapiens
ccttaagagcgcacatttgccccttgcattcctcgaaagggcagagcatctgctaaaagaccaatctgtgaagcactaacttgacttctgcttatttaagctggactaatcttgtgactaattctatcactgtgctgtggctgcctaagcagggaaaatgtgctaatgtgaaggggttgaaatcccttattatggggaaaatatcccagcatgcctttcaactttacttttggcaaaagtgaagaagattcctttctaaatagcaaaaattcactttgctatacaagaactactgagggggataaacccttgactttaaacttgtcaaatatgtttcgcagctaacaaaggctaaacacacacacagacacgtacacagacacacacacacatagtcatgcctattgctgccattttatccttagaataacttaattataaagaccacaatacactaaacacttcctacaaaatgtcctagccagggactatgtgataaagatttccatatatgggcgtgtgactaaggactgagagaaaatatggcagagactgctggctacaaatcttggataattccctgagaaggaaaag

SEQ ID NO: 20721 - DNA, 642 bp, Homo sapiens
gaagatgtagcaaagctgttggacaaacattatccatgaaaacaggcatgggaggtgacactgaacctatttcttcagatcaataggaaagatctctggatgaagcctcaggaagagataagaaataagctaaacccatatagaaagcatatgaaagaaaaatttcaacttgtatgggaaaaggaaacctgtcttcatgtccctgagcatttctacaaagaaaccatgaaaaatgagtcaaagtattgaatgatgcatatactgctgaggctagactattcactgtggtcctggagggttctgatggaattggaaaaacagcccttttaagaaaagtgatgggccaggcgcagtggctcacgcctgtaatcccagcacttttggaggccaaggcaggcggatcacctgaggtcaggagttcaagaccagcctggccaacagggtgaaaccccgtctccactaaaaatacaaaaattagctgggcgtgctggtgcatgcctatatttccaactacttgggaggctgaggcaggagaatcactcgaacctgggaggtggaggttgcactgagctgagatcgcaccactgcactgcagcctgggcgacaaaacaagactcagtctctaaaaaaaaaaaaaaaaaa

SEQ ID NO: 20722 - DNA, 527 bp, Homo sapiens
ggaagtcagtcagacaggggtgggagcagagagtcctgcaaccaccatcaaccactaaccaccaaccaacttttacaaagctcgtacagtgtgtctagggctttatgggctgttaagggctgattcatgccttctccccaaattcacatgctgaagccctaatcccaagtacttaagaatgttactatgcttggagataggggctttaaataagtgactaacttaaaatgaggccattagggtgggccctaatccaatctgactggtgtctttgttagaagaggaaatttgaacacacaaaaagacaccagggatgcatacacccaggggggttggcggagggtaacaaaaaacaagaaaactagacagaaagtccaaacatcctgagagcatctataccatattatagcaatttgtaatattttatattcatagtatcagccaggaacatcaagcaaagtattgttttgttcagtataacttttcaaatgcaaataagtccatacaggttgagtatcactaatccg

SEQ ID NO: 20723 - DNA, 545 bp, Homo sapiens
atatcattgattttattttctttagaatttacattgtctagctgtaagaaagcacagcttaacttctgctggtttcaagttaggaaaaatatttaaaaagtgaaataattgaaaacgttattttggagacttgtgcaaagatacgctttaaaattcagtccaaattgtagaagataatataaattgaaaagcgagtggacaaggttaaaatctattaactgatgcactatagtttattttgaaataatatttctctctataattccccaattttattcgagacaaaatcatagtaggaccaatttatttgtaaaatcagttttaggcttatgagacttggcctggtttttttgtataagaggcagcaaaataatcatttaacatattagctctctttttttgttttctatttttttgtttgtacataggcaattttattcataaatggactttgctagaaattttttgtaaggagtcaaagggtagaatctttaaaatcttcaagcccagtcaatattttatctgtgccaccagatagctatgtg

SEQ ID NO: 20724 - DNA, 498 bp, Homo sapiens
gctccagcagagagcccgggcttgttgtcatggcaacggcacggttgcaagacagagggttctagtgcacagacttcctgagacttagactcccaatggggatgtcataacttctgctgcctcctattgaccaaagcaaatcacatgatcagcttagattcaagaggatggaaacagaccccatcccttggtgggagttgctacacagtcagaaagcaaatggtttagaaggcctggatttagaaagggggctagagaaacagggttaagtttgccatcagtctagaggattactgagcatttccttttgaatgtaagaatctgaacttaaaatgtttgagtaatctggctaaaatgtttgagtaatctgggccgagagtggtggctcacgcctcggcctcccaaagtgctgggattacaggcatgaaccaccacgcccggcctccttctttatttttttatcttttattttattttacttttttaaatagagatggg

SEQ ID NO: 20725 - DNA, 621 bp, Homo sapiens
ctatgtttccctattagctttttagtctcatgaaggcatttgtgttctaccttgagcacctggaacagtgtctttcatataagaagtgctccatacctgtttactggttgaataaaatagatgtagaagcagagaagatacttgggctatgattcttgactatccagataaatgctcaaaatttgcttctgcaggacactgtttttcagaggtagtgtaatattaggctctagtggtacatgctgggatgattgctagccacagagcctcttcctcaaaaattgccactgtttctcaaatatcacagaatcagaggcaattaaaaacaacagaagaaggccaggcatggtggctcatgcctgtaatcccactataatcccaacagtttgggaggccaaagtgggaggattacttcagcccaggagtttgagaccaacctgggcaacatagcaagacctcgtcttcacaaaaaatttaaaaattgtctgggaatggtggagtaggcctggagtctcagctattcagaaggctgaggtgggaggatcactttagcctgggaagtcgaggctatggttaagtcataatcatgccattgcactccagcctgtgtgatagagtaag

SEQ ID NO: 20726 - DNA, 555 bp, Homo sapiens
ggatagtaagcagggggactaaaagtcacatggccagctagaggggattagaaaaccaaggctaagaatggccaagtgactgtcccagggccacccaaataagaagcagcagagtgaggactgcccagattctctgtcagatctccgtgcctaacaaagtgcctggccaattacctctctgcactgagagaggtatgcattcaataaatactcctctgaatgaattaagtaaacaaacgagtgaatgacttactgaatgactattgaaactcaattctgccaaggttttgtcttagcaatgctaatttacaggtaagacctgttggcataattaagttggaaagtgctgtttgcaaagtaaccctggaagtgtcatctttcacagctctcatgagaacaaatcatcactggcagccatgtcaacacaaataagccaaaggaaccttgtcaacactgacggtccccattgttatatttaaaaaaaggcaccagagaggctggccaggctacactctgagctggagccaaaaagctattgcagtctcctgcattgag

SEQ ID NO: 20727 - DNA, 564 bp, Homo sapiens
ggaggcatcctgttcctgaggatctaagtggtctttattattcctcaggagcctcctgacatctatgaggcccagaacaagagtacagatggattctcacatgtcctagtcaagattatttaaataaaactgaaatctttaagttactttgaaaaatttagttaaattttatttaatatttatgagtctatttataattctataatgcccagttataattttatggagcctatccttgaaatttcagaatagatgaaatgagtatgcagatcactgaccatcatgtttatcatgataaaacatatgaataagtaaatactttgaaaaatatttcatgctaggaaaggtaaagtaggccaggtgtggtggctcatgcctataatcccagcactttgagaggccgagacaggcagatcacttgaagtcaggtactcaagatcagcctggaccatatggcgaagccccatctctactaaaaataaaaaaattagctgggcgtggtggcgaacacctgtaatcccagctacatgggagactgacacaagagaattgcttgaacccatg

SEQ ID NO: 20728 - DNA, 576 bp, Homo sapiens
aatatctgtgaaatcagttttgagatgttaagtttttctcctaatttaaattaaatgaacttgtttcattcaaatatgtatgtgtgtgaaaatttggggagaattttttaatgttcatttgcttatcaaattatcttgcatatgtgacagtaccaaagtttgggaaacaataccaatatggtacatattattttattaaaagtgcttgctgagggtgggggatagagtgggtgataaaggggatggaatttccgccattttgcctatgccttctacctcactagcagtgtttgacattcctattatgggtgcttgcactgcacagtatgtataagacctcaggcttcacaacagattttacccacatctaggacagggcccccaatacatgctcaaatgtgtcaatcccaacatttttatagtgccacatagttcacagttgggtaggtaaaaccaccattttacagatgaggaaactaaggctcactttctcaatgtcacactgctagtatatagcagaactggtacttcggtctaagtttctagtatctctacatcactatgcttcatcagtct

SEQ ID NO: 20729 - DNA, 627 bp, Homo sapiens
ataatttgcttacacttcatggtgtttattgtcaactttaatttttatttccagcatggttctcaatacttcatcttaattgctactgatgaagcaaatgacagagaggctaacttgactttgtgtcaccaacaggctctgtcagaattgtaaagcccactgacatggttagagagatcgttgaggcaggaaattaatgaagatattcaggacctaaattcaacacttgactaaatggacctaacagaaatctacagaatattccacccattaataacaaatacatatatattattctcatcagcacatggcacatactctaggatcaatcacttgcttggccataagaaaattctcaacaaacttcaagaaatgaaattacaccaatcacactcttggaccacagtgcaataaactagaaatgaataccaagaagatctctcaaaaccatacaattacgtgaatgttaaacaacctgctcttgaatgacttttgggtaaagaatgaaataaaggcagatatcaaaaaaatttttgaaactaataagaacaaagataaaatataccagaatctctggaacacagctaaaagaatgttaaacgggaagtttatagtgctaaacacctg

SEQ ID NO: 20730 - DNA, 548 bp, Homo sapiens
gatcatcattttaaagtatattaaacataagctaacttttttttggtgagtcagtcaccaatattatttgttggttattagtttttatactgtttattatagcatactgtgggaatattgagatacatgagtcactgtttgcagtaattgaactgttctttttcggtttgctgttgtctaatttttatctcctctctgctgtcaattgtgatttctcacttttgttagtcttgtaatacctcctcccttgttctaaaatttttgctataaataagatcccaagattgttataaatccccgtcgggcccagcgtggtggctcaggcctgtgatcccagcactttgggaggctgaggcgggcggatcacttcaggccaggagttccagaccaacgtgggcaacatggtgaaaccctgtctctactaaaaataccaaaattagctgggcatgatggtgtctgcctgtaatcgtagctactcgggaggctgaggcacaagaattgcttgaacctgggaggcagaggctgcagtgagccgagattgcaccact

SEQ ID NO: 20731 - DNA, 576 bp, Homo sapiens
gcagactctgcaggacagtccctgggtgactggcggagaaaagagagaaactgaagaaatgaagaaaacgttgcctttaacaatgacaaatgggaaggtgggcgaagtccactgggctgaggtctggccagggaagcaggacagttattttcagatcaactgttcccctttgccaacaaattcatcttgtaaatcaacacagcttcacaaaggacagcactgtcatcttgcaaagtgactctcaaattaatattcacaaaatgtgaatgctaccagaggtaaatgaagagcaaactggagggtgggtttgacagcccagttgaaattggtacgacaacattaatttatagtatcttaacttagctactgccaactctgccccataagtcattgccttagggggaaaaaaagacctgatgtgcttaaagcaattaaagcttaattgatattgaacctcctctccagataaagtcagaaattagacagatttttggcttctaggagaacaattatcatttaaacaaaataagaaaacaattttctcccaaaactatctctttaagtatctccatttag

SEQ ID NO: 20732 - DNA, 397 bp, Homo sapiens
catgttgaaaaaaaagggtttttacagatttcaaaatctttcagtgaaatcagtacttcataaagtattctagacatgcatactctcaagtaactgcattattcaataatgagtaagtgactattttgcaaaatatatagtactttttgaactctgcactaatatggcaaattattattctaagtttataaagcaacaatgccacttcatggctttattacacctttaagacaaaacgcttactctactcaaaatttacacagtattaacttcagaacagcatatttatatatttcaaaaacaatcttttggtctctgatttactacaaaatatagccccagatacagacataaaacagagcaaacctttaatttccaaaatttgagtatcagctag

SEQ ID NO: 20733 - DNA, 558 bp, Homo sapiens
cgagggccgctcctccacagtccccctgtggctgtggcaacagccaagactgctgctgctgctgctgctgtgaaggagcccttctttggccaaagctagggaaggaatttcaggggaacttagaaaagtagatcatacatgccagcgctgaagcagaacttaagatcagcaagtcaccacctgcctgattttgaatcctacctatgctatctttcacaagcagacatgcaagctgtgcttgaatagcctgcattagaccggatactctgaaaaacagatgtcaaggcaaaattaaatgtgcagagattttggctgggcacaatggctcacttctggatcacctgaggtcaggagtttgagaccagcctggccaacatggtgaaaccccgtctctactaaaaatacaaaaattagccaggcatggtggcaggtgcctgtattcccagctactcaggaggctgaggcaggagaattacttgaacccgggaggcagaagttgcagtgagccaagatcgtgccactgcactccagcttgggtgacagaacgagactccatgc

SEQ ID NO: 20734 - DNA, 552 bp, Homo sapiens
tatttcaaagtaaataatttcagctgtgtgagctgcaagtaggccaaagaaaacaagacagtttgttcttaaagttaaactaatggggaaaaaaaacaggacagggaggtatctcaagttcatttgagccatttttaaaattttggtagctggtttctgtttttcttctttttaaaatagtaacaacttaggattttgtgtgccaccagcttccattccatttcataaaagcttaatctagcaagaattggtgagccctagtagaagttagaaagaaatgttgaagtgtgtatgtgtgtgtgtgtgtgtgtgtgtgtgttggcatcagaatcaccttggacactttttaaaacaatgcccttggctgggcgcggtggctcagatcacgaggtcaggagatcgagaccatcctggctaatgctatgaaaccccgtctctactaaaaatacaaaaaaattagccaggcttggtagtgggctcctgtagtcccagctactggggaggctgaggtagaattgcatgaacccgggatgcggagcttgcagtgagctg

SEQ ID NO: 20735 - DNA, 597 bp, Homo sapiens
ataactcatgtgataaaggccactattagttattccattgaacagcaggagctggagcatgaaaagggtaacgatcagttcaagttcattcagaaatccttgactctactgtctcagcctcactctgaaatacatttttataggccaaggatcagcaaacttcaaccagcaatccaaatctacctccatgcctatctttataaataaagttttattagaacacagctatacccagttgtttacatattatctgtggctgctttccacactgtgtcagagtcgagtggctacaatagagactgtatgacccacaaaacctaaattatttgctctctggacctttacataaaataatttgtgacctctaatctagaccaccaatagttttgtttcttcctgcccttcttaaaattctgatcacaggccgggcgcggtggctcaagcctgtaatcccagcactttgggaggacgaggcgggcggatcacaaggtcaggagatggagaccatcctggctaacatggtgaaaccccgtctctactaaaaatacaaaaaattagccgggcttggtggcgggcgcctgtagtcccagctactcg

SEQ ID NO: 20736 - DNA, 451 bp, Homo sapiens
agggaagtagaaagaaaaaaaacgcccatcgccaaatgccatctgacctcatttccttctactccttcttttctatgcacatttagatacttgtgatcgtgttatacacctacgttttttgtaacttgtagcaaaagcatgtttttgagccagtatgtggaagctgtgagccccgtgtgggctggggaagagaagagggagaaacagatgtggcctagccagcctctagccaggctccctcagatcccagcctccagagccgccatgggtaccacgcgtctccaaaggccccaggcctccaggactgctgcccctccagcagattcctcgcacatttagctcaaagatttggtgcccatatccagctagcagaatgacaggaactggcttttccttctttttaggctttctagagtggcatggttaagggagggtgtaggagtaggggaaa

SEQ ID NO: 20737 - DNA, 580 bp, Homo sapiens
agaggtatataaaatgaataaaatacagactctgcccttaaggagtttaaaaactagtaggggagagacatgaaaataaatagccatgatacagaatgaaatgttaagtgcccccagagaggtgaaagcatactccaggaaaatgctgatagatgcaattgcttctacagaaggtaaccaggtaaattgacattggttgggactttaaatattgaatagtgttttattctttttcagaacagtcattgttttggcacttttaaaaataatgaaaggcaaatcatatttccatatatgataagtaacactaaaatactcacatttcttaaaatgtcaataatggaagggatctcaaagatcatctagtcctatatgttattaatatcaagacatgaataaaatattttggaaattgaagtatgcttacaacaaaacctcaactatccataatcatgtaataattctgtaagagttctaaccttgacaaatacatttgtctgcttcctagtctatttgttctgggcagcaacttgactttttacagttcatttggagagaaatctttagcaaactacttggg

SEQ ID NO: 20738 - DNA, 428 bp, Homo sapiens
tagactttttaggaaaataaagattgcacccgaatcagatgattcaagaaataggatttagtaaaatcaaaagtatattcaccaagaggtttttcttctaatatgacttatgttcacacatgttgaaaacagaaggactcgccaggcgcaggggatcacgcctgtaatcccagcactttaggaggccgaagcgggtggatcacgaggtcaggaaatcgagaccatcctggcaaacacggtgaaacccagtctctactaaaaaaatacaaaaaattagcccggcgtggtggcaggcgcctatagtcccagctacttgggaggctgaggcagaagaatggcgtgaacccaggaggcggagcttgcagtcagccgagatggcgccacggcactccagcctgggcgacagagagagactccgactccgtctc

SEQ ID NO: 20739 - DNA, 561 bp, Homo sapiens
agcctatttatatttcactggatagttttaaagctagtccttataatacataaatggcatttttacattgatttccatagtgatcatcttactcttgaacaccccactatgacttttctaaacaggaagtcagtgctatttgaaattatagatcagggtatatgaacattagaatcatgggttattgagaaagtttcaataatcccaaaagccttagctaatttacagatatattgtatttttatctgtttctaattcaaagggttagtttcccagtaatcatatgcatttttaaagctctgtggactgtgtaaaaagttgaagttgaggccaagtgtggtggctcatgcctgtaatcccagcactttgggaggccgaggtgggtggatcacttgaggtcaggatttcaagaccagcttggccatcatggcaaaaccctgactctactaaaaaatgcaaaaattagcctggtgtggtggtgcacacatgtaatcccagctattcaggaggctgaggcatgagagtaacttgaacctgggagtcggaagttgcagtgaacag

SEQ ID NO: 20740 - DNA, 644 bp, Homo sapiens
ccctcatgagctgttactgctgacccagactcgtgctaaactttgcttgaatgacaaaccaactttgttgacataaatccctagattgggggattaattgttacagcaattactctaggttatctggacaagtacgccatagataaagccctgccttgtaccagaacattaaacagagatacaaaatggcccaaggaaaaggcatatgcgtgtgtcccccagggaagccacaggctcaatctatcagtttttattaatctccaggttattatattagctgtcattttcttaattaagtctactttatcaagttctccctacatttatttaaatctatttattctgaaattaaaatacttgaaatccaatagtaagttttagtatactaattcaaaaattaaaggtctgagtggacttattactaaaacctatgtatttgtgagcgtcttataaaaatcaacagtaatttaatgtctgccagagcaaaagtcaacattctttagaagaagataacagaatccagagtgtctacaaaatataattcacagtgcctggtatacaaacagaaattactagacattctctaaagataaaaaagtgaatgacccggatgttgaattagcagacaaagacattaaaacagc

SEQ ID NO: 20741 - DNA, 332 bp, Homo sapiens
cacactgttttctcccatttcatcctcttggcaagagaactctcctagaaagaagactagcacctagcagaatgagatgttgcatagagattccaaacattaatttccttccttgccgaatgtaagcaaacacaaacagcaagtgctaatggtaaatgtggtaaagcactaatttctctgagttggtcaatatttagctgaggcatgtcagttcaaagcctcccacaatgtttctccttcattaagcaagtcatctctgagatattctgtaattttctgtatatcttctttattatatggttagtttttctgttaaagatcatgtgtgggct

SEQ ID NO: 20742 - DNA, 578 bp, Homo sapiens
gactataaaaaccaacaaatacaggtactacaggcaaaaacaaacatttttctttggattttatgcagatgatttagttcagaaacagggacaagcatggatattttaaaataactccattttactaccttcaggacttttatggaagtaacagaatttctcatgagggtatcaacgcctccacaacatgaaccaaagaaaagaacattttggcaaaggaaaaagtgactgcgttctccctctgcacttcatggttattactgtaccagggtacacctgaactcctaagtgccccaggaagaccactcctactccatggagacaaaagtggggaaaggggtgtcctcactgtattccaacactcctcttcagtgacaaattcctgaaacggaaaagtaaaaatggatgcacgtgtagaacttagggaaggtgtgttagctaattaacctaacaccataccactaaaatacaacagtacgcttgagcttttaaaaaaaatctttagagagaactactggtgaaaaggacatgtattggatacagatgatcagggtcaaattctggctctatcactgact

SEQ ID NO: 20743 - DNA, 515 bp, Homo sapiens
ggaaagtcttaaagggtctcccaatcacaggaacttccgtgactgtgatgttggggtgccccattctctcaggacgtcaacatgttcgccaaccgggaagcaatccaagccttatttttcagtttttattgaggcttcattatgcaggtaagattaattaaatcattagccacgtgatgaaacccaggccccagcccctctgccctccttggagttgagggtaaaggctaaaagtgtcaaccttttaatcagagcttcctttttctgctgcccacaccagcttatagaggtgcccctccataagtccctttgttaccatagcatctagtatggttggaaagtatgaataacaaaagacactcctatcacacagaaaattacaaggagtattgaagttctgagccagaaaccagggacaaagaccaagtatttatttttattataccagctagttatctcagattttcattattttgcttcttacatcaggtgtaattatcacatgattgtatatt

SEQ ID NO: 20744 - DNA, 627 bp, Homo sapiens
ggattccaagacctgcagcctatatgaggtatgtaaaagctattttcataaggaaacaagcaggttgcacatataagcccaacacagattaggtgctcagttgaatcacattttgcagaaagttgtggtctgcatgtatgactatacctttagtctagctttacaaagacataaaacatgtcataatcataaactaaggataaaaggaccttaaaatctagtcatcttaaggctgggcatgctggctcacgcctgtaatcccagcattttgggaggccgaggcaggcagatcacttaaggtcaggggtttgagactagcctggccaacattgtgagaccctcatatctactaaaaatacaaaaattggccaaacgcggtggctcacatctgtaatcctagcactttgggaggctaaggtgggtagatcaccagaggtcaggagtttgagaccaacctggccaacatggcaaaaccccatctctattaaaaatataaaaattagcctggtgtggtggtgcatgcctgtagtcccaaccactcgggaggcggaggcaggagaattgatttaacccgggaggaggaggttgcagcgagccaggatcgcaccactgcactccagcctgggc

SEQ ID NO: 20745 - DNA, 613 bp, Homo sapiens
cagtataagaattatgggactccctttacgctgtaaattattgtttttccattcttttattctaacagcactcagtagaggcagatggaaacaaattattttttccttttaattatcatctaaccttcattaagtgatactatgtacatgaaacagtgcaaagtgtttgggcaagcaatacagaaataaacaaaagtgcaaaattatagtaactgttaaaatttgatggctttatctataactctactttcttatgataatagaaagtgaggaaaagctagtcaggtagactctgcagttagccagagttcaaaatctagctgtctcttacaatctctgtcaccctgaacaagtttttaaagctctctatgtctcaattccttaaatataaaaagtaagaataataatagtgctttgagcagtacctcagtaaatgctagccattattattgctttatccttataatggctatctactttaagaactgggtctaggccgggtgcagtggctcatgcctgtaatcccagcactttgggaggccgagacaggcagattgcctgagctcaggagtttgagagcagactgtgcaacatggcaaaaccctgtctctac

SEQ ID NO: 20746 - DNA, 603 bp, Homo sapiens
tgccctttctagcccatcatttataatctttagaacaagagacccagggtggccattagtcctagtggcacagtccttgctgatcacagaagatgatcgtgatagcatcaagacgatcacttgaggaaagtggtcagcagctggagtgggggttggttgtttttgtttgtttgtttgtttgtttggtccttttctctgggataattagcctcccagccataataaccaaggaatgtaaggtttaaaaggacttaagggtatgtgtggttgatagtgtgatgagatggaaatagagaccctggacatagcatcccaggaggctcagagcatttttgaggagctagtcattgatgctttatttgctttctctctaatggaatgatttcacagttttcttaaatagctgggaaaaaagttggctgggtacagtagctcatgcctgtaatcctaacattttgggaggccaaggtgggaggattgcttgagcccagcagttcgagaccagcctgggcaacatggcaagacccccatctctgcaaaatctttaaaaattagccaggcgtggtagcacaagactgtggtcccagctacttgggaggctga

SEQ ID NO: 20747 - DNA, 589 bp, Homo sapiens
catccatcagattggcaaacttttaacagtctggaaagatcaggttggctggtgaaaatataaggaaatggtgattattaccacctgctgggacagccataaatttatagagtcacagttggatagcaatttctcaatgtttactgaagtttagtatgtgcatactgtctgcttagcactttcaattctagataaaaaccctgcagaaactcttgacccaaaaaggcatttatacctggatggccatgatagcaatgtctggtaatactgaaaaatggaaaacaacctattatcagtggaagattggttgaagaatttgtggtatattcacctattagaaatactttgagcagttaaaaaattaaaagaattgatctacatgtttcaacatgcataaatcctgaaaacatgtttagtggcaaaataagctaccaaaggaaatgtataacaggatatcacagactgtttatgactatgcacataatacagtaaaagcaaatgtggaaaagataaatacatattaattccatgacaagggtcatttctggaaagaaaaaggactgagtaggagtctccagctgaatcttta

SEQ ID NO: 20748 - DNA, 293 bp, Homo sapiens
cccaaagtgctgggattacaggcgtgagccaccgcgcccggcccaggtgaaatattattatcctccacctacaaactaagaaaaagaacctgaatgactgcccgggactccctgggtaggagagaggggagctaacaccagagcccaggtccccagctccccacccagggcttcactgcttggctccagtcaataaaatagcacaggtctaaagagtctaaaatctggaggtccccaccagaaagggatccttctttttttaaaaaggaaatatatccaaaggttagaatcag

SEQ ID NO: 20749 - DNA, 585 bp, Homo sapiens
gtacatgtaccatattatgtctccctccccatacatacacagagtagtgttttcctgatttatgctttactttgatgccatcctcctgtattgaagtgtgctctaagaaaaagcatttcaaatgtagtgttgtggctgctaggaagatattaagtgatgttgtattatgtcatataaaatccgtatgatgaccttctggagagatttctttccggttcagggaaaggtgtgattctcctgtgcagtcagattcttctcgtggacacagtgagcaatataacccatcaactttcttttttctgtcggctgttagaaagccagattcaaatgcatgttttgtagtagctggaacttttatattgaactgaaaacctcagtcaaagctggcctgcatcaaacagggaattttttggctcttgtaacaggtaacagagaaggccaaaggtgggcacgggattccaagtcttccttgctaagcatcttttctctctatgtgatgtttctaaggagttacaggctaaatccctctggctccaagcctagtggaaagagaaattctcttccctcatggtacaactcactcct

SEQ ID NO: 20750 - DNA, 554 bp, Homo sapiens
gaaagcttaggttttccctggagaaagaggaaaggtagaaacagacaggaccagacgaccggccagacaagaccacgtgtaagtgccaaaagaaccacacaggccacgcctttaattccagcactttgggaggccaaggcagaaaatcacttgaggccaggagcttgaggacagtttgagaacagcttgggcaacatagcaagaccccatctctacaaaaaattttttaaagtctgggtatagtggctcatacctataatgccaacactttgggaggctgaggtggaaaattgatcacttgagcccacaagttcaagaccagcctagcaacatagtgagaccctgtgtctataaaattttttttaaattaggcatggtggcctacatctgtagtcccagctacttaggaaactgaggcaggaggatcccttgaacccaggttgatgctgcagtgagctgtgttcatgccactgcactccagcctgggtgacaaagcgagaccctctctctcaagaaaaaaatgttttttttaattagctgggcatggtggcatg

SEQ ID NO: 20751 - DNA, 581 bp, Homo sapiens
gaaagactaaagatcaaattatatttacagactctgattctaataatactgaacacagcctactattttcatataatatccattcaaagaggtttcgtgagtacaggtaatctgtaaagatggtataaaatggttactctctccgtgaaatcctctcaaaactcaaatagtaaggagatcacagggtaaattataaccttgtgtcatctacttagtgactcctgtagaatgttacttacagactttgttttagcatttaaaagttaaaactcagttatctgggtctggtgcggtggctcacgcctgtaatcccagcactttgggaggccaaggcgggtcgatcacgaggccaggagttcaagaccagcctggccaagatggtgaaaccctgtctctactaaaaatacaaaaaaaattagccaggcgtggtgccaggcacctgtaatcccagctactcgggaggctgaagcagaaaattgcttgaacccgggaggcagaggttgcagtgaatcgcgatcgcgccactgcactcaagcctgggtgacagagtgagattccgtcaaaaaaaaaaaaaaaaaaaa

SEQ ID NO: 20752 - DNA, 606 bp, Homo sapiens
ttgggctatagccacaggcaaaatggcaaagtagaagcgaagcgaacttgggtcacatccactgtcttttttgcatcattcttccagcagttgaaaggaataatagagtgatcctcatatcaaagacttctttgatgggtctgacatggaggtgggtagatgatggcattatggaaagcaaggggtggtgtacaaagtgacatgtcttctagaggagtgacttttatgtaaaggagaagaagcattatagagtaagaactctcctgcaccattcttgactcagggatatggagtgatgagcagtgcttatccaagggttgctagagaagtgaaatcctcagtgcagagccaggagaaggaggcagagctccgagaagctgttcctgcttgactgctcaaagggaaggatgtctcaatgaggccacggcacacccactgccgggatggaggaagatggtgttaaggatggtcgctggtggtctgtccaccaccagagacatactctctggatatttgtttttgtcatctctgcggtggaggtgaaaatacttaccctgcaaggctgttgtgaggatcacgtataatcatcctccttgaacgcaccct

SEQ ID NO: 20753 - DNA, 628 bp, Homo sapiens
cactttgggagaccaaagtgggcagatcacttaaggtcaggagttcgagaccagcctggccaacatggtgaaaccccgcctctaccaaaaatacacaaaaaattagccaggtgtggtggcaggtgcctgtagtcccagctacttgggaggctgaggcaggagaatcacttgaacccggcaggtggaggttgcagtgagctgagatggcgccactgcactccagcctgggcaacagagcgagactccgtctcaaacaacaacaacaacaacaacaacaaagttcgttgttttaagagcaaaagaaacccatacaatttaattaatttgagtagcattatacatgttcatattacccagataacatatgttaccacagtacctaaactatgtcctgtagatatttgctgtcatttgggggtgcttccatctgtaggtctcgttccgttgagctgccccgagccactcccagcagctctgttctaggactgcacgtaaatgtcatcatataggctgggtgtggtggcttatgcctgtaatcccagcactttgggaggccgaggcaggtggatctcctgaggtcaggagttcgataccagcctgaccaacatggtgaaactccatctctact

SEQ ID NO: 20754 - DNA, 539 bp, Homo sapiens
ggttttgatttgcatttctctaatgatcagtgatgttgagctttctttcatatgctggttggacacatgtatgtcttcttttgagaagtatctgttcatgtcctttgcccactttttaatggggttgtgtgggtttggttttgttttgttttgtaaatttctttaggttccttatagatgctggatattagacctttgtcagatgcataatttgcaaaaattttgtcccattccataggttgctcatttactctgttgatagtttctttcactgtgcagaagctctttagtttagattccacttgtcaacttttgcttttgttccaactgtttttggtgtctgcatcatgaaatctttgctcacgcctgtgtccagaatggtattgcctaggttgccttccaggatttttatagttttagaatatccccctactgtcgacaagatgccatttctctgatcaactactttctagagaatggagcagctggtttaaccaagctacttttgacctgaacatgacataccttatctaaatctc

SEQ ID NO: 20755 - DNA, 535 bp, Homo sapiens
gggcatgttatttaactctgcttgatgctgcaattttctcatctataaaaaagagttaataattttatttatctcatagggttattgtagagaatgaaagtatttacaatagcactgagcatattgtaagtactggaaaaaatgttaattaccatcctactttttattattgggtaaaagcaagtaaatcaagtcctcctatgtttctgtttcctacatcccttcttgtgtgtgtatgtgtgtgggtgggtgtgtgtgtcttctcttcatactttccctcctatattgaatactgaatattgtctttattgaatattgtcttctccaatcctgaagtttttcctacagaaagtccttcagtactgctcttcacagagaacagagaaaagcccaaatagcccaaaagcccaaagtgaggtgaagtctgagcaaccatgtcctgtggaggaacaaagcagcaacgcccagaccattgttctcagtggctcagtgaggacagctacccactgagcagagtgtctatggtaaggagagc

SEQ ID NO: 20756 - DNA, 506 bp, Homo sapiens
acaaagcatggtgcattgatacaacatttttcccaatccaagcaaaagcaaaatcagctgcaatgtgttgcctcagttgatttctccctctgatttctcctgaataaacctgtacctttagcatacctcagaagaagtaagtaatcagggagttcaatgtgtaaaatcaatatatactataatattatttacttaagtctgtaaaaaataaaataacattgtctgtgtttccagactttacggccacctttttataaaggtaaactggtatttaactttctgttgaccttcagcattttattttcagcctacatataggtaaaagcccagtgaaatctgccattgtatttacttttaagttgttaacagattattcttctcacagatactatagatactgtaattgactctgtttatctctttctgttggctctcgaaagcctagagcaaaatgtgtggcccatctgtacagaatcttattgcttgcatttttagaagtaacctca

SEQ ID NO: 20757 - DNA, 585 bp, Homo sapiens
aaatatcagtgttaggagttcacctaggaaacagcccagttagaatatcattcagggaagcataatcactaaaacaattcatgtaccctgagcttctactctgccttttttgtgctgtacttttttatataaggcaattactaaaggctaccagaaaggacaaaagtcaatttcaaagaaacagaccatgcagggagaaaaacaaaacagaatttcaaaaaccattgagattttagtatttctagagaggtaaaagaagaaatgctcccatgaagcaagaataagacaataagaaagaaaagcaatgtacatacatgcaggaactctcaggtaacagaaatgatcactggaaattaaaaatttgattggagaaatgaaaaagacaaagagaaaggaagtttagagataaagatgaagaaattttttagaagataaaatatagtgataaaggaatagaaaacttgggggaggggaaaacaggtgaacattagaggtctaatccatgaaaggtccaatatctaaataagaggagttaatacacagacgaaaaggagtagaggaaatcaaagaaagaactaaaaaaaa

SEQ ID NO: 20758 - DNA, 518 bp, Homo sapiens
ggctggtcttaaactcctgacctcaagcagtcctcttgtcttggcctcccaaagtgttatgattacaggtgtgagtcaccacacccaacatgtgtctatatctgtagatacagatacacacaccatttctacctgaatatatagcaatatatatgtgcttccacattctttgtctacatgtttttttttcctccaggatgaatctgtgatgatgaataaaaaagtgaataaaaaagttatttttattcaggtgtagataaactacttctgtttctctcaagctgctataacatgggccatcttgtttggttagaatgtatagtcaattccttagaatccagaagaggagtcattaattcttgctggaagataagggccaagctgtaacttctggcatatggaggaagatcctgactcaggaacaagtacatcacacttggagtcatgagccctcatttggagttccaattctgttattacctcaataggtgaaacccatgcttctgcgtactctacca

SEQ ID NO: 20759 - DNA, 642 bp, Homo sapiens
gtttctatgggtaactcctgagcctatgtttctaaggagatgatctgttgattgttaatgagtcctgtgagtgctttaaaaaagaaaaatggcatcgtatttgagagatctagactaaaactaattgtcacacacttcaggaaatatgacagaagaaaaggcttttaattttttttattttctcattattgaaaaggtcactgatcagttgagtacagatgaaaggttcttagagtagatcaatgacctgttgttagtgaaattcttggggtctgaatcttagctatttagagttttacattatcatctctaaatgttttgtctattataataatgaataaccagctgggcgcggtggctcacgcctgtaatcccagcactttgggaggccgaggtgggcggatcacgaggtcaggagatcgagaccatcctggctaaaacggtgaaaccccgtctctactaaaaatacaaaaaattagccgggcgtggtggcgggcgcctgtagtcccagctactcgggagtctgaggcaggagaacggcgtgaacctgggaggcagtgcttgcagtgagctgagatcgagccactggactccagcctgggtgacagagggagactccatctcaaaaaaaaaaaaaaaaaa

SEQ ID NO: 20760 - DNA, 522 bp, Homo sapiens
ggtgttgccaggagaggtaaggtgtggtgtgtacagggagcccctgtcatcatcgggatgactttatgtccgtgagagtggcagcccacaccctagctctgagctgctggctttccccatctctgacaaccttctgtcccactgtgacttggccacccactcccatcaccactccctagacttagtcaccacccagaactccctcacctctgaaatcactaatcttgatggccttctctatactctcagcttctccactcaatcactttgtctactcttgacctctgaccccatcaggtaccccgtccatggatccctctgttttctttcaatccagcagccccctttttcctgcattctcttttctcacacctgagatgcacagctcagaattttattcattctctcctataacataaattcccccttgttgcaccgcctgccaaaattccaccggtggatgaagcagctgtccttttcctctgaactgcactggcatgacaggtgattctgcaggagaag

SEQ ID NO: 20761 - DNA, 521 bp, Homo sapiens
  misc_feature 437: n = A,T,C or G
tatataagatcttatggacttacatgcatagaaagtaaataaaatgtagtcgcttccttctcactcttctgtgctttcccacacgctgctccttcccttggaaacaccccttctctgcctcaccacagtaactctactcatctcaaaaactcactttaaacatttactgcttccaaggctctttgcttctaacccagcatttgatatggtattattggatggtaatatttttcccatctaaacaaagagctccttgagggcaggggctgtatcttttgtttctatatcctcaaccctaagataaattgcgtataaagcaagaatttgcagaaagttcaacctccaacatgcaacaaaaattgctattaaaactcacactgcccatctgaaaaaattttccaacatttatttatttaaaatctatttatatttaactntcccagattgttactaaataatcagttcataggactactgaaactaaattaacagaattcctatctgcattcttaataactcca

SEQ ID NO: 20762 - DNA, 523 bp, Homo sapiens
tataccattattatggtgccttattgctcaaatacgacagagacatctgataatgtaattacttcaccttatcacgctttaataaataatgtaggaaggacagcctctgtagtgagcctgtctaaagaggccaagcatacaaagggacagtatctgtgatacagctgatattaatttgcagagctgaaggtaagcaacagaaacattaagatcagatattttaccatgaatgattaggcaaatgcataagccagggtgtatcaaagcacagctccctctctagacacttggagaacagattgcctatccaagtgtgaacgtttgctacttacatgccttttgaggcatgaagaaatgcctgatatttattgtttttttatattcctggacttgcccctgccctgcctctagcataagtgtcataaaggtgaatcaatatgtgtttgaaacattggctattatacaaaaaaattgagctcactgtggatgttgatttaataatatctactgattattcctctca

SEQ ID NO: 20763 - DNA, 571 bp, Homo sapiens
gaaagtccagtctgtcaagagagcccagaagcaacccaggctaaagggggctagtgaaggcctcttagatataaaaatgtacccttccacgcaacagaaccttaaccaagaaaaagatgcttattgtatttacctactataccaatacaccaaaaggtgagcaggagttccctctgagacacgggattatcagtgattttaattttctggtttatagttttctgtattttctataatagacatgtattacttttataattagaaacaaaattgtaaatattataaactaaaaaggagataaaaagaataagagtaccattcagggcttaaaagttttaggtgagggaaagagaggatcgatttcaaaaatgtagcctgtgttaagggatcaagtaggcatcattaagaacatactatgtgctggccaggcgcagtggctcatgcctgtaatcccaagatcacgaggtcaggagatcgagaccatcatggctaacacggtgaaaccccgtcctactaaaaatacaaaaaattagccgggcgtggtggtaggcacctgtagtcccagctactc

SEQ ID NO: 20764 - DNA, 505 bp, Homo sapiens
gtcaccgccggactcccgtctcctcctgtgtccctgcagagacagggccactgggagccctcgttctacttttgtgtctgccccaccatgagaacggcccctcgccaagcctgagcactgtcctgggagatctttcttgctctttcttgtctattctctgtcatttgctgagaaatcagagttgatgctagaaacacaggggcgaggaggatactgcttgcatatcagtggtaacccagaccacgatggcagaaaacagccacccggcaaggggactggtggccacggggctcacacaagccgatgcccatcacctggcgatggtgtccaggacattgtcacgaaggtccctggcatgtgtggccccaggcacacctcacatcctcctcatctcaaaatggaagacccttttgggggaaattactcttagctggcatcaggttaaactctgcctcccctcagcagtcacctgggaggtagcaagcagccagcgacaccgtgtctc

SEQ ID NO: 20765 - DNA, 622 bp, Homo sapiens
tcagtgtgaaagtcatccagtaacacggtcacaagcaagagcgagctctggaaactgcccatatggtgaagggatatataaatatttaatatatttaatattttacctggtaccatagccattttaaattattctactaatattatctaataatatgtggtataccatttctctccaagaaattaaagttctgaaaaatacatccatacttacatcttattgcttcttcaaaccacacttgtgttcatgaagcaggaaagggtcaacgtgcaatgactcattatttcacatttacctgacaggctgcaaaagtgcacatgatattatagttcaagggcatttaggtcagagggtatgctgagggctatgacccaccgggttatgaaatgagctgaaatatcaagactgacatttcttaagtgaaatagaatagaatggaaaatgtcagagtacaacactccaaaatatgatagttgttgcttcatgaatattctgtttcagaaacataaatatgtgtaggtatgtcgtatgtgctagatctcaatgttattaaagctattaaacacattataaggtacctattctaggctgggcacggtggctcatgcctgtaatcccagca

SEQ ID NO: 20766 - DNA, 447 bp, Homo sapiens
tcatgatctgcccacttcggcctcccaaagtgctgggattacaggcatgagccactttgcccggcctgcaaatatattttaattaaatcatgcaaatgaaataatataaaatatagaaatagttctaactacctatggacatttcagagcagtgaggaaacatttaagtattcagtactaatggtggaaaaactgattagctatctgggggtgaggagggtgaggggagctaggtccttacctcatttcttacaacaaaaatactccagatgaatcaaagatctgaaggtaaaagatgaaactataaagataatataagggaaaatgttggctagatgcagtggctcacacctgtaatcccaacactttgggaggcccaggcacatggatcacttgaggccaggagttagagaccagccttgccaacatggcacaaccccgtctcta

SEQ ID NO: 20767 - DNA, 333 bp, Homo sapiens
tttgtatttttattagcccaaagtgctgggattacaggtgtgcgccaccacgcccggccccagggagggtttcctcagtgcccctacagctccattgcagcaggcccttcatgcctgaaccacagaggtggttttctccatgttcttgccccttcgttcattttacgcaacagatatctattgagcaactgccatgtgccagacactgagctcaagtatggtttattctagcgaggcaggaagagcagtgggtctatttatgtgattctggaaattcacaaaggatgaaacctatgactactcaagtattagctgcaaaagctggtaaagttc

SEQ ID NO: 20768 - DNA, 587 bp, Homo sapiens
ggacagcgacctggattgtccttctcccttctctgaaaaattaccccccatatctcccgtgtccacgtcaggggatgtctgcaggttggtttgccaggaagtgccattctagccatctctgctcgcatcaggaacctcctcttgctttagtatgtgaagtttcaggaaaatgaagtaataggaagttgtaaccagttgtgggttgatggttttctccagaagaatggagtatcaatatcgtttgaaaaacttaatttttatgatgtgagtcccaagatagttttacaaatgataaaagaggaagaagctggctgggcgcagtggctcacgcctgtaatcccagcactttgggaggctgaggcgggtggatcacctgaggtcaggagtttgagaccagcttggccaacgtggcgaaaccccgtctctactaaaaatacaaaaattagccgggcgtggtggcgggcgcctgtaatcccagctactcaggaggctgaggcaggagaattgcttgaacccgggaggcggaggttgcagtgagccaagattgcgccattgcactccagcctgggcaacaagagtgaaactct

SEQ ID NO: 20769 - DNA, 600 bp, Homo sapiens
cattctgtgatcccaaatcaacacatagctctttggcatatttttctacagcatttaacattctagccaactgaagttccagactcacacctttcaactctggcatgtgttatggcagattgacaacccaataaccacacaagatgcctataatgcaaaattagaatagagttctgctaaaattatgaatctttatgaagaagaaaagaaccttcactgacaatgttcaaattttttaattttctttttgtttgtttgtttgtttgtttttgctacggagtcttgctctgtcgcccaggcttgagtgcagtggcgcaatcttggctcactgcaagctccatctcccaggttcacaccattctcctgcctcagcctcccaagtagatgggactacaggcgcctgccaccacgcccagctaatttttttgcatttttagaagagacagggtttcaccgtgttagccaggatggtctcgatctcctgaccccgatccacccgccttggtctcctaaagtgctgggattacaggcgtgagccaccgcgcctggcttaattttcttatatattttggtacctattcacttgaactgagtcaatga

SEQ ID NO: 20770 - DNA, 505 bp, Homo sapiens
ttcccatgttactttcctgacataaaagaactaggcagcaaggataatgtaaaggccaactagctaccaagcttcctcagttttaacacgttagtcttaaaatattttttcatttataagggagtagtgtagtttgaagtacttgattcagaaagaaactccaggaaatactagagctatctccacctcccaaagccaactagcttgtggaggcactagaaggcattttttttcaagactcatgattttcacagataactgaaaccctgcgtggctaagctgctgaagttgggctttcctggccatcaccaacatgtttgcagcagggagcccaaccaagctttaagtcatgcagtctgtggtggttaaagaccactgctggctgggcgcagtgactcacgcttgtaatcccagcactgtgggaggctgaggcgggtggatcatgaggtcaggagatccagaccatcctgcctaacacggtgaagccccgtctctaccaaaaatg

SEQ ID NO: 20771 - DNA, 616 bp, Homo sapiens
gggctgggcgcggtggctcacgcctgtaatcccaacactttgggaggccgaggagggcagatcacgaggtcaggagatcgagaccatcctggctaacaaggtgacactccgtctctactaaaaatacaaaaaaattagccgagcgtggtggtgggcgcctgtagtcccagctactcaggaggctgaggcagaagaatggtgtgaacctgggaggttcacaaggcgggtaacaaagggcccatgagtcctgattaactgatctgacaaaccatctgtcacccacagccctaagccacactgtgaaactgcctagggtggcaccagctttttatcttcctcagggtcctcccctcaggcccccaagtaacccctcatggtccagattctcccgagtgactccattcccatggtcatctcccctcctgagcctccccctctgagggccaagggctgtcctcagggccctcctggggcttcctggtggggaacaacctgaggcaggaggataagctcttattcagagcattgagaggaaattgtgaagcttgcagtgagccgagattgcgccactgtactccaggctgggtgacagagcgagactctgtcccaaaaaaaa

SEQ ID NO: 20772 - DNA, 194 bp, Homo sapiens
gaggaagcctagacatcacacttaccagacaaaaaatttaaaacaactgtcttaaatgtgcccaaagagctaaagcaaaattacaaatctgttttaaaaaattgaagtgaaaaagggaaataggaggaaaataaatacacatcccaattcccttatctatagtagctgagactcaaatatttaatatatcatat

SEQ ID NO: 20773 - DNA, 626 bp, Homo sapiens
gaagttgttttggaaaagatgtacctgcccctcaaccaggcccaggcgcctgctgagcctacgacagaagttgctacccctaccccaggtgaaagtacagcaggacactctttccaagtttatcatgagtaactaagcaaaccaccatccgatacccaacccaggcccctgttctacatagaagacagataggaatattcactcagattgataagaaaagcatcctgcacatctcaggatggtcaaacctccatgattgctatgactcttgaatgacaccttcccccggagaaacagacaagaggaaatggattgaaattgatgataggccgggcatggtggctcacgcctgtaatcccagcactttgggaggcagaggcaggaggaggatcacttgaggtcaggagttcaagatcaccctggccaacattgcaaaaccccatctctactaaaaatacaaaaattagccgggcgtggtggcacatgcctataatcccagctactcaggaggctgaggcaggagaactgattgaacccatgaggtggaggttgcagtgagcccagatggagtcactggcactccagcttggatgacagagtgagacagtctccaaaaaaaaaaaaaa

SEQ ID NO: 20774 - DNA, 604 bp, Homo sapiens
aagggcagagtgacttggctggggctgcacagtgaattattctcagagctgggactctcacttaatcagctctgttttctccatttatccttgaacccagtactgcaccatcaccccgctagaccccaggagatactaagtagcatgctggaaggagcgctagtcttgcagggccaagtctggtcccgtttctctctcacacgtgttctgtgtccttatgccaatcacttctcttccgggaccttggtttcctcctcagctgggcagggctctaaccagagctgcctccttgggttgtggaggggaatccaaggccacagtgcacgccgagtggagccttctgttcctgcacgtggaaggcagtggctctcattaggagttaacctgaattgggctgggcgtggtggctcatgcctgtaatcccagcactttgggaggccaaggtgggcagattacctgaggtcaggagtttgagaccagcctggccaacatggtgaaatcctgtctctactaaaaatacaaaaattagctgggtgtagtggcacatgcctgtaatcccagctactggggaggctgaggcaggagaattgcttgagcctgggag

SEQ ID NO: 20775 - DNA, 630 bp, Homo sapiens
agtattattaatggagtctgttatacagatcaatgataataggctgaagagatgagcagatttcagatacacacagtccgaaggagaaattggaatttgattcctgccagagtagaaagtttttggagaatacctcaggctttcagttgaaatctcacaaaggtgaagaccttgaagtaagaccacatcctaagaatgttggcaaatttgaagaacacctatactaaggctaaagtcaaacctgaaaattatgaaagtcatatctaatccctgacatgtaaagagcttggaaactatcactcccatcctcacaataagaaaacagccaaagccaggcatggtggctcacgcctgtaattccagcactttgggaggctgaggtgggtggatcacctcaggtcagaagttcgagaccagcctggataacatggcgaaacccagtctctactaaaaatacaaaagttagctgggcatggtggcatgtgcctgcaatcccagttactagggggactgaggcaggaggatcgcttgaacctgggaggcagaggttgcagtgagccaagattgtgccattgcactccagcctgggcaacagagagatactccaaaaaaaaaaaaaaaaaaaaaaaa

SEQ ID NO: 20776 - DNA, 450 bp, Homo sapiens
tacttgacaacataatgggttagttgcttgaatcaactcttccactaaaaccagtaattattccttaatataatatagaaaataccttccgagatatgtcaattagttggtatgagagtaagagattatcagatttttttttttttaagcagggacctagggatgtaagcagagaactgcgacctgcagtcactccaaaagcatttggagtgactttgaaagacagtataatagtatgttctcttccactgaatttcaacaccaaggactgcactttcctgtaggagttacctggaaattctatcactgcctcaggaattgcagagaaaattgactcttcaaatctgggtacaaagttgaaggaaattatcaccattaataatttggaaacaaaatcttattaaaagcccaaactgaaatgattctcagtgattggggaaagctcaggta

SEQ ID NO: 20777 - DNA, 511 bp, Homo sapiens
aatagaattgttgtatattaaagaaaaagagacagaaccaatcactataatgatctctcctggattggatcctggataagaaaaactcatgtactttgcaataaaggatattgttaaagcagatgaaaagatttgaataagctctgtataccagaaactactattaaattaataatgatttctttattttgattattatactgtaattgtgttaaagaatatcctagttttaggaaatatatgcaaatatttagtggtaaagagatactatgtattcatctcaaattgaggctatctctcatataaatacatttttttaaattcctttagcagtctccttctttgtccatggatactactgtcttgaatggaatgggcactggaggcttgttaaatcactacgtatgcccatcaaaaagaaattgacaatgccatgtgttggccaagatatgaagcaggtcacattcttctaaattatggatttgagaatataaaataatacaatcacttc

SEQ ID NO: 20778 - DNA, 528 bp, Homo sapiens
gacgacagagggcattcatcactatttttagtttaacaagagcacacatctggaaggtattggcttttcaagtcaactgctggaaagacagctggggggtgtccatttcaggaggcttaccttggtatcctggggtcgtgccacgtgctaactccagtctgtgtatgcaaaaagtaaacttggccctggactgttgttctttgttctacacaagaaattagagatccaaatgagacaagttcaattccagggagagtttgtaaccaaccctcgatgccctcacgtctggtattatctaaatctagataacactcccctcttatcccagttcttctctctgaggtggccgaataatcccctcttctccatctcgccccatgctctcctttccagagcactacagacaccctcatctagcctacatgttaccttggtttgctttggtgttcgtttgcctaagattttcacttgatttctaaactgggagatttggagcaattgctgaaaattcatgattagctagattta

SEQ ID NO: 20779 - DNA, 488 bp, Homo sapiens
agaggaagccttggtcagcccatggctctctagtcccggtcattgactcagtaatatttcttgtttacctcctaagtggcaggaattatcacacctggaaggttctgtagaggagaagacactgattagagctgagttttgtgtgataaggtgctttccagcccagagagtagtggagactgacagctgggataaggtaacatcaggaagaggaaacggctgggctgaacttccaggagtgtgacctgggcctgtgagcgagtgaaggcagtccctgtggtgcagcagagggtctggagggggttgagacagtgaatgagtcagaggcagaagctggggtcggactgtgaaggtctttgaggccctgctaagggcattgctctttatcctttaggaaatgggaagccatgtgaggtgggaggaattttaagagggaaacaatgtggattcatgtttgagatagagaattataacactggcagcaatgt

SEQ ID NO: 20780 - DNA, 546 bp, Homo sapiens
tacattggtaggtagcaaaagccacatgaaacgtatacaggtgtaccaacagtttttccttgttaaatatcagctctgtggtatgacagaagtgaggggaaccgggttcctttgctgtgtcctgaaggtagtggttagagtcacttgcagggttaataaaggctgttgaaattgagcttccgttggtggttaaccctctgccttcttcaggttcctgtgagatacctgactggcacttcctttccagataaaagaccttgggggaagttggtgaggtagttaccaggggctactaggtgctaccaacctgttgaagctcagtgatgttggatagggtgtgtacactctgggacacacagatgagttgaaaaagaacaaaattcactgtaagtgggtcttgcagtcttgtacacttcagaactcaattatgcacatgactatggcctgcccctgcatatgaaatgctgcagatgtaaccaatgtaggaattcatgccaatcagggtaaggaacagtaaatgaagcagatgggaagatgagctcaggc

SEQ ID NO: 20781 - DNA, 608 bp, Homo sapiens
ttggcctcccaaagtgctgggattacaggtgtgagccgctagtgcccagcatccttaagataatttttatgtgaactgagacttagaaccactaacttagattcttggatgccttctagaacttctaggattagacaaatattgtggatagactgtaagagaagaacctggccatagtggagacaatcactgttatgttatccagaggagagggtcatcttgatcaataatattaacagtagtagtaagagtaatactgctactactgatggcaacattgaaggccaactttatgtcagtattcttccaagtgctttataagaattacttcatttaggccaggcacagtggctcacgcctgtaatcccaaaactttgggaggccgaggcaggtggatcatgaggtcaggagatcgagaccatcctggctcacacggtgaaaccacgtctctactaaaaacacaaaagattagccaggcgtggtggcgggcacctgtagtcccagctgctcgggaggctgaggcaggagaatggcatgaacccaggaggtggagcttgcagtgagccaagatcgcaccactgcactccagcctgggtgacagtgagact

SEQ ID NO: 20782 - DNA, 540 bp, Homo sapiens
ccctaaaaatactaggggaaatattcaaaaaatgacaatagtgccattattcctcctcctcaaagagactatcagaactaaaactctttgcttcatgttcctgtttacttctgtcactttcaagtcacagaggtattatcagactgtcatcattatatgactctgcttttccaacagaatcaattacctatcccttatctcacaacttgatagtgatagatattgaatgcttatgttctgattagcaaactctttttgcatttttaataacaacttgaactcctgatatgtctggaaaatataaccccttcaacagccctttcaatgggttgctactattttgctcaccccatcttcacctgcctaatcatgaggaggtggggtatatacaatttcagttaatttgtagttatcagtctattatagttctttccttctgaaaaccaacaagtaaataaaccagcaagcatcaccaataaactttgacagtttatggttcataacgtacgtctacaccaaactttccattcaaatgctttt

SEQ ID NO: 20783 - DNA, 562 bp, Homo sapiens
ctctgggattttcattcctcattaatgtgtcaaaatgactatgactataggagaagcttcaggggaactgaaaggttaccctgggattttccctgggtaaacttggacaagacatttccccttctcaagcggcagtttcttcatctgtgaaatgaaaggattatgctatataatctctaaagctccttctagcacatgagataactaacacttacatctctgacccttcaagaattttgataggccttccctggaaagaattcaatagctaaatgtagatgtttatgggaacagaagagcaagagtttctgcagacaaaacaaggatgaacgaagcctgcgttccgaccaagatctgaaaataaaccggtggcctaattttgcctcagcctctgctttgagaattaaaagacatttttgagtgtaaagaaattcctcaaaactatcaacagtggtcaaaaacgagccatcagaaactgcaaagatctgttgcaaaataccagaagagaaggcaggagtaggtctctgttttccttctgattcctctgctgacttcatcacac

SEQ ID NO: 20784 - DNA, 472 bp, Homo sapiens
taaggcatagagttaaggattctatccaaagtcaaacagatagtaaaagataaagctgagataaaaacaatttaaaaaactagttaatttattaactcatcagatattagcccaaagtgaataaacaggtgtataaacagtacagttttttactttcagaatatcaaaggaaatgcccatcgttgctgcatgtatgatgacagctatcgaaagttatttctctggttgtgtcacttaacagtcgctgcctagaggaaatggagtaacctctactggaggtcattctgatgaagggttttggaaatcagaactttagccaaactactgaagtgaggattgcagatagaaatgaatgtgttctggtagtttggtttcactctttgaagtaagttgataacacatttctttgacaggaaacctacatgttcataaagtatgaaggcaggatttcttttcaattcaactgctttca

SEQ ID NO: 20785 - DNA, 549 bp, Homo sapiens
acggaaagcaaactgttaaagaaatgtgggttgtgtgggcttagcagtctgacctagtagtcacaaaaggtcatgaaaatccacttagtatttagggacacaatgctgatatggcataggacagcttgaggaaaaacaaaaagaaacctaaaagtcttacattctgaaattgaggcacaaagtgtaacccagggtccttttgagatgataaagttcagtcctgcaggttgctgaattgtaaagtccattgagtttacagaatctcaatatcacttaggtgaaagttagagcattgctcaaaactctaagaattagattagggatctagaagagaagccgaagcatctagactactctcaaccccgcctccccttgcccccaggtcctccttaccagcccacatcctgccctcataatataaccagaatgactttcctggcataaagaccctgaaggcctcttgctcaagcaagttccattgcatggagaaatggctcctcactcaccagtccttgcatgttaccctgacgatctctgaattatctttga

SEQ ID NO: 20786 - DNA, 325 bp, Homo sapiens
gaggctggagtgcaatggcgtgatctcggctcactgcaacctccgcttcccaggttccagcgattctcctgcctcagcctcccaagtagctgggagcctgaacgctggtgccagttaggccaacagtcatgtggcaatggctatgaattgcaagcattgctgattgttatctgctgctactgcctttgagctggagcggaacagatcaacatgggccaaacaagagcctctttggagatttctctactgcttcaagcacacagattccaagtttagaagctcaagagaaggttgaaaataaaatacatttagtttttgtcatcta

SEQ ID NO: 20787 - DNA, 487 bp, Homo sapiens
caggtcttaaaagataacatgtaaatgtttttaaaatggtaaaaaaaaagaaatcacatgctcagatcaaagctgtagaggaaactgacataattagattcatgtggtggctgaattaggttacccacaaagtcagcatttaaatatttgatactaaagttctagtaagaagggattctcatcctagctttgctgttaactggccttgtgaccttggacatatcacaagcccatgtcggatctgtttcttcatctgtaaaatgtgcagcttgccctcaaaggccttgcagcccttggcacctcagattctgtgggaagcagtaggacagagagtgtggtggcccacagttaataatagaactatggttattcctgctttttaatattggagtattgatttttctcacttctgaaataaggacagaatttgattaaaaaatggaaacagaaatatctattttttatgtataaagaaacatgtttgaga

SEQ ID NO: 20788 - DNA, 323 bp, Homo sapiens
  misc_feature 96: n = A,T,C or G
taatcagatatttatggaataaataaaatctgtaaatgtgaaaaaagaatcatgggaatggtaaatttgatagtgaaaaactgtctcttaaaaagngtgggatcacaaggtcaggagatcgagaccatcctggctaacacggtgaaactccgtctctactgaaaatacaaaaaattagctgggcatggtgacgggcacctgtagtcccagatactcgggaggctgaggtaggagaatggtgtgaacccaggaggcggagcctgccgtgagccgagatcgtgccactgcactccaccctgggtgacagagggagactctgtctc

SEQ ID NO: 20789 - DNA, 541 bp, Homo sapiens
gtaccgccagccagcacccccaaggtctctccactctctcacacggactagtataatgttcaaggctccaggttgaaaagccaaagcccctaagataaaaaccatgagaactctaagaattggagactatgtgattcaactgagcaaaagaaggcccttgactcagcccaagatagacatttttgagagatctgtcatcaagtatcgaatttagaagtatcacttgaggtaatcaatctttctgaggatgcaaatttctttgtataggttgaaagaagaaacatctccaatgcacacagatacatcagttaacaaattaaaaacccatataaaaccctcactccatctgaagagtcctgagactgtatctagaaaagtgatcacatcagaagaatcttcaaatatcaacagcactttgaagagaaatataaaaacaactgctgtaattccttagtaattatagttatggaggaactaaatcctgcatctgtgagcagagaagagcctcagcctggattcttggagattagtcagggggaaa

SEQ ID NO: 20790 - DNA, 581 bp, Homo sapiens
tgctacaaaaatgaagaaaaagcaaagacctctaaagataaccaaacgtggaaaaattatatcaacactacatgtgccatacaaaaaatgctgagaagagtcctcctattaaaactatatgatgctaaaaaacaaaactatcatataaaaataggtagctttctaggaaagatataaagatatgcaaatattatagaaaaaatatcctgtagcattattataataccaaaaaatgttttatttaactattctctaaaatttaaagataaaagctaaaaataataatgaacatctgttaataaatacataacataaatagatatgtttagtgacatcaataactaagttgaggacagatgtaataagaaataatttgtgcatgaacccgaatttaaatttcaccacttcaaaatatattgttgaaattttaagaggtttttatataatcctgaaggcacccacaaagaaaatgtctgtacaggtacaaaaaaggaaataagaaagtagtgacagcctatccatacaaaaatcaaaaagacacaaaggaagatagaatgagaaacagacctacaagaatcatt

SEQ ID NO: 20791 - DNA, 532 bp, Homo sapiens
aactcagtcccacaagcattaacccagtcccacaagagtggtattaatccatctttcaacctaatcacctcaaaaaggccccatctcccaacaccacaccaggggccaaatttacaacacatgaattctgaaggatacactcaaactatagcagactttagcacatgaatttggaagagacacacttcaacccataacaatgctgaacctaggagccccatcctggacttcctgacacatttacacctggtagaaagaaaggaaaacacaaaagagtggttttctctctgcagcctactgatggtacaccatcctttctagtcactgggtgaggagaatacaggcttttcctcaggacaactttttacaattaaatagccatgtactccacacgttagcaagtccaacagcacagccagagccttcataaggcaagaattttttatctaagtcagcaaaagaaggagatcctcttttcccccaaaataacccactaaccaaataagtcacataaacacaaacccctttcaac

SEQ ID NO: 20792 - DNA, 594 bp, Homo sapiens
tagtattaatttgaagtacattgtgataaactaagatgcaaattactattcctggagaaactactaaaaaatataaaaatatttatagctgaaaaagacgaaagaaagtaatacactaaaaatagtcatttaatttaaaaggcagcaaaaaagggataaatacatgagacatatagcaaacaaaatagtataatcacagatgtaaatctacccattttgaagattctattgaaaggtgaattaaataaacaattcaatcaaatggcagattgttagacttaattaaaaacaaacaaacaaataggatccaaatagatgccttctgtaacagatacattttcgattttaagaagttgaaagcaacatccaacagtaagagatataaaatatttatataaataacagacaaaataggcttgaagactacaaatatgactagagacaatagggctatagcatatgaataaaaggatcaattcatcagaaatatataataattataagtgcatacacaactaaaacagaaccccaaaatacattaagcaaaagttgacagaactgaaaggagcaatagataatgcaacaataataaac

SEQ ID NO: 20793 - DNA, 511 bp, Homo sapiens
gtaatctagagatgatttaaagtatacaggaagatgtgcataggttatatgcaaatatgtcatttatatcagggacttaagttgtccatgaatttcggtacccaagggaggtcctgaaacctaatcccccagggatatacctacgtataacaatataccaaaagggcttgaaacaaaagttttgaagactgctattgtgcagcaaaatataatttgtaacagcttattttatgactacatattattaagcactgaatatggaaaagaagtgctaaaataaaagtgccatgaacaaaaatcttgaagctctttcagcacattgagaatgatatctgtagaataatttcctaggataattaatgagtgtaaaagaaaatacacattttggccgggcacggtggctcatgcctgtaatcccagcactttgggatgccgaggcgggcggatcacgaggtcaggagatggagaccacggtgaaaccccgcctctattaaaaactacacaaaaatta

SEQ ID NO: 20794 - DNA, 565 bp, Homo sapiens
tatattctttcataagatattctcacatatttttttcatgagaatcttacatattctttcactcatgctatcataagtgtgtttttttctctcctgttcacaaaacacagttgtcatttcagctaaaatgagtcaactcaaaatttattttctaattacaaatttaattgtcagaaaagatagaaaaggaccaggtgcagtggctcatgcctgtaatcccagcactctgggaggccaaggcaggaggattgcttgagcccagaagttgaagaccagcatgagcaacatagcgagatcccatctttacaaataataaaaaaattaattatgtgtggtggtgtgtgcctggggtcccagctacattgggaggctgaggtgggaggatcacttgagcttgagaggtggtggcatgagctgagattgtgccactgcactcactccagcctgggtaacagagaaagaccaatctcaaaaaggaaaagaaaacacagaaaagcacagcagaaataataaaatcacacgtaactgcattccctcaaaataaccactgtaatttttttcacat

SEQ ID NO: 20795 - DNA, 541 bp, Homo sapiens
ggtggaacagtgtcatccccaaaccattcctaccacctctggtctgtggaaaaactgtcttccatgaaacccatccctggtaccaaaaatgttggggaccgctgctataaggagtcgagtaggatgtacctctaattagaactgccttttagaatgctggttcctgtcacaaggtggtgggtggagggtgctgtgcacaccactgcctgtacacctgtactgaggggtctctccacacagacgccctgaaagccatcacagaggtgaccaccacactacagcacattctcatccggctggagaacctgcagaagctaacggagctgcagcgggacctggtgggcatagagaacctcattgctcctggcagggtgagtgaccttgctctgggaatgttttttgaactactttggtttttcaattgagatataatttacataccacaaaagtcaccattttaaaatgtataattttggccaggcacagtggctcatacctgtaatctgaatactttgggaggctgaggtgggaggatcgcttg

SEQ ID NO: 20796 - DNA, 431 bp, Homo sapiens
ggaagagagagagaccctgcctcaaatcacctggatgagaccctggttgcaaggggtagtcctatccaaactaacgctgaggccctgggcttcgtgacagcccgtggcacgttctcagttgtttctagcatgtctagcaaacctttggaggtcagagcctgtctactcaggggtgttcacttggagaagggcaaacacgttggggagagtaataatttgcagacctctggagaaccattcggtgctccagagctgacacatcccccacgctgtgactcgccaagccattctgtaatggatgcacgtggtgcacacctataagaagcattttcaggcctagggccaaaagaatatatcacaacgaagaaaaatggtggcaagatacatgggccaatagccggtaattcaccagcgttgaaatcatagccagc

SEQ ID NO: 20797 - DNA, 557 bp, Homo sapiens
gcatacgcacacctgttctggaaagaatcctttcctcctcccccgaccccccaacaagggataaaacttcatatcctgacagctgtctcataaaaggatggttatatgttaaaaagcacttgctacacacttgtattgccagagtccttcggggcgtttgtgtgtgaagagtcctaactgggaggtagtagctgttggcaaacacccaggcgacattggcatttccgtgatttcttcttttccaattagagcagtgtttcttatactttaatttgagttacaggcttacttatttattttattttattttttcagtttcttgagtttattgtgaagaatgaaatgcacatatagaaccagttccattagcaaaagtcgtatcagtcttctctttgtagatgtggcatgatttgtgaatctgaccattataagggcatcttttgctaatttaatacgtatctatatacctactgctacttatgcatccataacattttttattccataaagagaaatgtattctacaatgattaagtcattaattctcatagcatctc

SEQ ID NO: 20798 - DNA, 443 bp, Homo sapiens
tatttctatttaggcaaagtctacagcaagagaaaaatgtgtgatcaaccatcgggatgtacatatttacaaaatgcttctcttccaggaaaatattttaatttttcttgtatcactgtctgttctctcttatctccctaaacttatttccaacaaagcacctacctcagtaagttggacttaggttgtgtatcttatggactgagagcatttggtggccagtatgtttctcacatagcaaagccatgaacaatatctgattgatgattgtcaactagaactacttcttgaataaaattgcattttacttactattttatttgtagaatatacccatctactttatatatctgtattgcagagcaaaaaacttacctttgcattataaaatattgaaaaataaatagttttattatctataaaaatgtatagcagcacatata

SEQ ID NO: 20799 - DNA, 493 bp, Homo sapiens
caacacatgtaagaagataaggcagcatcagttcaggagcttgtcttggaaagatcatctcccaagcagactgaaccattcacatttcaaccacatcatcttcagaatgcgaaggcccattattggaagccatcacctcataccattatgcatttcctagagcttccatagcaaacaggtctccttaaagtcggggagtaccaggagatcatcaggatggggctgatggagacatcagaaaacagtgaagcaaggccagtagacctggagattgcagcaacagttcccaagagctggggcttcctcacagctgtgtgtgtttgcatcttctggtcccaagagcagccactgctcaggtaggctcatagcagattattcacctgccaagccattagccagacatgattttagaatggcaggcccattatcacccatgttatttgaattggaagacatggtatttggggttgggggtagtattgggcttgggctc

SEQ ID NO: 20800 - DNA, 562 bp, Homo sapiens
tgtgaatcaggccgggtgcagtggctcacgcctgtaatcctagcactttgggggtccagggctgtggatcaagaggtcaggagttcaagaccagcctgaccaacatggtgaaaccccatctctactaaaagtacaaagattaggtgggcgtggtggtacaaacctgtggttccagatactcgggaggctgaggcaggagaatcgcttgaacctgggaggcagaggttgcggtgagccaagaccatgccactgcactccagcctgggctacagagcaagactccatctcaaaaaaaaagaagaaaaaaaattgtaaatcaagaaatcaaggttgaagcgcaaaccaggtcactcttgtacatgtaattgccataaaagctagcagttttcaaatatataaaagcataagcttttttaaaaaacaattttacttaaaattccgatataaaaaaagcagatgaaaacaaaactacagtagtatagatttattttgtaaattcaaatgcaatcagttaataaaaacagttaagctgccttgataaatgtacatttgaaattggggg

SEQ ID NO: 20801 - DNA, 580 bp, Homo sapiens
aaagaaagctgctgggaaaggaaaacaggttttccaggagccactggtcattcttggttgatgatttgtgtgtaatggagagttaagccacctaagtgaaggactgcctgaatacatcctacaggcagcaatggcctacttcattaaacgcagcacaatgttcttggactagtgtgtcaaaatagaaaagtaattgctagtcttattatcctaagctgcatatggtatgatgtgaaagtcagtatgtaaaagaaatgtttccttaaaggggtgaacataatttcctggaaaattaacataagtcaaatgaataaattagcagtcagagtagaaacaaatattcttcattttttttaaacaaaacatttgctaagaagaacaaaataattcatatttattttcatgaactgggtttatatgtattaagataagcttcttatttcactctgaatctttcccctaaacaaaaactgtacaatgaatgtataaaaacttgagaggtcaatctatctaaaaataattcagaattatctctaattttctcaattaaaagaatatttgttgcacataaaatacattt

SEQ ID NO: 20802 - DNA, 544 bp, Homo sapiens
gaagccaacggaaattttgcaattatattagactgggtaaaagccatgttcttccaagactgtgtcagtctgtataaaaccgtaactccagcttcaagggctggggacattttgatacccaattttgacaatttagagaccgttttaacagtaaaaccttcctgctacaaaaagacaggcattcttttaaatgtatggataagttcacaaaaaagaaaatccaagtcatcaggtcacaaatgaagaaggaactgaaagccatatataaactgcagctgctgcagctgggaggctgacagatgatgttggtctcggtaactaaggggcttggattttaaaacccacagaaagccagaaagcaaggtcttgggccccatgtgaaacaggaaaatgaaatccatgctccatgcccaacctcacctgcacaaacctgggaccctcaaaggtctggtatcttaaacaaaaggtgaatcgggaaaaaagaccaagaatatctcagtggtgttttatcttccctgcgagatagcaggaagcttggtcatgt

SEQ ID NO: 20803 - DNA, 315 bp, Homo sapiens
gaaacaagaggctatgtagtctcgagatagatccagccctatgaggcacatgtcaatcacagagggaaagctatgcacgcacaaagcatgtgtgaatcagagagaaagctatgcacgcacgatgagtagaagacaaacacgtcctgcaaggagacggaggcgcagggagggggcggcagccgtcctcccaagacatgaggacttctagttcagtctgagaccttggtgcagggctgggcgagtaaacaaatgcaaaagaataaggacctcgaggtcgggcgcggtggctcaagcctgtaatcccagcactttggg

SEQ ID NO: 20804 - DNA, 531 bp, Homo sapiens
gggtgcaattaaagtcaaggaaaatgtatttgctgagctgtacaagcagacagcgtacggcatggaccatctgtccttcctggggcccgcagctgcggtgtgcacagcccccaattccatctctctgggaatatcacactcctgctcaactgttgagaaaatgcccaactcaaaaattgccagcctctggttgtcagtggcggggagttgggggtggcgtgttggattgtgaaagaggtgaaactcgttttcactcactttgtttcttcaagccccacagaaacttcacgtgtccattgttcagaggttcatggaagtgggacagagctgatcattcaccacctcactcagccactcacttggtgctgaccttgggaagtttagtgaacatttcggcgactgttgtctaatgtgttaatgatacaaaatttatgccaaagatttgaattgttacaataattaataaaataacagattgaaagcaactagcatagatcactgcacttgatatacactccataattgacatat

SEQ ID NO: 20805 - DNA, 473 bp, Homo sapiens
aggcagaacacagaagttcttcctgtgttcagaggaataacaccttcattacagtaacagagatgaagaagaagaatacagagacaggtataggaaggtgaagactgtgcttatgttatttaattcataatgcatgaagtgaggtcattcattaaggaaggaaatggacactttgagattttgaggtcaaagctttatagcaatgagggtaatgagcaaggaagtgctaataataggaaatagcttgcagtcagcatgatgtttaaaactggtatttcagctgtgatgacttttccacttctgacatgattagggatatgttgttacagttgctctttggaaattttgttaagtaatgatataatgtaaagtaggaagattgtcaagataactgaacaaggtacagtgtggctaaataaaccactagtttaatttactcaggtcctggactagactcacatactgtacttact

SEQ ID NO: 20806 - DNA, 475 bp, Homo sapiens
acttaatcttagtaaacctcaatttcttcatgtattttatgtgaataacagtgtatactccataggatccttgtgaggtttaagtaacctaattgtatatgaaatgcttaggacaattttggacacattttatactctctaaactggtagtattattcttagtagggaaaatatgtcttgaaagagaatgacacagtaatagccttttccaactgtagtgattaaattaattattggttgctgatatttccaggagagttgatttgcagggtatttttgttgaggcacagagctatagtccaagctcctttgatttctgttttgatttccaacctagggtcaaaataagtcaatttgtgaatcttgcaatgaatccattatccttaaggagggagcatttggaagacaaattataaaattaaaaagaattcagaatattgctgagtagaactataatcctatttccctatgtaat

SEQ ID NO: 20807 - DNA, 552 bp, Homo sapiens
ctgtgcctctgggtcctcctctgatcacagagaagtaggcatataggctgatgcctgtgaagtgctaggcacaaggcccagctcacgaggtacaatggtcatcatcacagttcttccaggaaggaagcctgggtccagcaaagcaggaattaaaaatcctgaagtggccgggggcagtggctcatgcctgtaatcccagcactttgggaggctgaggtgggcaggtcacgaggtcaggagttcgagaccagcctggccaacatagtgaaaccccatctctactaaaaatacaaaaattaactgggcaaagctgggcgtggtggctcacgcctgtaatcccagcactttgggaggccaaggtgggtggatcacgaggtcaggagatcgagaccatcctggctaacacagtgaaaccccgtctctactaaaaacacaaaatattagccgggcgtcgtggcaggcgcctgtagtcccagctactcgggaggctgaggcaggagaatggcgtgaacccgggaggcggagcttgcagtgagccgagtttgcaccact

SEQ ID NO: 20808 - DNA, 429 bp, Homo sapiens
cccattttctagttgttctcaaccattttccccctactcaacacacctgaggaaaacaaccaactcctaaaggtaaccactggagtggttcccaaaatggtggtagttcaaaattccagtgaaggattgggaggctacagagtgacataagtagtttgatgaagtcctctaaatcattctggtatccggccgggtgcagtggctcatgcctgtaatcccagcactttgggaggcctaggcaggtggatcacctgaggtcagcagtttgagaccagcctggccaacgtggcaaaatcccatctctactaaaaatacaaaatattagctgagcgtggtggtgggcgcctgtaacctcagctactcaggaggctgaggcaggagaattgcttgaaccggggaggtggaggttgcagtgagctgagatcgcac

SEQ ID NO: 20809 - DNA, 383 bp, Homo sapiens
aagatagggtggttgactgagtttacaggtatggaaactgagatgcaggcttagtgacctgctcaaggtcataggcttagtaaatggtgcaaatggaaaccctcatatgactccaaacccagttctgtttctcttataaaattgtctctatgtccaaatgaaggatatgaagactaaatgaaggaattcttttttttaacaaaagaaaaacatgttaatgtgtatctgtcagacatggtaataaggaagttctggagatatgggggagtttgtaatttttagaagctatgggtaagaatgtactcagactttacagagagttagagtgctttaaacaagtgcttctcaaacttcaatgtgcatggaaaacaaccagggatctt

SEQ ID NO: 20810 - DNA, 580 bp, Homo sapiens
gattataggtgtgagccactgcacctctgcctcccgggtaacctctgcctcccgggttcaagcgattctcctgtctcagcttcccaagtagctaggactagaggcgtgtgccaccatgcccagctaatttttgtatttttagtagagacggggtttcaccatgttggccaggatggtctcgatctcctgacctcgtgatccgcccgccttggcctcccaaagtgctgggattataggcgtgagccacaaaagttaaaaattttcaataaatgtgctgagtcctcaaaaagaaaacagaaaagtaccaagctaaaagatgcaagatcaggatctgacctcactctacaattttctgtctgtataagctggataacttacttaactcctcagagcctcagttttctcatctagaaaatgataacagcattttaaaaaaaaaattttttttaatttttttaaaattttattttttgaaaaatagagatggggtcttgctgtgttgcccaggctggtcttgaactcctgggctcaaatgacctgcccacctcagcctcctaaagtgctaggattatgggcatga

SEQ ID NO: 20811 - DNA, 461 bp, Homo sapiens
gataccaacctccagcatccttcaaacaatgactgatgtgggttggtgttcaaacatcccacaaactccattcactttctttccttcatgtcttccctcttctctaccagcacttcttgcactttctgagtaagctatttggactttatctagaggtttgcttttgaaggaagacagttatgctttacaagacaacttaaaatattgcttagctaaacacaaagcaaaacaagcaaacaaacaacaacaatcttctaaggctaataaaatgctaaaaattatacaatcatctttggccgttttgccaatgtagtattctgggagtcatgtgggatgtccaggtaagtcatgctaaagaagcaacacaagaatggtctagatcgctgcctaagatctctgccacactgtagagtggaacgaactacaaggagcaagcgagaaaccaggaaacagggcatcac

SEQ ID NO: 20812 - DNA, 189 bp, Homo sapiens
gtaattaatgtgcagtgccaattctgtgagtatgatgtgtgcatggagccagccaaaactctgattgaatttcagaactgggacactctcttgttttgcattcaggaaggagtgaaaatgtttttaaacaagagggattatttgtggaattatcaggtgaggatattaaggaatttagtgaagataatg

SEQ ID NO: 20813 - DNA, 300 bp, Homo sapiens
acaatacggccggaggtagggcacaggaagttaaaggtatttatcctggcatcagctgcgataatggttatgactaactcagtcagtaactttgaaagtctgtgataaccagcattgaagccaactgtgtttataacatgatggaaagtgtgtttgtgctaaaagcatatctgtgaggtgtgctaagaggtcatcctcaacagtttggggcttcttcctttaaaatatgtgattaacttgcttctggaattgaaaaagtaattctgcagtaagttattttgaagtgaggggtagttttga

SEQ ID NO: 20814 - DNA, 366 bp, Homo sapiens
cctctctgttgcccaggccggacttgaactcctaggcttgagcaatcgtcttacccattgtcccttgtgacagtgactttaagtgattcaaaaggcctttatagaaatgtcttttcttataaaacaagcatactaactagaaggggaaaagaatatttaaatattgacagtcattaacaggatcactcaaacactttgctctatgatgtttgactcttcttagaggagtgcagtggggtatcacacagcttctgctcaggtacaatcatgttttcaaaagaaaagggctgggcgtggtggcttatgcctgtaatcccagcactttgggaggccaaggcaggcggatcacgaggtcaggaattcaag

SEQ ID NO: 20815 - DNA, 431 bp, Homo sapiens
atgttaatatatgtcaatatataattttaaaaggaaagtattaactatggtgtttcagtgtcatttttggaaaaaatgagtttttcaaaaaacttcaaatgctactttgcatctaagcatgtgtgttgtgtatagctacagcaagacgtattactgctgttttatattttaaaccttgatgctggtaacatgtgtttcttccttattgtgaaagggtgttacaagtggtatcagcaaaaccatttgcttttgaactctgaggtatttatatggcccctatgtgaagagtgctttggaaatggtttaagcccagtcaactctcttttatctgtcggtgggttctgagccttcctgctgcagctgtccagtcctttcctggatgctgacactgaggttggagaaagtcaaggctgggcatgtactggtggggg

SEQ ID NO: 20816 - DNA, 343 bp, Homo sapiens
ttttagtataaactcttccatctgggaactttcacttttatgtccctgttcagtgttctgtgtacttcagcactctagtattaattatggacactggcattctaagtaacatgaagaacactaaaaataaaagtagactgaacaaagtggcaatgtccggagaatagtttgcatttggtgaataatcaatccatcatggctttgccattgctctttgtatgtgcgtgcgtgtgtgtgtgtgtgagtgtgtgtgcatgtgcgtgtttagcattacttaagagtgagatagttattcttcagggaaatttttacagatgatggtttcacaaaaatcagccttttt

SEQ ID NO: 20817 - DNA, 320 bp, Homo sapiens
acaagcacagagaaagggagaaagagagagagagagagagagaaataacagagtagattgagtttctgattttggagctgttcgccccctctctctccttgatatagacaatagtaatgaaagccctggatttcagtgcctagaatcagacacccattgaggttttatgggatttttagagctttattgtaaaaatcacattttaaacattggcagactcaaacagcttatattaaccacagggaaggaaggatgtataataatgaagcaattttattggacattcaggtaagagaaagaaggaaagagaagggataggg

SEQ ID NO: 20818 - DNA, 550 bp, Homo sapiens
gtggcgcgatgtcggctcactgcaacctctgcctcccatgttcaagcaattctcctgcctcagcctcccaagtagctgggattacaggcacctgccgccacacccggctaatttttgtatttttagtagagatggggtttcaccatgttggccaggctggtctcgaactcctgacttcaggtgatctgcctgccttggcctcccaaagtgctgggatcacaggtgtgagccactgaaactggcccctttctcttagtagactaatatgtattgagcacttccaatgtgtctggcactttgcatgggttatcatgttcaatcctcacaagtgccctgttaggatttccatttttcatatgatgaaactgaggcaaagggggttaaagaaattgctggatcatttgcctctggtgccttggctcacttccttgaggcctcacctctgctgcttccagctgtggccttggtggaccattccgtgagggctttgactcaactcacactgacagcgtctcacccaaagtgagtaccagtcatctctgcctttcat

SEQ ID NO: 20819 - DNA, 528 bp, Homo sapiens
cagtgtcctgaacttttcggggtcactctcaggtgagaacagtttcgtgggagcctctatgagccaagccttgtgctgggctcagggtaaaacagtgacaaagggggacgacatccctgttccagtgggtcctacagtcaggtggggcagacgaggcatgaatcaagcaatcttagagagaccgggtggcattcaaggctcaaagctcgccctgagggaaaggggtgagcattggtgacaacccaggatgaagcagcgtggaccggccccggggtcagggagggctggggttgacatccgatccccagggtgtccatagagagaggccagcagctgaggtaagggaggagagagcactgtgcagaaaggactgtgagtgcaaaggccctcggggttggaggcagagcacggagggctccgggaaccaggtcagagtggctccagacagggaggcatgagatgaggctatgatggaacgtggtgaggatggcgggcctgatcctaaaaacattggaatttattggcaat

SEQ ID NO: 20820 - DNA, 539 bp, Homo sapiens
tcactctgtcacccaggctggagtgcagtggtacgatctcagctcactgcaacctctgcctcctgggttcaagcgattctcctgcctcagcctcctgagtagctgggattacaggtgtgacacctcgcccagctaatttttgtacttttagtagagatggggtttcaccatgttggtcaggctggtctcgaactcctgacctcgtgattcacctgcctcgggctctcaaagtgctgggtttacagtcatgagccactgcacccagccctgagtcattttttaaaattcagattattgggaccattcctcatgagctgaattataatttttgcaaaagaggttcagaagtctatagttttaagaagccccctgtgtgagaagagtcaaatgcataatttgtatagatcctctcaagttcaaagttctgtgattctaagagaatatgcaaaaagctatggacaacataaaggaaaagaaacaataaagacagtacattcatttcacagaacaagtttgaattggcctaatttaaacaaact

SEQ ID NO: 20821 - DNA, 474 bp, Homo sapiens
tgtctgctcctgattcttaaagtgcccctcattgcctctttttgtcacctctgctcccttgcttctacctatctttttcgtcccgtgtattctcctcatatgtcatttaagaatttcaaacctgctcattgaattccacattccaagttcacaaatatttgtgcattttatcttcagcagcattgtcttcctcatttgagtgtggcaagtttataagaatttcagcttctgctgggcgaggaggctcatgcatgttgatcacctcaggtcaggagttcgagaccagcccgaccaacatggtgaaaccccatttctactaaaaatacagacattagccaggcctggtgttcacaccagtaatcccagctacctgggaggctgaggcaggaggatggcttgaacccaggaggtagaggttgcagtgagccaagattgcgtcactgcactccaatctgggcaacagagtgagacact

SEQ ID NO: 20822 - DNA, 532 bp, Homo sapiens
ggaaagactaatcaatcttgggactctttgaataccatatgtagccatagaatgcctctccatacagcagtctaggaatatactaccaaactactattattgtcttgttagttaaaatctacctatgtctagactggaggactacaatgtcaatttaagctttgtgatttcagttgtttaataagtttggcagatctggttgaccttaacaatatctgtaattacaggagtctctgattaaagtatatgaattatttgaaggcaaaaactataccttatatttctttgtacctgtaaagttctcaagttataattgggtgcatagttactgttcaaagtattcttaatgaggaacaaaataaagtaaaataaaatagagtttttttcattgttctctacctacatatagcttacgtggaagcaaatactgactaaataatctcagaagttcataatttaatagcagaacaaagaggagttgctgctatcgcagaatagattgtttcaagcaaacattcatgtcaatatatga

SEQ ID NO: 20823 - DNA, 328 bp, Homo sapiens
gcagccagtgaaataggaagagaaccaataagcaagggggagtagtgtccagaaggccacagtatttccagaaggaaagagtgaaaagctgtggcaaatgctaacaaacaaagactatataagataaggactgagaagtggcatttgcatttggccaagcaaaggtcattggtgaacttgatgagagcactttcaagtaaaagggcctccgtagagtgaactagaaacagaaagagaagcagcaggtccttccaaggaattttgctattacagagaaagaaaaaaatgaaatagttggagaggaagaacgtggtatcaggaagttgga

SEQ ID NO: 20824 - DNA, 420 bp, Homo sapiens
agaggaagccttggtcagcccatggctctctagtcccggtcattgactcagtaatatttcttgtttacctcctaagtggcaggaattatcacacctggaaggttctgtagaggagaagacactgattagagctgagttttgtgtgataaggtgctttccagcccaaaaagtagtggagactgacagctgggataaggtaacatcaggaagaggaaacggctgggctgaacttccaggagtgtgacctgggcctgtgagcgagtgaaggcagtccctgtggtgcagcagagggtctggagggggttgagacagtgaatgagtcagaggcagaagctggggtcggactgtgaaggtctttgaggccctgctaagggcattgctctttatcctttaggaaatgggaagccatgtgaggtggga

SEQ ID NO: 20825 - DNA, 230 bp, Homo sapiens
cagtttgttcttaaagttaaactaatggggaaaaaaaacaggacagggaggtatctcaagttcatttgagccatttttaaaattttggtagctggtttctgtttttcttctttttaaaatagtaacaacttaggattttgtgtgccaccagcttccattccatttcataaaagcttaatctagcaagaattggtgagccctagtagaagttagaaagaaatgttgaagtg

SEQ ID NO: 20826 - DNA, 538 bp, Homo sapiens
caggactaaaggatctaactggacaatggtcctgttacccaagaaaactgatttgtgtttaaaaacaatacagtaataggacatattcatatgcaatttgagcggatgccattatcaaaatggtaggatgtggtagctaggtattccactctagaccaatatgtgtaatcaggaaggcaggccagggcaaatgaagggagagcttggcagagttagtaattcacatgcctgaaacctagactcaaatcttactcaagtcgcttcttatctgatgttaacatgtcattttccagaacatttctgaacttcgatttccccctaggaaatctaaaatgaggatatgtatctcaaaagacagcatatgggggtcatatgagaaaagcatgtgaaatagtttcatctgtaggagagccactttaaaatttgtgaattaatttttatttttgctcatattggtattgtgacagtaaacatttaccccctaaaacaagctataatattagctgggcatggtagggcacacctgtaatcccagcat

SEQ ID NO: 20827 - DNA, 484 bp, Homo sapiens
gggggccgggcacggtggctcatgcctgtaatcccgatcacctgaggtcaggagttcgagaccagcctggtcaacatgatgaaaccccgtctctactaaaaatacaaaattagccgggcatggtggcacgcacctgtaatcccagctacttgggaggctgaggcaggagaattgcttgaacccaggaggcggaggttgtagtgagctgagagcacgccattgcactccaacctgggtgacagagtgaaactccatctcaaaaaaggaaggaaggaaggaaggaaatggagttaactagtattcatgggtgccgattatgcctgcacccattgatggaacatcttccctcggccagactggctgaccactgggacccagagaggaatgagatcgttccttccccaggctcggatctcacagtctaacaggagcctgatccagggctgagcacttcacagggagaaacaagagatgaccaagatgt

SEQ ID NO: 20828 - DNA, 353 bp, Homo sapiens
acctcacccagctaacttttgtatttttagtagaaatggggtttcaccatgttggccaggctggtctcgaactcctggccttgtgatccacccgccccttcctcccaaaatgctgggattacaggcataagccactgcgcctggctgagaaaacattttaactgatgttaatgagcagcttctaaacacatgattaggacgcagaagtcgttccctctggtggaatctataatgattacattaattcattttgattaattagaaatattcgtatctaagagcatccatgttgagagttctttgtttctaagtggattatgatttatgtaagatagaaaagacaatgggactgg

SEQ ID NO: 20829 - DNA, 409 bp, Homo sapiens
tggtaggaaacttgaatgaaggagagggacacaaaagagggcagaaaagcaagaatcaaaaatacttcatgccagactgaatactgaaagtggtaacaaaggaacaacaatgccttggattcccaggtgcctccagagtattggtgacatttatgaaaaaggggaaagtttggagaaagaaaatccaggtttgggaaaaaaatggctagatttgatgtgttaattgaggttttatttaaattatgaatgagcaaatacagtcttcctaattttgttctggttggttggtctgagacatgcgaagacatagaaaagagttccatgaccttgaggatgttataatgtctggacagttgaaccggtgactgaagctagaaacagaggtcacaataggagttttatagttatt

SEQ ID NO: 20830 - DNA, 487 bp, Homo sapiens
gttcaagcgattctcccgcctcaccctcctgagtaggtgggattataggcacccgccaccatgcatggataatttttgtatttctagtagagacggggtttcaccatgttggccaggctggtttcaaactcctaacctcaagtgatttcccccagcctgacctagccacccccacctcagcctcccaaagtgctgggattacaggcgtgagccatggtgccaggccttcagacagctttgaaagctaattaaaccttcagaaacttgatttgttggaataagttacacctgggcaagttgaatttcctttttcatagcatcagaacttccagcattttattcgcatctgttgagatgtttttgaagagcatttcattacttctaagtatatgaatatgcctatctttagttagtcattcagtatacaagttttttaaagtgtcggtttctcagctatacccagatcatctatatttttattgaaatc

SEQ ID NO: 20831 - DNA, 554 bp, Homo sapiens
tacactaattccctcttcaaccttttgacatttaatttttattaaactttaataaagttgcgttttcaaagatcaccaaataactaacttgatgtgaagtcaggtgcctcttttgtgacttcacctgtttgatctctttcaagcacttactgttgcccaccccttagtttcttctttggtttctatggcacagatctcttagtatttctttcaacttgctgccagccatctgtttgatcctttcagttagttctttctctccacctacattttaagttgttgcatccatttttacttcttaatccacaaactcttttatagcactttcattctctcacatgacttccatactcatatctttgtaagtgattaccagaagtgtatggtgtctccaagtctcatatccaattacacaatgagtaccccagcctcactcaacatgtcttagagaaagctcagcattttctcctgcagacctgagttccttatcttagttaacggtattacaatattctcaattgcataaattataatattttacatagtaaacaagt

SEQ ID NO: 20832 - DNA, 558 bp, Homo sapiens
aactctcctcttagttatttgtttcaaacgcttccctaaaagacaactaaaaaatacaccgataggtttttcttgtgctgtccttcataaaacacagtgcctgatgtataaatcaagatgcaggataacaaaacaaagtgaaaatatgttcatggggattaagaagaaggaacaaaaagatttaatatcttaaaacaagattttcttaaagtaagaacactcttgctccttccagtttaacacacacacacacacacacacacaaattaatgcatgtatggagcaattaaaatctagattatataggttataaattaatctgcaaaatttgccaaagatatgtaggcctgtgttatgaaataagatgtaggaaataggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcacgtgcctgtaatcccagctacatgggaggctg

SEQ ID NO: 20833 - DNA, 454 bp, Homo sapiens
cctgcaagatccttcacagaccaaccatagcttctcatcgccccctcctatcccatccacttagtgccatatgccgtagacacacaccaccatggcaccccttcagatctcctaaaggaccacttgttctcacctactgtttatgtgtgctggtttgtatgtggttttttctgatactactctttctcctcttaacctcccgagaacatctacaaatcctgaaaggccatgttcacatgtgacttctgaaaagcttcctattacctcctcaggcatctgtcaacatgcttttcagggttcccacagcaacttgtatattctgcactgaagcactgaaagtactccctggtaattatttgttttcttgtctgttatctttaatcttaattttccccttaagcaatcagttagaaagcagatttcaaaattattatgtatgatggatagttaatat

SEQ ID NO: 20834 - DNA, 558 bp, Homo sapiens
acacacacatacacacacacgcacacacacacaggaaagaaaaggtcaccctttttgataattcagcctggggctagttctgatcctacctctaagcattctgaaggtgattcagtttgcactgccaaccaaatcagagcaatgataatgttgtaaaccatgaattcccacatttgaaaccatgaaaactgataaacaatctttacaaaaaacaattaattctacttctatcccatggtgcagaaggagatctgaagaccctccctatgaaaatcacgaacactgtatctttcaaaagtactgtaagtcagactgacctaaattcaaatctccaccctaccaattctagctggattaacctgttatcaggtaagtaaagtctctgattctgattttcttcatctgcaaaaagaggattataaaatctcctctgctttaaagagttattgacaagataagatgaaacaacatatgctgagtgcttagcacagtagaaggcagctataccaaacaccaccaccaaaggtgaaaggcaaaatcacaattttcagctaaata

SEQ ID NO: 20835 - DNA, 486 bp, Homo sapiens
acctggaagagctggcaaaggagcctggggctgattagaaacccctctcttgggaagaggtttgaccagggctcttggaaggcatcagaggaatgacgtaagacaaacagtgtgcaggaaaatcactgtttattccatcctaaatttgaaaaaaactagttcctagacagaaaaatatcagtgcacatagcaagagtttttatttgagtgttgggagcccccaaaaagcacctttgagagaggatgtggaaagtcaccgtctataaatgtgtttttagtgaattcacgaaggatgttttggctaaaattgatttctgtgaaatcttaaaaagctgaacagacagaaacaaacaagcgagcctccatctttccacgtgaggcaagccagcagggatggaccatgaggcacttctctgggtacagaatttaaggaagcaccaaaaatcttagtaatcaagagaaagaatattagaatgaaatatactg

SEQ ID NO: 20836 - DNA, 118 bp, Homo sapiens
actcatgacctcaagtgatccgcctgccttggcctcccaaatcaaatactgtttttgatacctaaaaacaaaagttaatctaaggcaagttctcagtctattctgtgcattcagaaag

SEQ ID NO: 20837 - DNA, 512 bp, Homo sapiens
gatagtgaccagcagagggcagaggccccaggctcaacagccttattaaaaatacaggacaggggaggggaaagaaactcattcattaattctagccgtatttattaagctttcatgatgtgccaggcactgagctagatgctgggagagactgttttcattccagcgtcacgacatgaaacagaaggctttctgttttcattaaaacatgacggtttcattaaaacatattctggtggtgtcgacagggatatgcacacacacacacgccacacacacatatgtacatgtatatcattatataaatttatgttttatatgcaatataagcaacatttaattgtgcgtgaataacatatgtccagatggtgatgagcacgctcagaatcaaatcaagcaggacgaggagaggtccaggctggcaggggccagcgctttagcctccgaggccagggagggcagtgtggggcggacacacacgtgacgagaaaggcgccacaggctgggatctg

SEQ ID NO: 20838 - DNA, 311 bp, Homo sapiens
tggagcaaaagcaccctcgatcatttacagacactgctctgacctggtgctacctggcactacattggtgatagtacatcctgagctttctgaatatttctaggacaattctacaaggagctctctcttcctcagaagagaaagaaccaacttcccgaggagtaacccagtcaagagacacagctaagggaagatcagcatgccccacggctatcagtaaggcaggagaccagtgctgaccaccacctggacccaacgaactcaccacctgaacttacactatcatgcactggcactccaaactggggtgg

SEQ ID NO: 20839 - DNA, 527 bp, Homo sapiens
aagtgcagagacattcttgtggaatagggatcagagccttcccttatatattattgaactgcatccatttacataaccttctgaagtcagttttataaagaggccaccaggctcatggcagacaggatcttacccctgataaaggctgacctctgacactgcaaagcccctcaccaccgtgccagccacagtgagcgtccgggctatgctctccatccttgctgacgaacagacagagcacacagcagggactcggtgggagtgatttaaagtactgaactgaagaagggaataaaccatatttgcacattctccatagctgcttctacacttataaaaagctgtctcggatgggcgtggtggctcacgcctggaatcccaatactctgggaggctgaggtgggtggatcacctgaggtcaggagttcgagaccagcctggccaacatggtgaaaccccatctctactaaaaatacaaaaattagccaggcatggtggcacacgcctgtagtcccagctacttggga

SEQ ID NO: 20840 - DNA, 494 bp, Homo sapiens
caccccactcccttggtaccaatttactgtattagtccattctcacatggctatgaggatatactcaagactgagtaatttgtaaagaaaagaggtttaattgactcacagttccacatgatttggaggccacaggaaacctaatcatggtggaaggggaagcaaatgtatccttcttcacaatgcagcagaagagagaagtgccgagcaaagggggaaatgccccttataaaactatcagattatgtgagaactcacagcataggagtaaccacctccatgattcaattacctcctgccccctgtgttcccccagaacatgtgggaattatgggaactacaattcaagatttgggtggggagggacacagccaaaccacatcacagcattttcttactttactattagcagacacaaagaagtatggattttatcatttggaaatatttttccattttttgaggtaatacattttttaaatggtagaataaca

SEQ ID NO: 20841 - DNA, 462 bp, Homo sapiens
gattgtacgtcagtctggtgagctttggtaatgtgagtctgccccaagggatggctctgcttcaaagtgctggtaaaatcaggtttctatgccagcaagggtgacataggctttagagcaagggtgtccaatcttttggcttccctgggccacataagaagaagaagaattgtcttgggccacacataaaatgcactaacactaatgatagctgaggagctaaaacaaaatcaccaaaaaaatctcataatgttttaagaaaagtttatgaatttgtgttgggctacgggttgtacaagcttgctttagagggtaaccactgaggaagcaggggggaccggggccctgccccttcctggaaaggaagattgggagactagatttgtggctctttctcccactgtttcagtttctttttaggctaggcacagtggctcatgcctgtaatcccagcactctggg

SEQ ID NO: 20842 - DNA, 374 bp, Homo sapiens
ctaaatcatagaattcataggaaatattaactgctttttaatttctccttgggaaattcaccaattttatacgttctgaactaggaatttaactagctcctatacatttacagaaagaaattgactgccacatatttgtgactattgttagaaaaaggtgaacactttatcctcgctactgagttgggaatatatctagatgacatttatgattgtttcctaaatcaaacaagatatttggggaagctctacttgcaaaacatattaaatggcaaagaagctttggttagaagtgaggaggagggctataaggaagaacagataggagtagaaaataaaagggccagaataaataaaagaagtctattttgtag

SEQ ID NO: 20843 - DNA, 512 bp, Homo sapiens
ggtggccctgagcaggttacttcacatctctgagcctcagtttcctcatcagaaaagtagggctagtagcaatgtctgtttcatacggttcttatgagaattaatgaaataatccacataagcactgtgcaggacacctgctctataaagagcccggaacaagtgcttatttcattctaagtagtcatgatacagttttaaagcagatttatccagctagaaattattggcacattttccttctggatactactgctctccagcctccccaccagaggaaggagaagaaaggagatgaaacctcaagaggacatctgcattattttagccactccgataagccgcatacaggaggaggaatttgtaacaacagctaaaagtgaagttattgaatgacctatggccattctggtccccatttagcatctcttgaggatatgtacattagtgtgaacgctgtacagtagcaggactggcctcagatcctttccctataaggagtagactgctct

SEQ ID NO: 20844 - DNA, 513 bp, Homo sapiens
tttcttctcattcattgaagattcaagtacccggtctcactgttctttacactactaatcttatacattcatgtaaatgaattatccaacacattagcctagatccagcttcaatcatatttttatacagtcatactttgaccttttattatcattctaaaatctctattttttaagtctcttactctctttaccatatccaatcttttgcttaccccatgaattctatttgaaccattctttgacccattgaacttccaatccactgactccttaacttttctcactggcaataactccccacatatgcacgcttcattcatgaaaaaaacaaattctcaattcccttgccacactctatcttcatattatgcaagtagcaaaatcttcacccagaataaatttgactctgactattttgctggtgataccctccagcctacagaagaagaggagccattcacagaaatgcagaagaagcttcaggaagatagaagaaaaacctggagacta

SEQ ID NO: 20845 - DNA, 520 bp, Homo sapiens
cattaccactgtcaaaaatgctgaaaatctgtatgttttcaagatgtattaacttgggtatgtttatttcacatggtaactccttgattatccaaaattcactgagaagaggatgttctatctaatacaattttctggttaaaaaaatcctaagacatgttttagaaaatccatggtctattaacaataattgtttgaaagattgtgagtcttatcttctgtaagatcagttgtcaacactcaatactgaaaaggaagaacgagagagaaatgagagcatcatttattgagggcctagcatggccctttcccagctttgaatcttagatctaccttttactgcctggagttgtttagcaagtgatttaaaatgtatcattatcctcatttatgaattgggatcatggtggtacattcccctagcaggttattaggaagactatatgagatagtgcaagaataaagaatctgcttcaacaaaaagctagaaacagttctgtcaaattcacatggaaacaaa

SEQ ID NO: 20846 - DNA, 587 bp, Homo sapiens
gcactaacactgtaattgccatgaattcaagcagaacatagaaataggagaaactgggctgctgtttttttaaacaagatttttttttcctttcagttcaattgaagtgttgctttctaaataccaaggacagttaatctcatgctttcaaatggtaacaatgaacccaagaatctaagagaataactttttaagtctagaatccttttttggactccctgttagacaacttcctatggagcgcaatttggggtcttgaagcattacatgtttgtttgccagagtttatccagaagaccagcactacttttacaagctctcttgactaaacttgtcataaagttggatggcaatggattaggaagtcttgtctggtacaccaccatttttgcaaaaagatgtcgactccatccctcagctcgtttgatctattttaactttaaaatatggatcttcccttagtcaacaacagaaaactctcaccagataatatgcctcaaaggaccttccaccggatccttatcaaattctctttgggagtctactggtaattgtttgaaggacacagtctattcctttctccacat

SEQ ID NO: 20847 - DNA, 324 bp, Homo sapiens
tgtttgaaaattctcccaaatataaacaaatatgccgttccatgtgaatatatttgcatataatatatgctaacacattattagcatatattatatgctcatcagtgatgacctctgagtgctgtatttaggaggcttttaaaatttgtttttttgtgtgtgctttttctatatattttgccatttcccccattaaataaccactgcttttgtaatgagaaaatagctacaaaactgggtttttaaaattaggtcattgataaccttagagtaatttcagtatgttataagtgtggaagatttttaaatttgtttgagtagtga

SEQ ID NO: 20848 - DNA, 451 bp, Homo sapiens
gaaggacaggtggctgggcgggggtgttctgaacgtgttgaagttgagacacctattaggactcccctcgatgtcaggcagatagatctatgagttgggagctcaggggcgaagtctgggctgagatataaatttggaagtcatcagcagacagatgatatttaaagcctgcaagagttaaccccccctccccacttccataacttaatcattcacaggacagtacattttcaaaagactggagaccaagagagcccgttatccccacgtcagcctttgcgaataggccaccttgatcttgcccatgaaaacataatcatcgggctttaaaactcacagtcaggaaagttcaagcaaagatgtgaagccacagaatttgttattcaaaatatcctttggtcgtggttccttccatccacctggagacagaggatttctgtaagcttcccat

SEQ ID NO: 20849 - DNA, 370 bp, Homo sapiens
ctacaacaaccctgagaggtcattatctttatcttagggaagaggaaaattaggcccagagaggtagagacttacctgggttccacacctagcgagaggcagacaggagaccaagcccaggtccagcaccacccttggattcaagcaagggcagggcccctgccccagacctggctctgcagggaccccacactttgtcatgccattttccttgagtatttctacatcctcctacagttcctggggctggctggggcaggcagtgccttctagcagttgccccttacctgtacttgtcctttgtgagccctggtctcatctctcctctttgggatactcctgatgttaccaagcaatcaatgggctcact

SEQ ID NO: 20850 - DNA, 464 bp, Homo sapiens
ggacatcgccccatcccagcagaggaaaacataacatacagctaacagagacaaagactttctattgccaggaacaatggccaacactcatcactcttggtaaagacagtaggaaactgggattcaaacacacagtgaagaatttcagttagatgcaaggaagaaatttccacagggactgtgagtgataatgtggtatgttgcaaagaaaactgaacttaaaatatagaacactggattttagttcctgctctgccacaaaccagccatgtgaccttgtgagaggcattttactattctgggtctcagtcccctcaactgctaaaagagtatcataataaatctctaattttccattcaaccctaaatgtttataagccaaaggttctatgatgcttccctttggaggctgtcaaagaaagagagaatatttcaagctatttccatttgtttggacacagatg

SEQ ID NO: 20851 - DNA, 489 bp, Homo sapiens
catgccaggctaatttttgtatttttagtagagacagggttttaccatgttggccaggctggtctcaaacgcctagcctcatgtgatctgcccacttcagcctcccaaagtgctacaattacaggcgtgagccaccaatgcccagctggaaaataattattcttaacttttaaaaactaaatagaggtaatgaggagaaataaactaaattaaaaatgcagaactttgaatcctagcttcacaaaatatctggtttaataattctgttaaattcttttattcagtaaatactgacttggtacctacagaatacaatctatttcagaataaagtgtttcaattgttgactcatctataaaatgtgaactagaaacagattgtttttttcaaagagccaatttcaaacagtactggaaactgtatggatcacgtactacacatacttacgagatgatttcatcagatttttgaaaagaatttgagcttcta

SEQ ID NO: 20852 - DNA, 444 bp, Homo sapiens
ggcagtatcagctttcatgtatacactaaagggaaacaaagttggatcaggtgtgctgataaatgtttaacaacaggctttccaggtagaaaaaacccctatatgacattcctgatgacctgggaaaataccaccaaagtggagatggaaataagtgtgtacaactagctcttgtgatccggtatgaactggctgcggtgcactggttgtatgtaaaggaaacattatttagaaagtaaatattttgattttcattttcagcaatggaaacagaggcttagcaggatggacatcttgattaattttatacagctagaccatgagggagacagaagattaagaatagcagttatacatgccaacctctgcattagctttaatcctgattcaagtgttgagattccaagtctcatattcttcctgttaatgcctgtggtaaccttt

SEQ ID NO: 20853 - DNA, 501 bp, Homo sapiens
agatagattagcaaaaagcattaactgaatggcttttgagaaaagagaagtacacaaaccagccatatcagcatgtattaatttatctgtatatgtaacttttgttaagttagttaacatctctgtgccgtcacttttttagtctttaaaataagttaacataattttttctatatttttcctataatatacatctttaagtacctagaagactcctggcacagagctagggctcaggaaatacagttaatttatttcttctctttttccccctttttatttcaagaaatgggtgggggaatattaatacctaagaaattaaaatgtatgctggtattaaaaaactcttgaccaggcgtggtggctcacacctataatccgaggatcacctgaggtcaggagtttgagaccagactggccaacatggcaaaaccccgtctctactaaaagtacaaaaattagccgggcatggtggcaggcagctgtaatcccagctactca

SEQ ID NO: 20854 - DNA, 508 bp, Homo sapiens
tgtacccgtgtcaaatgacccttgatgaggctgtctcactattacttttcctggaaagctagctttcatcatagcagaaaagacctcaccatgcagactctgctgggtcaccaacgggcagcaccagtgtctggtttatggcttcagaggtaagcagaggtccaaggacagtggaaaaaaaaaaatcagtatgtttgaaaacatttcaaattaatattaaaataaattcaaggaaacgccattagaaaagccagaactttgctgaactccttgcatttattttatagtttaatattgtttttattttaaataacaaatgggaggaagggcaatataatctcagtgtttagagcattgaagctccaaatctgcatacatgaaacagatcactggccctatgatatgatgttacaatgatccatatactcctatttgcacacacacacacacacgcacatacacttgataatttcttgcaacaaaattttatccatttactttaaggatt

SEQ ID NO: 20855 - DNA, 494 bp, Homo sapiens
aaaggagtaaactgtgggtgcatgttacaacagttgtcactctcataataattatagaacgaaaatatatcacaccaaaaaagattacgtgtggtatggctccatttacatcaaattattggaaataaaaactaatatatagtaacagaaattaaatcagtggatgtctggggaggagggtgacaagggagagactacaaagagtcatggagaaacttttggtggtgactaatttgttcattatattgattgcggtagtggctttgggaatgcatacatgaatcagcatttatcatattatgatataataaattcataaatgcataaactgcacaatttatatatgtgcagtttattatatgtcaattatgccttagtaaaactgatctaaaaagttacatatgaaaaaactcaatattataaatctgtcaattatctccaacttgatctatagattcgacacaatctcaatataaattccagcatgctcttct

SEQ ID NO: 20856 - DNA, 518 bp, Homo sapiens
gagggactctcacaggggcagctataataccacaaccctggcttctcagagcctaggcccaagaacagccatgaccctggtataggtactcctatacactcctacacagtggagtgtataggagtatacctataggtactcctatacatttctacacagtggagaagccaactctgggtgaggtgaactactgcatgcccatgtatccggctagagaaccaacttggaaattatatcctcagtgtatccaccctccaaccaccatatacatatacaattagctgaggaaacagcttggtggaccagttcccagaaatgtcacaccaccattgccaaaaactcccacagcttaggccaccaaggcactcatacctatctctaatttggagtatgtctgatgaatcagcacaaaaattaaattactgggtccacccagaaccaaagcaaatgcactccactcaaccaacaccatgggacccatttatggtaataagcctctctttttaggaaagctgctc

SEQ ID NO: 20857 - DNA, 549 bp, Homo sapiens
taagacttcatggtattgttttcatcaaatgggaaataaggtcagataactatggaacaaatatttatgtagtagtctctcctgacatagtgaatataacggtgagcctgctgaaaattctctgcttcattaagcttacattatgatgcactaatgggtggaggtaggtgctattacattttgaggaactgagtcccatcctgatttgttttaaacatcttaatttttgtcaaattataaagcttgttgaatccattcaattttttgccacattgatagggaataattatttattcagtgcttcacgtattctttacatttgtatcaaaaaaaggatagtggctttggcattccaaaattaatgaagaatgtgatagtcataataatagtcatgtaacttggtgagtagaatatatattctgttgtattcatagattaatagtttttaacatggtgagtagagcaaaccattacttggctaaagagtgttcttagaaattatataagaagataaaatgcttacaaataattggtatcaaatgatattta

SEQ ID NO: 20858 - DNA, 539 bp, Homo sapiens
ggttttttatgtctccttggttcaattttggtagattgtgtatattctgtaatttattcagtttctttagatttttccattttttttgcataaagttgttcatttggccttgcatttttgtctgaagcaacattctagccagagtgacaaatatgtaatgaattaatgttatcttcataaaataagttatgttaaaataatatattaaagtacatgtccactatatttttctgaaagttactttagactagaacttgagaatgaataagtttcttgttttttatatttatttattgtattaaaactgaagataaattattccagatttaatattagattggtgtattagtcagttttcacgctgctgataaagacatgcatgagactgggcaatttacaaagaaagaggttttaggtttattggacttacagttccatatgactggagagccctcacaatcatgaaggaaggcaaggaggagcaagtcacatcttacatgaatggcagcaggcaaagagagagcttgtgcagggaaact

SEQ ID NO: 20859 - DNA, 378 bp, Homo sapiens
acttctgaactccctcaaagatacctgtggccatttactaaggacacaaaaatacccaggcatcttaggttactagaacataagataatggtaaaccctacacatctaaaaccactctgggctggacataggagactgaggcaggaggagcacttcagcccaggattttgaggcttcattgagctatgattttgacaatgcactccagcttgggtgacagagcaagaccctgtcttaaaaataaataaataaaaataaaggctaggctcacgcatgtaatcccagcactttgggaggccaaggtgggtggatcacttgaggtcaggagttcaagaccagcctggccaatatggctaaaccccatctctactaaaaata

SEQ ID NO: 20860 - DNA, 493 bp, Homo sapiens
gaaaactgagattcttttcatatgtccagaacatgccatatatgaggtcttctttatgtatttgtttattctgttttctccattcttaactcctcactctgcctcatgaaacccttaaagaccagctcaaatactgccttctccagccagctttgtctaaacaactcagaattacatttttaagttcaaccagtgttcagtgcactaatgttttgtgcagattattatctccctaaagataggcaccttgttatttaggcatttattcagcaaatacatatgaggtaccattgggttcatgtgcctgggaccagctgggagctgaagttataaaggagaaagatacaatctctagacttcccaggagcatatttcatgggagaaagagaaggaaactggtcactgcaacatagggtgatgagaactaaaagctggttacaggagcacttgggaaagtcacccaacagtactgactaattcaggaaagactttc

SEQ ID NO: 20861 - DNA, 563 bp, Homo sapiens
aatagaattgttctatattaaagaaaaagagacagaaccaatcactataatgatctctcctggattggatcctggataagaaaaactcatgtactttgcaataaaggatattgttaaagcagatgaaaagatttgaataagctctgtataccagaaactactattaaattaataatgatttctttattttgattattatactgtaattgtgttaaagaatatcctagttttaggaaatatatgcaaatatttagtggtaaagagatactatgtattcatctcaaattgaggctatctctcatataaatacatttttttaaattcctttagcagtctccttctttgtccatggatactactgtcttgaatggaatgggcactggaggcttgttaaatcactacgtatgcccatcaaaaagaaattgacaatgccatgtgttggccaagatatgaagcaggtcacattcttctaaattatggatttgagaatataaaataatacaatcacttcagaaaactgtttggaagtttctactaatgttaagcatacacttaccctatga

SEQ ID NO: 20862 - DNA, 509 bp, Homo sapiens
gacttcctgtcataggtgattcctaatgctcctgacccatggcagccaaataggttcccccttggaggcttccattctgccctgttacctgcccttattttcaaatttggaatgtttgtagaagtctgttagtatctctctcacttattttgggggtatcatactgttttcacagcaaaagagcttgcagtcagctttagcttcttcctttaatacatgaggggtaacacctgtgctatttgttttctttcctaaatgccttcacagaagcagttttgaaccagagaatatacacaattaagtaaaaggagttgagagaaatcacatggagagcaataaagaaaagaaactaaccattgttgacagtgcactgtgttctaggcactgtgtagctaccccctgcccccagtacctgcctttctttagagcacatattattttttaaatatttatttatcatcctcctgtctccattaaaatacaagttccacgagggcagacaatttagt

SEQ ID NO: 20863 - DNA, 319 bp, Homo sapiens
  misc_feature 276: n = A,T,C or G
aaactggtatcctcctgccccagaagtttctccaagaaatcctcctcatttccgactcatatccaaagaacagacaccttgggattccataaaattgacttttgaagcaacaggtaagtcatataatagttttttctcccctcctttatttcttaaacttgttaataagtggcatgtatgtttttccctcagatatatcacaggaaccagcaacttaggaagagcctgtgatgtttctaaaatcaattgaagctggttatgacttctttttttttntaatggaaccccccccctcgggggtaaaggaaattcccccccc

SEQ ID NO: 20864 - DNA, 533 bp, Homo sapiens
cagggtacattataggattttggccaaccagtggattggttgcccttgagccaagagcttacttgtgatcttagccatagtggcaaattgcccaggatcaagtggtcagattaaagtagctgtaggttcatcagtttccttcaggaagcattttgggcatattagacactgggattcttacaataggtggcatgctaaatgtccagtagtttcctttcagatagtgtttattgagtacatacctaatgttttccaatgctaggttttggggaattcaaagataaataaagtatccatggaagtcacagtgtcactaaatacagacatatggattcaagaaatgttgtaaccagcctgggcaacatggtgaaaccccgtctgtactaaaaatgcaaaaattagctggatgtggtggcaggcacctgtaatcctagcttctcgggaggttgagacaggagaattgcttgaacccaggagacagaggttgcagtgagccaagatcgtgccactgcactccagcctgggctacagag

SEQ ID NO: 20865 - DNA, 584 bp, Homo sapiens
atctcagtggtacctttgggtgaagcatactcagaaagaaaatgtttaaatggcataaagccttccataaaaatgaaaatccctatcatgaattgatgatgtctatgcagcagatcttgtgcttggcagcttattatttcattaaatctgcacaaaaactcaatgagtttaggtctttttacagccccaattttacatatgagtaaatagaagctcagaagttaaaatgctctggaaaagctcacatggctcttgagaaggtagaattaagatcatttcatatttcccctttcagttaggagagttcttcccatatctcactcgttgtattgtaatagtttcacaaatcacagatagagacatttagaaataactttgaacataaataattgcattatagttgaaatgtgtacaggcacgtgattcaaaatttgtttactcagataccagaactatttgattctttcaaataccatgcctacaattcacagtttttagaattacactgtgatttagcataagtacatttcagtgaataccgaggcaatgcctttggaagagaattgtttacagcaatctatttt

SEQ ID NO: 20866 - DNA, 531 bp, Homo sapiens
agtgaaagtagctaaactagggaagagaaagaaggtgaatccattcaccatttgagaaaacatctgcctgccaagcatagacaattcagttgtggatccagaaaattccttcccccatcaaatttaagatgagacttttatttatttattattttattttatttttgagatagggtcttgctctgttatccaggctgcagtgtagtgctgcaatcatggctcactacagcctcaaactcctgggctcaagtgatcctcctgccttagcctcctaaagggctgagattacaggtgtgagccaccacgcctggccaagaagagagttttaaatgttaataaattggcctgtgataacactgaattatattgggtttcaagaaatcacaaaaaaagcaacacctccctgctgtcagcagctcatagaatggtgggctagacataaacgtatacaaggaaattgccacattgtaagaaaatgtcctattagtggcacatactcatggccatggaagagcaaagaagaggagatag

SEQ ID NO: 20867 - DNA, 408 bp, Homo sapiens
agaccagacgaagctgtcgattcaggtgcccaggatgcctggaaacacctggattctcccgattttattcaaaagccaaatgcgtttgcctactgagaacaaaaataaatctttcttctggtaaagggggaaattagcaagtgccaagtgaaaacacattttctctttccctggacttgattggatgagaccatgaacaggcaaaaggagccaacaggcctcctggccccagagctgcatccaggtgggagctgttgaggcctcagctatacttcccgtgaccttgagaggtcacgatgccagggctggaggccattgtggctcactgtaacatttccagatgttaatgaatgtttcaggagtgattgtgaaattcgctaagtgaaatttatttccctttgctctgac

SEQ ID NO: 20868 - DNA, 486 bp, Homo sapiens
ggtctgctcgctggcttacccctaggacgggcagctcaccacttctcccggtcagttctgtttaagagaagttcctttctgcctgtaagcaatgaagtggaatgatcaccaaaaagtggtgtaagaaaagaaaagtagacccgcagcggggtgtattcgtgctactgtttgtgtaaaacacagaaaaaagaaaggggtggtctgatgtatagtcatacacaccagtggttttggagggagtttttgtggatataccacattctctccatttatcagggattttgccctgacatccctccaccaccacgacatttggcaatctctgaagacatttttggttgtcataactggggaagtggagaggcgatactggcatctagtgagtagaggcctggaatgctgctaaacattctgcggtgcataggacaccctttccacccccagccctgccactacccccccaaaaaaaaaccctgcaaaaaatgc

SEQ ID NO: 20869 - DNA, 474 bp, Homo sapiens
tggcacgatcttggctcactgcaacctctgcctcccgggttcaagcaattctggtgcctcagcctcctgagtagctgggattacaggcattcaccatgacgcccagctagtttttgtatttttactagagatggggtttcaccatgttggccaggctggttttgagctcccaacttcaggtgattctctcacctctgcctcccaacgtgctgggattccaggaatgagccatcatgcccagcctttatttttaatcttacaaccaattaaaaatcaagaaatgagcttaaaggaagccacaaggggatatgccaaacaaaaatgtgggttcattttttaaccttaacttgtattttcagttgactgacagccaatagttggcaagctagttttggcctatgtcaaagcagtaaaataagtccccgtcatgatggtgtccactgtctaatcgaggaaaatgggtatctacatcat

SEQ ID NO: 20870 - DNA, 475 bp, Homo sapiens
gcattttagcgagttgtttatgcatcatttccttgctgaattatgaacaatgaggtaagagaccatgtatctccacacatcttatagtgcctggcccatggcaagatctcagaaaatatttgttgaataggtactgaataaaacgaatttttcctggccttaaaaatattgtacaatgtaatataaattcatggtttccaaatatccaagccgactctcttggagagcatgtaaatcctaaggactctataattcaacactgtttggcaacttctccttgtcctgaaatactccagctctggaatataccttggggtagctgtaggtctcattgtaagctatggaaaagcatattcagcatgataaaatctgggatgagaactcttgagctctgaagtgagctcctgggataaatggggaagagcttcgttaataagagtggcagccaaaggccagtagggaccttcagaagtca

SEQ ID NO: 20871 - DNA, 472 bp, Homo sapiens
aaacagtttagttctttctaatctgtatgatttttattaatgtttattgacaatgtactagagctaggtgttttggtacaatgcacttaactgtacatacatccttgccttgtttcttaccttagagaaagaattcattctttccttattaagtatcagtgatgtctgtggggtctgtagttctatcccctgtatctctcctgatgctgttaaatgtgtgccttttctttttttgcctctcttttccttagttttaataaacaaacaataataatgtaataggttaacataaaaggaaactgattgaggcatataggagaaatatgtgtactatctttgcaaatttgttgtaaattcaaaattattccaaaaaaaattttaaaaatattaaaaactcattaggtttattagcttatataatttcaatatcaccgattagagaaaagccaaagatttgtcaattataagtatt

SEQ ID NO: 20872 - DNA, 549 bp, Homo sapiens
caacatatctgactgaggattgaatttggcttctctctcagctgttcagttcctatattatacaaggttagatccctttctctatgagcagaagaaccaaaccatctgcagcttcggaggagaaaatgtgctttcaattatgcacctggcctgaatgttgagccgcagttcgatgggtccctaattgagccatcatggtgcgaacatacagggagacactgtgtgcatcaggcctgtgggttttgccctaagataatgacagtacagcagccacatcaccacggtgaccaccacagctgccaccactgtcacctccaccaccgcagaaggcccaagagcctgcagacatacatgctgggtgagaaggaagttacccagcaagggtccagggcagcaggctgtgttagggtccctggaaagcctccctgtatcctccagccagaatgcatcatcctgtccccagagtgcctggcctgctccacagtcacctgtctggccccaaacccaaagaagacccagacaacctctccctactcccagcaggacact

SEQ ID NO: 20873 - DNA, 566 bp, Homo sapiens
gctatgggagggttctgttcttggtaataaggaataagatgctggtttcaaaccatgagaccagcttaattgtacttcggagattacgttccagaagccagtaataaccaccggttcaaagagattagaatccagcagctttaaactgcctggatatgcgatgatgggaagaaagggccattcagtatgttctgcaagttcccctaccccctcttcccagttataggcactttttctgctcctgatttttccagaactatagactgccacagggttctttattgctggcaaattttaagtgaggggggatcagtcctttgtacaaactacatgttagcaattaaattcacttgattggctgggcatagtggctcacacctgtatcccagcactttgggaggccaaggcgagcagatcacctgagatcaggagtttgagaccagcctggccaacatggtgaaaccccttctctactgaaaatacaaaaattagccaggcgtggtgatgcgcacctgtaatcccagctactccggagactgaggcatgagaatcgcttgaaccctgga

SEQ ID NO: 20874 - DNA, 549 bp, Homo sapiens
tgtgcccaggctggtctaaaattcctggcctcaagggatcctcgcaactcagcctccccaaatccagagattacagggattatagttataagccactataatcagcccgtcttgtttaaaaatcaaatccctccctatcaaactcagctttctgaatcgcactttgtcttttccaaaacataatattctgagctcagcagacacttccttatgcgctgttacgcatgttagcgttgctggaattacagtaagaataatcatctgccaagagccagttcaacccatttctgatataaaaagccattttagcactttgggaggcagaggtgagtggattacctgaggtcaggagttcgagaccagcctgaccaacagggtgaaaccccacctctactaaaaatgcaaaataaattagctgggcgtggtggcacacacctgtcatcccagctactcgggaggctgaggcaggagaatcgcttgaacctgggaggtggagtgagccaagatttcaccactgcactccagcctgggcgacagagactccatctc

SEQ ID NO: 20875 - DNA, 404 bp, Homo sapiens
attctagagacacatatgtaatgattaaacttaaatgaaaacgaaaatattctaacctgaagttttaaacactgatacacacacacacacacacacacacatacacacaattaaaagaaaaaataaagaagaaaaatcaaaaccaaacacgtctccagaaaaatttcaaaaaattagccaggcatggtgcatgtgcctgtgatcccagttactcaagagtctgaggtggcattatcactagagcctggggaggtcaaggcttcagtgagccatgatcatgccaccgcactcctgcctgggtgacactgtaagaccctgtctccaaaaaaaaaaaaaaaaaaaaaaaaaaaaagggggcctttttttccggaacccccaaatgaaaaaaaaccttgggggggggg

SEQ ID NO: 20876 - DNA, 591 bp, Homo sapiens
gtgctagcccagggttgggctacggaagcactctgttacctgctgctgtttctcagaagtgagccctttggcatggagagctggaggaagaggacgaatgctcaaggtctcagggctggagaggaaatcatgatcatggggtggcaaaggacctcaaggcactgccagacactctgggctcttggagaactgttcagagttggcgataactttctgtaatcctaggcatctcttctcttgtcacatttcattgagatatctgtctatcctatttaacccaagcctgattttggataggatccagaaatctaggtgaatttcaggggcctggttgcttcctcatctagcttggtggtaagaagctcagcccctctctgtgggccatgtggagagtacagaaaataaaactgtatcagggccgggcgcgatggcccatgcctgtaatcccagcactttgagaggctgaggtgggctgatcacttgaggccaggagttcaagaccagcctggccaacatggtgaaacctcctctctactaaaaatacaaaaaatagctgggtatgggggcgggcacctataatcccagctactc

SEQ ID NO: 20877 - DNA, 567 bp, Homo sapiens
tgtagtcccagctactcaggaggctgaggcaggagaatggcatgaacccgggaggcggagcttgcagtgagccgagatcgcgccactgcactccagcctgggcagcagagtgagactccgtctcaaaaaataataataatatagagttatgtacatgtggagtatttactaaattgatctgatcttatatgaattatttcaggcactctcgtcttcatcttaaaatggaatgggaatctacatcatttgggacttcccattactctcagaaaatagcccacctctgctttttgaaaataattctcggccgggcgcagtggctcacgcctatcatcccagcactttgggagtctgaggcgggcggatcacgaggtcaggagatcgagaccacggtgaaactccgtctctactaaaaatacaaaaaattaaccaggtgctgtggcgggcacctgtagtcccagctactcgggaggctgaggcaggagaatggcatcaacccgggaggcggagcttgcagtgagccaagattgcgccactgcactccagcctggacgacagagcaagact

SEQ ID NO: 20878 - DNA, 570 bp, Homo sapiens
ctgtaaataaaaggcatgactgctggaataacctcatgtgagagggtgacagcatcgaggctctaagtgtcagtgatactgttagggttgcaatgcagaggagtggatcccaaagccctcctggaagaatcctccaggaattcttccaaaataggagcaaaagtacaagaaatagaaatgtcagtggaaggagacttataaatccagcatgttcagtaagagtttcagaattagaaaataactatatatgaaatatcaagaaagaaacagggctggttgtggtggctcacatctgtaatcccagcactttggaaggcgaaggcaggagaatcgtttgaggccaggagtttgagaccaccagcctggccaacatggtataccccatctctactaaaaatataaaaattggctgggcatggtggtgcacgcctgtgatcccagttactcgggaggctgaggcaggaggattgtttgaacccgggaggcagaggttacagcgagctgagatcatcccactgcactccagcctgggtgacagagcaagactcacagagcaagactctgtttcta

SEQ ID NO: 20879 - DNA, 106 bp, Homo sapiens
attgattaaccaaaaaaagtttatttttgagaaatttaatttttagataagcaatacaggataccccagtaacccggccagaaatggaaatcagtaaatgaaatga

SEQ ID NO: 20880 - DNA, 527 bp, Homo sapiens
tgagggtcacagaagaacggcccaggagctgctctggaaagtacaggggcccactagtcatccctacatcccctcgctgcaggccaaaaaccccaccagtttagaaggtgagtcactgttagggattgggaatcgtgtccccccaaaaatccagatgtcaaaatcctaacctacagtgtctcagaatgtggccctatttggacctacggtcatcggcatatggacttagttaagatgaggttgcggccgggcgcggtggctcacacctgtaatcccagcgcttcgggaggctgaggtgggtggatcacaaggtcaagagatcgagaccatcctggctaacacggtgaagccccatctctactaaaaatacaaaaaattagccagaagtgatggcacacccctgtagtcccagctactcaggaggctgtggcaggagaatcaggagactcacttgaacccgggaggcggaggttgcagtgagccaagatcgcgccactgcactccagcctgggtgacagagtgagact

SEQ ID NO: 20881 - DNA, 561 bp, Homo sapiens
ataataaactggtggtgttatctattctgtacagttctctgggggctgattacaagtgctgaatggcagtattaatctctgttgtttttcacttgagtgatcctatacattaaagtcacagtgtacattgtttctctgcttgatttctcctcatctcaaaatgtagggtcaaatgaaagaggcaggtagatatttagagaagagcattttaatctaaatataaccatcacgtactattagtaaagaaattaagaggccaggcatggtggctcatgcctgtaatcccagcactttgggaggccaaggcgggtggatcatgaggtcaggagttcaagaccagcctggacaacgtagtgaaaccccgtgtctactaaaaatacaaaaattagccgggcagggtggcatgcgcctataatcctagcttcttgggaggctgaggcaggagaatcggttgaactggggcggtagaggtcacagtgagccaagattgcgccactgcacttaagtcagggtgacagagtgagactccgtctcaaaaaaaaaaaaaaaaaaaaaaaaaaa

SEQ ID NO: 20882 - DNA, 451 bp, Homo sapiens
gaaatgaaacgttaaatcaattaaacagaacagtattttctattaaaactatagaagaactgtgtagttaacttgaaagaaatctaaggattccttagagaccaataaattaaattgtgtattaattaacaggcattaaaaacacatagaatttggactcaaaatacaaacagcaagtaaacactaaagaaaacaatgattcaggccaggcacaggtggatcacgaggtcaggagatcaagaccatcctggccagtgctgaaacccagtctctactaaaatacaaaaattagctgggcatagtgccacgcacctatactcccagccactcgggaggctgaggcaggagaatcacttgaacctgggaggcagaggttgcagtgagccaagatcgcaccactgcactccagccagtgacagagcgagactctgtcccaaaaaaaaaaaaaaaa

SEQ ID NO: 20883 - DNA, 474 bp, Homo sapiens
aatgactcacgctcttttcctggtatcagaagaaagtgccactgataaaaattgtgtgcctgggtcccacctacttctaattgtcctgctcaagcctacctgttcctcagcagtgctggtagcttattgatgagaacaaagacggtacttgggaaatctaaggaagggcaatgtggcaggtaaaattgtcagtaagccgggcgtggtggctcacgcctgtaatcccagcactgtgggaggccgaggcaggctgatcacctgaggttgagacttcgagaccagcctgacaaacatggagaaacctcgtctctactaaaaatacaaaattagccgggcacggtggcgcatgcctgtagtcccagctactcgggaggctgaggcaggagaatggcgtgaacccaggaggcggagcttccagtgagccgagattgcgccactgcactccagcctgggcgacagagcaagactcggtct

SEQ ID NO: 20884 - DNA, 565 bp, Homo sapiens
atagcaggtgacagttttaccacctatttagccttccatgacaagggttgccattattccaacttccaataatggcttcctcattgtacgccccctgaatcctaagcaaatattatatacagttaaccctctaacaatggagaaggggggtatgggagggttggagagctgacccctaacacagttaaaaatccacatataacttttaactcttccaaaacttaactactaatagcctactgttgacctgaaactttaccataacatatacagtttattaatacatattttgaatgttatatgtattatatactgtattcttacaataaagtaagatagtaaaagaaagtatcattaagaaacatgcagtggttcatgcctgtaagcccagcagtttgggaggctgaggcaggagtactgctcaagtccaggagtttgagaccagcctgggcaacaaagcgagacctcattgctacaaaaatataacatacattaggtaggtagagtggctcatgcctataattccagcactttgggaggctgaggaaggagaatcacttgagcc

SEQ ID NO: 20885 - DNA, 495 bp, Homo sapiens
ctctactgagggttccataagataaagtattcctgtgtaaattaatagttcaattaataacttattttttttctgaagtggaaaacttactgctccaggaattgcacctccatctagtcaaaagaatgcaaaaacaatcttttccttttctaggaaattaagtgctccatattttcaatgtttgtaaggtcgtggctgataatctatgaatattctgagtacataggatctaaatagatttggtaggtgaaataggcataatttgtgacttatgggcttctaaatttcacatgcttcaccccttaaaatctagatttccactgtatttttagtacatctcccctcaacaaataattatttaccattgttttccttgaaatattgaaatcacctttgaaatgtgtttcctagacaaaataaaattggcaaggcattattagccactaatagccaaataaaaatttgtttataaagattagcatccacaaaaatctt

SEQ ID NO: 20886 - DNA, 493 bp, Homo sapiens; identical to SEQ ID NO: 20799

SEQ ID NO: 20887 - DNA, 539 bp, Homo sapiens
agtgattggccgcctcagcctcccaaagtgttgggattacaggtatgagccaccgcacccggccaacaactattaaagtggcaccaaagactaggaccaaaatgaaactttctccttgatacaatcagaattgaaagggagttgaaaagggaataattttctcacttctgactcaatattatttgaatcaacatacacacgcttcctaaaacattcttaaataccaacagtgctgcctattccccactttggaaaatttgccccataccataatgaatgtctgatttttaaatctgttgacaagagaaggctgaaactggaacataagagagattcagtttggatagaggaaaatgactttattttttgtaagtatatcacccctcaggagatataaaataatttttaaaaaatttcagtccagtaataggtgaggtaagtgaaaagtgagaacactggaggtgagggcatctcctttcctagaaagcattaagaataggccacttgctgggtgcagtggctcacgcctgtattcctcg

SEQ ID NO: 20888 - DNA, 568 bp, Homo sapiens
agctcacggggcaagggccagtggaacagggatgtgttcttcctacagaaagccttgtgacttcctgccctttcagtaaaggcttttgtgcattctactggaatgtcaggtatcaaaccactaccgccaccgcatagcccttgcccgcctgcagtcggccttctggtccgtctgacgcagtcgaactctgcagcgttcaccttgcttcctatcttgttttgcttccaactttccattacaaaaaaacttccaacatagagaatattaacaactacttccgaccgggcgcggtggctcacacctgtaatcccagcactttcggaggctaaggagggtggatcacgaggtcaggagatcaagaccagcctggccaagatggtgaaaccccgtctctatgaaagatacaaaacagctgggcgtggtggcaagcgcctgtaatcccagctgcttgggaggctgaggcaggagaatcgcttaaacctgggaggcagaggttgcagtgagccgagattgtaccagtgcactccagcctgggtgacagagcaagactccatcccaaaaaaaaaaa

SEQ ID NO: 20889 - DNA, 579 bp, Homo sapiens
acttcttgaaagctgccaatagcccctgaaaaaatagtacacactcctcagttatgtagattaaacaagaaaacaccagtagtttagccacttgtcaagtttcaacttaacttattatcatcatgatatgaataggaatgtataaaattctcagtttggggtagatgacgctatggttaaaactggaattttgtaatataaagcaagggggaaacaggtataagataacaagtggcaaatgacacaggattaaagaaaaatgagaaaagaaggggagaataaatgaaaatcaaattgaagagggaggaactagaaaaactgtaggacaaagtgtaaatgaaagaaaatagagccgggcgcggcggctcacgcctgtaatcccagcactttggaaggccaaggcgtgcggatcacgaggtcaggagctcgagaccatcctggctaacacagtgaaaccccgtctctactaaaaatacaaaaaattagccgggcgtggtggtgggcgcctgtagtcccagctactcaggaggctgaggcaggagaatggcgcgaacccgggaggcggagcttgcagtgagc

SEQ ID NO: 20890 - DNA, 619 bp, Homo sapiens
ttaatataaacccttaaatactcatttctgtatgaaatatgtccgtgtgtgtgtgcgtgtgtatgtgtgtgtgtgtagagggagagacagagagacaaacagacagtgagacagagagaaagacagaggtagaggttatgacaaagaaatataaaaggcatagcgaaataggattagcattcttcctaattatgaaagtattcagaaattccttactcatttcttaataattgtattaagcagtcaaacatgtagagtagatatatttctagtaaattttagtggttaggaaatcatcaggccaaaattgccacatagacttgtagcaactctcctcccaaatcagttaaaaggaagcattaattcatacgtagttacttaaagttacaattcaaaaaaagtaaaggaatattctattttttctacatgtgcaaacaaaaaacaccggatgtaaagatgaaactcaagaataacttgtcttttattcctaagaggacaattaaatggtcagatgtgtactaataggttaaaactcacagggattgaacatgagatttgtgaaaagaacattgtacaaagaaaattaatagaaactcgggggaaaaaaaaaaaaaaaaaa

SEQ ID NO: 20891 - DNA, 600 bp, Homo sapiens
catattttttaattactttatttaatacagagaagatgagaagacaatgtaaatgctgctttgtgagtgatgggaagaagtacttttagtgatagcagtgaatcaaagcataaggtcatcaatagtcgacttcattgcccagtgttttcaaagtccccacgtgtgttggttattctttagtaaagtagacgtgacaatgctcgttggctgttattgtgaagcttgactgataatactgggattttgagatcaagaggctagaagccaagatgtttgaaatatgtaaggtcagctgcctgctctttcctcctcccctacgagtgaatcaacacttgctttataagcttttcttctctatctcctttctctattgttagtttcacttcctactcttaaaaattctgagctttcaaaatcatgtttatcaggagaaaaaagagactgaaagagcttaaaatgggatacctctggccgggtgcggtagttcacgcctgtaatcccagctcttaaggaggcagaggcgggaggatagcttgagcccaggagttcgagacctgcctgggcaatatagcaagaccccattctccacaaaaaaaaaaa

SEQ ID NO: 20892 - DNA, 599 bp, Homo sapiens
tcgttctttcctggtggttttctttatctggtctcatgaagttttattctatacatgtacagcttagtattcaaccaaagactcaaaggaatcgctatgtagatattggagttctttctctacagaacttcctcttatcaatattctgccccacaaactccagccacctcaacctccccaaaccccgttcctcttctttgtgctgtggttcagatagaaaccagggaaattgcagggcttacctcattattttctttctctcaaggatgaaagtcttgcactacctgttgtttaatatgtgaaaacttgttccatacatttaatctagctttctagttgcttatagagatggggcaaatttgcttccatgcattccatcatggccagaaggtggaaatctctggagattttattggaatcatactaaatatgcatatcaaatcttccatcccaaagatattttctgtctgtccacacacttggtatttctttagtgttgtttatttaagagctaatgcataaagccaagcgtggtggctcatgcctgtaatcctagcactttgggaggccaaagcgggcagatcacctgagctcaggag

SEQ ID NO: 20893 - DNA, 514 bp, Homo sapiens
aatgcccattgaaactactctatatgatactataatggttgatgtatgttctaaattagcccaaatctagacttatgagactgggctagaaatatgaatgacacaagaggttgtaagagaactaaaaattatctcatgaacttcaagatcatcccctgggtcccagaattaacaatgagaatacagagaatgcttctgagaaaactgaaagtaactacttcattttgtgacctgccttctgtatgcatctgataattttggtttccaaaaagattgttactaagtagtataaatcatgtacattgggcagaatgtgtgctgagataccttctaggcacctgagctgccaagagcttaccacacgtggagctgcttcctgcttggatgtcatacctggaagctgtggtaacaatggcagcctatgggtcagttctacagctgatgaaaatatgaagaggtgatggtcatttttctggaagagtttctggacttctcaggcagtcacttctgtatt

SEQ ID NO: 20894 - DNA, 603 bp, Homo sapiens
taacattggtgattgaatgttaattttctaaacatgatattgatattgtggctacttaggggaaggttgttacgattagaagatgcttatgtatttacgggtgaaagcacgtggtatttgcaccctactttcaaattgttatgcaaaaataaacgaataagcaaataaagatgtgtttctgtgtgcatgcacacgagcctgtgtgtgcgttagcgtgtgtgtgtgtgtgtagtgtaggagggagaaagagtgaaacacagaatgccaatgtggcaaaatcgtaaaaactgatgaatctaagcgaagaatatgcaagtatactttttcttattctttcagtgtttctgaaggttttaaacttttcaaaatagacacaaggaataaaagactcagtaaaatgaggaattaattcacgagctacagaaaataatatgtgtataaataataatggtaattatgaaacatatgatgtgtcacaatttaagtgggagtattaagatgactcacttgtaactgaagatcaaaaatcacaaaatattgttgggtttttgaaattatattttcctaaatttataataggcccaaaaagaaacagaaattaac

SEQ ID NO: 20895 - DNA, 591 bp, Homo sapiens
gaaaataagaacttacttgtattctttatatggtcagtaaagaagtgatagtggaaaaaaacaaggtcaaatgaaggtgatgatttaggaagttggaaagatagcctaaactacaaaatggtatataactagtgaacacttagacacactgattgatgaacttcagcttttggattggtgagagcataaaatgagagcagctgaggtttgcaaatctgcaatctccttgtggaaaaacaggcgaaaacacatttcagcctaataagatttacctactaatgagtcaagacttgatccatttgtcctcgtaattcaaaagctaattcaaatactgatttgatatattgtgtgaacaaccgttgctgattatcatcgcatacctggcattctcttttatctgatatctaaaatatttggtaattcctggactttctcttttcaaacccagtacagtttaatttcaatcttagaacagttgtctttgagaaattcttccctctactgcatctgtgaatgggcatagcatggttacatacgtactatcaccacagagaacatttgttgaattaaagccaaagtttaaagcaacag

SEQ ID NO: 20896 - DNA, 593 bp, Homo sapiens
acttttagtactaataaaaccaagaaagactgcttaaaataaagacataatatgcttatactactattttaaaaagaaagactgcttacacaaaggaattaaattataccgaatttaacaggacgcacacaccctcacttctaaggtaatatctgaaaaatattctctgattaatgaaattaaaaggcataagcatgatctgtaaaaagtaacaggatttcaatcctaataattaatatattaactaattccagaagcagatcaagtgatactaaaaagcttctgcataccaaagggaacaagcaacaaagttaaacggaagcctatagaatgggagaaaatgtttgcaaacctcacatctaataaggggttaatatccgaagtataggctgggtggggtggctcatgcctgtaattccagcactttgggaggccgaggagggcggatcacctgaggtcaggagtttgagaccagcctggtgaacatgatgaaaccctgtctgtactaaaaatacaaaaattagctgggcgtggtgttgtgtgcctgtaatcccagctacttgggaggctgagccaggagaattgcttgaacc

SEQ ID NO: 20897 - DNA, 575 bp, Homo sapiens
tccgctcactgcaagctccacctcccaggttcacgccattctcctgcctcagcctcctgaatagctgggactacaggcgcctgccaccacgcccggctaatttttgtatttttagtagagacggggtttcaccatgttagccaggatggtctcgatctcctgacctcatgatccgcccgactcagcctcccaaagtgctgtgattacaggcgtgagccaccatgcccggcctatcttcactttattaaaaaaggaaacgagtgaggattacagccccaaatggacattttttcctgggtgctatgaaaaggaacaatggaaaggaaagggaatatttgtcttcttttgttttattgggtcgtgtttgtttgtttgtttgtttgtttgtttgtttgacagggtctcgctctgtcgcccaggctagagtgcagtggtgccatcatagctcactgcagcctccacctcctgggctcaagcgatcctccagcctcagcctcttgagtagctgggactacaggcacatgccacaacacccggctaatttttcctttttttttttttggtttttgggtttt

SEQ ID NO: 20898 - DNA, 170 bp, Homo sapiens
taaggccaggtctgaagtgagctctctgcgctgaggggatggtgtgaggcttggctccccaagtctcaggcatatggcctgttgctcttgccatcagcacacacttgcaggggctgagagtggggtaaaaaaaaaaaaaaaaaaaaaaaaaaaaagggggcctttttttc

SEQ ID NO: 20899 - DNA, 483 bp, Homo sapiens
cagttactttcaaggctgaggcagaaggatcgcttgagcccaggaggtcaaggctgcagtaaagtatgatcacaccactgcactccagtctggggtacagagtgggagcgcatctctaaataataatgacaatactaagaaattcagcaaatggatgtttcatatgtgtgcatttcattgcatgcaaatttataaaatctcaaagataactgcaaacattgaactccagttggtgatatgaatccggaaatgtttaagggtaaagagtactgatgtctgctttaaaattctttaaccttctttaaaaatacatttttaaaaaatcagatgacttgatagaggaatggactgatagatgtgtaataaagtaaatagagaaaaatgttaacaattgtagaatctagatgatggggccaggtgcggtggctcatgcctgtaatcccagcactttgggaagctgaggcaggtggatcgatcacctga

SEQ ID NO: 20900 - DNA, 302 bp, Homo sapiens; identical to SEQ ID NO: 19962

SEQ ID NO: 20901 - DNA, 532 bp, Homo sapiens
gccaacttactgccccacttctgtttccagaagtcacacacactagagtcagtttcatttctttgtagttaccctttttgcaactacagggctattacaaagtcacctgaggccactactttaaacagaaacatagtactacaaagccctagaatctaagacagccccccaatctgagggtcatctcagtccttgacactcctttctttgttaattccacaagaagaagaaattatagagctggcaccaatggtggcttcagcaccaatagtaaagggctggaggcaattgtaaacatcacctccacaatgaaggtaaccttattactcatcacattcaaagtgcagccctaaagaaaataatcacttcttattccttttctcgtatttttttcttggccactcattttcagctgagtgaagtattctactatgtgaaaatgattactagaaggaggtgttaggagagagaatgtttataagatatcttagtaagaaatgtatacttttgcctttgggaaacaaaggacaac

SEQ ID NO: 20902 - DNA, 583 bp, Homo sapiens
ttatttatatttaaacttgttgaataacaatgtaaacaccagcaatcaacagacacagcaaatgtagtttctagaagtctgatgtaagtatgtgttgtgtgttaacaaggcagtattctttgattctgtgtcctacaacttcatatttattcatacatttctctttctttattacatataggttagagtatcactcttcattattactaatagtgagtagtttccagatagcctgtgatttcccagggcatcttggcaggaaagtcagtaataagaaagtcaccaactagccgggcgcagtggctcacgcctgtaatcccagcactttgggaggccaaggtgggaggatcacttgagttcaggaattcaagaccagcctgaccaacatggtgaaactccgtctctactaaaaatacaaaaattagccagacattgtggcatgcacctgtaatcccagcaacttgggaggctgaggcaggagaatcacttgaacctgggagatgaaggttgcagtgagcctagatcacgccactgcactctaggctgggaaaaagagcgagacagtctccaaaaaaaaaaaaaa

SEQ ID NO: 20903 - DNA, 526 bp, Homo sapiens
tattatttcaaagttctttccactatattaacaacttctcatatgataaagttataaagtgttcataccacagagctcactataatgattaagtataggatttaagaataagccttgaaataactgaattcatgaaaataaagtgaccatttatgaaccacacagaaaatttcatacatctcattttagagataaaagagatacaggctatcaagacactcaccctgacaataaggatccatttgatcaaggaaaggccaaatccgcagatagcaccataccttccagctatggtattggtgatacagaaggataaacaaaatccaagccagttgaaaataaatgccactaaaagcaacagaaaccgttcttttataaaccacaatttggaaacaaattaacatagacatattaataatatttcatggctcaatggaaacagcagctccctttcttttaactctgccaattaagccttctttatagactatagcctactttttgcaaatggcttatttgctatact

SEQ ID NO: 20904 - DNA, 548 bp, Homo sapiens
actgtccctggccaaaatgcagtttattttgaaatgtttatttaaaaataagatgggcccagcactttgggaggctgaggtgggtggatcactcacttgaagtcaggagtttgagaccaacctggcttatatggcgaaaccccatctctactaaaaatacaaaaattagctgggtttggtggcgggtgcttgtaatcgcagctactcgggaggctgaggcatgagaagcgcttgaacccaggaggcagagattgcagtgagccgaggtcacgccactacactccagtctgggtgacagagcgtgacaatgtctcaaaaaaaaataaataaaataaaaataagatggatggatagagacaggaatgtataggtagatgcaataaagaagatatattaaaatgttgacggtagaatctaggcagtgggtatacaggtgtttagtgtaaaaaacctttagtttttctccatgcttgaaatatttatttttaaatgttcgaaaacattaaataagaatggatgaaacagcaaaccctaaaacaattctaact

SEQ ID NO: 20905 - DNA, 546 bp, Homo sapiens
ggatttttgagcataagttggcttaaatgtcatctttatgtccccaaggtctcgttatgatgtgacgtcactgcgtaaacccataaaccgattccagcatgaatataggttatccatggttagttatccattttcacactatgagccctcagggacatttttttccattcagtaactatatggatggctctccttctcctcactcctttacattctactgtggatcatctctgtttacaactctccgctcctctttctcaccagattccaagctctttgaggacaagctccacatctggttcattcttcttttgcccatggtgcctggcacagtgtggagcttccaggaggtgatgaataactgtatgtacaaagaacagatgcttatacttaaatccatgttttagagcatctggccagtcttacccactctctgaggaatgtaacattataaaaaacagttaagagacaacctggccaggtgtggtggctcacgcctttaatcccaacactttgggaggccaaggcaggtggatctcttgagcc

SEQ ID NO: 20906 - DNA, 557 bp, Homo sapiens
tgaagtattaaaaattatagatagcgcatgatttaaatggaatcctcttctcagaatgttaaccactaacacacttacagtactctcaggacaaactctgaaaaatagaccataaatcccacagggtggatataccaagttgcatataaagcaaaccaagcccttaagacaggaaacagaacattcaatctcaatccagagaactttagaacagatatgttcaattcaaagttttcttcattgcttgcatactaggctctgagaaagccaaaaaagtaaccaagaaatgtatactcagaaccgactttctgaagctgacaaagtaaaatcccaaaatgatataatatgtaggcatgggatgtatttttgatacccaactcagattgtataacaaataaatgtcaagggtattcctttcaagcctcacctggttacagcaaacttagagacacatatagacacagacaccacctataaatattttttgctctaacataagccaaagctttggagaaaaggtaatgtaaggatatttggaggactccacaagtacatgt

SEQ ID NO: 20907 - DNA, 540 bp, Homo sapiens
tgacttaatcatctcctaatgaccccagctattaatactatcacattagtgattatgtttcaatatatgaattttatgagacacattcagaccatagcacatagctaataagtaatgaagccaggatttaaacctaggctgctctgaagtcaaaaatgctatttctaccatgctgtttctatcccacggacttagcactgtggggtatattaagataatgacacatagtttctgtctcaagaaacttattgttaagtagaagacacatggcaaatactaatcataataatagaaagtaacatttggccgggcatggtggctcacgcctgtaatctcagcactttgggaggccgaggcaggcagatcacgaggtcaggagattgagatcatcctggctaacacagtgaaaccctgtctctactaaaaatacaaaaataaaattagccaggcgtggtggcgggtgcctgtagtcccagctacttgggaggctgaggcgggacaatggcgtgaacccaggaggcggagcttgcagtgagctga

SEQ ID NO: 20908 - DNA, 590 bp, Homo sapiens
agcattacttacgtgtactgagtaaaagagaaggttggaaacaaagatagtgattttgtttttaattttatataaattgtatttatccttctgcaactagcctatttgcacaaagaatcaagagtcagcagcatgaaaaatcttggttattagaaactatgtaaaagcaactggagcctagccatccaatgctgcagtttcctattttatttttcagtatctagtgtttctctctctcactctgctgagtagtgaaaagttaggataatccaattctttaaatattattgatgcacaggggatccaattttaatatttggagaagataaatctacttggaagaatatactgaatattgtattcttttccactatagcagaagtgagcagttatcaaaatgtaaatttcagacatctaattgtatgatattccactcactaaacaaggccatgttttcattaaagcttggattaaaattccagttgtgcatacacttggaattttaaaatttcctcatgagtccatataggttgcatcacccattcaaggcaaaagacacacacatacacacacacacatacacacacact

SEQ ID NO: 20909 - DNA, 589 bp, Homo sapiens
accacacccggcctgaatcttctcttttaaaatatccaggtatatctctttagtgaaacaaaagcaataaccaaaaccaagacttccatgtaggaagggaagaatgagagatgccagcccctggcagagacgtggactgtttgcactggtttcaatttaacaacctcagagcacacgtgattcatcagaatgctgggggctggccaggtgccgtggctgattcctgtaatcccaacactttgggaggccgaggtgggaggatcgtttgaggccaggatttcaaggccagcctgggttaacaaaacaagaccccatgtctacaaaaaatatataaaataaaacataaattagccaggggtagtggcgtgcacctgtagtcccagctacttagaaggctggaggcaggaggattgcttgagcccaggagttggaggttgcagttaaccatgattgtgccatggcactccagcctgggtgacagagtgagaccttgtctttaagaaattttaaaaatagacgggcacagtggctcacgcctgtagtcccagcactttgggaggccgaggcgggtggatcaccaggtcaggag

SEQ ID NO: 20910 - DNA, 523 bp, Homo sapiens
atgtgcaatataaaggagttgaacaaagacagtggttttcaaactggattccgaggaaccctagggttccaagaagacatgatggtgagaagagcaaggcaaaagggaaagaagacaattgttaatgagcaggacccccacttctacccagattgctccttcttgctctgttttgtctaccatgcttccacacaatactacacttaatcaaagggttttggcagggcacagtggctcacatctctaatcccaacgctttgggaggccaaggaagatggatcacttgagctcaggagtttaagaccagcctgggcaacatggtgagacaaaaaaatataaaaattagctggacgtggtggtgcatgcctatagtcccagctacttgggaggctgaggtgagaggattgcttgagcctgggaggtcgaggctgcagtgagccgagatttcaccactgcactccagcctaggtaacagagtgagaccctgtttcaaaaagaaacacacatacacgcaccccaaaac

SEQ ID NO: 20911 - DNA, 487 bp, Homo sapiens
aatctcttaagtgatggtagggtgatctcaacctaaatcttttaattataaattccactctcatttcactatattctactaccttaccatagtgctcactttaactggaccacaagttcagtatagttttcattgtctgagactttaggactttattggttgtatcttcaaggataatcttctgaaatgtgaggccaaatgcttggagttcaagtttctttagtagtcccagcagacagagaaagattaaaaaagaatgtagcaacaagtgtgtgtcaatagaaaattattttaattgaaatgatctattttaattatcaacaagtgtgtgtcaatagaaaattatctattgacacacacttccttctttctactaaccatgacctctaaacttctctttccatgctttaataaataaaaggagatttcttattaaggacaatatattatcttggcaattataatccttttattgataatataaacc

SEQ ID NO: 20912 - DNA, 457 bp, Homo sapiens
ttgtaaaagagttcttgagatacagcactgaatgtaaaggaaaatattggagcattcaactacatttgagaaataacttctgtttattaaaagatactataagaatgaaagcacaagccctaatgaatattcttgtttgatactaaaccaaagcttgagaagtggtagtttcgcaagtttttcaagtggtttggtgcaatctgaagactgcaatcccatcaatgaactttatatctttaccctttaaaattataatttatgggccgggcgcagtggtttacgcctgtaatcccagcacttcgggaggctgaagcgggtggatcacgaggtcaggagctcaagaccagcatggccaagattgtgaaaccccgtctctactaaaaatacaaaaatcagccgggcatggtagcaggcacctgcagtcccatctacgggggaggccgagacagagaatcgc

SEQ ID NO: 20913 - DNA, 459 bp, Homo sapiens
aggtgtgtgccaccatgcctggctaatttttctatttttagtagagacagggtttcaccatatggtcaggctggtctcgaactcctgacctcaggtgatccacccgcctcagcctcccaaagtgctgggattacaggcatgagccaccgcacccggcccaacttgtgcattttaaaaaagatcaaattgaaacactggaaacaagtaaatcaggaggataaagactgaagctcttcataggtattcaaaagtccttttactgtttgagagtggggtcaggatattaacttttagaatactaaattaaatttgtgtggtaaaatttcactggtaacgactaaaagaacagaaatgaggccaagcatggtggctcacacctataatcccaacactttgggaggctgaagcgggcagataacaaggtcaggggatcagagatcaagagattgagaccatcct

SEQ ID NO: 20914 - DNA, 610 bp, Homo sapiens
acatatctctagtaaaactaatattgttatctgccctaagactgccttcccccaagaaaaatgttaatatttagcaaaatcatcatttaccttgtagaagatcaaaaaaagatcatccagtttcccatgcaaatcacctgcagtgcaaatgaaaaatcagtattcagtagagaacaagatgcaatgcccatttttaaaagtgaaatactgctgatccactccaagtgttctcagggcattgggtttttatcctatgacgatgttaatttgacaggcaatttgtctccacagcactcttctcttcctctcctatagtggggacagcatctagtgcttcaattaccttttcagtccagtcatttgcacagggcttcgatcactctgggccaagcactgtgctaagggttttacatgaattatctagttcagtccttacaaccactctatgagatgggttttatcttcatcattctcatcttacaaatgaggctcacagtagttaagtaagttatgcaaagatacccagccatcaagtatcagagcaagaattcaaacccaactttaactcacttcaaaactcaagcttggctgggtgtgatggctcacacct

SEQ ID NO: 20915 - DNA, 329 bp, Homo sapiens
gaattagattagggatctagaagagaagccgaagcatctagactactctcaaccccgcctccccttgcccccaggtcctccttaccagcccacatcctgccctcataatataaccagaatgactttcctggcataaagaccctgaaggcctcttgctcaagcaagttccattgcatggagaaatggctcctcactcaccagtccttgcatgttaccctgacgatctctgaattatctttgattagactcagatcttcacatgtctagggaatcaactgcaaagtcaaatcctggaataggccagcctgggcaacaaagtgagacccctg

SEQ ID NO: 20916 - DNA, 525 bp, Homo sapiens
ggcacttccacaccagctcagatgccctcagtgccacctcagtgcttccctcccacccggttccaactaagtaccttttcttttctttttttttgagacagaatctcgctctgtagcccaggctggagtgccgtggcacaatctcggctctctgcaacctctgcctcccaggctcaagcgattcttctgcctcagcctcctgagtagctgggattacaggcgtgtaccaccacacccagctaatttttgtatttttagtagagacggggtttcaccatgttggtcaggctggtcttgaactcctgacctcgtgatccgcccacctccacctcccaaagtgctgggattacaggggtgagccaccgcgcccggccccagctaagtaccttttctgtagccagcactggggaaactcccagggagaggaatggggaattcctgggatcatggagagacactcccaagggctaggaaagccttccatctctgcctggaatgcttctgaataggggcgaaaaaaaaaaa

SEQ ID NO: 20917 - DNA, 543 bp, Homo sapiens
gaataagtttgctgtgttctagtcaccaaaaggaggttcttgtggcctggttcactggctcatgcgtgtaatctcagcactctgggagcccagtgtgggaggattgcttgaggccaggggtttgagaccagcctgggcaacagagtgagacctcccgcctctacaaaaaaggtaaaaattagccgtgcatggtggtatgtgcctgtagtcccagctactcaggaggctgaggagagaggattgcttgagcttgagttcaaggctgcagtgagctaggatcgagccactgctctccagcctgggcaacagagtaagaccccatctcaaaaaaaataaaataaaaagagagagagagagagattattgtgactggagcacaaggacagagggaaggggcaattcaggaccaaggtaaagaggtcagcagagaccatgccacactgagctttatagcactatgttccactcatctgcctgcgctcaggactcaaaataggtgtgacaaaaaggaagccccaggctataagggctgggcaggtgagt

SEQ ID NO: 20918 - DNA, 566 bp, Homo sapiens
gcttacatccctaacttataaagaactcttaaatttagggaaaaatgccaaaatcttcaataacaggcaaaacacatgaacagacaattcatgagaagaaataaaaactgacccttaaacacatgaaaaaatgatcaacttcactcttaggataaacaaaaattaaaactacattgatacactacttttcacccagaagacagacaaacattcaaaagctaaacaagtcatcctgttagcaaagacgtaggaaaagttctctcacacatctctggtggcaatgcaaagtgccataagcccccaaaaagggaattttacagtatctaacaaagctacatatgtgtacactcctgaggcaataatcctaggaatttaccctacagatttgtccctgagaattcaaaaacacacatgcacaaagccagggagtgtaaaatcatttataatgcaaaatatcataaactactgaaataccaaagcacaggccactggttgagtaacccatagcacagatacccaatggagtgctatgcagctgtttaaaaggagaatgagatcccttgaac

SEQ ID NO: 20919 - DNA, 100 bp, Homo sapiens
atggagactacacaagtagatgactatttcaagtacaactgttaaggggttgtaataaaatacttagagacgagacaggattatggagttttatctggaa

SEQ ID NO: 20920 - DNA, 592 bp, Homo sapiens
gattaccagttgtccaccaccatgcccagctaatttctgtatttttagtagagacggggtttcaccatattggtcaggctggtctctaactcctgacctcaaatgatccactgcacccagctcattgtaacttattaatgtggctactaggaagttttaaattgcatatgtggttctcattatatttctgttagcaccgctttagaatattattttgaataacatccaaatttcagtattagccaaatgattatcaaccaatattgttcagtctggacttagttctatttgactaaatcaactaagtacccactggtttgttaataatttctagagtgattatgaaacaaaataaagctctgaactagaagttgtagaagaagacaaggagggcactgccaaaatcataaaatacagtcctctttctttaaaaagcttacaaccgaggcctggaaagacagagttgaaacacaacaggttatgttcaaggtcaaaacataacacaactgaattatttttcttgaggaacaatggaaagaagattaaccagctgggtgtagtggctcatgcctataatcttagcactttggga

SEQ ID NO: 20921 - DNA, 471 bp, Homo sapiens
ggataacttcccccaggacgcccattccctgcaagacaaacagctctccaggaggagggtgtcctgcctttcatgcaccctggccacgtcccttcctggggaacatgtgcattgaaggaatcttttggcttccctgggccacattggaagaaaaagaactgtcttgggtcacacataaaatacactaacacggctgggcctggtggctcacatctgtagtcccaacactttgagaggcccaggcaggtggatcacctgaggtcaggagtttgagaccagccaggccaacacggtgaaaccccgtctctacgaaaaacacaaaaattagccgggcatggcaacatgtgcctgcaatcccagctccttgggaggctgaggcaggaaaatcgcttgaacctgggaggcagaggttgcagcaagccgagatcaggccctgcacttcagcctgggcaagaaagtgagactttgcct

SEQ ID NO: 20922 - DNA, 587 bp, Homo sapiens
ctcacgtctgcagaaggccactgactttcacacgaggcctcccaggaagggatgccaggcctcagacactagctgttggatctcgggacttgccactccactttggcatttttcaggaccacacggcatacagttgatctaacagtctttcctgtcctcccagtggtcagctgcagcccagttctagggcttctgtgggagaagacaggagagggctgggagtcagggcacacagatgtgtcagatgaggctttgcttgcaaggagctcaccacttgggtggtggagaaggcccagaaggcactactacagtgctcccaaatcaggaaaagattgctaaatgcccgtatactcaggatcacatgggagcccagagttggatgcctggatcagctgggagtctacctgacattgatgatgtttggctagaatactgatggacaaggccaggcgcggtggctcacgcctgtaatcccagcactttcagaggccaaggcgggtggatcacgaggtcaggagattgagaccatcctggctaacacgatgaaaccccatctctactgaaaatacaaaaaattagctgggcgt

SEQ ID NO: 20923 - DNA, 518 bp, Homo sapiens
atccttgggccctcagtaactagttgtcatgtttttgaagccagagttgggcagagctagagctctagggaagatgggcagagctcagggagctgtggaagcatctccttgtttgcctgtacccagcaggtaagggaataacaagggcttgaggctctggattccctggccattggcttagccactcgatgtgttgagcctgctctgaagagggcgggggacatgctggtagaaagcacattggtggccaggtgcggtggctcacacctgtaatccagcactttgggaggccaaggtgggcagatcatgaggtcaggagatcgagaccatcctgacttacacggtgaaaccctgtctctactaaaaatacaaaaaattagccaggcgtggtggcgggtgcctgtaatcccagctacttgggaggctgaggcaggagaatggcgtgaacccgggaggcggagtttgcagtgagccgagattgcaccactgcactccagcctgggtgacagagtgagact

SEQ ID NO: 20924 - DNA, 495 bp, Homo sapiens
gtggctgccttcccactggcgctgcaggttcctcactcagactagattccccaaactctgttccacagaacaacagtgtccctcagaacatcgtgcactccacaggggtaagacctggctatcaatgaatgaatgaatgggaatgaataaaagggcacccgatctctccctctcagggattcacatgggaaaagcccaagctaccaaggtccccgttcacttggcttcacccagtgcttcctagattcagtggaaccccttcctgccccaggacctgccgacatccccaggcaaggtcagccagggcacgtgggaagccctggcccattccttcctccccactcaagaagaaaggaagaggctgggcgtggtggctcacgcctgcaatcccagcactttgggaagccgaggggtggatcacctgagatcaagagctcgagaccaacctggccaacacggcaaaaccccatctctactgaaaatacaaaaattagc

SEQ ID NO: 20925 - DNA, 506 bp, Homo sapiens
gtataacatatgctggggcgtgggtcttctccagggttctttcatcaatctgccccccgtacatcttctgcagctgctcacactcctgaagggaaagtagttaatacagatgggatgcagccagacccgcctcatgcagtgatttcagcagatgcagatctgcctccaagctctcatgggcagaaagagccgcaagagaacagtgtccttgatgagcaattaactcatttacctaagtatctggtgcactaaatagattcacatcctgttctgtatgaatgaatggaaaacatcaaggatggcctttgtatgagtacaagtgtccaatgtgaaatctgtgtacaaagcacatgccattggaagcttggtcatcaggaaggcagaaaggaaattggctctttatagaatctttatagtacagaaacatatagaggtacatttccttcctctgagagtgccgttccataccacctggagagaatgccaggtggtaacaatgtacagca

SEQ ID NO: 20926 - DNA, 523 bp, Homo sapiens
gaggcggaggttgcagtaagccgacatcacgccactgcactccagcctgggcgacagagggagactctgtctaaaaaaaaaacaaaagaaagtacccttgtgattctgatatcagacaaagtagaattcaagccaaaagtattaaacctaacagctgctcccaatattttttccacatttcctctcccaaattctacctagtctattttgcccttgtttcctattactttctcacctttctttttgtctttctccctgctcatctgagttcgccctttaattttactttcttgtatgttctgtgctcaactttttaatatgtagggcaatttaacttaactttgcattttctgtttacctcatatctaaagtctggattacatagaaagtctcaggagcctacagacaaaaacaaataaaaatgaaaaggttggtcaggcgcggtggctcatacttgtaatctcagcactttgggaggctgagatgagcagatcacccgaggtcaggagtttgagagcagtct

SEQ ID NO: 20927 - DNA, 488 bp, Homo sapiens
tgggcaaattaaacagatggcttaggaaggaactgctcagataaagaaggcaggttcccaagtttctagagatagagcctagctccaggtcatgaagataaggctgtaggtaatggaagataaactgtaattctatgaatacctataacatatttacaaggtaatgtcactcaaaacagaaagcaaattgttaaactggagccagaacctaggcactcaaacaatagaagcactgggccgggcgcggtggctcacgcctgtaatcccagcactttgatcacgaggtcaggagatcgaaaccatcctggttaacatggtgaaaccccgcctctactaaaaatacaaaaagttagccgggtgtggtggcgggcgcctatagccccagctactcgggaggctgaggcaggagaatggcatgaacccgcttgcagtgagccaagatcatgccactgcactccaacctgggcgacagagcaagactccgtctc

SEQ ID NO: 20928 - DNA, 354 bp, Homo sapiens
caatgctaagtgctaaggatgtgaagataaatctctgctctactgaatttcagtctagtgggagagagagagacaagtaaatagtctatttctttactatatgttaagttatccaatagaggtagataccaagttttgtgggagcacaaacttcactgttgtcagtgaaggattcctagaggaagtgtatcctggggtgagtcctgaggaataagtaagagtagcaagttaggattattcatagaattttactccatcttctgtgaagatggagaatacataccaaattgtggaggcaaaagaaagcatggcatggtctgaggaaaataggataattagggtagaagcaggtaa

SEQ ID NO: 20929 - DNA, 599 bp, Homo sapiens
atttgttgtttatgcggaagagcagatgtatttctgttcccttaatttctttgtagtttccatgtagattcccgtcttcccatttttgcaccctccatctagagaagattcttgcccagtccctcccatctgaattatttttattcaaccgtttcctcatgagtgccataggctgaggcttccaatttaaggcagtcatcctgcattctcagcatctcctatgttcacaccaaaatacaagagagattcagagaggggatggaatccttaacataattcaaagtaaagctaacatccaaccttttgccagaagatgggaagagtttctactaacagtactgaaaaaaaaactgctattggcagcagatttgaaacactttgctgcttgagaaacccaccagcctgaagtgaaatatttatcccgccctcatttctagtcttaatttctcccaaggtcttactcagcagtcagtaaactgagaaattgattctatatgttctgaaattgcatgctgaagaggctgtggcaataaaatctcactctggcggacatcctccttcctccaatgaacggataatacccataaaattatctcttt

SEQ ID NO: 20930 - DNA, 566 bp, Homo sapiens
tcgttctttcctgggggttggctttatctggtctcatgaagttttattctatacatgtacagcttagtattcaaccaaagactcaaaggaatcgctatgtagatattggagttctttctctacagaacttcctcttatcaatattctgccccacaaactccagccacctcaacctccccaaaccccgttcctcttctttgtgctgtggttcagatagaaaccagggaaattgcagggcttacctcattattttctttctctcaaggatgaaagtcttgcactacctgttgtttaatatgtgaaaacttgttccatacatttaatctagctttctagttgcttatagagatggggcaaatttgcttccatgcattccatcatggccagaaggtggaaatctctggagattttattggaatcatactaaatatgcatatcaaatcttccatcccaaagatattttctgtctgtccacacacttggtatttctttagtgttggttatttaagagctaatgcataaagccaagcgtggtggctcatgcctgtaatcctagcactttggga

SEQ ID NO: 20931 - DNA, 292 bp, Homo sapiens
catgagcaacgacgtgtgtcagtggaaatgaggaagttatgagcaggatagggtaaaacaagcagataagtatttgacacacagagaggagaacgtcgaaagtttaggatagactggttgataagacagttttaataaagctgtgtaatttgaactttgttcagtaggctccctgaagctatttaataatattagtcgtagtagtactattactaatagttaacttattattattattataggttgttctgctttgttttgttttgagaaggagtctcactctgtcatgctc

SEQ ID NO: 20932 - DNA, 542 bp, Homo sapiens
gaaataagtttgagtgttccattgcacagtagggtgactctagttaacaataatatattgtatatttcaaaatagctagaagagcaaatttggaatgttcttacccttttccttttaatatagtaatctccacagcaagtacagatcacaaagttctacttttttcctgccctcatccattatttcacttttcatgaattcagtgaggcagtgtttggtaatagtgtcaaattagtagaaaatgtgaggtctagcaatttgacaatgatataactgtcacaatgggtctactttcagcatgtgccatgcataattagaatcaaatatatacctcttaccatttctcttaggttcacccaactctgaaagctctcaggtcattaaggcatatcaattagtaatgattttttctaccccaccccacccctgcagccaggaaagcatacattaaaggggatatctgcagtcaaaattttaatgtgcacaatttgaaaatatctactttgacacacagaacagtatcatctgagaaactcatttgc

SEQ ID NO: 20933 - DNA, 593 bp, Homo sapiens
gcaacacattaaacggtatttcatgcttccctgaaccaatttcagaaagtaccaattaataagttgatggggaagaggtcaacgggtagcattaaggccacctgtctggagacattaggtgcacactttgaatgaaagacccacagagagttgggaatgaagtaatttatcacacattcatgaaggcataaaatgaggatttaaggcagtttcgaaggcagctcctccatcttgctgctattgtgattgatcccattgctctggacaaaattgggcatcccaatgagacagtgtaaaacgtctgaagctgtgaatttttacgtatttatagcttcttctgtggtgcagactgtgcagagcaaccaacttttctttcagagagttttagagagtcatgtagacttagaagttgtgaagcttccatccatatctcagagtgttctgggcatctttctatgcattcatttattcattcattcgacaaatatttatcagtgtaccatgcatactggaccttagtctagctgctgggaattcatctgtgaactatacagacagctatctctgttcgcacagggtttattttttagtag

SEQ ID NO: 20934 - DNA, 420 bp, Homo sapiens
tagcaatgatataaagaacaaatataaaatatgtttgaaaggaaagttaatgaaacttattactaaacttggatgacacttacagaaacagggaatttggaaagaaagcttgtttgagaatagaagactataagacagatattcagatagcctcaaaaacctatgttgcttgccccagatactagtactttttagtaggcaaaactcttaagatgttctccaatgatgcttgctctcgtgtaatctctttttaatcctgagtagaacctatgaatatgatgaggcatcactctcatgattgtgttaccttacatggcaaagggatttttgcagcattaattaagatttctaatcagataaccttgggttcatcaaaagggagattatctgtaggggcctaacccaatcacatgagcccct

SEQ ID NO: 20935 - DNA, 339 bp, Homo sapiens
gattgtacgtcagtctggtgagctttggtaatgtgagtctgccccaagggatggctctgcttcaaagtgctggtaaaatcaggtttctatgccagcaagggtgacataggctttagagcaagggtgtccaatcttttggcttccctgggccacataagaagaagaagaattgtcttgggccacacataaaatgcactaacactaatgatagctgaggagctaaaacaaaatcaccaaaaaaatctcataatgttttaagaaaagtttatgaatttgtgttgggctacgggttgtacaagcttgctttagagggtaaccactgaggaagcaggggggacc

SEQ ID NO: 20936 - DNA, 330 bp, Homo sapiens
cttagtaaaaacacttcttttctatgcatgctcttaaaaaacaagggtttaggtggacatgtgagttcatatttaattcttccaaatgcacaaaagaattttgttgggatattttttgttgcaaaggatggttgtttttctttaacttattttaaaatataaaaataatgtatttttaatgtagatttgaaaaatgcagaaaaatagaaatcaagaaaaatgaaagataaacactatgaacgtatagtagcataaggttctttccaaccttagtattatgcgtagttttcttctggacttttggtttacagtatttggttgaatttggga

SEQ ID NO: 20937 - DNA, 557 bp, Homo sapiens
atctctaaccttcattgctatactcctccctcacaactgtaagtatgctttaagctccagagcactggctgggagtccaatgccttctttcacaccattcctcctccctgtgataggaggcttgtcttctagatatgactatgttttctacttgaaaactgccacgtgcttggccccagggaccctacccactgcttgtgttcttcatctctctgcccactgactggggaatcctacgctggcagtattgtacattccttcttatcttccctgccaataagaagctgcctcccacaagataggtgaaccaaaaatttgcagaaaataaatgtaaatgccccatggcactatgcatagaggctcaacatcactgagaataaaagggataccaattaaaatgacaccatgataaccatttactacctattagatcggcaaatattcacaagctgaacaatgtattccgttggtgaagctgtggggaaacacactcatccatcctggtgtgaatgcaaaaatggtaccatccttatgaagagaaaattggcaatgcttac

SEQ ID NO: 20938 - DNA, 543 bp, Homo sapiens
ttgttctgtcttctgcttgaggctttggataaaggcaaagcccttttaagcccaagcaggacaaagtccaaatctgaaaattgcactatcctccaaaggtctttaccttccaatgagtcagataattttggatcattcccattaatgagtcatgctgaccaaatgtagtttttgtgtatttcttgctacaacttttaaatattcccttccttccctttctacatttgttgagtgactactgtggaaacaagactcagaaagttaacaggctcttgtataaaagtattttagtaatttaacaaactagtgttgctgggcgcggtggctcatgcctgtaatcccagcactttgggaggccaaggtgggcggatcacctgaggtcaggagttcgagaccagtctggccaacatggagaaaccccatctctactaaaaatacaaaaaattagctgggcatgctggcaggtgcctgtaatcccagctactcaagaggctgaggcaggagaatcgcttgaacctgggaggtggaggttgcagtgagccg

SEQ ID NO: 20939 - DNA, 450 bp, Homo sapiens
gtcctgacctagactagattcgggttcagcttctgccttcctccccgctccccaggctctagggaaagcctgcctcccactccaggtctgcctgggaacaccccaaacacacaccagccacacgcacaccaatattcatatatattttatatgtagttactcttttgtaacagctttacaaaaatagccacagactagaagttgtagaaatgacagtgtgaactatctgtgtgtgctcttcagttccgcaaatcccccaggaccagtgttgagcacgaagtctagcctgcagtttagcctgcagttactctatagaaacatggtgactataaggattgaaaagccacaaaagaccacagattccagtacaattccattagttacgaaatgtccagaataggcaaatccatagagacagaaagcagattagtgggtgccaggggctggggg

SEQ ID NO: 20940 - DNA, 511 bp, Homo sapiens
catatgttcctccaagtctaggaaccattgccataaatatcaaccgcctcttcctcgtgagaccacagtaactatgggatgatacaataagggcaagatgaaagatcaaagctttggtgaaggaaagataatggaataaaagacacggctgtgtatcctgtaattaccactatacaaacaggcatcagctttatagtaataatcgtagagcatttattctgcacttcctatatgccaggctttttactcttttatgaacaacatctcacttgtcacagcttgaggctgtaagttgaattatgtgttgcttactaaagatactggaaattatacatcaaaattcattttggctatgtttagatagtatcaaaatggggtattttccaaaattagcaaatatagttttattattggtaataatatcattaataaaaacgataaacagaactgacaaaagtacattcaagaaatatcaggccgggtgcggtggctcacacctgtaatcccagca

SEQ ID NO: 20941 - DNA, 616 bp, Homo sapiens
gaattagctagccttgaaatccaataaataagtttgtctttcctacaaaatttgtctaagggtaatttttttctttccagagaggccctctgctgcccatccctttgttctcaaaatacaagttaaaaactataagtgaaggctgtgactatgttttagttttttctctatatacttttctattatttttaaatattctgttactttttattggatcaataacaaataaaatatcttgccctgttaccaacataatttcacatatttttaccctaatcttcatttttttcctgagaaattatcacatggattatatgtcacttgagtgaagttataaataaccataacaatttgctctggaagaatccacatgaaactgtaattctaactggtttatgaattttttattcccattaatggcaaatatcagatatccacaagggagaaggtaaaccactatcttaatgttcttccagagtatctctagagatccaaacttcaaaagctgtacaaagtcaaaggtgaaataatctcaaggcctatgtacttgactctagaaaacacgatcaaaaaaataaaagaatacctctttgttaccatactcaacataaaacac

SEQ ID NO: 20942 - DNA, 542 bp, Homo sapiens
gcagattccttgaggagactggcagctgatagttggagtcccagaagctcacttatgaatagaggaagaagtcaagatgatctgccagttcagataatcagtggaaaatcctctgcataaaatcactttagtgatgatggaaatagaaagctaagacactgaatagccagttgctatatccagtgtgccagaggcatacaaagagagcactcattgaaacagagtaagctgagctgtctccaaacagaaatgtggtatgcttttgtcatattaaggaaactgtcatccttttaaaaggaaagtatacagagtggaagattatagtgcagacctatcataggaaagcttaaaattaaataaacctgaaacactttttttcctactaaaaatcagaattaaaaatcacaagttagaatgcttacctcaatctatactaatgatgcaccgggcaccttattaaacaaactggaagtaaaaatcaaaatacgtgatattatttttagatgatttataagttccaagtagtgaagaggaaaaatgac

SEQ ID NO: 20943 - DNA, 586 bp, Homo sapiens
tgtactctcacctgcaaccatcaacaacgtcaataaatccacctgcttctaagactacgtttacttaaagcataagaatacaatgataatgccttggatttatgttgtactttactttcaaagggtcttcacacttattgtcacaatctctacaagaaagagataatgcaagattcacattctgccttctcagccaataacaggatcagagaagttgaaatgatccagctaaatgatgggatcactaaggttttaatcatgtctgatgactctgagcctggactcttctcaaagtacaataaataaattaaaaaagcatgaggaagtgcaagaatagagtatggaagtacaaagaaaacattagaaaacctgggtttgggctgggtgtggtgcctcacgcctgtaatcccagcactttgggaggctgaggcgggcagattagctaaggtcaggagtttgagaccagcctggccaacatggtgaaaccccgtctctattaaaaatacaaaaaaattagccaggcatggtggcaggcgcctgtgatccccgctactcgggaggctgaggcaggagaactgcttgaacc

SEQ ID NO: 20944 - DNA, 422 bp, Homo sapiens
taagtttgtcttgacccacatctattgtttcagttaaatgcattatggatattatacattaattagtatagtgttaggttagctgacaatcatccttttaaaaatatactttgaggaactgaaataggcaagaatgagacaaacgaaaatgacctaagaaaataaccaattacttttgaatcagaacatgaaccagagcattttgtttcatgtaaataatcagactccacaaggtattcaaagaggaggtaaaacactattgcctcaaatgtctatgataaaaggataagaacgttttcaactcctagatcttatcttactgtaggaccccagaagaggagagtaaaaaagctgaaacaggagaaagatatgattttagccacctcatttttatacaaccgagaccgtgttaaaaaaaaaaa

SEQ ID NO: 20945 - DNA, 463 bp, Homo sapiens
tttacagccggtggtctacaggacttacataaatatccacatttgaatgacccttaggaatataaatctaatatgtccagaacgaatcccttattcttattctattccagttctaattcttctttcagtggataattcaaccaatatgcttttctgagctagggctaattatcattctttacttatctacgaatacaccactgcctgagtctatcagttctattggtcaaacgtcatctaacataacaaacatgtcttcataacaaatattcttatattttttatgtcctttaaacataccttctaacaattccctagtttaggtcaccataatcttttacctacattcttgccataattttctatcatatttccctattttgagacagaaaaattattttccacatggcagccaaagtgatttttctataatacaagaataatcacatcactccctcccatc

SEQ ID NO: 20946 - DNA, 528 bp, Homo sapiens
tatcttatttcagttacaatttgcattttaattatgattaatgagactaagctttttttgtgtagttgactgtacctttggattcttttcccaaatcccttttcatttcttattttctttatggtttcagaaaatgtagtttacataattgcagcttgattttttaatcagttaatggcatgcttaatggagagaaaaaatattaactatatttccctttttaattactgtgcttttttcttttttaagaaaatatttcattatgttaaatttcagtgttattctacttagctattccttaaatattatagtattttggatttcacatataattttgtaacatatcttgagttttttgtatatacagtaaggctattttctcttttttgttttttaaggcaaaaatcacataatataaaattaataacttaaccattttaaaacatacaatgcaattgcttttagtatgttcacaatgttccaggacaatttcatcatatcccttctaacaacccattatgcataaag

SEQ ID NO: 20947 - DNA, 479 bp, Homo sapiens
ttccaggagcgccagggtccatggcaaagctctaccctgggccagctgcccccgcacttgcacctgggcacaggaagttgatgttcgcagaattaagaactttttttgtctcaatgcgtgaatggttaaagaaactgtgttaaactatggtgcctccatgctactcagcaataaaaagaaaggaactactgatacacacaaccacctagatggacctcaagagaattatgcagaactgaaaaagccaacgtcaaaaagtcccatactcggccaggtgcggtgggtcatacctataatcctagcactttgggaggctgaggtgggcggatcacttgaggtcaggagttggagaccaacctggccaacatggtgaaaccccatctctactaaaaatacaaaagttagctgggtgtggtggcacatgcctgtaatcccagctacttgggaggctgaggcaggagaatctcttgaacccggga

SEQ ID NO: 20948 - DNA, 589 bp, Homo sapiens
tggtgattgttaattggcttgcatattctgttttggatattccactgtttccttataatttgtttatttataaggaaacttataaacaaattataaggaaacaatagaatatccaaaataaagagaatagttatgggttcgtatagataattcttcagaatctactaatttgtgtctttcttctttacttctgtaaacttttcagctactatatattagaatatttcttaacttttttatattcattctgaaatttcttgctgaaatttgttcagaaggtgagttaacggagctatacatctttagtgtcatgtgctctaaattgcaaaatacatgtatttttatttcagacaacttgagcaacatttgtgcaaatgttttatatacacggacttaatttggtaaatttaggcatgtggtagacaaatttaaaaatgtataaaaatcgtgggcaagcatatgaacattctatttttgctactataaaaaaatagcagactatccaactattttatgatactcaacgatacatcttactaaatggtcacgactcttgcctctcagggtcagagtttgcaatagtgaaagc

SEQ ID NO: 20949 - DNA, 550 bp, Homo sapiens
aaatactggaatcgcctgcctctggctgtcatgacacactgttaaaaaaaggaaaaaagttacaaatcacctgaaattcccctttgcagacacacacacacacaaacacacacgcatgcacagacaccaagacagtgtgtacacctatcattaggtttctgtcccagatagtatgcaacaataatagctaacattcacaacataatttcctcagatatggtttttctcttaattataaaaattcccaaggctgggtgcggtggctcacgcctgtaatggcagcactttgggaggctgaggcaggtgagtcacgaggtcaggagttcgagatcaggttggccaatacggtgaaaacccgtctctactaaaaatacataaattaactgggtgtggtggcgcatgcctgtagtcccagctacttgggaggctgagacagaagaatcacttaaacctgggaggcgaaggtttcaatgagccgagatcacaccactgcactctagcctgactgacagagtgagactccaccccaaaaaaaaaaaaaaaaaaaaaa

SEQ ID NO: 20950 - DNA, 480 bp, Homo sapiens
gaggcctggagggacctacagaagggctcacaatgaagttagacaagatgatgttaatggatgtcagctggcatctctcttccactccctactacttgcccaggaatggaggctgtgcatggaccaaacatcatgggctcctgctcaccagtgctgatctatctgttatcattgctgaatgcccaatttgtcaacagcacagactgatgttgagtcctcaatatggcaccattccttgagaagaccaacctggtggcaggtggattatattgagccccttccacatgggaaagaacattggtctatccctgctgaagttgatacacattgcggacttgggtattctgcctggcttgcagagcttttgttggaaatcctgagcaaaggcttataaaatgcctgatctactgaaagttaaccgaaaacattgtctcacaccaagcgacccattttattgcaaaggaagtacgacaatgacct

SEQ ID NO: 20951 - DNA, 604 bp, Homo sapiens
cttgacctcaagtgatctgcctaccttggcctcccaaagtgctgggattacaggcgtgagtaaccacgtccggccaacaaaaagatgtatataatcctcttgcctgtttaaaaaaaaggggggtcaatagttcagatctgtcatattatagtcttgtttaaccatttaacatttagttttaaagtattatcttttcttgaaacattcacccatgctgtttgctatccatcatcactcaaagtttcttcttcctttatcttcctttcctggccatcaagaagtttactttctcaattctgtccctactagctgtgctcttattcaggtcaagattattcacatttggaatactgcaataatatcctaaaaggtcagcctacctctggtcttgtattcctcaaagcacttaccatgataaccattttaaaccctgctaagcaaacctatcacttccctgcttaaaatcttctagtgactataaaatggatgaaggtcaagcttctccactaaacatagactatctggcctggtccttattctcatcactcacagttttatattctgaattttgcggctccaggagccctgaattgcttgcattcta

SEQ ID NO: 20952 - DNA, 609 bp, Homo sapiens
ctcatctttctcttatgagagaatgttaaatgggttttttgctcctgtcctggaattcaagctaagacctgaaatgctaaatgtaatcagacaaccatcctttctagcctcttggttcatataagaagagggaaaaagatcagtcctgatgacaggctagttcctcctttcctgtttgaagtcagagaatgaggagaaaggaatggagatagaaaagcagagagaaagactgacatttcatgattagccagggcaatttcttttttgttttattttataatggctgctcagtaaggatagcctcagcttactgatgttgttagaaagtgacaattcttgccttgcagaaggattactctgcattgatctggcactttggcctcagtttgaaatagaatttgcctgcagctacattagcataataaaacacagcaaattcacagtctctttctggcacttttcctgcagtatttgtagaatactagaaactattttttacacattagttatacttgcctaaaaatcttcagaccatcatcaatctacagagatctgagagaagaaatttaagttgttccctcccctaggcccccaacatgccataaaaca

SEQ ID NO: 20953 - DNA, 575 bp, Homo sapiens
gcttacaggctatatttgtgtaatatttatatggttttatatggttcttgatggaaatcccctaaaatccttttcgtagcgagtcagagaatgaaatctgtggtttaatccactggcttttctttaggcaagagacagctgtgctagaagaatggaggattataataaatttgaaaaaccagaacagttcttcaggtaagcatgatctgtactcctgaccttaggaattgactctaggtcccagattttgaatttcttatgagcataatcttctacttaaaaaaatcacttaattaacagtgattattgagtatctgcatctcctccaagaaataaaatgccatatacatgacacacacacacacacacacacacacacacacacactcttgatagtcctacagatgactaatcactccccaccccccgacttcctgccttttcattcatacattggggttgagatctctgctaccacaggagctgttgcagagaaaaagatttttaaaatactatattatgtaaattagcacaaccattatggaaaacagtatggaatttcttcaaaaaaaaaa

SEQ ID NO: 20954 - DNA, 450 bp, Homo sapiens; identical to SEQ ID NO: 20776

SEQ ID NO: 20955 - DNA, 569 bp, Homo sapiens
atattggggcaagaaaaaaatgaaaatattatctcctttacttagattttgagaatgggctaagaaataaatacaacaaaaaggcaactcttcatgttctctgtgttacttatgaaggtccaaagatatggcttggaagtaattcaataagatctcctcctcattctttaaatatattctgctgaataatttactaaaagtagtggttgaaaacaatcaatttaccaacattttgttattaaaaaatgcaatgcctaagaagtatttttacatagtgtgctatgtatgttaaatatgcatgcatatgttataattactttatatgtatacaagataaagggcctgggtgtggtggctcatgcctgtaatctcaacactttgggaagctgaggcaggtgaatcacgcggtcgggagattaagaccatcctggccaacatggtgaaacccaatctctactaaaaatacaaaaaattagcagggcatggtggtgtgcacctgtagtcccagctactcaggaggctgaggcaggagaatcgcttgaacctgggaggcaggtgctgcagtgagc

SEQ ID NO: 20956 - DNA, 580 bp, Homo sapiens
gaggtcaatttttaatctttgagcccttggctggcaatacccctggcagcaggggaaggagcatctcaggggatcttggtggcacctgatagcagtctgtaaagtccatttattatgctcctaagatccattgcttcatataaaacttctctcccattagagaaaaagcttgtccagggttctggttggttttccttcctgcagaaataaaaagaagtttagtggcatgaaccacagcctcttgccactaaagttcatctcagaggtgcaatgcattctcttttctttctcttgtattactcaatttagattctccccaccctcagttagccccccttttggtctaggtgaattatttgataaggtgactcaaacactcatcactgaagggttggagtccctactcaccttacttctttcaggctttgtttgctgcagttgtctatttattgttgaaaatatgcagaagagtagcaagatatgccccaatgaatcacctgaattcccaggtgttctttcttaccttcactttgaaagaacaaacctaccttttccttataattggggtaaattatgcctg

SEQ ID NO: 20957 - DNA, 580 bp, Homo sapiens
ctcgtcttagtaacagcacttatcaatcaaattattgtgtagtttagtcactgatttggcatgttaaatgaacaatcatgaactgccttacctggagtccatttcaggggctaaatcttaactcactaataaccttaggatcaaactcttactgcacagagatgcatgtctgcagacaatacatgattccattattctttggtctggtgtgatatttacgattgatcttaaccctttggcgagaatgttttacaccttcccatttgttttcaacctgttttagatatgtaagttgtagaacttcccagctacagtctaacttctttggttaattatgtttcctttaaaacaaatccgggtacaatttttgagggttcacttaccaaactctgttatcaaaaccctttagaacagtcctctagtgtgactaacaaagttctatgttaaaaatatcaacttttggccagtcgtggtggctcacacctgtactcccagcgctttgggaggctgagcgggtggatcacctgagctcaggagttcgagaccagcctggcctacatggtgaaaccccatctctacc

SEQ ID NO: 20958 - DNA, 577 bp, Homo sapiens
aattatatgactatttcaacaagcatctggagataagtttaattttgtattctctaacttttttttagtttactttaacatttttagtcatttctttataataagtcatttgtttcgtttgtgtcctaaataaaatttaacaaacatttaatgagcaactaatatatgccagcaactgtgctcatttatctggtggctaaaaagacacaaaacaatgaatctcactctcatgcagttttcaatttcaacaggagagatgatacaattatatacataactatacaacatggcagaaggcaaaggtcgtgattgaacaaaaatgacatttgaaagtatttagagggagaaatatcatgcagttggaaagaattgggaaacttcccctaggaaaaagaattttagaggatggataggcatttgcaaggcagaagctgggtgggagagtgttgcagtagacagagctacacaggcaagggagcaggacaattcaggactaatcttgggagccacaattctattgattatgctggggaatagggaacatgcaaatttctcccaatcattcaaagaaagaaag

SEQ ID NO: 20959 - DNA, 560 bp, Homo sapiens
gaatgttgtggctgcttttctcttctacccagatcactcaaagtttgttcatataatcaataaggctgtttcactttcttattatttgtgtgttcactggagtatcacttttaatttccttcaagaaattatggaaagttccagttggaactagaactagaacatggaactagaagtttctttgcattcacaatttggctgtttggcacaagagacctagttccatgttctagttctagttccaagaaagttccagttccatagcaatgatgtgcatattgcaaaatttggaagtttggaaagtcccaaattggaaaagttggaactttctagttgtaaatttatcttggaactaaaactagaactagaactagaatatggaactagaactttctttgcattcacaatttggctaatgtttggcacaagaagtctagctttcaacctgtctcaggtttcaacatgcctgcctcacatagcttaatcacttccagcttttgatttaaaatgagagacatgcaaatcttccttttatttgaatacttataggccattgtatg

SEQ ID NO: 20960 - DNA, 585 bp, Homo sapiens
gaattgttcagaaagaggttcacactgggctgcccttcccagcaaagcatcttcctgcgccgtttgtagagacatgtgttttgcagggctcctgcctttccccgggaggccacaggcagccctccattctctggtcccaggcttctcatagcatgtcccacagcccctctgcatattcttcccacttatcctctgggacatcctgcccttttggggtttcttccacctcactggtctctctttcccagttctttttactggcttctcccctactcaatctacaaatgtgaaagggctgcagggctctgtgctgggtgggccctgttattccccctagttctgccatggcaaagcaaataccatacagtcctggggcgttaagtaccatctccagccctgtcatctccctggaactcagactcatgcacccagctccctatatcatactaccacatggatgtctgcaagagattactaacaacatagttaaaagggtactccctcaaaacatgttcttcctccaggcttcttgacttcaataaaaagcatcatatttggccgggtgtggtggctcatgcctgtaat

SEQ ID NO: 20961 - DNA, 579 bp, Homo sapiens
ggtcttgaactcctgacttcaggtgatccacccacttcagcctctcaaagtgctaggattacaatcgtgagcaactgcgcccggcccaggaatactttttcactgaggggaagagggagtgggtggagactgacaataaggtactcttgaggaaatatggtagaagggtggataaatatcagcacatgaggagttgcttcacaaaaatatccaacctactgacaaaagagttgtggagtatttcatgatacaatagtggtcgttgttctgtgtctgtgagacctccttgcgtcattttaccttggtcacttcaaatcctataaacaaacatttactgagatctcatgtgcagcgggcacggtgctgggggcttggtctcaaggctaaggaggtggaggagattgggcttccaaggaacaggtgaataaatagattcattgagttgtggtggttctatttcctcttcccaccaaaaccacatgcgggaaacatatttcctcaaagtctgtggtgtgggttttaagttttttttcgtgttcttagatctaaaagaatcaggccgggcacagtggctcatgc

SEQ ID NO: 20962 - DNA, 572 bp, Homo sapiens
tatggtatgggagaaagagagagaaagagggcaacacgcgcacacacacacacacacacacacacacacacaaacacacacacacacccccctgcatgtaacccagctgaaaaagatctgaatcagccagtggttatgagagggacgaagattggggtatgggggtgtcacaggggacttttttttctttttctctcacatctctgctgggaggaacttttgccttttctttagttgtgtcttctattttgttttctcaggaactggctcagcacagtattttcttaagataggttcttgctttgtcaccgaggctggagtgcagtggtgcaaccatagctcactgcagcctcaatcttgtgggctccagtgatcctcccacctcagactcctgagtagctgggcatggtggcttacacttgtaatcccagcacattgggaggctgagatgggtggatcacttgaggtcaggagtttgagaccagcctagtcaacatggcgaaacccagtctctaccaaaaatacaaaaattagcccagcgtggtggcagatgcctgtaatcccagctactt

SEQ ID NO: 20963 - DNA, 532 bp, Homo sapiens
tgtctaaaacatctcatcttatttttcccccaagattgttcttgttatgaacaatttttgtggtgtagaaaagaatgtgaagaaataagcctttcagataacatttcagattaggctattatagtaaaattaagcatcccaatcaaggcattgggattctaaactgatttactacatctatgatctcttatgtttttaactatttggaagagacagaaaactataactgatttctctcctgaaagcgttctcaaggaaggaaagcatagaaaagggtaacgctggtatattagactcatgatctgctgaaaatataataaaaaaggcattttctaaaaatgctgagagattttgacctaacaagattaagaggcagataagaagtaagaattctggccgggcgcggtggctcacgcctgtaatcccagcactttgggaggcctaggcgggcggatcacgaggtcaggagattgagaccatcctggctaacacggtgaaaccccgtttctactaaaaatacaaaaaattagcc

SEQ ID NO: 20964 - DNA, 535 bp, Homo sapiens
ggaattaaatatctgtgaaggagcaaaattacagtaataattgcttctggccttaatgttgggctaggatagcttgttggataagtcaggaatgcctataaaaataccagttcttggctgggtgtagtggcttacacctataatcccagcgctttgagaggaggccaagctgggaaaattatttgagcccaggagttcaagaccagcctgagcaacatagtgagaccctgtctctaaaaataaaaataaaaacattagccaggcatggtggctcattcctgtagtcacagctactcaagaggctcaggcaggaggatcacttgagcccaggaagttgaggctacagtgtgctgtgattgcaccactgcattccagcctgggcaacagagcgagatcctgtctctaaaaataaaaataaaaaaagtagccaggcatggtggctcatgcttgtagtcacagctactcaagaggctgaggcaggaagatcacttgagcccaggaagttgaggctgcagtgtgccgtgatcactccact

SEQ ID NO: 20965 - DNA, 575 bp, Homo sapiens
agctctgttgtttatttttatgttttgtggagatggagtcttcgccatgttgcccaggctggtctcaaactcctggcctcaagggatcctcctgcctcatcctcccaaagtgctgggattagaggcatgagctaccacacctgggtcatttttataagtaaatatgattattaactgagaaagggtgaatgtcaaacatctgctatgtgggataaatggctgtgtttggcaaagaaactaaaaaataaggggcaatatctccaccaaatcctctaacactgactcagcatgtgccctgaatcatcttataagccaactaggttttttacctataaatgtttcttcactaaagtggctcatgatcatggttttggaggacgaggactaacagacacacaaacaagaaatcaaaggcataactggatagtgcattaataatgaagcatgtatgacagatgatgtggtattgttattttataattacagtatatattaacacatatccactctgcttattgaaatatttttcattccttccatgatagagaatcctgcctctgctctgaagcctttct

SEQ ID NO: 20966 - DNA, 578 bp, Homo sapiens
gcagctgccagctaagatgtctagtgactgatttaagagcagatgcagaggaagccctttacaaaatgggacacactcatggctgcctttctagatcagtgatgttgaacttttaaatatgtttattggctttttgtatttcttctttgtaagtttccaaaggaaatattaggagaatttctgaaccagagcccatgctatggctatttgactttgcagtagacacatttggatgccttttcactacctcctttggccccgaagctcttgttaaaacaggtgcgcctgaggaactgcgtctatgcgtgaagaacactctccatttgcccctgacgtctgcctcactcttcccagattgaacctttattatcccatgctgggctgggacctcattatggaaggcctcgaaagccagcctgcggaggttgaacaagggagtaggatgatgagagttctgctgtaagagattaacccagcatcagtgtaagagacttgagagggaagaatgggtagagaaagagatcagttagaagtcttttattggctgggcatgatggctcacacctgtaatcccagca

SEQ ID NO: 20967 - DNA, 391 bp, Homo sapiens
cacttatcccttccccaggaggcattcaggtctgggaactagccctgtcatgcaagtatcctgtgcagggtttccagcttcctccctcttcagccatttcttcaaataagctctctgccacaggctactcttcgttgtgcaatctgtggacccagttgtcatctgccaccactgtctagttatcttttgactgccacaagtggactccaaaaaatctccaaaagaaattgttaccataacaagatggccaactagacacagccaggaagcactgctcccactgagagacaccaaaatattgagtacaccaatgtattttgcgcccatcttcagagagaaaatgctgagagtcattacagaggtgatgcagacaacaaggctgaagagggag

SEQ ID NO: 20968 - DNA, 574 bp, Homo sapiens
ggaattaaatatctgtgaaggagcaaaattacagtaataattgcttctggccttaatgttgggctaggatagcttgttggataagtcaggaatgcctataaaaataccagttcttggctgggtgtagtggcttacacctataatcccagcgctttgagaggaggccaagctgggaaaattatttgagcccaggagttcaagaccagcctgagcaacatagtgagaccctgtctctaaaaataaaaataaaaacattagccaggcatggtggctcattcctgtagtcacagctactcaagaggctcaggcaggaggatcacttgagcccaggaagttgaggctacagtgtgctgtgattgcaccactgcattccagcctgggcaacagagcgagatcctgtctctaaaaataaaaataaaaaaagtagccaggcatggtggctcatgcttgtagtcacagctactcaagaggctgaggcaggaagatcacttgagcccaggaagttgaggctgcagtgtgccgtgatcactccactgccttccagcctgggcaacagagcaagaacctgtctcta

SEQ ID NO: 20969 - DNA, 575 bp, Homo sapiens
cgtgcttgactttcaagactggctcttctgcccttagcaaatgtccagtctatttcactgaaacagaaaaagcaaagtagaattgatttacaaaagtgaaagatggatttttgttagaagagtgatgactgaatttaattttatttttaaaggtctgtgtacagttatacaactcacatacgtatatgcacatatacacgcacacatacattgtcttgatacaactgcctgagggaaaaacacacgtttcctttgataaatctcttggtctgtaaaatttctaaatcagagatgaaaggcactactaaataaaagctcaccacaagacaggcatggaagtttataaccaatctgatgttgtctagataaccaattctgtgtttggagctgggtagcattgcacttctggttgatgtgattgtatgaattagtgttcgcatgttaatgggtatatggatgaagttttccatcttaatgacagttgttggggcactgttctggtagaaagcacaatgtctctgcaaactcttgaggccaatgcatacaaaagcaggaggcattttgggaggggagag

SEQ ID NO: 20970 - DNA, 577 bp, Homo sapiens
gtccataaaggaatatctgaatgggtaagagagaacaaggagagttgggtcacccaaggcaagagagaagaacctttctagaaaggtgtagttggcagttttaaacatgccaggaaaatcaagtagcccaaggcccaagaaaaatctactggatctgagaaaatagaagctataggggaaaacattttgtttgaaaaaaagatgaagattcaaaagggttgacgattgaatggaagaccaaaaagtagagatatgtggttgattctgtctctttggagtaatgtcacttttaagtttttatttctaactcttataattaatatttcttgttctactaactactaccttcagggtaataaagtagttatatccacatattttcacctctcctttactatgaaatgactacttgtacattttcatcatttagctggaaattgtctttgaacttttgatagaaatgtgcattatcctatcatactctatttagattcccctttagaagtgacttatttcctccagctgctagaagtgttgcaagtagacagtttttagctgctgaactcctatctggatt

SEQ ID NO: 20971 - DNA, 502 bp, Homo sapiens
accatgagcctctgctctgatgtaatttttagtgtatgttgtatttgttgacatataattttatattttgcttctttcacttaatgtatcatggaattttttcatatcattaaatattctctttgtgtggcacaatagtatttcagcatgtagatattttgtaatttattgaatgaatcctttttgttgcatattttcaattttgtctgtaattatatagcaatgcagggaatagtcccgtgtagcaggtggaattctaagatgaactccagtgacacttaccttgtataattccctctccctgtgaacatgatgggatattacttccatgattatgttatgttacttgcaagggaattttggagatataattaaggttgctaatcaattggctctgaattaatcaaaagggcaatattctaggtagacctaacctaatcaagtgagcactttaagaacagagagttttctcctgcttgtggcagtagaggaagtcagagag

SEQ ID NO: 20972 - DNA, 570 bp, Homo sapiens
attacccaatattgtgttaaatatctttgtcactgttccactttattatggcaatagtgattttcaaaattatttttcccacagaaccctctctttagatgaaatcctagccagaagcataaacaaataaaacagataaaagcacaatgattctgttaaagatgagaataaatcagagggcttttcagctgcaaagtactaagtattctcttcatcctatgaatttccatagtactcattgtctatatctctcatctcatgccaaattacacactcccttgaattttactttaatgtaactctgttgcttcaactaaattgtgagctctctgtgacagggaccacagctttaaagctttacatctccctcaacgcagccaacaatccaacaatgtctttcatacaatagctgtttcctactatgtacatgtttccaaattaattgaatatgatgatgaacatatagggttccaaataattcaattcacttttctagaattttaggatgtattccctcagggtccttagatacagacagttacacacacacacacacacacacacacacac

SEQ ID NO: 20973 - DNA, 564 bp, Homo sapiens
gaagtgactttgaatagagaaggaaaatctggttgcagaagagatggtggtgtgattgatggaaaggaaataactaggtctgttgaaactggggagccagggggagatgtctagtaggtaacgggatggggtcaaggcccaataaaggtgtctgaaccagaaattaaaatgttgaagtggttagtgtgtagtagaaggtcgcaacttggaagttaatgggatatcttaggaggaccataagtaatagtctttccaatatgtatcatctctggggtgattttctagattatagcattatggtataagaacatcaaaatattttaaggaggtcgtaatataccatagaaaaaggatttgctgatttatgcaagacagctcccaatccatgaggattaaaatgtaagctcttgtctcttcttgtgttagtatataaatataatatccgaggatcacttttgtttctggtcatattgcagtaactaatactggattttgcttcttgctgtgatcaactataaaactgaacaaaatgtatgaaaaagatggtttcattcattgagcact

SEQ ID NO: 20974 - DNA, 562 bp, Homo sapiens
ttttgatagaacgaagtcagtgctaaataaatatctgttgggtcactaggctttgaagatgtcatctactgtttatgttcatgagctcttggaacatgctagagtattttgtgcagagagccacaaagtacaaaaataataatgaagcttcaaagccaaaaggcattaagtggagagatgcaagtcttacgtagcagaaagctaaggctgtgacattttttcaaccttacatcaatcatttagattttagccaatgagcaatcagttcatcatcttaataggatcacaagaaatagactgatgaagtcttctgctgtggaacatctgttcacgctctctctttattgttagcctgctgtcttttcatgcagtaaagaaaaaacggtaaactatccaggcgcttagtatatgaaaatttaattcacttttcctttatttcctgttcatattaaattgtcttactgtcatcatttattttatcatttattttggtattatcaccctcttgtagtgaacagaacacactaagagttactcatttaaggcctggtgaggtggctca

SEQ ID NO: 20975 - DNA, 583 bp, Homo sapiens
cagaaatgagaaagatttgtttattttagagaaaagtaagatgcattctcagaaaagtcaaaattaacaaatacaaagtggaaaaacaatatctacgctatggatttgttaaccatacttcatggtttatttgagatagtacttgcttactcatattgttcttcccaaaattgttaataacacactcttttacttaaaatgtggttaaatttggaaaagtaattatatggtcatcttctctatgggggcatcaaggagacagatcattttcagtaaaagttaaagagataattagaattggcaacgaatttgtcgagaagctgatctaacgggtatatattttcatcccgattttatccatgaagaagtagaagccaataaacattaagttattttaagtattgctcagtaaggaagaggcaaagcttcatgcaaaccaggatcaagttcacaatctcctaaagaaacaaaggcagtacaatgatatggaggctatgataaaacaatttaaaatatgaaacattgctgagatggaataggatgaggtctttaaatgtgattggatttgttgactacctttaag

SEQ ID NO: 20976 - DNA, 567 bp, Homo sapiens
taactgttacctgtatgaattaagataaggagttatgccagaatataagtcacctgtgtcactaagtttactgtttagctcactttttttgtagcaagattttgatgaaggacgcaatatgttgatttacagtctggtacaaattttgatgtagaagatgcttccaatatcctggtctcttagttccttgatttcttctccagtgatcttattttctaccctaactcaactacatattcccattgtcatatcctagaatattttgtcttttatctgtaactctgctctcttcccccaatctcatttcaagcatcccactttctaattcctccagtaaatacgtcagttccaacagcccatcaatcccattgggacctacagtttatctatccaagcttttccctgttcctcaccctcacttctatacagctgaagtttcatactgaattataatcactttctcgtatacacgtttaacaatcttgtccctccctggcttcatgcccagtgatctcttgtatctatgaccatgtcctttatcttctcctctgtcactggatgaactgt

SEQ ID NO: 20977 - DNA, 563 bp, Homo sapiens
gaggtccaaggaatgataatattagtttggaaattctgtattctctattataaacctaactacaatttcaagagggtagtggataactcttctatatctctgatcatttgcagagctcagcacagtatccagcatgggtgatgtctgcataaataaattaagaataaatgcttcataacaaattagcagctgatagagataatatttaaaataaaggtgttgttcgagaaaatggaaccctatgactgtcacattaaaatgctgtaattgtataatactatttcaaagataacacccatccaataaatattctgctctgtgaagaaatgcctacactaagcatggaggaaaatcttccattggatagtgaagcatagttttagatcttctttgactgcacaggctcctttcacagcccttccaggaggtggaaagggtttctaacagtgtgttcgtctggtcaattgtacttcttatatttacagtttgaagatggttttcacataattgcttctctgtttctattcctccttccactctgtctactctccctgcatgtgggt

SEQ ID NO: 20978 - DNA, 453 bp, Homo sapiens
tccaaaccagattaaaaaggaatagaatggatttccaagacaggcaggcaggaaggaaggtctgaggtttcattgtaggaaagaggctttctacacttagccggactatgtgcaccctgcttagagcaggcagacccatgcagggaggactagagtccagtgaacagtatcaaatcattgagtgcagcaaaggcaagttgcttggtggtctgcagggctccaacagttacaacagtaactcagtcaaatagtaaaacttgaaagaatggaatatttacattcttcttagaaaaaaagaacacaaattcattattcagagatgtagtccaacagtgtatttgataaactccagaaagaacatgatatgggcatatatacccattctgccccaggtctcactgactcctcccttctccccactctcaacctcccatcccctaaaaaaaaaaaaaa

SEQ ID NO: 20979 - DNA, 560 bp, Homo sapiens
acctcttctcctgcgttattattctccttctcactagtaatatacttaatattttaattatttgtcttgcttatttcctctatgggaggtcaatgaagtcaagtattttgctctccgctgcaccataggtgactacaataatgcctgttatatagaatgactccataattaaaatatgctaaaataataatggaatatgatttcctacataatatatcaaaaaaacttaagttaataaatctggcaagagcagagagaaatgtaaattgtcttatactgttgatgaaggttaacttaagcaacaatattctggaaagcaagttgtcaacttagacttaaatacattttttaaaatctataacttctggagcatgtcttaacgtctgtgaaactactgtaagtgtcacaaactcatacacttataatactacttaatgtttttataatacttaacaaagttttatttaccaaagatttacttataaaaaacttataagctgtctgggcgcagtggcttacgcctgtaatcccagcactttgggaggccaaagtgggtggat

SEQ ID NO: 20980 - DNA, 580 bp, Homo sapiens
ccagtgttatcaaaaagataacgggttttgaacaagcatttggcactttgatgacaggaatctaaatcagcttcagtgatgaactcaataattataagattctggtttgattgagacatacacctatctttgatgtcctggtttggttcaggcatactgaggataacttagagtaatcttatttcttttggaaaggcacaagaatatacataatgctccaaagattcttgatgtcatgaaaatcactctcatcctaaaggatttgttagccagtgatccctctgaagcaagttcacatttattagaatttcagaacagtgtagataatgtggataattttagttctagccgcataaaatacccagaagtttattattacaattaaatcttgttttttattgcaaaataccgtggtgttctctataactgtgttgaatttataatgatctaattgagaggaatttatccccaaaggataagtgtttacattttttattttaaattattaagggcatatattattttaattacagagatagtatataagtaaaagattcattttatttaaatgttttcttaa

SEQ ID NO: 20981 - DNA, 571 bp, Homo sapiens
gtccataaaggaatatctgaatgggtaagagagacaaggagagttgggtcacccaaggcaagagagaagaacctttctagaaaggtgtagttggcagttttaaacatgccaggaaaatcaagtagcccaaggcccaagaaaaatctactggatctgagaaaatagaagctataggggaaaacattttgtttgaaaaaaagatgaagattcaaaagggttgacgattgaatggaagaccaaaaagtagagatatgtggttgattctgtctctttggagtaatgtcacttttaagtttttatttctaactcttataattaatatttcttgttctactaactactaccttcagggtaataaagtagttatatccacatattttcacctctcctttactatgaaatgactacttgtacattttcatcatttagctggaaattgtctttgaacttttgatagaaatgtgcattatcctatcatactctatttagattcccctttagaagtgacttatttcctccagctgctagaagtgttgcaagtagacagtttttagctgctgaactcctatct

SEQ ID NO: 20982 - DNA, 570 bp, Homo sapiens
catgtttatgatctcgtaatgattctaagctcatcaccatttctgttactgtgaatctgatgcttggcatttggcatcagctacagagtgcagggattcggtacaattttaacaattgcagagaatggccctaaaaataagaacttgtgggctggaatcatgttttatctgccaagggaatctgggaaggaaaacaggtgtttaataatgaagtggtatgaatttaattatcatctactttgagggtatcacacacttggcagccttatcaatcaaggaaggaaattaatgaaaaagttaagaactctctacagagaatacatgatgcagttagtaattttaaataggcatggttaggtcctgtacagatttgtatctgatcctcttagggggtgcggctacccaaggctgcatttttcatcctgtggtattaccttacctgaatataggactccagctctagatatcccatctataaagtcaaaataaaccttctcactgggtgcacacaaacattcttctaactgtagcaatgaagaaggggtcaaacagatggaagatggggattaa

SEQ ID NO: 20983 - DNA, 578 bp, Homo sapiens
tgataggattattgctaaaggcagaccagtgtgataagatgtggaggctggacagatataagtgtggaagacttttcactaaaccaatttgtcaggattcttgctcaaactggatttaataaggacagaaagagaagcccaaggtcgagcctagtgcagggaggactcagaggagcctgactgaggttttggtcaaaggagagtctttgtcaaatgttgaagtttcccttatcctacccctaacataatgacgttgggaacaaatcagaaaagaaacataattttagataaaagctggagcagccacaaactaacagcttagaactcactaccattcacaattcattcctttatatgtaaaaacaacctcacaacgtgctgacaagcaagtcttcctagttaacaataatcaaaacaaatgggaaatatatttgtaaagaacaaagcgaatcaaagaaattccttaaatctgtcattcagctagcatgcttgggaattattcaaaatactgctaggcttggtacaatggttcatgcctataatcccagcactttgggaggccaaggcagggggatcac

SEQ ID NO: 20984 - DNA, 548 bp, Homo sapiens
agactatacagagatttctcccctaactgactacacgtactccacgtcctatcctactaggacagtatgaaaagtcacaaaataccaagctagggactttctaagcttactaacaaggagataacctttccccagtggagctataagacatagacatgtacaagcagatgctaaaggagtagtgacagatcaagagaagttgggacatccacttgagtaagagtatttttcaatatggaagccctctttctggatacagaatttaatgccttgaccagtttccaaaataatggttccaacatgctgctagaaaggcacctagaaacatgagatgcaatgcccctacaccaatgagatagaattgacatagcaaatggtggaagaaggtattaaaagcaaagaagtgatcatgtctgagcagacacattaagctgaaaactcaccatatggtttatgtcatgaaaagtcttgaatgttgtatcatcataccatttctaacgtgataagaaatgtcctggtgaggataaagcagcatcactaagaagttt

SEQ ID NO: 20985 - DNA, 573 bp, Homo sapiens
gtctggggttcagtagccactgcaccagtactggggctccttcttcattatgccaaacaacaggagtggctgaaccccacaaccccagtggcacagagcttgggcccaggatcagctgtgactgcggacctgcacagcaaggaaaccaactcccactactgcacttccagattgcacagagcacccctggctccaggacttggagtggggatagactgcagtagaagtggttttgatgtctaaggtatgggcacacatggtgtgatgtgcagcttaggtctgaagcttggacatgcatggagcagctgccactccagggtctggggcatgcataggtttaagaaggtgctggcttgggttctgggcagcacaaaagttgcccttttttgggaaaggaatacacagcatctccctctctgagggttttacggtagcaataactattggttacctcagtggtgaaagctatcaatatcctctgcagaagaggccactggggaccatggtggcatctgccacatggctgatcctgagagcccctgccctttgttttcttcatagccatcgccagac

SEQ ID NO: 20986 - DNA, 567 bp, Homo sapiens
gaatcacaaagtctttaagaaaatggagacaggacctatagtgatcactactcacaaatcactagaatcacatgctgaaacactgctgcagaatatcaatgtgtggtctgttcccactgccattaacccaaccatgactttctctgcctgtcctggtatagaccatttagttcttgttaagcacagttttcattattttcaacctttaccaaccaaaaactactaaagaaaaagttaatattctaaggagtacagttaagagatatcctaacattctcactgaatcagccaaatataaaggctaacatgttaaacaggctagagcagttttcttcaaactaaagcagtagggccctggagttaacaagacaactttccaggaggttaggatagtttaaggagaatccggttaaaggtggtctgcttccaccgtactcccagagcttgatctgtctgagaattcttgtggtttgctggttgtccttcccatcctcccttataaatgtattcacttctcccacattacttcctaatcttacaattgttcatttcccagacaggtgcagt

SEQ ID NO: 20987 - DNA, 566 bp, Homo sapiens
gaaggagtaaactgcaaatctctgggccaagagtgtacagttatacttcatgagtaatatcactagaaagcagaacaacattcagtggtttgaagtgtagtattgaaatgctgaatgggttataaaattcatttgttaaatcactcatttattcaaacagccattaagaacatgctgcatgtcagaaaaagcttagtcgtcagaaacataaggagtgtgtgtatatgtatatgttctgtgtgtgtgtgaagagctcacaaaattaagcaactattacatcacaacaaaacttactgtactgaaagaaagatattattgccatctgctttctcaataaattcaggggatagttttgagctactactatatataagctagtaggaggtaaagataaaggaacatgtgtaacaataagaatttaaatgaaaaattgtgttttaatgctatgaattagagattgttaatttgtaaaggttgcctatgtatatgctgttttttattattaccacttcaatttttttcacctactttctactatcttggtttgctttccttagtctttaatt

SEQ ID NO: 20988 - DNA, 565 bp, Homo sapiens
ttttgtttgctgctatattctctgtacctggaacaggcctggcacatagtaggagcactatgttatttccagaaggaagcagtgaatgagatacaaaccagaaaagacagcagaggtgataaacctaacattatacaaagtgaaagtcaaggtgcaaattatgaacgaaacaaaggttttacactcatttttgaaagggagaaataacagtcacaagcccttaggtcctaaagtaaaaactgtctccccaaaaaaggaaaattgcaaatactacattgattttagaaaggttaactcccatcttggtcacatctcagaagcaaaaagtgacgtaaaagacttgaataaagaaattaatggccaggcgtggtgactcatgcctgtaatcccagcactttgggaggccgaggtgggcagatcacttgacgtcaggagtttgagaccagcctgggcaacatggggtaaccccgcctccactaaaaacgtaaaaattagctgggtgtggtatcaggcacctgtaataccagctactcaggaggctgtggcaagagaatcagttgaacct

SEQ ID NO: 20989 - DNA, 603 bp, Homo sapiens
actgtctagggattctgaatgttcaagatcttctttgctattattaaaggagagattaagctcaattaaaaattaccaaaaaaatcagctgtattgtcattagagggttaatcgaaattttaatgttatagatcatattaaccttttctaaataagagcaccttcatctgagtttatccttgtcagacttgccccttataacattaggcagaccatgactcctcttcaatcctaataggtgaagaagacatcaggacagcatggaagtgtgtccacaattactctgggttgtcacaaagatcttgactgttatctaggatgaccctttttagcatttgagcggtctctttaaaaatcaaacgaaatatatggtcctcgttctcataaaataaaacaaaaacaaagcaaaactgaaaagaccaagaaacaaaaaggtaaaacagatacacatgggattgttcattacctgtaggttaagaaaccctggtctgggaatatgagattgaatcagtgtaccagctttggaacatagtaagaactgaaagactaatagatgacagaatgttacagacgaattcacaatgagccatgaaggaataggag

SEQ ID NO: 20990 - DNA, 602 bp, Homo sapiens
gccctcatgcctgtgatcagtgagtgcagccttcctcgggagctatcatcaggacctgcaagtgagtttaaatgccagtgagcagagacaatgtattcaaaaaagactccagtttcagctcaaacattcccctaggaataattttggcaagagatctattctgaattcgtggtaggctgggggcaaagatgagagaaagaagaaaagggaagtctctctgaaaggagctttgaccccagggcttagaaacggagtctgtcttcaagcttttggatgctctcgtaaaaagggtttgtaaataatttagcacccccaagtagtagattctaagtggcaaacagcctgctgagaggagggctgtagaggccccagggaaaagagaactcaggacaaccagcttcacaagagcagggaccatggctgctggtcaccaccatacccccagcacctgcacagttcttggaccatggcagatgctgctcaggggctacttgcgtgggtcaacatctaagggaataaacaaataaatgatttatcattagggaaaaaagcatgccaaaaacaacagcacatacccataatcattccccagttttgacacc

SEQ ID NO: 20991 - DNA, 510 bp, Homo sapiens
ggaatttatgaatgagagtgctttggctgcaaagcattcccattatagcccctcagccaccacaaaactgctgtgtaattggaagggaactttttcccatgcaaaaaagcttgctgtcggcgccaacccatcaaagccatggcatggagggatgcacacctgcaggtagcctacctcattcatggggatcctggtccctgcctgcatcttctgctcacaaagggatctggatctgagaagatcagatcacagaagcagggaatgaggacgtggcaaaccttgacggtcctttcatccactcaattcagaggtgaggaaactgaagctccaaaaaaagcaaaataaacaagtcccaggtacatagcccatcaaaggcaaagcctggacccgaagccagcctttctcttgcatcccagcccatccatatatctaaaagctgaccctatttcagtgtttatttacctaaaactatgatcaatgaattcaaatatcctaaatgtcattctggct

SEQ ID NO: 20992 - DNA, 577 bp, Homo sapiens
aaagttcattctattttgatgggtttgcttccctggtttattgatgcatgcctttgtttacaatatgaatggtaattcttcactgtctgtaatgaatactatgcttactttacaaaattaaagtgaagaattctttctgtctagagagaaaatattctgtgtcttaccagaataattttctgtgttatatgatgaccttataatgtctttgattatttaaggagaaaaaaaattcctcatttatgaaagacataagggttttttctaactgcattgctgttagtatatatttttaaatgttttattgtcactttaattaaataggtaaccaaatattgcttcttaggtatccatggcctctcgtaagcaagtgtccaaactgttctgataactgttaaaaatttaccttccccaaataggatcctaaatgtagaaaaaaatgaaataaaagtttcaagattttttttacacctaaaactttcatctttgagatttcccagaaagctccggggaaaaaaaatgacaaggttttctcttttactttataaaaaaagaagtattagaaataagtgggttt

SEQ ID NO: 20993 - DNA, 524 bp, Homo sapiens
atgtgagaaataagttccaataaattgctgtgcccttaagaaagtcaaaaaacaaaccctacaaaatatctagaagtcaaaaataagatcaaagcacatacaagatgatgaaatatattcaaatatatccatacttcactaaatataaatggactacatgctacggttgtactgttggagaaaaaaagcaaatccacctacaggagatttacaaagacacttgaaaaacacatggatttgaaatgttgacagtgacagcacagaaagttcaagaaaatattaaataaaaaaattgaaagccatgatagctagagtaataacaagtggcctttgacatcattttttactgcttctgccacactatatcccgtaagtcaccaagtcctatgttaaatgtcttttaaatatttcttggttggggtgattaaaaccttttggaaatagtggcgatgattgtacaacatcataaatgtaatcaatgccactgaattgtatgcttaaataaggctaaaagggcaaatttt

SEQ ID NO: 20994 - DNA, 496 bp, Homo sapiens
  misc_feature 427: n = A,T,C or G
gtatcagggggttctattgtgcagccaagtttgagaaccatgcaataggtccaactcattcaggaggggtgaaagtctaaatgccaaatgtagctgctccatgtctctggctctctgaggtcatttgtttattcatccaacaggccactcactaatgggtttccactgaggtcacagaaacacaatcttttgagtattagtgtaaaaactcccaactaaaccagaaaggacatcattaattcatttattcatttgataaacactgacttagaccttcatctgccccagtcactgtgatatgcctgggaatactgagttgattaatgattaattctagtgatcgagaagctccagaccaataagaggaatggatttcaacataataatatttactccctttacttttactgagtattctatgctaganactgcacttagcaatttgtccacattatttatttttatcttcataaagccttctgatgtaagcagcatt

SEQ ID NO: 20995 - DNA, 598 bp, Homo sapiens
cggtggtagattctgggtgcttatcacaagggacagtaagatagtgtctgttaagaggccgtttcgagctactgaagtcttgctctttttatgggcaagagtcccctggttaggactgatagtggaagaatgtgcttggtcatgtctttatctggctggatgcatctttattgatcaggcaaaatatctgatccctgctggcaacgtgccttatgaaatgtaagatagagtctttttctaagatggagccactaatgtcaagggtgctgtataaatggcctctgtgtgtttcctctttctgtttctcatccttacccccatctcaaaatatctaaattctattcatcttaatgcctgaattaaatagtatctccttcagaaatctcccctggtttcctcagctgaaggagttgtatttctcttctgtacgcctacaggcattttatctgtggatctataattcacttatttatacaattatgattcaattctcgatataagtgccttatccttcccactttaagcaactcagatgtgagattatgtcctcaatcatttacaatcccaagcagagttgctggcttgtgacaggctcaca

SEQ ID NO: 20996 - DNA, 560 bp, Homo sapiens
tctctgtaactagtttagtttagacaatgaagaattcaacgcaggttcttgtgcaagaagccagcatgggaaatacagtgttttagagatttattggtgggacacagaacagttaatgacgaaaggaagatgacaagttaaacctcagttcttgcactaactagaggtttgtgactctggacaagttgtcagaaacctctggcctcagtttactcaaccacagaataattcctcctttacaagtgttgcagtgaagatgttgctcctttatatctgttgctagcccacagatgacaacaaagaaatactggctattggcatctgggaacttcagaagacaaaatgaagcctagggataaaaggggaagaacaggctgggcatggtggctcacacctgtaatcctagcactttgggaggccaaggtgggtggatcatctgaggtcaggagtttgagaccagcctggccaacagggtgaaaccccatctctactaaaaatacaaaaaaaaattagctgggcttggtggcgggcacctgtaatcccagttactcgggagcctg

SEQ ID NO: 20997 - DNA, 315 bp, Homo sapiens
gtcagcccgtcccttctgccttggggaccagccaggctttttccttactggaagctgggggactctagctccccatctccttgcacacacacacacctgcacacacacacgtgagcccaccctgcagagcttcagcatactcaaatcagaaggcccccttctatttcagtgccttcaagggcttccgaggtcactctcccagagaccagaggccttaagacatcgcccagagtcacccagagtcacccccccgggctcttccctcccagggtctgaatctttctttaaaacagagtctcagggtgggtagagggg

SEQ ID NO: 20998 - DNA, 493 bp, Homo sapiens
gtatcctgtaattttaagaaacggtttgcaaacctgagtgttcctcagacagagtggcctgtaatgagccagcccaagaggctgacacccaggtgcctccaatctcatcgtgtgtggtgcctaacagcactatctgggtaaatccagagtaggttactcatctgtttacatagctaaggtagaagtggacaataagacctcaagtataaggatgacagtgttaggattattagatgcatctactgatagcccgtaaaacgtgtaagacagaagcagaaaacaaacttacttgcacacactagtattaatattgtgacagctaacagccagttgtttctggcttttaagaagttggggctggacgctgtggctcatgcctgcaatcccagcactttgggaggccgaggcaggtagatcactcaaggtcaggaaatcgacaccagcctggccaacatggcgaaaccccacctctactaaaatacaaaaatcagct

SEQ ID NO: 20999 - DNA, 511 bp, Homo sapiens
agagtcaggaactagatctttcttatcgctccagaatttagtacagtcacacacagaagagcgtagatactcaggaatgttttttaatgcataaaagaggaaaggaagaaaggaaaaataaaaagaggtgttatatccatctattcatatccaatgacctgtccagattcatcgttagggccactcacgtgcaaggtaaatgacacatatgaaacaaaatctgtggataaggagcagaatgatgagttgggggtagagcaaagcgataataaaataggggatttgccttatttacacagactttaaatacgtgagttaaaaagcctaaactttcagagacagagaaaacaaatgtggaaatacagaagagtgtgatgttgaggctgtccaccctagctgtgccctccaagtaggtaatgttcagtaccaatcactctgcattgacttttcacataatatccgtggtcataaatgtggagacagttagcaggctgctaaacagcagtacatt

SEQ ID NO: 21000 - DNA, 485 bp, Homo sapiens
tgcatactttaatccagcctcagttggtgtgtctgggttttctggctaggaagaatgctgctgtggaatgtgctggaacagatccttacgtgcgctgtgttggagtctttccaggtcaggggttctcaaacggatttcaggaccctttacatcatccagaatgatccaatagccccaggagcctgtgtctgtgtggattatgtctgccggctgttagtgtgttagaagttgaggccaggcatggtagctcacacctgtaatcccagcactttgggaggctgaggcgaggatcgcttgaggttgggagtttgagaccagcctgggccatgtagcaagaccccgtctctacaaaaaatgaaaattagccgggcatggtggcgcatgcctgtagtcctagctactcgggaggccaaggtgggaagatcacttgagcctgaaaggttgaggctgcagtgaaccaagattgtaccactgcattccagcct

SEQ ID NO: 21001 - DNA, 493 bp, Homo sapiens; identical to SEQ ID NO: 20998

SEQ ID NO: 21002 - DNA, 530 bp, Homo sapiens
cccagcaggatttatggccagtgaggagggtactaactgcataggtaatggcagcattcttcctgcttacaaattcttagatctgagtttttagatcccctaagactatcatcagttcagtgcttatccagacaacccagaattttttattaaacaattatcatgacagcagtctgctagatcccaggtgatataaaaatggatttttttcccctaacatttttgaagaaagagtgtcatatatgtgcatagacaagatacgttaaatgttacttttggaccaccctgcatgaatcaaaactggatgattttgatgtgtgtcaaacaaatcaaagggaaagtagaaatcagttactggccaggcgccatggcccacacctgtaatcccagcactttgggaggccgagcctggcggatcacctgaggtcgggagtttgagaccagcctgaccaacttggagaaaccctgtctctactaaaaatacagaattagccaggcatggtggtgcatgcctgtaatcccagctactt

SEQ ID NO: 21003 - DNA, 615 bp, Homo sapiens
tagataattatataatcatagtaatcatgtttttaggccaggtatggtggctcatgcctataatcccagtgctttgggaggctgaggtgagagaatcactcgagtccaggacttcgagaccatcctgggcaacacagacatcatctctaccaaaatatacttagctgggcatgacatatcatgcccaactaattattaataacatcccagctacttgggaagctgaagtggaaggattgctggagtccaggaggttgagtgagctatgactgcaccactgcactcgagtctaggcaacagaggaagacctcgtttccaaaacgaaacaaaaacaaaaaaacaaatacctttataacatttccacaaatgataacagtagacataaagcaactgataaaactaattgaactagagaactagacagaactagttagcacagatagaactagaacactgtcaattaccttgatctaattgatagaaagccaacaactagaactaaaactatttttcatgaaaatcattcaccaagacagtttcaggcaaaataataataataaaagcctcattaaaactaaaacaattataaatatattcccaaaaaaaaaaaaaaaa

SEQ ID NO: 21004 - DNA, 551 bp, Homo sapiens
ctttacaaacaaccaatgtaacaaatatagggaacagcaaaaaaattaatccacaagacttttgcaaaatatgggttctaaattaagaacttatagagttcagcggaccttgctgtgttcctgtgcaaagtcagtttagatattaatttaacatgcaagcaaaataacaggagaatgacctctgaccctttcatcagtgcttttcttctcccatagtgacccactggtcaaccaacagtcagtaacttaggcagtaatggaaggtgaggtcaggcatagttcatgtgcttctgtaatctctttgcatctctgcgagttaaacttcttagaaagctttttcaagatgaaatcagcttgccaattttcccccttcctttcagagaaatgccttcaagcacttgaggaaaaccactgtactcatcattttactaatttacatgtcatgtagtatttatcatctttatacctatttcacatatgattatacctatttcacatctttataccttgttcacatatatttcatgcttattctatgtataaaccatagc

SEQ ID NO: 21005 - DNA, 520 bp, Homo sapiens
  misc_feature 449: n = A,T,C or G
tgcagattctgagttaaaagtctcctctgttccttgttgtgaaaactgcttgttaattgaaaaacagtgacaaggtcctataaggtattttactttaaaattatatacaataaaaatgtttgctaaatgaagaatcatcataaaaccaatttgttttacagctaggagagacttttgtgtttatcaaacctgttatttttactttctttggcaagtggttgattctttttcggggcaaaaaaatgtacactatgtaccaggaacaacttatcatatcaagaaatctaggtagttactaaagactactggttaggtctaaagggcctgggggcgtaactaaagatgctgtccctgtccaaattaggataatgttagcatcaagttttcaatcaatagcttgatcatatcaaatatacttaaaatcaggagttcataacagtatataacanaaaaggctggactcagtggctcatgcctgtaatctcacaactttgggagcctgaagtggaagggtcacctg

SEQ ID NO: 21006 - DNA, 512 bp, Homo sapiens
cattcatcactatttttagtttaaaacaagagcaacacatctggaaggtattggcttttcaagtcaactgctggaaagacagctggggggtgtccatttcaggaggcttaccttggtatcctggggtcgtgccacgtgctaactccagtctgtgtatgcaaaaagtaaacttggccctggactgttgttctttgttctacacaagaaattagagatccaaatgagacaagttcaattccagggagagtttgtaaccaaccctcgatgccctcacgtctggtattatctaaatctagataacactcccctcttatcccagttcttctctctgaggtggccgaataatcccctcttctccatctcgccccatgctctcctttccagagcactacagacaccctcatctagcctacatgttaccttggtttgctttggtgttcgtttgcctaagattttcacttgatttctaaactgggagatttggagcaattgctgaaaattcatgattagct

SEQ ID NO: 21007 - DNA, 415 bp, Homo sapiens
aactaatgcagaattgatttttttaatccagtgagtttttattttttaattagttaattttcatttattgtgactgatgattgcatccattttttgctatcttattttgaacttagtttctgctgccttttctgttatctttttttgcctttcttattccattttagccacttgtaagtttagcaacttttgtatgctagttttaatactattttattttatttcattttatttatttattttttttgagacgcagtctcgctgtgttgcccaggctggagtgcagtggcatgatcttccctcactgcaacctccacctcccaggttcaagcaattctcctgcctctcagcctcccaagtagctgggattacaggcgtccaccaccacgcccagctaattttgtgtatttttagt

SEQ ID NO: 21008 - DNA, 471 bp, Homo sapiens
aatgatactgtgataaaaggcatccaccagcatgaacttcatatgtgactttgctgttagatctcaggaagatgtaaaaaggcagtttaagatcttttatcccaacttcctggataataaaaagatagtaagtttaggactttataaaagaaataaaatcaagaaagaaatggggcatgaaaaagaataaggttagacccttagtttataccatatataaatattaactcaaaatgggtcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccg

SEQ ID NO: 21009 - DNA, 563 bp, Homo sapiens
gtcagctatctagaacattcctatgacgttgtttctaagcaattagaagcctggaatattttgagtggtctgaaacactttcctccacaaaacagatgcctgttttaccagtttttcaaccccattgtgatgatatatttctttgttttttaatgaaactgttgtgctccttttcagacagccctggtaattctactgtaatataatctccacgaagataggtaagtggtctattttgtttacagctgcatcctcagggcttagaacagtgcttgatatacaataggatttgaatacatgcatgtggaagaaatgacttccgtcaggactaaggtacttacacaaaagtatttacggcctgcccggtggctcacgcctgtaatcccagcactttgggaggccgaggtgggcagataatctgaggtcgggagtttgagccccacctgaccaacatgaagaaaccctgtatctaccaaaaatacaaaattaactgggcgtgatggcgcctgcctgtaatcccagctacttgagaggctgaggcaggagaatcgcttgaaacaagg

SEQ ID NO: 21010 - DNA, 510 bp, Homo sapiens
aagcctccggagattcccttcatgggatatcttcccgcacactcagaaccctttcccaaccacatgggacacacctgccactggacctcgaggccgaggcctccttccaaaccccagccccaggcaaagctttctgcctcccttgcaggtccctctcaggggatttcaatactcgtggaacctgccttccttcaggagttcttacacccgcgcctgggcttgtttattccctcaacaaacgcctgctaggcgcggaccctgtgctggtgggcaggtgatggtgagcgagacccactccaggctccgggacctcatggagtggaggagctgggtaaacaggtgggtggcaattcagtgcaatgaacactactcgggagtgtagagagccaggtgggggaattgccaggggatggtgcaggcagaaaaggcttataagggggtcattcacatggggtcctgaagggtgggtaggagcccaccaggccaagggtagagtgcagcccatgcacg

SEQ ID NO: 21011 - DNA, 591 bp, Homo sapiens
ggaaccccaaacaaggcatgcctcaggttgggtcacacaacgtagcaatgtcctcctggaggaaacgcctatttctgcctgttgttaagtgtactctatgaagaacccacatggagtggtctcatccacctcagatccaggtagagaaaagtgggacctgggggatgggagctcaccaggcgtctgcagtgttcccgtgctaaaccctctcacatcacggatacccagcatggggccagagactcccagacagaagcagaaagaggagggcatctctacatgaagaattacaaccagcaatcaaccactactgacaactgtttaaacacctcatgattctgaattaaagacaccaagcttctcaaatacaagaatgctaaaagaggccgggtgcatgggctcacacctgtaatcccagcactttgggaggctgaggcgggcggatcatgaggtcaggggatcgagaccatcctggctaacatggtgaaaccccatctctactaaaaatacaaaaaattagccaggcgtggtggcgggcgcctgtattcccagctactcaggaggctgaggcaggagactggcgtgaacccg

SEQ ID NO: 21012 - DNA, 501 bp, Homo sapiens
cacagagaaagacagagacagagagaaagacagagatggagagatagaaacagagagacaaatgggaaagaacaaagtataccccaaagtacagtctgctagcagtagcctgaagtctttctgaccacttggcagcagcttggaaaatgttcctcactaccttcatggaacctatcatagcataagaaccagcccaaagtaaatggatgggactttgaatttttgtttaaaaatgatggcttgtgcctggtcaaaatggtgtgtgaatggcttatgcattgatatatatcgattggcataagtcagagcgcttcagacctggtctcggtctaagagatcctcagtggagacgtggcgtctttggtcatctaaggtccctgcagcatcacaaagggaaagggcggcatcttctagtgtttacacagcccaacagaaatcctgtgttcttgtaaggaggtgaccaaggtggacctgaacctggattttgtctggttttatctg

SEQ ID NO: 21013 - DNA, 481 bp, Homo sapiens
gtgggggaacctcctacagaattattgagcagtgaattggggcatttcttacagaattattgaacaatgtacttttatcacaaaaaagaaatttggagagaatctagttcgttctgttaaccccccaaaatactgaagcttttgggaattatcatgcttgaggttgcttactgaatgctggtcttctgccgctagcagcaatgcttgtttcatggtctacaatgtgcagcatcactatattctttcatttcccataaacagttgtgaatggaattccaagtgcggaaaatgggatcaaaatttgatgcaaactagtgaagatgtttgacctttccatctggctcagagcggagcagttgttcaggtttagtagcctcaagcaattacctgagatcttaagattagcatgttatgataagaagatgtaatatttcatgttaacaactgagtggggaaagggaagcatacataccgcattagt

SEQ ID NO: 21014 - DNA, 508 bp, Homo sapiens
tatataaagctgagcgtgagttaggattctggagaccatggttgcttatctcaacacagaaattgtttggagaaaaattgtctggcaaccgatattagtgtaacgtttctaagggattaaactggttactaatgtacaaaaaaaatcaaaatattttgtaatttcgtgaattggatctaaataaaacctgtaataatgactatgaaatcaaatttctaaatagggggaataatcttctgccgtcattaaaatgatgtgccatttagaatatttttttctaatttcttgtctctctttaaagctcttccataaatcatagaaatgaatacttatgattttggggatttttttttaccctgataaacataaacttaaaatttagggagctttttaacatttatgtttatttttataattaatacaaaattacagaagaaatgaataataatatttccagttaaacctagctttagtaaagagatgtatattattaatttatcctctcaag

SEQ ID NO: 21015 - DNA, 582 bp, Homo sapiens
tgggagacactggccctttttcttcctcttcctcatcatcactttcattttctgtaaataaattcagagaagcaggtcacattaagcaattcatacttcacatatgaacaaatcactgtccagtcatagcacaaggacataactattctcagtgcaagaataaggattctgacaggaatattctagggtgtcctagattaactttggtgagaattagatgaccctgctttccagacccacaggccaaaatctccctctacgtgtagaccataatgccatattccctgcctgagtcaaagttaaacaaaattttttccccaaaaaaatctccaaaaattggtcaaacaattttctaagagtgttgctgcgatacggacttatatcaccaggtaacatggacattaaatgtttagaggcatctatacatgaaacacgactgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattag

SEQ ID NO: 21016 - DNA, 434 bp, Homo sapiens
agtcaccctgagagtgaaacagatacaaagagagaatgaccctcacagctacagaaagaaatgaaatggggcaggagaagagggggaagaaagctaaataactgatttttttaagaatgccagattaaggccgggcgtggtggctcacgcctgtaatcccagcactttgggaggccgaggtgagtggatcacctgaggtcaggagtttgagaccagcctggccaacatggtgaaaccccgtctctactaaaaatacaaacattagcaagatgtggtgtcacgtgcctgtaatcccagctagtagggaggctgaggcaagagaatcggttgatgctaggaggcggaggttgcagtgagctgagagggcgccactgcactccagcctgggcgacacagggagactccatctcaaaaaaaaaaaaaaaaaaaaaaaa

SEQ ID NO: 21017 - DNA, 506 bp, Homo sapiens
aatatagtatacaatatctgtcacttctctatccatttggcaaagacttcatagagacaaatgttacagaggctcaaaaatggagactactagaaaaatgaccaaagccagaaataaagtatgtgctaattagaaaacaaataattaaatggcccaacccgaatgttgtgtgatgctgaaaagagataaatttctaaggcacaccatctgttttacagtttattttgctgtactacaaacctactcaatatagttctgcagtgatctagctgctaactcatttgcacaattactttaggccagaaataactgttgcacagaatcctttgagagagcaacacattcatggaagagggcaaacataattcattcttgggtgaagactatttttagcccttaaagaaaaaaaagttattcaaagaaatgattagaaattgccaaaggaaaattagataatttaaaaggagagtgatatcactatatatttatgtatctaaatttatctg

SEQ ID NO: 21018 - DNA, 463 bp, Homo sapiens
tgggattacaggcgtgagctaccacacccagcccatgccatgcctttttgccattatagtcgaggcacttggctttgcatgtttatcttttatgttagcgatcccaatgacttcatgaagtgacttcatgagggtatccacacctgggttccaggtctcccccgcgtggaactacagagtgagtatggcatgtgctggagaaaacaaaatatgtgctggccgtgtccttggggaagatatttgatccctaaagatgtgattgcctcatgtggctctacaaaagagttgtttagagtttagcatgagcaattgcacagcacaaactctctgttgtttgcgtgcattggggcagggcgtccagagccgggggcacttcagaggatgtactggtgattttaatataaaaacatccaaaacaattagatgtaaatatgaggaatgggtcatattacctatttaatgc

SEQ ID NO: 21019 - DNA, 512 bp, Homo sapiens
tgtttagtaaaccaggtttagatttcactcttgtacatttcacccattatctaggaccaattaaacatttggcactgaggaataattcagagcaacaactcctaggggagaactagattgtctggttggtgatcaaaaagaattaaagcatctctgaaggcaattagtccccaacactgtgaccaaggccctggaggtggggcatgttctttctgccttccacacaccgcttcaggctgaacaaggtgttattttttaaccctttgtgaattacacttctttaaattcctgtgataattattccctatttcacaagggtgcctttctgtaacatcttgaatatgttacacaaatagtctttcttgaggcaccctctggtgataatactaaagatcacaatcaaaaacaattgtgcccagagtagaagtaccactttgcatttaggttgtgatccactgaaaagtaaattaaacacattaatatttctatttagggaaattctgacaagtaat

SEQ ID NO: 21020 - DNA, 285 bp, Homo sapiens
ggagctcaggagcattcaggatttccatgccccttctctctgcatcctcctgcctctaatctagctatagcaaggacactacagcagttcactctttaagagtatttctggttacccagtgaagggtgggatcaactctcccacccaaaactgggttgggtgtcaagactgattcaccacatctcaggagggtgtggaaagatgtattgctcacatgaggctttctggggagagcagggcagccatccaaacgggtctagtttttattttggttggagagtggct

SEQ ID NO: 21021 - DNA, 468 bp, Homo sapiens
gaaaaccaggaaaatatactcaggagtcaagagcagacaatgtttcaagaagtcctaacagcattaggcatacacacacacacacaaaatcaaagctacaatactacggtattcaatagaaccatatgcctcagatataactcaatccctttatcccaaaatctaattccacttcttacagtcccaacctgatgaatggcatcacccagtcacctaatccttctccttcacccgtatcaatacaccattaaatccaaaagattcaactcattttatatcttttatttcttatctgttctttcctccatatggcttccaactaaattcaggtcttcatctctcagcaggatattgaaataatcccttatttgtacccctgccccttggcttagtctggtacaacccatcttctaccttggtgccagataaaaatgtccaaagtatgtatttgattatattactttctct

SEQ ID NO: 21022 - DNA, 587 bp, Homo sapiens
acagaagggccagcccccaaatttgtgtgtgtgtgtgtgtgtggagacagggtcttgctatgttgcgcaagctggtctcaaactcctggcctcaagcagtcctcctgcctcggcctcccaaaatgctgagattgcaggcataagcctcctttataccctcaaaactttccttttctctaatagctggaaaaagtaggggtcagaagtgttataatgattttacaaaactatcataattaaaatgggtatccagagacttatcactcttcttttttagattcctgtcttttcagtttaataaaattcaagtaaccaggctttgatatttttgtattagtatacttcacagagatgtctcacagatttttaaaatctgagctttgtttttgttttgttttgttttgtttttggccaaagaagggctctggccagtagctgaggaagcaacaaaagaaggtgacagagacctactatgtacccacgataattaaaaatttaaaaaagagggctgggcgcggtggctcatgcctgtaatcccaggactttgggaggctgaggtgggtggatcacctgaggtcaggagttta

SEQ ID NO: 21023 - DNA, 574 bp, Homo sapiens
gtatttattaagtatttaccctgaaataagtactgcacgaagcatattcattcagtattgtccagttgctcttagcatgaagtcactggtgtcaccttgatggcagtgatgagacaaattacttgtttcacctctttaaacatcagatagattgctggggacaaagagacagcatggcttccaaccattacacaagtcccccttctgcagccaggatcatgtctaggatgatgcagttatggaagacagcatgctgagtttctattaatttgatgaatcaccaaattgagaccagtggtggtggtgtccagggacaaagtgaattgcttcagcagtgggtagataacccactgtttttcagttaactttttcagcaaggtaataatttccttgggatggtatccaaagggtggcaaacctctccctaaaagtagtgtagatgaaatctaggctcagttctgtagctattttctttaactagcactctaggaaccactctaggaaccagtattacacttacatgaggacttgtgatgacctggacacctcttttgttttctacgatgagagtgag

SEQ ID NO: 21024 - DNA, 555 bp, Homo sapiens
tactccattgttattcttaggatagtgagtgagttttcatgaaatctggtggttttataaggggcttttccccctttgctcagcacttcaccttcctgccaccttatgaagaagaatgtacttgattccccttttgccatgattctaagtttcctgaggcctccccaaccctgtggaactgtgagtcaattagacttctttcctttataaattacccagtctcaggtagttctttatagcagcacaagaatggattaatacaccaaccaatagggagcttgagaaacttagctttccccattccaactcccacacataaactaccctccgtgcagctactgcttgctgtcaccctgtcctggatgcaacttcctgtttgttcttgcctgtcaaccttctcccatttggatcataaataacaaagagttctgcctatcctctctgtcattgagttgtatcttctcaaaagaacctttaaatattagaaaacaacttgcaagatttcaagccaactccaagttatgtcacattacacctgcacacccatacccaaca

SEQ ID NO: 21025 - DNA, 569 bp, Homo sapiens
acgtcaaaaatatgtgtgctaaagaaacacagaactaaggaagtctatttacctgatagaccgcctcacccacggggctattttcactgctgtaaaagcgaaaacaaatagaggacaagtcacagtgccaagaatacaggacttcctcttgcagatcctcttttttccaccctcactgtagctctggggaaattcctattcagtgggagaagtttaagtcacaaaacggcaccagcccattctcaaagtgctattatacacctctgagcagtgaggatgggtaatgtcagcaaaatatgcactgtttattttcttgaaaattaacttgggctggaaacgccttccagctccttcctctcagtggattttccatttactgtcttcaaccacctgggcttgtctgtacctcctccacagctctactgagaccctcctgtttgtctgaactatgtcctcatgttccttctgccacatgtgctcaggcctcagtttttccatgaaactttctctaacttagctgcctcctttccactgttctcaagccctttctggagttacaagggcattag

SEQ ID NO: 21026 - DNA, 526 bp, Homo sapiens
tgtataggagtatacctataggtactcctatacatttctacacagtggagaagccaactctgggtgaggtgaactactgcatgcccatgtatccggctagagaaccaacttggaaattatatcctcagtgtatccaccctccaaccaccatatacatatacaattagctgaggaaacagcttggtggaccagttcccagaaatgtcacaccaccattgccaaaaactcccacagcttaggccaccaaggcactcatacctatctctaatttggagtatgtctgatgaatcagcacaaaaattaaattactgggtccacccagaaccaaagcaaatgcactccactcaaccaacaccatgggacccatttatggtaataagcctctctttttaggaaagctgctcttgtgtttctacatttgccccctgcacatgtggtagaaaaattgcttcttccagttttaacacatgtgcaggggtaaatgtagcaacagaaaaaaacgtggcaaaggaagaaaacatgacac

SEQ ID NO: 21027 - DNA, 486 bp, Homo sapiens
caatttgttctatccaggaaatagcaatattcttttttccctgagagcaaaaggccattctgaggattctgaggaaaagcccaggtctatggtcaacaattttctatctaggagcaataggcttgcctgcttgggccttacacaaaaatgctgcatctatgttttcattgtcaaggcaggaggtgataccagcagttctcagaatctgaaagaaaggggctggggacagtggctcatgcttgtaatcccagcactttgggaggccgaggtgggtggatcacttgagcccaggagtttgaggttatagtgagctatgatagtaccactgcactccaagaaagaaaaaaaaaagcctgggggtggtggctcatacctgtaatctcagcactttgggaggcggaggtgaatggatcacacggtcaggagtttgagactagtctggccaacgtcgtgagaaaccccgtgtctacccaaaatacaaaaatt

SEQ ID NO: 21028 - DNA, 529 bp, Homo sapiens
ctccagggcagggctgggaagaggacttactgaaaacaatgtggatgtttcatttagacatttgttcgttcgttgtactgtggtattgggtagcactgagcacctcacccccacaagccaggtccagcactaggccctgggctgccaaccaccgcaaggcaggcacctcactttaatggaatcaactaccacatttacaaatgatgtacttcaaggccgaggcaggaggatcacttgagaccaggagtttgagaccagcctgggtgacatagtgagaccctgtctctatttaaaatgaaaatagaaaataaaaatataaaaaacagacaaacaaatgatgtacttcagtggcagaggcaaggcattaggagagtctggaaaagggagtgcagaggaggtaacatttgtactggatctgaaaaaaataaatcagaggaccagccgcggtggctcacacctgtaatctcagcactttggaaggctgggggtgagggcagatctcctgaggccaggagtttgggaccagctc

SEQ ID NO: 21029 - DNA, 554 bp, Homo sapiens
caagaaaaggtgatcatcacaaacctgaagctcaggcttaagacccctgagagtcggggagatgtttcaagggattctggagaacatatctatttttatcatcatactgagatgtcactggccttttttaccttgctaacaattgcactgatggtgcacaagcgacaggcaagactgctggcatgttagacttgatcaaggcagtgacctcacactgtacaactacttattcatcttttaccatgacatggtgagcaaacaaagtgagggtaaaagctggtttgttagtggtaaatgaaatgccttggagaatgtgttttgtaggaggtaaattatgaggataattgcattatgtttaaatagttttctcagacatcagtgaaatgggaaaatggctatgtgataacacagaatagcccttatgaaaacaacagttggccgggcatggtggcttctgcctgtaatcccagcactttgggaggccaaggcagagggatcgcttgagctcaggagtttgagaccagcctgggcaacacagtaggaccccatctcta

SEQ ID NO: 21030 - DNA, 562 bp, Homo sapiens
ataacaatagtcctatcaagtggtagaaacttaagtccccatgtttcacagatgatagtaaggtgcccgacaaggaaaagagctaaggagtttgagtttctttcccttcagccccctgctgctttcatgacaccatgacatttccctggagagagaaccccctagaaaggtatcaggtgatagcatttaggaaccttctgctgatttgtgataagcttattccagtgacttagccttaatactaagcttatcctagtattaatgattaaaaggttggatgaagccaggcatgctggctcacgcctataatcccagcactttgggaggccgagacgggtggataacctgaggtcaggagttcgagaccagcctgaccaacatggagaaaccccgtctctactaaaaatacaaaattagctgggcatggtggcacatgcttgtaatcccagatactcggcgggctgaggcaggagaatcgcttgaacttgggacacgcatgttgcagtgagccgagatcgcgccattgcactccagcctgggcaacaagagtgaaactctgtct

SEQ ID NO: 21031 - DNA, 523 bp, Homo sapiens
ggagagctcattccaggcagtgagaactccaagtacgaaggctctgacgcatggcatgtttaaaggccccttcaaacaattttatggcaggaatagaaaggggaagaagagtgtttcaaggtgaggatggaatgtagactggaccctgtcagcccggttattcaggttttagcttttaaaagagaagttataaaatagttttattttatagaaaatgaaagtcagaaattaggacatgataagtactgcatagctaaaacataatgttcactgcaggttagggactgaaatcatgagaggcaactatgggaccgggcatggtgactcacgcctgtaatcccagcactgtgggaagctgaggtgggcagatcacttgaggtcaggagtttgagaccaacctggccaacatggtgaaattaagtctctactaaaaatacaaaaattaccttgggtgtggtggcacacacctgtaatcccagctactcaggaggctgaggaggcaggagaatcacttgaacatggg

SEQ ID NO: 21032 - DNA, 570 bp, Homo sapiens
tcagtgaaactctaagaatagagaagatgtaaaagttacatttttgatttgtgtgagtccgaggtaagacagtgtttgacagccgagagagtgctgggcctgctttgtagtgttagctctgctccttgcttgtgagacaacttaggatgttccaaccgctctgggcctcaattcactctttgtaagttggaaatcagttatatctcatgtaccaggctaactataaagactatatgacattttatctgattctatgtgcatttgtgagaatggtagaagttgaaaagggtcatctccaaaggaggggggagagtcagagtctggccacttacgcagctaattcacaaagcagagggtatttaaaaagtaagaggccaggcatggtggctcagcactttgggaggctgagggggtggatcacgtgaggtcaggagttcaagaccagcctggccaatatagcgaaactccatctctactcaaaaaatacaaaaattagccggccacagtggcgtgcacctgtaattctagctactcgggaggctgaggcaggagaatcacttgaacatggga

SEQ ID NO: 21033 - DNA, 499 bp, Homo sapiens
aatatcatcataaaaaagatttccaaaatagcacatctatgttctttactgacacatatattccaaaactttgttaatatagggataagaatcacccaatcaacaaaagctgttaatacgcatacatgtaaaatataaaaacattcaaatgctaattccaactccaaataggaggctaaggttaatttccctttaactttacaagttaaattccataataaaagttttataaaacaaattctaaacctcattcaacaatatttactataaccaaaatgtcaaatcaagagtttgcatttgctcttggaattcaccaaagaacaggatcattcttgaaaagcagactaaggcatggctactttaaaaggaaaatgatccacagccaggcatggtggctcacatctgtaatcccagcaattctggaggccaaggcaggcagatgacctgaggtcaggagtttgaaaccagcctggccaacatggcaaaatcccatctctgc

SEQ ID NO: 21034 - DNA, 504 bp, Homo sapiens
agattgacaagcattaaaagtctgataatgtcaagtattggtgagaatgtagagaaattacattctcacttttgtcagcagtgtaaattgatacaatcattttctgaaagatgttagtaagatagtaaattcaagcttcatgtattttaaccccagcagttgtactcctgtctttatattcctgatgaatgaaatccttgtatttttattttggagacggagtttcgcccttgttgcccaggctggagtgcaatggtgcaatctcggcttaccgcatcctctgcttccccagttcaagcaattctccggcctcagccacccgagtagctggaattacagggatgcaccaccatgtctctactaaaaatacaaaaattagctgggtgtggtggcatgtgcctgtagtcccagctgctcgggaggctgaggcacgagaattgcttgaactctggaggcggaggttgcagtgagctgagatggcaccactgcattccagcgtaggtg

SEQ ID NO: 21035 - DNA, 573 bp, Homo sapiens
tggggttacaggtgtaagccaccgtgtccagcttagctattacctttgtattctaccagtatgaactcaagaaactcatttgattcttctatctgtaggtcagattcactgtgtgaaacactgacaatatatggtctataaattattaatgatttcaaatgattcacacacatattcatacagttttcaagttactaaaagctgaaaagaagattttgtggaattttcacttttttcccatctcctggaaacggaagtgagcaaggcagaaaacagagggtaaaaagaattcctaagaatatactgggctgggcgtggtggctcatgcccataatcccagcactctgggaggccgaggtggggagatcgtttgagaccaggagtttgagactagcctggccaacatggtgaaactctgtctctactaaaaatataaaaaattaggctgggtgccgtggctcacacctgtaatcccagcactttgggaggccaaaatgggcagatcacaaggtcagaagatggagaccatcttggccaacatggtgaaaccctgtctctactaaaatacaaaaa

SEQ ID NO: 21036 - DNA, 521 bp, Homo sapiens
ctgcctcttctaccacctaagtcctgcccacccctgcttcaggttgccccataatgcctcactgtcagtcaggcctttcacagcctcctccacctgcaggcaccactgcttcctccacacccctcagccatcaccacctctcatctatacatgaaacggaatatccccttccattggtggatgctgggtttgagtttccctttctacctcttctactagagttaagctcaccaaagcaagaactcttttatatctcttgacagcctcaaaacttagcctagtgctttgggcagagttaagtttaaaatatattctcatgtgtggttaaggatagctgcaataccagcaattgttgactgtttactacatatcaagattgtctcatgggttaggcatggtggctcatgcctgtaatcccaacactttgggaggccaaggcaggtagattgctagagcacaggagttcgagaccagccagagcaacatggcaaaatcctgtctctacaaaaaaatacaaaaat

SEQ ID NO: 21037 - DNA, 628 bp, Homo sapiens
tacctcattcttttttaaaaagtaagtcatcttctaaggctcctccacttccaaattccaaggacccaatccagaaagtgaggtctagattaaccccagacatgtgttggtggacctccatgctaaatctctacaagaatcaatgtggcgttgggatctaagccactccagacttgacagtggataagtctaaactcctggataagtctctccaagctgctatgtctctgagtgtagtttggtgcttgaggaggggccaacatttgttacacttattatatcagtcatctcatttaatccccattacaaccctccaaggtgtgtctgcactggataggtaagaaaaccaaggctcatggcccagcatggtggcttacggctgtaatcctatcactttgggaggccaaggcaggtggatcacatgagctcaggagttcaagaccagctggacaacatggcaaaacccaatctctataaaaaaatacaaaaattagctgggcatggtggcacatgactatagtcccagctacttgtgggggctgaggtaaaaggatcacttaagcctgggaggtcaaggctgcagtgagctgagattacgccactgcaccacggcactccagcctgggtg

SEQ ID NO: 21038 - DNA, 484 bp, Homo sapiens
tagttctgaccattttaaagagtaaggctttttatttatttatttgctttctgaagtcttaaaagaagttatagatctagttcctataacttgaatgtgagtccagggactttatttttttatatcctataattccttgtatatagatagcactttacagttagtaaggactcagtaaatgttttgtgacatggcattttaagctgttctgatgatgttatccaataaaaatcacaccatctcatatataaacacaattatggatgtatattgaagatcacctgaggtcaggagttcaagaccagcctgagcaacatggagaaaccctgtctctactaagaacacaaaaattagccgggtgtggtggcgcacgcctgcaatccccgctactcgggaggctgaggcgggagaatcgcttgaacctgggaggcagaggttgcagtgagccgagattgcgccattgcactttagcctgggcaacaag

SEQ ID NO: 21039 - DNA, 546 bp, Homo sapiens
tctgatccctttctctctcagagttccataaattcggatgtcttagtcaagtaagttagactacagaaagcatatgttaatctactaggttgttgtatgaaaatcatttaacaaacagtacttttctttgttctcatcttttagtataggaactacttacataatttgtgcaactatggggatattcatacggtttttcttttttggtgagttacattaattgattcttgaatgctaaaccaatctacaattcctgggattcactttacttggtcaaaatgtataaaactttttctgtattgttggacttgattcactgaaattctgttaaggatttttgcatttatgttcattagagatattagttggtgggttttggctaatggttctgatatcaagacaatgctggtctcatgaaatgagctggaaattgtttccttctcttctgttttctagaataatttttataagtttggttttatgtcttccttagatgtttactagcattcatcagtgaatccatctagacctggaatttcctttact

SEQ ID NO: 21040 - DNA, 624 bp, Homo sapiens
gttgttaaaccattagctataatgtgggatacagcaagagatcattgggccaaaaatgtccactctgagccctgagtgatctggattcctaattcaccctcagagggtaattttacggggggtgttgttccatagcactttgacaatgggtctcatttttctgtttctctactctgcaaagagactacatggaagactcttagcatagtaatttaaaacccctctttgagtgccaaataagttatggagtccatgtacagagaaaaagaacacatacacaaacatttgcaaacaatttcaagatgttcacactgtccaaagcacccgtgtacctggtcccaggttaagaaactattttgcaatgtcaaatatgctgtgaacttgctgtgagcacagctttttccctgtcactgaagtctatataacttccataatatgatattctcactaccagtaggtataatgcctgctggaggatagaacaggagagaagagcttcgtcagtctgtagtcaaccccagaagggtacatactagcacacaaaagcgatgagcaagccctgtgtattaaacattctgtcatcactgacagccccctaaaagtcaaacctacaatttatctaat

SEQ ID NO: 21041 - DNA, 544 bp, Homo sapiens
gaagaagatgggagaacttccttcctgctggtcacttaggagccagaatgacctttgttacctggacttttccttttctcctcctcatcattgttccatccccactaagaccttcattattttggaaatattaagttagaaatctagtcatggccagcatgagagagggacagggatgcatacaggaatcaaactgaatacattttgtgttttcattccccgtaggtacttctgctggtgtcaatcattgggactggattatgtctaagcatcttcaacctcacaggggtaatttgaaaagttgaggaggggtttgcttttgaagagataagctcatataatgcagaatccagcctttatggggatcagggggtcactccaaccatggccttcacaaatggccttcaactgtaccccttgggttcatatccaagtgaaattattagtctaaatgattgaaagataataatatctattatacaattaaaaacctgtatcccctcccagatcatacacctacaaattcatgttttaaactaatctt

SEQ ID NO: 21042 - DNA, 562 bp, Homo sapiens
agggaaggttggaaaacctgaggccagggctctaggcaacaggaagggatgaatgatggtcttgcaagccactatcactgggataaatcgatttaaccttctatccatctttgtgtcaaagagccttagcttgggtcacatgactaaccttggttgggcaggacagggcaaggtgacttgattcaaccaagacagcacttagtggaggagaagtaaataaattgctattagcaaaagaaaggagtactggatcctagaaagctaaagaacaataaatgtctactacaaggtttaattttgatggctcccaaacccatgttcctttcattaagttaaaagttctctattcctgttagttggtcaagtaaaagacgtttactttgggctgggtgcagtagctcacactggtaattccagcactttgggaggccaaggcaggcggatcaccggaggaaaggagttcgagaccagcctggccaacatggtgaaacccctgtctctactgaaaatacaaaaattagttggacgtggtggcacacatctgtagtcccagctacttgag

SEQ ID NO: 21043 - DNA, 373 bp, Homo sapiens
tgccaaaatttaacttggatgggaatgttaatgtcctacacacgatattatttatggaagtaataatgtcaaactataattttttgatgtcattgttatatttaatcagcatgggaggacatgacttgttgatgaggttttccctggggaaagaaaaaaaatacttccagcataaatatactgaaatgatgcttaattttggaagtgaggtgagaaatggggaagccagacttagattagatggagaaaaaccttttctcttagaaatggaaagatagttgaattcctagactatggctattttcaaaagtcattaaccacccacaacatgggaaaaactcatctaaaacaattcctgatgttctttgccctt

SEQ ID NO: 21044 - DNA, 503 bp, Homo sapiens
agtaaccctaatggccaaaataaagtacatttggatatgcatatgcccaaagctatccatgacaaacataaaatttagtggaagctttttctgctgaaatttatgaaaaattcataatgcatgccatgaaagactctctttttaaataaagttacttctcatattataaaactgatgaaactattcaatttttatccaaaagttttgtgtagcttcctgggagttttccatactaatgtctcattatactacagaatttccatgggacagactggcttcactatatgcagcatactgaaaataagagctgtactccagaataatccactatagactaataatccattaattttattacatcactgttacacctgtatagcattagcttatattgtctcttgaattaataaattattctggaaaagtaattaaccatctcatgtttattattttgacaagttaactccattgcctaaacttctatacttaaatattaaatagta

SEQ ID NO: 21045 - DNA, 448 bp, Homo sapiens
aatatcatcataaaaaagatttccaaaatagcacatctatgttctttactgacacatatattccaaaactttgttaatatagggataagaatcacccaatcaacaaaagctgttaatacgcatacatgtaaaatataaaaacattcaaatgctaattccaactccaaataggaggctaaggttaatttccctttaactttacaagttaaattccataataaaagttttataaaacaaattctaaacctcattcaacaatatttactataaccaaaatgtcaaatcaagagtttgcatttgctcttggaattcaccaaagaacaggatcattcttgaaaagcagactaaggcatggctactttaaaaggaaaatgatccacagccagggcatggtggctcacatctgtaatcccagcaattctggaggccaaggcaggcagatgacctg

SEQ ID NO: 21046 - DNA, 532 bp, Homo sapiens
ctttgcaattgctctgcctccttttaaaacaaaacttttgcccttgctcatttctacttggagctgtcatttcttcctcttagcatcaataactccattttgctgtttagatcgtatcttcctcagaaaagatgttccagacttcactaagtcaaattcctttgcatagctcttggcacagttgtggtgttacttttgtgtgcatgttagttttattccttcctttatcccactgatctgagtttacagatcagtgggatgtgactggtctgtttttattcattcttgttccctaggtgactaatagcatagccattgagacatagtaggtgctcagtaaatatttgttggatgagtgtttaggtttaagaaagtatctttgcaaacatttgcagcattatcttttaatatttatagctagtcagtcatatatgccaatttctgcatctacctatttgtcctctttaactgtatatgccattagcagcaaagcagtaatatggatattactggcaggtttaagtcattgaca

SEQ ID NO: 21047 - DNA, 510 bp, Homo sapiens
gtttcccctggggatatgggttaacagttctgagacactgtacacgtatactggaattgaacaatagatggtggatggtgaggacagatttcttgctgttgaaatgggtggttagaaacaaacagtggagaaagctagaatatgtgggaatggactagagtttgagacatcagtatcaactcatgtttagcctactgtaggtacttttatttaatatcaatgaatatatacatagaaatatttttgatacatgtatttatatgaattaatatgcaaaaaatatttccttgccctggctgggtgtggtggctcacacctgttatcccagcacttttggagcccaaggtgggtggatcatgagatcaggagattgagaccatcctggctaacatggcgaaaacccgtctctactaaaaatacaacaaattatccaggcatggtggcattgtgcctatagtcccagctactcaggatgctgagacaggagaatcacttgaacccaggtggcag

SEQ ID NO: 21048 - DNA, 526 bp, Homo sapiens
cccaaagtgctgggattacaggtgtgagccactgctcctggccctaatttttatttttttagtagagatggggtctcgctacgttgcccaggttggtcttgaattcctgggcttaagggattctcctgccttggcctcccaaagtgctgggattatggccatgatccactgagcctggcctgtaaaagacacttctactgagcctggcctgtaaaagacagaagacggtgtggaaggagaggattgcagttggtcacagacttgttggccacaggaccctttatgtagggagcagctcaaaaggcaccagggcatctggccaggcgcagcggctcgcacttgtaattccagcactttgggaggctgaggcaggcggattacctgaggtcaggagtttgagaccagcctggccaacatggtgaaaccctgtctctactaaaaatacaaaaaaattagctgggcatggtggcgcacgcctgtagtcccagctacttgggaggctgaggcaggagaatctcttgaacct

SEQ ID NO: 21049 - DNA, 426 bp, Homo sapiens
cattctatacattaatatcttgtcagtttgattcctgtaattcagaaacaggagttctgtgatggaggctaaaacaaggctgagatggcacatttttactttcttggagggccttcattgaatagtcagccagcctccaactacagcatctctaccattttgctaacttcaaacgttccttgacagcaagcagagctctgaagcctgtcagctatcacgaggtcaggagatccagaccatccaggctaacatggtgaaaccccgtctctactaaaaatacaaaaaaattagccgggcgtggtggcgggtgcctgtagtcccagctactcaggaggctgaggcaggagaatggcgcgaacccgggaggcggagcttgcagtgagtcgagatcgcgctactgccctccagcctgggcgacagcgagac

SEQ ID NO: 21050 - DNA, 490 bp, Homo sapiens
ggatggtctcgatctcctgaccttgtgatctgcccacctcagcctcccaaactgctgggattacaggcgtgagccactgtgcctggccaacttccctgtttttagttgccttttcaaggatatattcttagaggcctgaaatagtatttctcatttcagtgaagtttttagattcctcaaattgcctcaacagcacatgagagagatgcatttctcagtggtgggaagcttgtgtccaccctgacaaccacatacagctcaaaaatgagaaatgtagcctaggttaaaggcagtcgggtggtgaggaaatactgtaagctgaagagctcaggcctacctaaaaggaatatctattttgtgaacacatggagttggggttcggtgttactagatcttctaacttaataagcaaaactagaaatctggactttcaagtaaaatcttctggctttgaagctgattttaaaagtattttggggctgggcatggt

SEQ ID NO: 21051 - DNA, 457 bp, Homo sapiens
acctaattctaacttaatggatgtgaacaatttttctccacaaatacagaaattcaaaattctaaggaggaagaatagaataagttctttggcaccacttaagaagcttgaaaggcagcagttaactgacatgtgattcccattcatctacatccttgcactaggctgggcgcggtggctcactcctgtaatcccagcactttgggaggccgaggtgggcagatcacgaggtcaggagatcgagaccatcctggctaacatggtgaaaccccgtctctactaaaaatacaaaaatattagctgggcgtggtggcggggtcctgtagtcccagctacttgggaggctgaggcaggagaatggcatgaaaccgggaggcaaagcttgcagtgagccgagatcacgccactgcactccagcctgggcgacagagcaagactccgtctcaaaaaaaaaaaa

SEQ ID NO: 21052 - DNA, 556 bp, Homo sapiens
caagtgaagcatatggccccatcaatgtgagttactttctttaactgttattaataataagtaaatgatatatatcttcagttccatgagaaataactcaatgaagtcatgcaggcagtaaggcagccattgtactaacccttcaagaatttaggacaataatatgagtagaggacacacataaaccaacaaaattcagctttgcttctgttttgtaaatgaagttcaaaaatacaattttgaaatttaggagagatagtaactatgttaaaatatgtggacatttgaccacatcacctagtgccctattttctaagcttccagcattgaaccgaaagtgctaaagtgaatcagatgaaataccttgatgtcagtcaaagggaatagcctgattgctcagccatcctttacaatctcccattgaaccaaggagaggtgaaacgatgtatatagcaaagtcatgaagattgatggcgcccgctgcttccaaatgtaccctatctgcatgcaaaccacttgacacatgaactgatagaaaacaaagagtgtttgccca

SEQ ID NO: 21053 - DNA, 562 bp, Homo sapiens
taattaattggctttacattagccgtctgtaaatacagtgtttcccagaggggagaggagaggaaggacaccaactttatttttaaatgaacatttatttttgtgctaatgagggtgttcaggggtacaaatgacaagacccaactcaaagggtacattaattgcctcacatagtaatgcagagagaggacagatttgagagatgcttgacttctttgctcaattattttatagaatgcagggtttttgcattttcccactttgtttcagtgctttccatggttaatgttggtttccttctcaggtcaaaataagagatcgcatctagaaatgataatcctcctccagttgaggcagattttcttagaagcttcctagtataccaaccttcatatcacactgaccagctatcattagaaagaaataagcaatttccaagattgacttagacccgtcatctgaggtgggatgatggttgagaagtcaacattaatattcagcataacctacctttaaattttgtattatattagtactatatgatgaatgtttaatctttggg

SEQ ID NO: 21054 - DNA, 188 bp, Homo sapiens
catcttgttataaattactctgttaggtcaagtcctggacattttcattcttagtacataaatataaaggacaaaactgttagcatgcaattgtcctttcctttttccgggattcccatgctgtgagtacaatgcaataaaatattaagaaattaacatattaataaactaagccataagaaatgcta

SEQ ID NO: 21055 - DNA, 405 bp, Homo sapiens
  misc_feature 156: n = A,T,C or G
ctgaataatattattacagaactgaaaaaaaaaacccaaaaatactactgtaagtatataagaacataattgaatgtgaaattgttctgttttatgtaaattatgtttaaagctaataaaggggaaatgtagaaaattataaagaatttaagaaangatcacgaggtcaggagatcaagaccatcctggctaacatggtgaaaccccatctctactaaaaaaaatacaaaaacttagctgggcatggtggcaggtgtctgtagtcccagctacttgggaggctgaggcaggagaatggcgtgaacccgggaggtggagattgtagtgagccgagattggccactgcactccagcctgggcgacagagcaagactttgtctcaaaaaaaaaaaaaaaaaaaaaaaa

SEQ ID NO: 21056 - DNA, 453 bp, Homo sapiens
agcctccctctttttactagtggggaacaggaagcttaggagaagtgaccgacccaaggtcagacgtccattgctagtttcatctgcccaccccgaatgggaaggtgggtagatgtacaagtgaaatactgaacaggggttagaaacagccagcattgccgggtgctttggctcatgcctgtaatcccagcactttgtgaggctgaggtgggttgatcacctgaggtcaggagtttgagaccagcctgaccaacacggtgaaaccacgtctctactaaaaatacaaaaattagctgggcgtggtggcgcacgcctgtagtcccagccactcgggaggctgaggcaggagaattgcttgaacccaggagatggagattgcagtgagccgagatcatgccactgcacaacagcctgggcaacagggtgagagtccatctcaaagaaaaaaaaaaa

SEQ ID NO: 21057 - DNA, 522 bp, Homo sapiens
  misc_feature 216, 217: n = A,T,C or G
ctcactcttgtcacccaggctggggtgcaatggcgtgatcttggctcactgcacgctccgcctcccgggttcaatgattcccctgcctcagcctcccgagtagctgggattacaggtgcctgccaccatgcccagctaatttttgtatttttagtagagacaggtttttgccatgttggccaggctggtctcgaactcctgacctcaggtgatctnncccaaactgctgggattacaggcgtgagccaccatgcctggccagcttatcaaaactttaaggagtactgaaaatcatttagaagttagtaagttatagtctttatacaaaaaagagtcaagtgttcatgttgtataactacacttagaagacagctaggattttaaagattttcctttattttgtgtagagaagaaacatcacacaatattctacttgtcatctttcctcaacttaattacatatatgctcacacaggcaaaatatttaagtatatcataccatgaattgttacttgacaaaaa

SEQ ID NO: 21058 - DNA, 568 bp, Homo sapiens
gctgaacttgatttaacatggttttattttgtttttaacaaatagaggccatgatgactgtttaggctgagtaatggaggcctctgctccaagggcaggctgcttttcaaacagttgccatctcagtaatttttatccatttgcatctcacaacatcacaagacaggtttacataaaagtccaggttaccctgcaggctgcgtggtaacctttgattttaggttgatactggagagaaggtccgagaagaagccatccttaacaggaaatacattaaaaaaattctttgaaactggttcctgtgtcattgaaaggcttgggtaagaacacacacatggctgggcatggtggcccatgcctgtaatcccagcactttgggaggccgaggtcagcagatcacctgaggtcaggagttcgagatcagcctgaccaacatggcaaaaccccgtctctactaaaaattcaaaaattagcccacacctggtggtgggcacctataatcccagctactcgggaggctgaggcaggagaatcactggaacctgggaggtggaggctgcagtgagcc

SEQ ID NO: 21059 - DNA, 608 bp, Homo sapiens
  misc_feature 55: n = A,T,C or G
cagagtgaatattttataaaagtataattacacataaaggaaaatataatacatntgagaaagtggttgttttatttagtttgagaattacatgctattaatgtatttgtatcattagaaattttgcagagatccctacagaaaataattataacaatttccttttatttcaacttcgacaatgtggtagcaggtatcctgaaggtgctgcctctgacacctcctggaaattctgtgtgcatgactagaagcattatttgaatgcttggctgagttccggagagggactctgagcagccagagggaagaacaaagtgtcgggagatactgggaggacacaggaatgcaggggacaggaatgcttttccaatttgtgcattggggaattgggggcaatcaccacaggagacaaaagttgggtgcttgaatccttgggtcagaaatcaaaacttactcccaccttctgctccacctacccaactaagcctggccctggctgggctacaccctcactgaaaagtatgcaagaaaaaaacctgcctactagctcagagggctggaatgaatcccaggctgtgtctacgtgggtgtcagcggggattgagtaa

SEQ ID NO: 21060 - DNA, 525 bp, Homo sapiens
ttgtaggcaccacttaataattccaaagacttatatattctaatactatagttgaataaaataaaaaagaaggtaacatggtactgtggccatactctgtcatactgcctctgaaagatgtggcatggtggtagagcatggaagagcaactagcaaagttaggagttagtgtttcatttacattgctgttttgacaaaaaatgtatttactaataaaagtacagcttcatctgcacttcactgaaggaaatcattgttaattgattttagatgagcacatgaaagtgatgagttgcattagatggaggtctaaagtcacatggaaattaacaaaacaatttattactgaataatacttcatactgatcaggctctttatacttttcagagtatctgcattatacactctctcattgatctacaaaataattgtatgtgacagacaggtagcactttgattttcacatttgatgaaagaggctcaaaggacattaagtgaagtaacttcacatccacatgtcttct

SEQ ID NO: 21061 - DNA, 608 bp, Homo sapiens
ttgcaagaacatggatgaagctggaaaccatcattctcagcaaactaacacaggaacagaaaaccaaacactgcatgttctcactcataagtgggagttgaacaatgagaacacatggacacagggaggggaacatcacacaccggggcctgtcagggtgtgggggcctggggagggatagcattaggagaaatacctaatgtagatgacgggttgatgggtgcagcaaaccaccacggcacatgtatacctgtgtaacaaacctgcacattctgcacatgtaccacagaacttacagtaaaataataattaaaaaattggttttattgcagaatttaagtacctatatatcttatattgcaaatgtttccctgcctgactttgtatttaaccacaacattaatgaataaatatacaatttatttttttgttttggccttaagtcacattttattttattaatatttgttgtgatactactgctttaaaatattttattctctttatttttgcaactataagttggaggctaagaggcaagtttaaatgctgagggagtagtttcaggtaaaacatcatctataatcatcacatgattatatttatct

SEQ ID NO: 21062 - DNA, 504 bp, Homo sapiens
tggcctggggtccccatgtgggagcagcgcgatgacaggggccgacccctgcacaatgcctgccctgtgtgggcctcatgtgtccttgggggctgccggtgtgtggagagagaaggatgactagagcccagatctctcatcaaggtcggtggctctctgctcagtagctgatccaactaactggtgacttccccaggccctagctcctcctttcccacctggagaatcttctctgccttgattcttagagaatgacagtcccttggaggccgaggagggcagatcacctgcggtcgggaattcgaaaccagcctgaccaacatggagcaacccgtctctactaaaaatacaaaattagccaggtgtggtggtgcatgcctgtcatcctagctactcaggaggatgaggcagaagaatcgcttgaacccgggaggtgggggttgtggtgagccgatatcatgccatcccactccagcctggacaacaagagcaagactccgtctc

SEQ ID NO: 21063 - DNA, 580 bp, Homo sapiens
tattagattaagggcccaacctactccagcatgacttcatcttaatgtgattatatctgcaaaggctgtattgccaaatatgatcacaccatcggtatcatgggttaggactgcaacctatcttttgggggaatataattcaacctacaacagttcctgaggaacaaaattagatagaaataagatgcacactttgggcatttccccaagcccaattctgtacaacactagaaaatactgcatttgtttctagaacgtttctaaccacaacattggaaagttcctaacattggaaatcattcagaataatgcccaaaacaacttagaaagtggaaggattgactaataaagaaatctaacaagagtaaaataagtggctgggtgtggtggctcacacctgtaagcccaccactttgggaggctgaggtgggtggatcacgaggtcaggagttcaagaccagcctggctaatgtggtaaaaccctgtctctactaaaaaatacaaaaattagccaggtgtggtggcatgctcctgtaatcccagctacttgggaggctgaggcaggagaatcgcttgaacc

SEQ ID NO: 21064 - DNA, 560 bp, Homo sapiens
gttagtgcaatggagaagtccaaggggacgcaactgtcaccagcaggaacgcaaacccctgtttaggcatatggccactagggggcgagagagtcaaaaggctgcatatgaacgtcagccttgccctcttcaaggtgtaaactttttcctgaatttccaatgaaagcattcttggatttcttctccctaatcatccccgatacttggtacagcaagaatcaggaatcatagtaatattttacccccaagcaattgtaaacatccacttttggcaatgctttttgttttctaataaaaatgtaaacatgaaaacagaaatcaggaaaatttcccaagattgattactgttttgagctgcctcctatgcaattgcctggaagctgtgaggccccaatgtgctccttccaggcactgtgaccagagacactgcgcgttgggtggggttgccagggaaaacacaggatgcctaattaattcaaatcaggtaacaataaagcctttaatgtaagtatgctccaacttgtgagggcagtgtgtgtgtgtgtgtgtgtgtgtgtgtg

SEQ ID NO: 21065 - DNA, 607 bp, Homo sapiens
attttaatgaaagttatactgtaactattttaaagggaaggggaaccacacatccctaagagattcaaatgtaatatattctcaaaatggaaagattccagggatacagatttctttctttcatggatttctcctaagcgtgttcaattcatttgatcatcaccgcctgtgatctgtgctttattaacattttagcatttggttggacccttcttacctctctctctatccatcacgtaagacatttagtgctgcctactggcagttatctgtgtaattgttttatttcactcactaagtgataagatccttgagtcaagacgctatgcgatatggcctgtatcttccacaataagtaatcacattgattcaaaagattccctcacgatacatttttattgcaaaaatgattttgtatttatccattttggaaaagaaattttatctcttgagcccctaaaaatggaattgtacacattaagacccttatacatatcacataataatcttcagggtcaaacattatagttttcacctgctgctattcctttgcagtagactagaatagagaattatataaaatttctacgactgtcaaaaaaatata

SEQ ID NO: 21066 - DNA, 576 bp, Homo sapiens
ctttactgggttctgggttgtagtccaaactgagtctctgacttaaggggatctgaagccattcatgtttagtttagtatctgatatacttggttttatttcttccattttaatttatggttgactgtttattattcttcatgattttctatttacagatctgtatgtttgctgatataaagtcactatttcatgtatctcctttgtttctttgaaagttctttgcttttctacaaagtgttaataataggatcctaatgaaacgcatcattgagtacttattctcaactgttacatgaaaacaacacagccaccatttctcctccaacaatgtgccttccctcaggcccaaaagatgaaacttgtaaaatatctttactgcttcactctaaattacctttggaaaaggtttttacttttttattccttttcctacctcaatttattgaatttgacaaaatcccctacttcttttggtcccagactatttttaaattttttaattgctgcatcattatttaacattatacactgatttatctatttacatacataaataagtgataaagaaagact

SEQ ID NO: 21067 - DNA, 536 bp, Homo sapiens
aacacaaaagcttccttgagggcaatctaatcactggttatctatccgtgctctgagcagagatttgaaacacagtgcttgtcattttctttctacaaactctccagtactgtcataagtagccattgtactcctcattccttctgatagtcatgattactacctcagaggccaagtgctgcagccacttgggctgacgattctcagtgttcaataggcactttgtcccaggcaaccgtaagtgatgatttaagtgatttaatgtccctgcacaccaaggcatactacaatctcactgtccctggccatgaggttctcactgtgtttaagcctaatcaagtcaaacagcccacccccaaatcccattattgaaggtttgtttcctggtagcacagctgataccaagtgctatatcattcagggttcatttagaaaaaacaggaagtacgctagaaattgtaaacagaggggagtgaatgcagggagctgattatgaaagtggtgaacaggctgaaagggcaaaaagaaaaagatag

SEQ ID NO: 21068 - DNA, 562 bp, Homo sapiens
caacatggtgaaaccccgtctatactaaaaatacaaaaattagcttgtagtggtgcgcgctcgtagtcccagctactcagggggctgaggcagaagaatcacttgaacccgggaggcacaggttgcagtgagccgagatcgcaccactgcactccagcctggcaatagagcaagactcagtctccaacaacaaaaacagagtctaaaataggcaaattcttaaagacggaaaatagattaatgattgccatgggctgtgggaaggaataaaagtgaaatgacatctaatgataaagaatttctttctggggtgatagaaatattctggaattcatggtgacagttacagctttgtgaatatactaaaaaccacttaattatatatttgaaagggtggatgttatggtatgcaaattatatttcaattttaaagaaaatgtcaacactcaacatgaaaatattcaaaattacagctccaacatcagaataaagactatatttttggatctctaggattctgatatgagtaagaccatgagtcattattatttggacactaaat

SEQ ID NO: 21069 - DNA, 411 bp, Homo sapiens
attctcctgcctcagccttccaagtagctaggatttcaggcgcccaccacgcatgccaacactggacattctgtaagggatggcttcccttatgctgacttgaatcatacaaactgctatcacatctagctccttcatcctgaacacattcagtcttctgcttgaatataaatctgaggtttcaattgtgttcctacagtcaatggaaagctactggaaaatttggagagtggcattaaaaatcctcctggaaaaggccgggcatggtggctcatgcctgtaaaaccggcactttgggaggctgaggcgggcagatcaccttaggtcaggagttagagaccagcctggccaacatggtgaaacctcgtctctactaaaaacacaaaaattagctgggcgtggtggtgggcg

SEQ ID NO: 21070 - DNA, 612 bp, Homo sapiens
agggtcacaaaagggtgaaatccatataccagcagggctgcattcttttctgggggctctagggaaaaatctccttctaatatcattcaggttttggcagaattcagctccctgtggctacaagattgagtcccttgtttctccactgtctgttggccagtggttgcactcagctccccctttcctttccatatggcagcgttcttatttaagccagcaagaccatatccaattcttctggtgcctcaactctctgagttccccttctggaaccagtcacagaagactccatttgtaaagggcttgtataatcaattaaagcccacccagataatttccatgtcttaaattcaactgtctcatataaataacttagtcatgggagtcaaatccatcaagttcacggtgtgaaagattatgtagcaggtgggaaatcctggaggccattttagaattctccccattgcaactgataaacctctagacagtccgagcaagagaaagagataagacacaaattaccaatatcaggaatgaaggtagtggggcaacattacgggatggtaagggaacaatgctgaatgcataacactatgccaataattctacagc

SEQ ID NO: 21071 - DNA, 567 bp, Homo sapiens
acataaaaatatcttcttatattgctgtttatcactgtaaaacaatctctcagaataaattctattcccctatgtttcagaatgacacaagtatcttaaaatttaagacccagcataatacacatatgggaagagaagtttattgctcattttttgtctttgaaaaaatggcactcatttctcttaactaagaatttcttgagtcttttgttacatatctatggtatgaacacttggttctcatttttcatcctagcaaaaaagagagagtaataatttaagatataccctgaaaatatttttacttttaacattagctttgtaatatccttgaagcattttccttaaaactagggttcttttgtttgcataatgatttttcttcgtgggacttaaagtactatggagttggatcccattccgttgaatgcatagatagctctctggtggtggttggaattgttcagtgcctaggatggttagcaggtacttaagggtttgttgaatttaaaagaaggtgagtttctttaaaattcctttaaagaattaattctcgatgagcctgag

SEQ ID NO: 21072 - DNA, 605 bp, Homo sapiens
ccttttcactccgttgtttcctttgctgtgcagaagctttatagtttgatatagtcccacttgtcaatttttgtttttgtagcctgtgctttatttttttaattgaaatttctatctgagttattctgacttcactctttctgcactggcatcttttttctacaaattatttcaagaatacatacacgatttgaactattttgctgtttttttgcttagatattatttggcctagatgagttacagaaacaaaatttgcaacttgaatttctcagtcgctgcaacaaatgtgctgcttctgaaggcatatccctcaggaggcaagtatcatatagtttgaagggatgtgtcagtcaaggctcaaaaaaataatgctgtaaaaactgaggaaatttagtattatactaaagctgatggttaagatgtaaatattttatttttgtccttcccagaaacacatacataattttaaacttctctaaaatgaacactattggccaaatcctaagaaattgtgaacgacaaattccatcactaagttatcccatatatgtgtactgtatttttctcatttttattttagtgaatagaaatgttagaaagtc

SEQ ID NO: 21073 - DNA, 319 bp, Homo sapiens
gaaaaatattggcttatattctagataaatacatacgcccacataatcccatacagggcaaataagtatgtgtgtctctgcggtgtgatgtgtgcatgcatgcaagcatgcttggtagactttatctgctcactgaatactttttccaacccaatgtatggaaagtgacagatggatcagcaatggctgagaagcagttacacatatctggccagcatggttttgattgtatgttgggttgtcagccagctacacaccagaactattattttaggcggctggaagagaattattcaatgtcaatgggaagagagagata

SEQ ID NO: 21074 - DNA, 516 bp, Homo sapiens
taattatggtgagaccttgggaaagatactgttttccacactgaatattccctgaaaagcgtagcagcactccacttgggaattcacgttatcaccattatcagaccaactgctagaatcaccttttctttcctatttagcttattcattcattcattccacaaatgctcattaagctcctactcttgccaggtattatgctagaaattggggatataaagatgaatttaaaacatagtctttgtacttgcccttaagaaatctacagtctagtaagaagaagacataagtaaataagaacaatgaaatacaggctctagaagagatctatatcttggaaatgtcagtgacagaggtcagtagaggacttcaaagtgttcaccaagctcaatcttgaatgaaagttggtacctatcagggagcaaagaggaaagactataatggtaagaacgagaatatgaatgaagccaaaagtgcaaaataccttatcatggtaggataaatacaagctagtca

SEQ ID NO: 21075 - DNA, 597 bp, Homo sapiens
attgtaggcccctttaagcagggctatcacatattgctgtgcaggctgcacagggtgactccaggggccacccgctgcagagactgtgctgtgtatgcacatcatacatggcagcccttaggttgataaataccttctggttaactcttccatctgtagctgcaagtctgcagtctccctctgagggtttttctagtctcttctctaactaggactgaatctttctgtccccaccgagactgtgccctagaggcaggtatagtttctctatcatttagaggcactgctctaaaacagagcagtgatggctttattggccctgaatatatgtgaaggcattagaagggtgatactggatagataatgagaaagacccacttcttccatcacctgtcacctctaatgttctcttccccaggatttgatagatcttactcagatttcagtgcttaaagatgccttttgcggccaggcatggtggctcatgcctgtaatcccagcaggttgggaggcggaggtgggcagatcacctgaggtcaggagtttgagaccagtctggccaatatggcgaaacctgtctctactaaaaatacaaaa

SEQ ID NO: 21076 - DNA, 598 bp, Homo sapiens
ggggtcggagggcctcacgtgtcccaggcatcagtgacctccccttgccattgctttttcctgttggctgccttttcctaccaaattccacttggcaaagagggaacccagctctttcaagagggacatcaactcctggttgttcaggaattacttggccctccttggctatcggccattcccagctgatgttggttccaagcctgagcaacagaaacagaggcctgtcctagccctggctgttcctactggacccacgtccagttctgagccacccctgggtgtattagccagggctgagcaagcagaatgtgggatggaaggtgagagctatgcagcaaaggtctcagggtggctctgctctctctgaggcctgtaagaagaacatgattggccgggcacggtggctcatgcctgtaatcccagcactttgggaggctgaggcgggcagatcacctgaggtcgggaggtcgagaccagcctgaccaacatgtagaaaccccgtctctactaaaaatacaaaattagctgggcgtggtggtgcatacctgtaatcccagctactcgggaggctgaggcaggagaattgcttgaacct

SEQ ID NO: 21077 - DNA, 458 bp, Homo sapiens
agtctagaatggtaggagcatcctgagacccctagtgggagtctcaaaccaacacagctatggtagaacatgtgaacaaggatcctggagacaggttgaatcccgggtatctagagctaaccatatgaggaatctaatacaacctgtgagcaagattgaccccagaaacttgtgccatgttcttgttattgctttgtatcgcctctagactcaatacccctgggagaactcaaaaccagagggaaacattgcctgattaaaagatgcatatctgagatttaaaatagggaatggatgtgatttctgacacagagagcccactggagagcaggtgggtgtggatttgcagagaggaatagaaattaaaacattgcagacattcagctactatcaggtggggaaaaaaatgagtagtactctcagctactatccaggtggaaaaaaatggatgatgcatt

SEQ ID NO: 21078 - DNA, 451 bp, Homo sapiens
ggaattgtcaatgagatagaagaaagagaggcagagagagatcatgacaagaagcatatatattatttctcaactttcagatttctctctctgagcttaccctctacatgcctttgaaaaatcataaagaaaacaatgcatttttcaggtctgaagctgagaactgccaaagcttctcttccacggatcccacattgaaatatgtgtctaccaaagtacataatgtacaaaaattagtgcttgtatattttttcttactaactcttggtcatctttagagttttacagttttgaatcagagcttccacttagcaaaatctactaaacagtagaaacatatgtttttggccatctggcttatataaagtttgttgattattacatgtcagccacatttttgaaaataccaaatgtgtgtcgagcacggtggctcatgtgtgtaatcccagca

SEQ ID NO: 21079 - DNA, 556 bp, Homo sapiens
gacctgagcccaaagcccttagtctgggctattaacgctataaaaatctccaacaactgattcctttaagctactgtagaagggttcttgcgggaggcatgagctaggctatgcatgcagatgaggcccttcctctacaaagccacagggaagccccttacccaggctcccaaatactgtggcccctccatggtagaagatgatgcctcgccggggtctggaggatgctgccttcggctggaacagcctcacgggtatcgtcccaaaacgcaggtcggtcaccacaagttcagggtccttttaattctcacgctatcatgtaaaaaacgaataaatttgggcatggagcaaattcccagcttctcaaatatattcccctgttggaggtaacaaaagaaagccagacgttaggagaggttagaatctggatggtagattccctgacacttagaattgttaggatgttttcacagtttctcacctgcctcctgtaggtacagggggctcttcaggaatccataggctctggactgtgtccaggtagagggctgggttt

SEQ ID NO: 21080 - DNA, 536 bp, Homo sapiens
tcggagagcaaacataattgcaatattttgtgtaagcatgactcaagaatgtttggttagttgccttatagcccttggtttcctcacctgtcagagagagtaatgattttcttatagaattatgagaattaaataaaatatgttacatatattaaatgaaattatcctgtggcagaaattattctgtgtcagatctgtttgacttgaaatataatttatttatcataattctaagagaaaagcatatgtatgtgtatgaacatagatagattgacagttaattggctagttcctggcagttgtaattacataataaactctcttaactaacttgagtcctgcttatataaaacgttgcaattaggccaagtgcagtggctcactcctgtaatcttagtgctttgggagaccgaggcaggaggatcatttgaggccaggatttcgagaccagcctaagcaatataggtacatcctacgtctacaaaaaataaaaacattagccagacacagtggcatgcgcctatagtcccagctac

SEQ ID NO: 21081 - DNA, 565 bp, Homo sapiens
gcctcagcctcccaagtagctgggactatgggcacacgccaccatgcccggctaatttttgtgtttttagtagaaacggggtttcaccatattggccaggctggtctcaaactcctgacctcgtggtctacccgcctcggtctcgcaaagtgctgggattacaggcatgagccaccgtgcctggcctaatttttgtatttttggtagaaacggggtttcaccatgttggccaggttggtctcaaatccccgacctcaaatgatcctactgcctcagactcccaaagtactgggattacaggtgtgagccaccgcgttcggctgtagattcttacaaggagtactcaccctaggtggcttggatcccagtaccagcccacagcctggggttggggatccctggcctcgagattagatcatgggccgactgggtgccacttgggcaaaagtcatttcaccactctatgccttctctcctatggaggtgctatggttttccatcagtagaatgggggtaaaaattatacctacctgatatggaggatgaagtgagttaatctgtgtag

SEQ ID NO: 21082 - DNA, 513 bp, Homo sapiens
agggtcacaaaagggtgaaatccatataccagcagggctgcattcttttctgggggctctagggaaaaatctccttctaatatcattcaggttttggcagaattcagctccctgtggctacaagattgagtcccttgtttctccactgtctgttggccagtggttgcactcagctccccctttcctttccatatggcagcgttcttatttaagccagcaagaccatatccaattcttctggtgcctcaactctctgagttccccttctggaaccagtcacagaagactccatttgtaaagggcttgtataatcaattaaagcccacccagataatttccatgtcttaaattcaactgtctcatataaataacttagtcatgggagtcaaatccatcaagttcacggtgtgaaagattatgtagcaggtgggaaatcctggaggccattttagaattctccccattgcaactgataaacctctagacagtccgagcaagagaaagagataagac

SEQ ID NO: 21083 - DNA, 429 bp, Homo sapiens
ggtttactgacttcctctaagtctactatttccagctcttcaaaacagaaggaataaatgaagtgagaagaacactggaataaggctaatagacaaagtggctaatctcagacccccaaggtcaaagaaaagcaattcatttcttggctttcatcaacacaagatatgatttatcaatctaagagcaggattacaaacattatacatctcaatgatatgttcttgcactgtgtaactttttgaacaatgacagattgcatagtcaccacaaagtcatgtcataaggcaaaattcattacacttgcacaagcactaggattttttaaaacaaatgtacacagtagcaattattactactatatatatgccatttttggggggaaagccttttaaaattcagttattccttgggattctatcatcttcatg

SEQ ID NO: 21084 - DNA, 481 bp, Homo sapiens
tccatgcctgtcattacgttaatccatatttgcttatccttttgatcttaatcggcacagtaggttttattatacccttacatagcaatttcagggtcacgtgaaaaacacatgaatttaggaaacattaagtacaaacagagaaccgattgtgtcttggttagatcaataattgtacatggttgtaaatgtcattccaactatttgtacacttgaaccatggaaacaaaattatttaatgagttaattctatcatctaaaattaataatacattttaataccctttgagtaccacaataaagttattacagaacaggtactttcatttattccacaaaaaatggagaaccgaagcagttgttgctttacctaattattgaacctctgatttgaatggaggaagctgtttcctgagagaagcggccccttttagcaaaggaacaggagttgtaatggaagcagttcccagccactgcaagc

SEQ ID NO: 21085 - DNA, 537 bp, Homo sapiens
tgttcagaagtagccagaatgctataatgaaccctcccgcacccatcacccccacacactattaatgcctcacctgtgttctttcatataaacctctgcctactcacctctctttattttgaagtagaactcagaaatcatttcgtttcatccttatatattgcagcatgctctagagttcatttgtaactcaagaaaagagcaataatgtaattccagcaataaaagtctctttaaaaaataccatcttttgaaaaggaaatctctctccattaaaaataattctccactatttttaatagaatgtcttctctaaaatgatttttatgaatctaattttttgggggattccctgaaaaggattttgtaatcttaagtttgctcctaatacaaagtagtagggtacattattttttaaaattgtaaatggtgactgatcaatatttaaatcatgttccaagatcagtagctttgtggtatgggggtggcgcagggcactcttaaatcctttaatgaaaatcacaactttatttgaaa

SEQ ID NO: 21086 - DNA, 556 bp, Homo sapiens
tcatctagactaatcagatccattaggcagaaacttggtctgtaaagcaaggaacacgctcagaagttacacagatgttccaattagatacactggtatatatatctaactatatatagtgtgtgtctatgtaatctaggcataaataataattttatttattagagtataggattaaacatgtctggagcccactaaaatgaaacacagtttctataaagacaaggctgtgggttcagttggggtggggggagttgttttactctttaaatgacaagatcttctattactatgttttttactgctcaagaatcaaaagatccaaattcatatcctaaatttgactgttattctttctacataaaactttattttttatttcaggatgtcctccgagttgcagaaactaagttgtagatatatcacaaaaattgacaatcccatgagtatttgatcccaacacaaaatattcaggataacgcttcactttctctcactggtctttcaacacttcttcttggcaaaaaaaaaaaaaaaaaaaaaaaaatttttgggg

SEQ ID NO: 21087 - DNA, 437 bp, Homo sapiens
acaacctctctttcacggaaggtcactatattgagcaccaacccttcgttcataattcagaaaggttctccatcctgggaagagcaacaaattaaaaaaccgctaccgacgtgcagatattttacagcgcaatccagtgagactctgcattttcatactgagaagtaaaatatgacctagacaagacccagacacaggctcataagaaagactacggggctttaaaattattgccttgatcatggaaagaaacatgaggaatcactggcagccacaactcaggatggtctttgggggcaatcagtgtttgacagaatcaaagaacatctggaaatcagcatattttgagctagttcacaccctgcttggttcatatttcaacagctctatgtactaaggcagttatatggccctgagaaaagcagcctggatttatc

SEQ ID NO: 21088 - DNA, 551 bp, Homo sapiens
tgctggtataaataaaacctcctgaagcagaaaggatccttttactcaagggagaaattcaagatttgtttcctgaaacaattttctctttctgcacttagctaaatgtgcaataatgagttgtgtccatcaggatatttaacttccaaaatgatattcagctctgctgttaataatttagtgtagaaaggtatccaaataggaaaagaagaagtcaaactatctatctttgctgacaatatgattctgtacctggaaaaccctaaagattgccaaaagtctcctagaactgataaaaaaaaatcagtaaagttacatgatacaaaatcaatatacaaaaatgtataccatttctatataccaataaattttaagctgagagccaaatcaagaatgcaatcccttttatgatagttgcgaaaaaacttctctaaccatgtagatcaaagatctctacaaggaacattggaaaccactgctaaaagaaatcatagatgacataaataaatggaaaaacattccatgttcatggattggaagaatcagtatca

SEQ ID NO: 21089 - DNA, 511 bp, Homo sapiens
gtttactgtgcaaatggaaggtgaaacagaagttaagcatcacagtgaggaaaaaggatattttatcacagtaaaaggaatcattcaccaggccaggcacggtggctcacgcctgtaatcctggcactttgggaggccgaggcaggtgggtcacctgaggtcaggagaccgagaccagcctggccaacatggcgaaaccccatctctactaaaaatacataaaattacccaggcgtggtggcgggcgcttgtagtcccaggtactcgggaggctgaggcaagagaattgcttaaacctgggaggcagaggttgcagtgagccaacattttgctactgcactcccgcctggggggcagagtgagactatctcaaaaaagaaaaacaatacccaaaaataaataagtagaatgattcaccaaaaagatacagcaactaatgagcttgaatgtacctaacaccaaattatgtaaagaaaaaaaaagtaaagcaaaaactaacagcattttaagg

SEQ ID NO: 21090 - DNA, 534 bp, Homo sapiens
gagctgcgggggaggtgggggtgagaggtttagttgtagacataattgaggtctccatacctgcgagccaccaggagaaaggagaagatgtcccataggcacatgggacatcagaagaactgattctgggtcagggaatcccattatggagccaccagttggttcagggaaagactgtgatgtgaaaaggggtaagtgccaagtacagaatgctggagataccagcccatgaggagacatggagacgaatcgtggaacaggcagagaaatctaggcaagaatggggctatggaagccgaaagaataaagtatttcacaaagaaggaactgagcaactatgaaaaaggtgcagagaaaacaaacaagataaagaatggggactgttcactaagcaggtagcacaaaaccacttgtcacttttgcctatggtgtttcagtggaaagggaaaggtaggaaagatggcagtggatggagaagtagatgggtggtggacagagagactgtgatactgtaatagacaagtctattgagat

SEQ ID NO: 21091 - DNA, 561 bp, Homo sapiens
acgtattttggctttatttctggattctctattctattgcattggtctgtatctgacacaattattaatagcattctctttctctcttaaaagcacccaggactgaataataaattgtgtgttcacactgcatctatgggaaacagttcttaacagctcagagtgaaccatggtggaaagatcctgtatcaggagacagggctgctgttctaacttggccactaacccggggagactttggatgagtcccttcacttctctgggcctcatccagaaatgaggggttggaaccagagccattccctgattcactagatcatttattcattcaacagatcctttttgagcttcctactatgttttggatgttataattttggcagatttcaatattaatgacagaatgttccagcttctccctgcttttgtctgctaaacggaattctggcttggtccattaggtctattcctccccctgtggaaaactagaatatgtcactctaaaatgtgcctattttgcataagaattgttgagctgcaggcaattaagaagaagcagat

SEQ ID NO: 21092 - DNA, 487 bp, Homo sapiens
tgttgtgccaaggggttaaagaaggtcccatctggccctgagtcccagtcctcaggtgtccctgaggtgtctatcatctgtgtggtccacattcttcagttcacatatgtccccactgagaaggctgcatcagccatcgtgaccaactctgagtcaggcttgaggacccaggaatcagtcatttgactgcttctgtgtcctgtgggggtgctgtttgtggcaatgactctctggacccatcacacagatgtcccctctctgggttcttgttgtcccctctggactctcacctaggaatggggcacagttacctcttgggaacataccaacatccagctgtctttatgttccttgtctcacgattcacctaccaaccctccaaccaactacttgcagggagaaagcctttctctataaatagtgctcttttctctgaggtatccagcattaactcctgcatgggtaaaaccttcggatgcaaagaaac

SEQ ID NO: 21093 - DNA, 597 bp, Homo sapiens
acatcttctttacagaaatgtttattcaagtcctttgcccctttttcaattgggttgtttgtctttttgttgttgatttttagtcctctatatatactggatattaatcccttctcaaacatatgatttgcaaatattttctcccattctatgggttgcctttttactctgttgaaagtgtctttttgatgcacaaaagtttctcaccctcatggagtccagtttgcctattttcttcttctgttgttcatgccttttgtgccttatctaagaaatcctcaccaaatccaatgtcatgaagattttgccctgttttcttctaagacttttatagttttcaaagacatttaggtctttgatccaatttgagttaatttttgtatatggtgttagaaaaggtccaactctattcttctgtttgtggagatccagttttcccagcaccatttgttgaaaaaccgttctttccctattgtcttgttgatctgtccatgtgggcccatacagaattccctcattcctttcatggctcagtcatattccatcatatagaggtaccatccctttccaacctgtcccctgctaaagccctaaatt

SEQ ID NO: 21094 - DNA, 597 bp, Homo sapiens
aggagcttgggttcagctcctagttgaatcaagtaactctccgccttcatctgtttaattcatttacacttagagtagtatttcttttgcagaaagggatgcatggctaaaaatgtactactgcttccattaatgaaaattaatttagcttaataagatgagtctgaatcttggattctgccagccctgagtttgaattctagtttgacccgtttctaggtatgtggcctttaagtttctcatctgcaatatgggaattaacactaacttcctggagttgtgagagttaaatgatttgggtgtataaaatatctgatacatgctctttataccctctttactccactcatagtaaataaatcctgtgggaagctgaagtacggttgggattgaattgaggtgggtgcaaccttagccctcacctggtagacttccttctagagtttaacctggagatactggagcttttgccattaagggaggtaacagatcattacaaaacattcctctggagttattcaggagactagaactgagccctttcttttgagagggtcaaaacagtatcggtttatgaatgactatgatagtacccct

SEQ ID NO: 21095 - DNA, 579 bp, Homo sapiens
gcctcgttcaaagcaacatatcattgccaaaattcacagttctagcacttacaagaaatagagtgaaagagaaaatctaatgaggagaattgtccccatttctttccaatgccatgcccaagaccagtgccatccggtagaaatataatgtaagccatatatgtaactttgcagatgtgaggtcctgggtgaggaagcaacctcttgagctaaagacaatcctgcctgtgtagttttacattatctagtagccccattttaagaagtacaagaaacaggtgaagtttagtagtttattatattacatccaaaatatccaaaatattatcgttcaacatgtaattaatggaaaatatcaagctattttacttcctttatgtatactaagtcttagacatcaggatacgtattttacactcacagcacatttcagttcggaccagcgacatctcaaatgctcaacagccacatggggctagtgatgccattctggagaacaggtctatacaattaaaactcccagaatatgcagagttgaataacctgcccttcagtaacccaacatgactgcccctgaat

SEQ ID NO: 21096 - DNA, 476 bp, Homo sapiens
gatcattattatttttaaatatattgcttgtccctagcataatctggcatatgatacaagctgactacttttatttaaagcctggtatgggtatgtatgactagaataggaatattgaagataattctttgttggacttggatttcttttgcgtattgagtcaaatttttttaaaaagagactttagaggtgaattttttcaaattatgctttgtgggagactagttctgtgagaagctttcggtcaaataaatttgggcagagctagatatcgtatctccctcttagatagttttaatttaggctgggatattaaaaacttgagaagtcttacagtaaagaaatcaattttgtgttacttccagccatagggcaggttagatactctgggggctccttctatgtcaaacctactggagcctaggtttaaaaaatactgttgatggactgggtgtggtgactcacgcctgtaatcc

SEQ ID NO: 21097 - DNA, 453 bp, Homo sapiens
atggtctattcattattgaaagtggagtattaaggtcccctagaattattatagtatccttggttttataacttcaatttcctttattttatttgagaagaattagaaaaaaaaatccaggtcaatcaattaggtttaattagaactcttataatattttattcagggaaattgaaggaaattagtatttgtaactatctaccatatggaaggaactgtattcatttcctttactattatttcattcagatctttacaagaataaaaagtattgtagccagatgtagtgcctcatgtttgtagtcccagtacattgggaggccaaggcaggaggatcacttgaggccaggaatttgagaccagcctgagaaacagagtgagaccttgtctctacaaaaactaaaaatattagcccggcgtggtggtgcacacctgcaatcccagctactctgg

SEQ ID NO: 21098 - DNA, 580 bp, Homo sapiens
cgtcagaacaaacagctgaagctatgcattatgtaagtaccaaggcaacattggatcttcctaaataatcttttatatctcacaaaatatatctaacccgattgtcccaaagtcccctttctgactttttttgttctttattgaagaaattttcaataagtataaccaagtaacaaattacttgttgtttttcaggatattagtaaagatccaaatgcagagaagcttgtttccagatatcaccctcagatagctctaactagtcagtcattatttaccttattaaataatcatggaccaacgtacaaggaacagtgggaaattccagtgtgtattcaagtaatacctgttgcaggtttgtaatttgctatgtcaaataatgctctcaaaaaagagaagttggactgcatgttctcactcataaataggagttgaacaatgagaacacatggacccagagagtgaaacaacacacaccggggcctgtcagggggtggggggcaaggtgagagagagcattaggacaaatacctaattcgtgcagggcttaaaacctagatgataggttgatacgtgcagc

SEQ ID NO: 21099 - DNA, 541 bp, Homo sapiens
tcatgatatcatcaaaggtgcttttggtggagtggtgaatggaaactagagcaggtaggttgagaagggaattgggatgtcagaaaattagcagtgaaaggaaaccataatttcaagaagcttgtccatgaagtgggggtgagggcagtgtggggagctgatagagttaaaggagtgttttgcccttttgcttttactccttaagataggaaagatatgctcatattttacaccaggtggtagaaataaggaaagggagagaccagtgataaaggaaagaccacaggaaagtgagatggagtcaggtctccacagagactgaaagctggtttgcctctcctttctctgtaaagtaggaggtgggtcctggtcctatgaagagagacgggagatgacttgggaccttcagagggatcaccagcatcactgaggggccagctgatggtatggatgatgagtccataaaggaaccataaacccagctccacaggttttctccagaatcatttctgaagaatgttacctgcaatgtgcccctgga

SEQ ID NO: 21100 - DNA, 603 bp, Homo sapiens
aacaaagaatttttcattatagtttcaccctttagatatggttctgctaccagacactgggacagccatgatttttgttctatttacctatatttgctatttggaggattaaaacattagactacattaaacacagactctacagaataggtaatacgggtcttgtggggtcattttgacaactaaagaaaagacttatccttgttatgaacaagtgtcctaccctacaggctatatttaattctagcatcttctgctgttgtatgatctagtacccattaacaatatgaagaaatctttgacattagtcttatatttatattatttataagtattcacaatctcatttataatgttgttaatagatgaaaaaatggaacgttgagtcattatcaactgaattaaatcaatatgtagagataattgcttgggcttttcattttaagcctagatacaatcttagattgccccaaattaaaggtatacagtataaaaatatgtaagttaggttcgtccattcatccatttagttattcttccaacaaacatttcttggacgcttgatgtattaggaactggtctgagaaatcaatgtatgacttc

SEQ ID NO: 21101 - DNA, 462 bp, Homo sapiens
gctgaacttgatttaacatggttttattttgtttttaacaaatagaggccatgatgactgtttaggctgagtaatggaggcctctgctccaagggcaggctgcttttcaaacagttgccatctcagtaatttttatccatttgcatctcacaacatcacaagacaggtttacataaaagtccaggttaccctgcaggctgcgtggtaacctttgattttaggttgatactggagagaaggtccgagaagaagccatccttaacaggaaatacattaaaaaaattctttgaaactggttcctgtgtcattgaaaggcttgggtaagaacacacacatggctgggcatggtggcccatgcctgtaatcccagcactttgggaggccgaggtcagcagatcacctgaggtcaggagttcgagatcagcctgaccaacatggcaaaaccccgtctctactaaaaat

SEQ ID NO: 21102 - DNA, 610 bp, Homo sapiens
gtgctgtgggaaggctcaggcttggaggcgcacaggcagctttggattctccagacagccacctcctagacgcatgttacaggacaaatcacctgcctaattttgcttaagtagaaaattggaattaataataacaataaaaacacttcttggggttttggagcccattgagagactactaagtttctgataaaaagagagaatttaaaatgattgttattagtaggtttttttcccaagtgaacctgaaatgaatgggtactttagtattttattttcatttcaaaataagacaagagaaaaagtatgagagtgtgtaaaaaagtcagtcatgcattttaaggagttaacacagatgatagatgaacacaatgtcatcagccttcatcacaaagtgaccataaaatatatatttaggaaaatgtaaaagtagggtctatcaaagcattttccaccatcatctattcaggacctcttctgctgttaagtagaggtgagaaaagaacagttacaatggcaataaataatgtcatatagttctgccttttagagacctgaggaagcaggtaatttaggattaacatgtacagaaaataagactcctctctct

SEQ ID NO: 21103 - DNA, 609 bp, Homo sapiens
tacttccaatgtgccttattttgagcctgatactatggaattttgcctgctattacagtacccaattattgcttggaataattttgcatttcctcgcattttacagagcatggcttgactgacaatttgacaatcagatagcctaggctgatgccattgtatctatttaataactttgttaaccaattaacacaagcagacaattcccataataattgagtattaaaaagcacaacaacaaataaacagtggacacttagaacaaacatctgaacactgttttagcccagttgccttcttttcctgaaagctccaaagacatacacacacacatacacatacacatacacacacacatgcacacacacacacgaagaagcacaaagaaggcaaagtacatttcattttgggattgaatttttactctggaacccagtataaagctctaacaggtaggctgatcttcaaggaaaggctctttttctgtgtatatggtaggctacttcccttcaagacccctatgtgaatctagaatctaaaccatggatggcgggatggcgacacctgtgctaatgtttgagaaaaagtaacaaaaaaaaaaaaaaaaaa

SEQ ID NO: 21104 - DNA, 554 bp, Homo sapiens
atttgctttccggtccaagttcacgggcttcccgaatcccctccacagatcctcagggttcaatgtggatcaggccataccaatcttaagctcaacccatgtgggcactgcaccatggttttgaatattgaagagacttaaaaatgtatggcaagtggctgggtgcagtggctcacacctgtaatcccagcactttgggaggccaaggcgggcggatcatctgaggtcaggagttcgagaccagcctgaccaacatggtgaaaccccatctctattaaaaatatatttaaaaaaataggccgggcacggtgcctcatgcctgtaatcccagagatcatctgaggtcaggagttcgagaccagcctggctaacatggtgaaaccccgtctctactaaaaatatatttaaaaaattggccgggcgcagtggatcatgaggtcaggagatcgagaccatcctggctaacatggtgaaaccccatctctactaaaagtacaaaaaattagcctgggcgtggtggcaggcgcctgtagtcccacctacttgggaggctg

SEQ ID NO: 21105 - DNA, 609 bp, Homo sapiens
cgcgcgatctcgcctcactgcaacctgcacctaccatgttccagcgattctcctccctcagcctcctgagtagctgggattacaggcacccgccaccatgccttgctaatttttgtatatttagtagagatggggtttcaccatgttgaccaggctcgttttgaactcctgacctcaggtgatccatctgcctcggctcctaaagtgctgggattacaggcttgagccaacacgcccagcccttactagacatttttctaattaaaaaaatattttaaaccttcaggaactgacatttctattagaaaaggtgttggaagacctctgatgacactggaatttgtttgaaaaaaagtagaaagcataacactcaggaaacactgactgtcaatagaattgttcaatgtcaggtctgtgggcaatacaatagaaaacattatgcacgagtttccacgctggcagcagtgtgtcaattttaaggtaaaattgaaaccgttgttaacaacaattagggtgcaggaggaagcaagttagttacagaatttcataaaataatctgtcactggaaagtaagaaaaaagcatgtttactagtaacaataataaaagt

SEQ ID NO: 21106 - DNA, 557 bp, Homo sapiens
gacctgagcccaaagcccttagtctgggctattaacgctataaaaatctccaacaactgattcctttaagctactgtagaagggttcttgcgggaggcatgagctaggctatgcatgcagatgaggcccttcctctacaaagccacagggaagccccttacccaggctcccaaatactgtggcccctccatggtagaagatgatgcctcgccggggtctggaggatgctgccttcggctggaacagcctcacgggtatcgtcccaaaacgcaggtcggtcaccacaagttcagggtccttttaattctcacgctatcatgtaaaaaacgaataaatttgggcatggagcaaattcccagcttctcaaatatattcccctgttggaggtaacaaaagaaagccagacgttaggagaggttagaatctggatggtagattccctgacacttagaattgttaggatgttttcacagtttctcacctgcctcctgtaggtacagggggctcttcaggaatccataggctctggactgtgtccaggtagagggctgggtttt

SEQ ID NO: 21107 - DNA, 571 bp, Homo sapiens
gattcaagtgattctcctgtctcagcctgttgaatggctgggattacaggcacgtgccaccatgcccagctaatttttgtatttttagtagagacagggtttcaccatgttggccaggctggtctcgaactcctcacctcgtgatctgcccatctcggccccccaagtagctgggattacaggcaccggctatcacacccagctaatttttgtgtttttagtagagacggagtttcaatatgttgaccaagctgttctcgaactcctaacctcaagtaatccacctgcctgggcctcccaaagtgctaggattgtaggtttgagccactgcactcagcttcattctagcttttaatataaaagatatttttcaaaagtaccattagtgactcttttaagtaatgggaggaataaggtcattagaaaccatttaccaaccaaaatatttgtgataggctttgttttgagccctttgaaccctaaatgaagttctctatactatctaggggtgaaaaaagttgtttttaaattctgcttcatttctaataaattagaaaattcaaagcaaaaa

SEQ ID NO: 21108 - DNA, 599 bp, Homo sapiens
tttatttatttatttatttgagacaggaatcttgatatattgcccaggctggtcttgaactcctgtgcccagacaatactccctccttggcctcccgagtgctgggattataggcatgagtcactgtacctgacctgctttttaaaaaaaaatgacaactaatgttgcaattaacaatcttttacttagtggaatgttatacttaaattccagaaaggattattgggtcaagagtacatacaattttgagagttacaactttatgggggttgtatcaatgtgcctcccccaccagcaaagtatgagagtgcctctttctccactgggtgtgatggcacatgtctgtgatcccagcagtttgggaggctgaggcaggagaatctcttgagcccaggagttcaatatcagcctgggcaacatggtgaaaccccaactctacaaaaaactaaaaaaatcagctgggcatggtggtgtgtgcctgtagtcccaactactagggaggctgaggtgagagaatcgcttgactcccagcaggctgcggttacagtaagctatgatcatgccactgcactccagcctgggcaacagggcaagacatt

SEQ ID NO: 21109 - DNA, 508 bp, Homo sapiens
gatgtccaggaatgcagctcagtaggtctcagccttatttcacccagctcttattcaagatggagttgctctggtttgaatgcctctgacacaaaggttgtaagaggagaaacaacttggtgagttccagaaaaaacaaaaggctgaatgaatgagatggggctcaggctgaggttagcaagaagccattctgcacaaggtttgagaccccgagaaggagcgtggatacctaacacaaagaatgataggaagcaccgacaggttttaagcagggaagcaaaacaatcgaatttctgtttttaaaagatcactctgtctgttacatggagaatggattggggtaggtaggggtagaagatcttgtagccctgaatggaggtgacagtagctacaatcagggtgatggcagtggatgtaaggtcaataagtttaacatatatttgacagaaatttaaaaaatagaagttattgggtgggttggatatggcaggtagtaaaagagagtgag

SEQ ID NO: 21110 - DNA, 596 bp, Homo sapiens
ttctcaacattacccctctccatcaccccaggagataagccaccattatctcttgctagatgactggggaaaaacacaaaccaactaaccttttagctccacctgactgctcatccatcctccatctgcacaataggaggaaaactttgtttgtttgtttatttatttatttattgagacagagtctcgctctgttacccaggctggagtgcaatggtgcgatctaggctcactacaacctccacctcctgggtttaaggggatggattctcctgcctcagcttctcacctagctgagactatgggcatgcaccaccacacccagctaatttttgtatttttagtagagacagtgtttcatcatgttggccaggctggtgtcgaactcctgatctcaggtgatctgcctgcctcagactcgcaaagtgcggggatcacaggtgtgagccactgcaccaggctggaagactttataaaatcataaatctggtcatgccaacacctttgctgaaaatccttcagcatcttcccaaagcatataaaataaagatcaaattctttagcatcatctctgtagtgggctgaatggtgcttct

SEQ ID NO: 21111 - DNA, 594 bp, Homo sapiens
attgccctagcatctgcatcccttcacaatttcaattctttagctatcttctgaaattttccttttttttcagttggacttattgattgtaacttatctcctagtcctatatccttcattcttatctttgttatcatcactttgctaaactcagtgaatttacctatccttatgtctacagctattgcatgtatactgaaaaccacttctaattttgatcttttacttgcatgtgcataatcctaagaccctgaagtacagcatgatagtagactttcatctcattcttgccagattgaaaaaaaaagaaatcaacttccttaactttctttctcccttcagattttctgtttcttttattgacatgtccagggctggaaatcttggaatcttctttaaatcaatattctttcgttctgtctcctttcgctttgtttgttcttagtattttcttcacaaactctcttagaattttcctttctatttcttttcccatggccctcactctaatcctttaactcactcttaaataactataaatattttctttccagctcactgcctccggattctttctaccatccaccactacca

SEQ ID NO: 21112 - DNA, 586 bp, Homo sapiens
agaaggggcctggcattgtgttgagcactcttgggaatttgaggcaactctattacccttccttggcctcaagaagcttagctatccccaaaataagaggaggcaaggaagaattaggagagttaagagtccttgtgaagcacttaaagactaaaaagctaccatgagtctataaaggcagattctctgaggaccacaggtatataagaagaaaaggaagtcttgattcagtaccagcagaggatctggttcggaagatgaagtgtgtttgagacgttaattaacaggaaccagagtcccagctgactctcgagcccaccctcatttctagtcccggctttttccactaacctgccctgctttttaaatgaatacccaagacagtctcatagcagtgatattctttccgtcaccctttggggaatggggagagacatggacccttgctccaaagccatgatgcctaaactcctgcctttcccaactaacaaggagcacaactataacctcaggaaatttaagttttaaaaagaaatcagatcgggctgggtgcggtggctcatgcctgtaaccccagaactttgag

SEQ ID NO: 21113 - DNA, 565 bp, Homo sapiens
ttctctattcctgtttccttgtctgtaaaattaggataataattgttcccaaatcataaagttgttatggggagtaataagatagagtgtgtaaaatactccatacagagcctggaccatagttaagagtaagtactctacaaaaacttgtgtttgtcattagagatacaataaaaagttatgaaccaaagtggccagtaaaaaaaaatgaaagtttttatatactgagcatctataatgtgtcagtcattatgttaaccagttttcatacattatttcttttaatttgttgtcttcgaattattttaaaagaattaaaagaacacagtatgatttaatgtgaaaacgaaaaagagaagattccagctgggcacggtgactcacgcctgtaatcccagcactttgggaggcctaggcagttgaatcacgtgaggtcaggagttcgagaccagcctggccaacatggtgaaaccccgtctctactaaaaatacaaaacttagccaggcgtggtggcatggtgcctgtatcccagttactcaggaggctgcggcaggagaatcactt

SEQ ID NO: 21114 - DNA, 513 bp, Homo sapiens
agaagggcagcctgagctctgcctcctgtcagatcagcagcagcattagattctcacagaagcacaaaccctattgtgaactgcgcatgcaagggatctaggttatgtactccttatgagactcgaacaataaatgtaatgtgcttgaatcatccccaaaccatccccaccccctactgtctgtggaaaaatcatcttccaagaaactaatccctagtgccaaaaaggttggggaccgctgcactatgatactcaattaagggggacaccagggccttacagcatttaagcaatcaagcctcctatataagcaccaggccatagtatgaccccagagtcctgtcctgtctctgaatcacaaagtgggtagcagcaattgaaagtggaattccattgtccaggcacgatggcccacgcctgtaatcccagcactttgggaggctgaggcgggcagataatgaggtcaggagttcgagaccaccctgaccaacatggtgaaaccccgtctctact

SEQ ID NO: 21115 - DNA, 425 bp, Homo sapiens
tttgggtttttttattgttggtaactttttttttttcgaggcagggtctcactctgttgcccaggctgggatgcaggggtatgatcacagctcactgcagcctcgaccacccaggctcaggtgaacctcctacctcagcctcccaggtagctgggactacaggcgcttgccaccatgcctagctaatttttttgtattttttgtaaagacagagttttgccatgttgcccaaggtggtctcaaactcctgggctcaagcaattttcctgcctcggcctcctgaagtgttgggattacagacatgagccactgcacctggccaacatcatttttaatggctgtatcatactccattatatataaaatactccataatatcataacttctccatttatgaacatttagttcttttcaggtttttacc

SEQ ID NO: 21116 - DNA, 591 bp, Homo sapiens
ttagctatttatcactgcatttaatatttatgaaaacttgcaagctttaattatttttaaaaagacttggaccttaagtgggccatgacagtatcctcagaaagatgacaataagtaagaggatacaacttcctttataattgacagatagggttccgtttgtccaattactttttttttaaaagaagagataaattcactgtaatgaatgtgccataattggaatctatagaggtctaccatttgaataaaaggtgctggatgatcacctccttagaggaaccatctaaggagaaaaggatatacaaccaaatgggtgtgcattgtgatagaaaatgtccctctccacctccacttagtattttattaagacttagaaaaattaggccgggcacagtgcctcacacctataatcccagcactttgggaggctgaggcgggcggatcatctgagtcgggagtttgagaccagcctgaccaacatggagaaaccccgtctctactgaaaatacaaaaattagcctggcatggtggtgcagacctgtaatcccagctactcaggaggctgatgtgagagaatcgcttgaacct

SEQ ID NO: 21117 - DNA, 438 bp, Homo sapiens
tttttgcttaaaatattctgttttccagtttacagggcttttcaactggttttaagataaccactgtttacatctaaacttttttttgtaaatgactgctgagtttctatacatattccatagctagagtttcaaagtaaaagctctagtatctttgtattagtgtgtgtatgcgtagatgtgttaatatgtgcatgtatatatatgtgtgtgtgtgtgtgtgtgtgtgtgtgtgtgtgttgtggctactaggtacaaaattggctttgaaataaatattttcaaattaagtaaatgagcccaatgcatttgaagtacatgtgacttaaataaatatttaataaataagttggctttaaaattattggtaaaaacaaattagagatattttaacaattatcagcataccttatagtttatattaattcatcaagtgat

SEQ ID NO: 21118 - DNA, 596 bp, Homo sapiens
ccaggcctcagcctgacaagctcacctcctggtggtcctgctcgggtagtcccactgcctcctgggaaagttgtggcctctgagagagggaggaattggaggtataaagactggacaggacattctgggtttcccaaagctgatattgcttaatgggccatgttcagaattcctgacctgtgtgggcacttccaggttccagaactttgccagaggtgccctcagtagtatctgaaataagaaaggtggtcagctggtcaatgtgttgcctctcatgaaatgggcatgggctcctaaaggaaagataataactttgtttcttcaatataccagtacatttatttctctgggctttctagttttaagagtttatccatatattgctcgtggaatatataattccctcggtgagtttacacagaaagtcctccaccactgagaccctttttttagggtttaattacagggagatagattcaggccaagtcacctctataactgcaagggaatgggccccatgctagcctgatgaagagggctttgacacagggaacaaaacacaaggagggaacgttgaagtgttggaactgtatcta

SEQ ID NO: 21119 - DNA, 607 bp, Homo sapiens
gaattttgttctgtagggaggtaaatctattttctcttgaagatacagagctaatttatttgactgaagcacttcatgacagcaatcatggaacacaaaaagaagctatcaatgtgcacacagaagcaagaacacaggccgtgcacacaggacaagcacagcaactgactcaaaagatgagcccttcccccagcagtcagtgggattcttctggtcttcctggaaaggataaagaacttatgagcactgtcactctaaaagggacagaatctaacgcaccttcatacaggccatctgaagcaaaaataatttggataaattttaaccagccgggtgcggtgactcacgcctgtaatcccagcactttgggatgcgaaggcagatggaccacttgacgacaggagttagagaccagcctggctaacatgatgaaaccccatgtctactaaaatataaaaattagctgggcatactttgggaggccgaggtgggcagatcacaagatcaagagatcaagactatcctggccaacatggtgaaaccccgtctctactaaaaatacaaaaattagctgggcatggtggcatgcacctgtagtcccagctac

SEQ ID NO: 21120 - DNA, 487 bp, Homo sapiens
ttgctttctcctaaagatactcataacattatttgacattatacctgagacatcttgtttgtctattaagtgtctgtgtgtatgattcatgtgagtgactataatataatctattacacacttagctatctgttttatatttacttgtgttttgagaacactaaacataataaacgctatcactggtgaccaccaaatgagaacatcttgacaatcatctcagatacgataacacaggtttcaggaacacagtgtttgacaccagaaaagaatatatggatttgaacactggtcagtatgtgaactttagtatctgatctattcttttacagtttggttttctcagtggtaaagtgaggatatattgaagtcttaacctttaaaaagatgcagtttctacttcaaacaatagagtgttacctaaatctctatttcccctacttttgcatcttggtgtgccttttaatcatattctttactgagttgc

SEQ ID NO: 21121 - DNA, 343 bp, Homo sapiens
accagcctcttatttggtagcacctagaattgaggccaagggaagtaaagagatcttgcatataattattgaagtttgttttatttgccttcagacttccttcttcatgaattcatcttttctctttaccgtatttcaggttctcaatcctttttatttattcatttattttaaatagagacagggtctcactatgttgcccaggctggtctcaaagtcttgggctcaagctattctcttgtctcagcctctcaaagtgctggtactacagatgtgagccaccgtgcctggacaattctctttatttataaagaaacctggccgggcacagtggctcacacct

SEQ ID NO: 21122 - DNA, 578 bp, Homo sapiens
atcctttttaccttcttcctcccagtcaacctctctctttttcacgtactctaccaacatccccacccaatctccccttatgcctccaaaattagtcctatcctgattgtggagtttggggttttctttgattcaatggatgataccagtcacaccatttgaaaaaagcatatgacagtgttgttcagtgttggtgaacaggaattcttgatatttatttttaaggattccatttaattgctaattacagatctttgttaaattaagccgaccttcactcacatttaaaaaatttaactttgttttggttttcatgagacaaatatctctctttaagtgaacaagcttttaaaagaattagcttcttcagtatggaaagcaagatgcaattcgcagctggtgcaatggcttacaccagtatgtaatcccagcactatgggaggccgagggggaagaatcccttgaacccaggagttcaagcccgggctgagcgacacagtgagacatctttacaacaacaacaacaaaaacaaaataacaataacaacaaataattacctcagcctctcgagtatact

SEQ ID NO: 21123 - DNA, 582 bp, Homo sapiens
cttcctagatgggatggcggccgggcagagacgctcctcacttcccagacggggtggcagccgggcagaggctgcaatctcggcactttgggaggccaaggcaggctgctgggaggtgaaggttgtagcgagccgagatcacgccactgcactccagcctgggcgccattgagcacggagtgaacgagactctgtctgcaatccccgcacctcaggatgccgaggctggcggatcactcgcggttaggagctggagaccagcccagccaacacagcgaaacccgtctccaccaaaaaaatacgaaaaccagtcaggcgtggcggcgcgcgctggcaggctgaggcaggagaatcaggcagcagtaccgtccagcttcagctcggcatcagagggaggccgtggagagagggagagggagaccgtggggagagggagagggagagggacagagggagagagggagagagggagagggcaggatttttttttaagtaagaattctttaccaatccttctttccccaacataaaatctcctatttgaagtgaagtttgaggtagggactcgagaggcagtgcctc

SEQ ID NO: 21124 - DNA, 572 bp, Homo sapiens
cagtcaatcttattcactcacagaatgaattgttcccaccctattcaaggaacttccttccttcaacccacctcacacactcccactttccacaaatacatttaattcagacatgaaatgggatttcttgacaacaaagcctcattaggaagagagtggatttcaggagaagatgctggaattatccctctcgtggcttatctctggtcctatcatgaccacaggatgttcaccaacatgctttcccagtctgtgcagggagaaataaaagctcagtaaactttgacaaatttggtcaactctcaagggaaacaaggtgtttatgacagattgtgtctataagatcttttctctatgattcccattttggttgtgcttgacatttaaaatgaaaactaacagagcagtgctgagcagaaacagaaaggaacagtgatgggcagtaaaccaggccttgcttagtatttggtgtcagtgccatgcattcttaccagcagcattcagtgtcaccacaaaaagtgacatcttcctgaggaactgtttacattagaagactaaagaaaagctaaaac

SEQ ID NO: 21125 - DNA, 571 bp, Homo sapiens
taggttagtttctgattggagaaactgttctgaggagctctgaaaaatagaactacatttatcaaagttttagtgttgataagaagggcacccgataggttttcattctcagctatgagtccacagacacgactagaggtgaaataagtcttattaaaagtaaaatccagtctcgacccagttcaatcacagaataaatggagatattcaacccctcaagctttctttctagcaaatgaaagggactctctatgatttgaaaataaaatcactctatcttgagtgtgtgtgtatgtgtgtgtgtatgagagagagagtgtgtgtgtgtggctgtgtatgtttagacatatgaagagtaaagaatatacgactaagaaaaaacagatattaggtgtcatcccagagataatcagtacatttcaattatcagataccataaataggataatcgtgttaaagttaattaaggaataaatgggaaaaatagaaaaataatgtcaggaaatttgaatctacatacagaaatcacagattcttttctgaagcaaaaattataactacttttttaaaa

SEQ ID NO: 21126 - DNA, 605 bp, Homo sapiens
cttatctttcattaaccttgtatcctcttagtgtctggcaaagggtgagtaactaatcaaaatttggtcaattaatattaattttaaaataattacatgtatattagtacagagccaaaactccagctcgaaactcccacctgctttcattacccttcctggtgggcttctctgcttccccattggattataagcttcttgtagaccaggattatgtgatacctcattgtgtgagcatgtaaatagttgatactcagtgttcttaatataattgaaatgtaaattattatgattacacagggccagcataattaataggccatacactcaactgagaatacaagagataagttgtttgcactgcagatggtattttctaaaaatgaataaagtggcatgaactgaatgcaagtttatgttatctctagttgaaaagaaaagtttctctcttaagcactattacgccttcttttggcagcagcaataattttcttcttaaattcacaaaagtcctaattcttgaaaaagtatgctaaagcaatgtggtttactcaaacaacagcaagcgctctctgcatgattccttttcgaactttctttaagct

SEQ ID NO: 21127 - DNA, 586 bp, Homo sapiens
taatttttagtgcaaatgtagtatttcttaattattatattgtttatttggaagtcaacggtattagggttctctagagggacagaattaaccatcaagtcaacccagctgtgacagttgggttttactctgatttatttggggaaggctaagtgctaggaatgtatttttagtatgataatctgtacaactgatgtcaaaccaatgtattgcatgaattcgcaaagtggtcccatgacacttccaaccttttaagtagtcttcagatttttaaaagggcataaattttttcttgaaaacgctgtcacccaccataaatttgactttctatattctcttggaattgtactagcttttcaaggctgagaggatgaaaagtagggggcagcatcatgtgagtagaggatggttgtctgtggactaaaggaatgagctgagctcctcaccttcttatgacttcagaaatcacttactgacaagaaggctgacggtaactaaaactgttaaaaagctaaagttagtgtcctatcttgatatacttctctttccccaaaccaagggcaaaaccattcagacctgtcctctc

SEQ ID NO: 21128 - DNA, 598 bp, Homo sapiens
gttacttaacaatatttttcactttctaaccctagttctgttgccatgcaggtatgatttagattgacttatcaattaagttatgtaactgcttgaaattaacattatgtgtgtcaatgttgtgattacaatcttcaaactactggtttcacagactgacagatgggataattttagcaaagcctcaccttcttattctattgaatatggttcctactcattgtctagggtagaggttgacattacagttcactctaaagtaggaatcctctgagctcacaagaacaccaaaagcagcattaggaagcctcccaaaagatgacatctattgtgttgcctacacaacaacaacagaaagaaaaccttgagtgtagagaagagaagcatccaagaaactatacaggacaaaggaaaagcctaataaaaactgaagcccaaaggaaagattcaggtcaagaaataacatgcacctgacttcaaattatactacaagcctacagtaatcaaaacagcatggtactggtaccaaaacagatatataaaccaatggaacaaaacagagacctcagaaataacaccacacatctacaaccatcag

SEQ ID NO: 21129 - DNA, 538 bp, Homo sapiens
attgtttcaaaggagtgctacttcttcctctcacatccaagcataataaaaccttaagagaatatttgtgtaatcaaatgctgatgagtagaataaagaaagttaataggaaaactataatagacttatggttacataatggtgagtcatgagcagtatggtcatttttatatataagaatgaacttgatgaaggaaagctactttaaaaacaatacctagcatatcacttaacagggaatctcaccaggcagccctataaaaatcagcagtttctttctctaaaaatcaacagtttcttccttccttcctttctctctctctttctttctttccctctctttttctttctttctccttttcttttctcttttcttttctttctgagacacagtctcactctgtcacccagactagagtgcaatgacacaatctcatctcactgcaacctctacctcccgggttcaagcaattctcccacctcagcctcccgagtagctgggtctacaggcgcacaacaccacacccagataattttt

SEQ ID NO: 21130 - DNA, 534 bp, Homo sapiens
gcctcatttaaccagcactgacagcacatgggcgtttcacagaatttaacttaccaaatagcctaaagttatctttccttataaagttaaaacattttcatgggcagtttttcaaaatgtatgcaattcttccttgcttttttgcatgtagcaggcattgcttgattaaactttatgttggatgacttaaccttttcataatgactcaatgtcatcattacaaaaattaattattactctgggttataatacagtattgttctcaggagtttttgaggtttggaaagatatttatcttactaaaagctctagagtgctatgattcttcttattagaaggatgagggtaaagaaggggtctaaactgaatactcagttcccatggctctgattttagaggtcattatgtaattctcagacacctaagttttgaggctatccctggaagaaactaccctaaagtgggagagaacagaaagatctctttgagcacagaggacatctactgaagcccaaataattttatactatcagc

SEQ ID NO: 21131 - DNA, 600 bp, Homo sapiens
agttattaggtgacgcagtagagattgtaactcagatctgtttgacatcacatttattccttcctaaatagcttctatttttatggacacaaatcttactaattatggataactgatgctgggattaggcatacaaacaaaaatgtagtaggctagctagaatgaataagcaaaatgtaaaatgtttttaacagaaaatcaacattatcatacttaaaaacagtttgtctaagaaataggaagtattgatagttttgtcttaattacttaataggaatccttcttatttaaatcattaattccttgatatacaaatagatcttgtataaatgaacaacataattcattctaagtattcttggaatactttgagaatcttagaattcgtgggaagtcttctgtaaagaacatgaagaataaacaaaacacttttaaaagttattataggccgggcacagtggctcacgcctgtaatcccagcactttgggaggccaaggcaggcagatcatgaggtcaggagatcgagatcatcctggctaacacagtgaaactccgtctctactaaaaatacaaaaattagccgggcatggtggtgggcg

SEQ ID NO: 21132 - DNA, 594 bp, Homo sapiens
cacccaggctggagtgcacgggcacaatcatggctcactgcagatccaagctcctgggctcaagtgatcctctcacctctgcctttcaagtagctgggactacaagtgccagccatcccacttggctaattttgtttcaagagatggggtctctcaatgctgcccaggctagtctggaactactggccttgagtgatcctcctgcctcgggctcccaaagtgctgagattataagcttgagccatcatgccaggccagatggtgcacagtttttaaatgaaatatttaaatcatataaaaactcatggggaataatataacgaatataatacgatacaatgcatacaatgaacaacacaatggcctaatatatggcaagtcacctttattatctatggacctctttttacccctccagctctccccaccaatgaaaaccattatcaggccaggcacagaggctcacacctatgatcccagcactttgggaggctgaggcgggcagatcacctgaggtcgggagttggagaccagcctgaccaacacggagaaacctgtctctactaaaaatacaaaattagtcaggcttggtgg

SEQ ID NO: 21133 - DNA, 516 bp, Homo sapiens
aattcatgctcattaaggagacgactaagtgaatcaacgacatcactaaggttatttctctatcctcgcatatgcatatagattaattcagtactctaataaatgtacaatttgatgtcactgtaatctcctttctctatatgtcatgcatcctaaatagtaaaatgatcatagggctatagcatgctctatatccagtttctatagaacatcaagtgcaatacgaaacacagagttctcagcaataattgaaggactgttaaagcatgaattaatctaacacatcaacaatcaaattaagaatcttgtatctttaattttaataagacaagtagaccttttgaaataaactcaaggtcataaaatattacctataaacataaacattggataaatgtgtaaaccacatctcagagttgacaatgaatgaatcacgaatgctctttttattaacaagtttgcgaagaaaactaataaacaccacatattaaaaaatacgcatatatttgctatata

SEQ ID NO: 21134 - DNA, 522 bp, Homo sapiens
gaaggggcgaggagggacagagattgtgggggcctggcacattgagtagactctgccccatcccatgtgcctgcaaagaatgatgaagtagtggctgatatagctgctcccgtaaccagccatactaaagcttgattctacccgccacctgcaagtggaaaggagaattccatgttgaaatggaattcagggcccaaagctgtaaacagcattctattgtcagcttgtgtcataccaggaaactctaacacatgacaaagataatcatcacagtcttaagagtttgggtgctatcggccagatcacgaggtcaggagtttgagaccagcctggccaacatggtgaaacctcgtctctactaaaaatacaaaaattagctgggcgtggtggcgcatgcccgtaatcccagctactcaggaggctgaggcaggagaatcgcttgaaaccagaaggcggaggttgcagtgagctaagatcacgccactgcactccagcctgggcgtaagagtgaaacttcatctc

SEQ ID NO: 21135 - DNA, 591 bp, Homo sapiens
ctctcctttgtccttgggcctcttcgatcacttattgtaatcgtcatttattgcaattgactacttgcgcctgtagtcccagctactcaggaggctgaggcaggaggatcgtttaagcccaggagtttgaggctgcagtgagtcataatcgtgccactgcaccccagcctgggcaacagagcaagaccttgtgtctaaaatttaatataaaaattattttttatattaaatcatggaatatttcaaacatacagaaaaccttgtctcctgtatgtctcctatcatgccccttgatgacagggacacagattcattacttcttctgtgccccaatcctcagcctagagcccagcccagattaagtgttcagtagaaaaacaaaacaaggccagatggggtggctcacgcctgtaatcccagcactttgggaggccaaggtgggcagatcacaaggtcaggagttcaagaccagcctgtttaacattgtgaaaccccgtctctactaaagacacaaaaaattagctgggcgtggtggcatgcccctgtaatcccagctacacaggaggctgagggaggagaatcgcttgaacc

SEQ ID NO: 21136 - DNA, 559 bp, Homo sapiens
gtagtggaaatcttgttttatatgcattattgaccagtccattaattaaccgtctcacaataattaacatcatgttaccttttagtttatatcaggaaaacctaccagagttttctaatctgttaaactgctgataaactgccagctagagtttttcccactcccccaaaatgtttaaaggtgtcatgaatgaggtatattatgttttctggctcatgatttggcaatccagtttgtcattacatattacacagagttgtcatggataagaagaggtggaaaatgtccagtaagccagttttactctgcttctgtcaatttataacaagctgccccttgaaatttactttctgattattcataagtattgtcactgttcttggaaaaggaaaaatgaaaagtgcacaataggccaggcatggtggttcacacctgtaattccagcactttggaaggccaaggcgggtggatcacctgaggtcaggagttcaagaccagcctgaccaacatggtgaaaccctgtctctactaaaaatacaaaaaattagtcaggcatggt

SEQ ID NO: 21137 - DNA, 524 bp, Homo sapiens
aatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggct

SEQ ID NO: 21138 - DNA, 536 bp, Homo sapiens
attccttatcaatccatcatagtgaatttcagagtggcccctcaataaacacatgttgaaatgtttgctaagagagccttgtggctacttccaaatttttcttctgtaacctgaaagcccaggacaacaatttctatggcagtgctacattgggtaattatttcttcctttctttttaagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggtatgttaaactagttaatctcttttgtaataatttcaggaggtccttgttaatatatagtagaacagaaacagtttttacttatttaaaattcatacctgcttcttctcaaaggttttcagcatcttgatagtcagagggaaacattgtagtaagacagtctcta

SEQ ID NO: 21139 - DNA, 97 bp, Homo sapiens
aaaaataaaaaaataaagaaaggtaaagaagtcagtcaagtattaggtactggctactggcacctgtaacttcatgctatttacaaaaacaggtgac

SEQ ID NO: 21140 - DNA, 532 bp, Homo sapiens
ggaggtggaggttgcagtgagctgagatcacgccactgcactccagcctgggtgacagagcaaaactctgtctcaaaataaataaataaataaataaataaagtagatgattcacagaaacctctgttcttttagagcactcttcaacactttttatgctttttatgtttgatttctaataaatatgtttctttcactacaccataagtatattccttcttctaagtttcattaaggtagaatcacgtatgtcttatttcctgttatatccctaagtacctagcatgtagtaggcattcaataaaaattgattgaatgattgaacactcaatcccatgatttgagtgtttttttttgtttttgtttgtttgtttgttttgagacaaagtcttgctctatcacccaggctggagtgcagtggtactatcttggctcactgcaatctctgcatcctgggttcaagcgattttcttgcctcagcctctcaagaagctgagactaactacaggcatgtgccaccatgcccagtgat

SEQ ID NO: 21141 - DNA, 598 bp, Homo sapiens
ctttgcaattgctctgcctccttttaaaacaaaacttttgcccttgctcatttctacttggagctgtcatttcttcctcttagcatcaataactccattttgctgtttagatcgtatcttcctcagaaaagatgttccagacttcactaagtcaaattcctttgcatagctcttggcacagttgtggtgttacttttgtgtgcatgttagttttattccttcctttatcccactgatctgagtttacagatcagtgggatgtgactggtctgtttttattcattcttgttccctaggtgactaatagcatagccattgagacatagtaggtgctcagtaaatatttgttggatgagtgtttaggtttaagaaagtatctttgcaaacatttgcagcattatcttttaatatttatagctagtcagtcatatatgccaatttctgcatctacctatttgtcctctttaactgtatatgccattagcagcaaagcagtaatatggatattactggcaggtttaagtcattgacaggtaagttaaaacaacaaacaaacaagaagggaagggagaccaagtatttaaaaaaaaaaaaaaaa

SEQ ID NO: 21142 - DNA, 530 bp, Homo sapiens
gaaagtactttgataagcaaggttatgacaacttcaagctgttaactcctttaaattctcctcatcttttgaggcaagatcatgttcttggcatggcccttcacaatcatgaagactgcagtataggacctagcctcttttccctgcatggaaatccagtaaacctggattataagaatgtgtggttaaagaggccaaaacataagactgatgaagggtgaatttagagatgtgtagtgaataattaactttacccaaagggaagttcggcctttgttctttgctgctgttgggtaacctctaggctctgagtgtcctgcctgagaggaatatctttattctagaatttgtccacaggaaatctaacaatgtgacatgcaatggaagctttgaaccatgccctataagttcagagttccagatgaagtagagacaaaatgcattagtcttatctcttggctgaggatgggaactggagactaaagtttagccacagagacagtatgtgatcaataaaaattctgaacact

SEQ ID NO: 21143 - DNA, 527 bp, Homo sapiens
aaacagatatattaccaaaaaagtgttcaagacctgcattcctgaacaataaaaatacttgaacaatatttaatattaagaaaatgtcaattatccttaaattgatgcacaaatttaatatgatctcagttgatataatgtggattgtgtccctgcccaaatctcatattgaaatgtaattcccaatgtcgaaggtggggcctggtggaagttgattggaccatggggatggatttctcatgaatagtttagcaccatccctcttggtactgtccttgcaatagtgtgtgagttcttgtgatttctggtcgtttaaaagcgtgtagcatctcattccttgctctctcttgctcctgccacgtgaggtgcctgccccccatttgcctcctgccatgattgtaagtttcccgacacttctacaaaagccaagcagattccagcaccatgcttcctgtacaacctgcagaaccacgagccaattgaacctcttttctttgtaaatcacccagtaccaggtatttctttat

SEQ ID NO: 21144 - DNA, 382 bp, Homo sapiens
ccttccaattattcgctattactgcaccagtaacttgtgtctccccttcaatgtaagtgccataagtacaaggactctgtgtttaggtatgtgtgagctattcacaattataatggaacagtgagaataagtcactaaagatatcagtgtctggcatgtaataataacagcagatcagtcaatatgttattaaatatttaaactatggggaaatgggaaaagagaaggctattgcctaggtaaatatcagtgccatgatgatgggccatggtagcttgtttcactggcacatgtttcattgaaccaagcttctgcaaaggcttggtctcagcacctggaaaagcagtcaattgaaaagatatagtggtggtgtgggtgctgc

SEQ ID NO: 21145 - DNA, 605 bp, Homo sapiens
aaatctatctttttgtctatcaattatctacctatctatctatctatctatcatccatttatcatttatctatcatctgtctaccatctattatctgtcctatctatctattatctttcttcctatcttatccatctatccataccatctactgatctatgaaatctctctcactatctagctacctatctagctattatatatcatctatctataatctttcatctatcatctgtctttctatcttatccatccatcaatccaaccatccctccattcaactatttcatctagtgatctttcaatcaaatctaactacctatcatctattctatctatctatttatcaatctatctatacatccatttcctactggttctgtttctctggcaaatattgactaataataattctagtctcctaatgatgagatatcattgtcagatagatctatgaattcagtttgactaaaagcatcaatttcagcactagggatcaatggagaaaagagaaataaaaggaaggctgcattttcttggatgagcaagaataaacaaacagagctaaccagccatacaaacactcagcatccacctatcattct

SEQ ID NO: 21146 - DNA, 585 bp, Homo sapiens
ggagaactaacatgcgccctgcaagaacacattagcccttgtaaatcaatcgttcctctgccttacagattacctgcaaaatgttgtaataggtgtgatttttaatttcattaatttggccaggcacacctgtattcccagcaacttgggaagccaaggtgggaggatcacttgagcataggagtttgaggctgcagtgagctgtagtctcactacttcactccagcacaggtgatggagtaagaccctgtctctagaaaaaaatccattgattaataaatactaataaataaaacccagtgcggccgggcacggtggctcatgcctgtaatcccagcactttgggagaccgaggcgggtggatcacgaggtcaggagatcgagaccatcctggctaacatggtgaaacctcatctctactaaaaatacaaaaaaattagccaggcgtggtggcgggcgcctgtagtccctgctactcgggaggctgaggcaggagaatggcgtgaacccgggaggtggagcttgcagtgagccgagattgcaccactgcacttccggcctgggcgacagagcgagactctgtct

SEQ ID NO: 21147 - DNA, 541 bp, Homo sapiens
acaccatgttagtaaggctggtctcgaactcctgaccgcaggtgatctgcccatctcggcctcccaaagtgctgggattacaggtgtgggccactgtgcccagcctccagtaaccctatttttgcatttgatgttgaaaattgctcacatatgatggtaatcctattgaaagacttgaaattagataaaatgttagctgtgaaacacttcataaaaaaaacaaaacaaaacaaaacaggccgggcagtggctcatgcctgtgatcccagtactttgggaggccaaggcgggcggatcacgaggtcaagagatggagaccttcctggccaacatggtggtcaagagatcgagaccttcctggccaatatggtgaaaccccgtctctactaaaaatacaaaaataagctgggcgtggtggtgtgcacctgtggtcccagctactcaggaggctgaggcaggagaattgcttgaacccaggaggcagaggttgcagtgagctgagatcgcgccactgcactccagcctggcgacacagcgagac

SEQ ID NO: 21148 - DNA, 590 bp, Homo sapiens
tattcctatcttgcgtgtccaccatctattgaaagccacatcaaaaacttaataggctgcatgtatattgaagaaaaaggggggagccagcaataactggatacatatcttgcagaagatttatgtgcagtgcaatcctatggtgattccaaggtagaattgactagacacccatatctagaatcttcttagttattacgctttgaaaatgcaatgaataggtacattggatatttgttttgtaaagaacactgaacattaaagagtgaagataaaattcagtttactactgtcttgtccatacaaccacagaatgctagctatgattgaaagatcttgtatctgcgagaatcaatatttatgagacctaacaattgtcttagagagatggacttaatgaactgcatgcagtaacttaaattgaccaaatattttgatagatttgtcggagtccaaaatcaagtaaaataatgtcatagagttttatattaacttgtaaaatggattagtttcaatccttttatgacagtgcattaaaaaataataacccatactcatctaaaatttctgttcatctgatcacagtgagc

SEQ ID NO: 21149 - DNA, 603 bp, Homo sapiens
tgccaaggagggctgggaatcttgccctacactctgctgttgcttttaaatgcggagaaggttggaggaaaaagaggtcgcatctgataatattgatcagactcaaagaagatgcgtgcctcatgccctcctgtctggtgcccagaggtggcagctgctcagaggtcactaggtcaccatggcagaagcaccgatgacctgaatgcctgtggtaatgaattcttccttagtcttgcctaagacgtaaactcagctgggcgaacaccttgatttcagtgttgagaccctgaacagggaaccttgttgtaagctgctaagtttgtggtgatttgctatgcagaatggggccacaacaggcagcttcgaggcaagttatacaaaaatgaaatgactgatcttgctcgcctgaatacgatggattaaaaatactatacacactttacatgtaaatgagcaatgtattgtctcacacataagaaatcctagttctacttgggttgtggattttctcccctcattgctgtaggggcctttcttgccttcgtccctccaagggaatattcagcacctgccatacctcttctgagcacactgtcttttctc

SEQ ID NO: 21150 - DNA, 501 bp, Homo sapiens
tggggctcaatagtttaatatattgtttaatttctacatcaatgatagtttaattggcattcatgcaaatcagttctgctgggagtttattatcctactccagtaacaagtaacgcattccttaaatatagtgtatgtataaattctacatggtaagtgaagctgtctttatgaattgctgctatagaatatactagattgtgtaggttttagtacaatccaggtaattatcaagcctttgtaatattttcaggaaagtgatcctttcacttcagtttatggaacttggaaagttttcagttaccacccacttgttagatcataaacttaattctatgtatctgaatttatttttctatttataaatttatctggatgttttctcaaaggtttcccgattaaaaacctatgactttgtaaaattaaaacagaagtaataagaattgtgttaaaaaacagaatcaggccaagcatggtggcttatgcctgtaatgccaacac

SEQ ID NO: 21151 - DNA, 595 bp, Homo sapiens
tttgtgatctgtcatggtcatggtatttcagagttggaggatggtctgagttctgacctggtgtaggaatcccttctcccaaaactctaacagtacattctcaggcttcgtgagctcaggcttaagacacattattttctgatgctggacagcttctttaaaaaaatgtagtttcttacattaagctaaaatttattttatgaaagttcaagaattctggtccaaattgggatgaggcctatggtgcaggacttccgtgaaattttatgagattacaaatgcaaaacacttagaacagtttctggcctattgccagaattcaataattgaataaaggcaggcagaaatataacagagataaatgtcatgtgctgtacttaggttaaagtatagaatatattagttctgttccatcttctaggttttttattttattttattttttcattataaatcctccactggaattctagggtttttaaaatcaatttttaatagctaaaataatgctttttcaatctagtaaattgtccctaactcaactttatttagaaagtacacatagcaaaactgccttagtctgggcatgttttat

SEQ ID NO: 21152 - DNA, 592 bp, Homo sapiens
atgcaaccaggcattcaatccaaccatacatccaagcaaccatccattcaatccaaccatacagtcaaccatccatccattcatccaaccactcatccatccatctctccctccctccctccattcatctatccatccattcatcccttcaaccatccatccattcagctatctatccatctgtcaaataaaagtatttcactcctggtacccatctagcaccatatattaaaaacataaggaaactgggattgactatcatcttaaaagccaattacatcacatcaggcatatcaggccatgcagaactgttacatccaagtgatacaaattataattactgttattaataataaaaaacagtttgcaaccaaacacatagtagaatcagataagataatgtttctaaaatgcctctcacagtgcctggcacatagtagatgacgaaaagttgatttcctgtaagtgtcaaccattgggctaaatcctgagataaaattatgaacaagataggcttggtccctgcccccatggaacttctatttgataagtgctatggtggcagcaaagagctcagagcatataacagaga

SEQ ID NO: 21153 - DNA, 597 bp, Homo sapiens
tttccgggggaaggacagtctattaatgtggcccatactgtccagcctcctggagcacagagcagtggacaaacagagctgagtgtatcttgggggcaaatggaacactctatgcatataaaaaacacttgcatgtactccataaatatgtaaaacattatgtatcaataaaagaaaaaatctagctcaaacagtaaacactcctgccacccctgaaactgacatttccttaagagggacatccaactgtgacctaaacacaatgcatcctgtcccctcccagaagctgaggtgtccatactcacagagggtccctttgacagctggtaatggctcccagagtctcttcctggaaggcacattgagcctggcaggcacccaagggcacatgaatctgacccctctggggattgctgtcagctgctgcagatggaaggtgctgcctctgcggcatctcaccacggagctcccattcctcagcaaccccccatacctgctggccaaactgggggaatagagacatgagggactttgacctgaatcccaagtaaaattactccaaaatatttgaaaatttgaaacaacaaatcatcccat

SEQ ID NO: 21154 - DNA, 592 bp, Homo sapiens
cattgttcttttctgtattaatagttatacttaaatgagctgatctagggctttctattaatctctattaactaatcatgacattttgattccatttaaaattgattttgtattttactaaaatatctagaatttgggtaatgctgaaaccctaaagataattgtgaattaaagtgatatctctctaacattaaatccaacatattttaaaaacataattatttaataatgttttcaaatgattccacacgtgaatagcactgaaaactataataagggcagtgatgataatattcaggctatcattccaggcactcagcatacccatctacttgaagatcatcaatttataagaaatgctctgtttgatagcattgctcaccgattctctaccaatacatttataagatttatgtgtgccttccaaattggcttcctactccagattcttagacaaaaatacatattggatggttaataaaattcattctactttccatttattacaagctatacttgaaaaaatttattgagcactgaaatacatacttgatctactgtaatagaaagggctccttgatgtgcctaaaga

SEQ ID NO: 21155 - DNA, 542 bp, Homo sapiens
gtaaataaatacttcaattctgccaggggaggtggctcacgcctgtaatcccagcactttggaggccgaggtgggcagatcatgtggtcaggagtttgaaaccagcctggccaacattgtgaaaccctgtctctactaaaaatatgtgttttagctgggcatggtggcacatgcctgtaatcccagctactcaggaggctgaggcaggagaattgcttgaacctgggaggtggaggttgcagtgagccgagactgtgccactgcactccagcctgggtgacagagcaagactccatctcggaaaaaaaaaatcaattataattttgtttacatgtattattacacaaaatggtccattattcagaagcctcccatttgaggtaatgattggtattattaggatcttttgatgaaatcttggttgaattgatgataatatgtttttaaaatatatagatgtttttatttcccaaataaaagaaataaagactctttacaatttaaggagaatattagagaatttttaaaataggtcaggcacg

SEQ ID NO: 21156 - DNA, 575 bp, Homo sapiens
cttatcctagacctctttccctggccctttatggcttgggctccgtagaggacaaagtgaataaaaccaaattttttattgcttcaaacagtatgatttcatcttgtaagatgtactttttcttttctaaggctgaatttgtttgatttctggtgaacacctatcttctctatccaccttcattcatttattcatctgttcaacacatacagtcggacacctactcggatcaaaagtcagagatcttaagagcacagcctctaagccagatcatctgagttcagatttcagttctaccattattagttcaatgatattggacaagttacttaacctgtctatgatcaaaagtcagagatcttaaagagcatagtctctgagccagatcatctgggttcagattgcagttctaccattattagttcagtgacattgggcaagttacataacctgtctatgctgcagttttctcatgtgcaaaatggggataataattatgcctacctcatagcgttattctgagaagtaaatgagttcataatgtgaaggccttagactaataactggtgcatatg

SEQ ID NO: 21157 - DNA, 487 bp, Homo sapiens
atggccgtgaggactctggggttgagctggagagtgaaacagacaacactgaacgagaagaccgacaatgcagtgttacagcagtgccttaccaattgatgagaactaaaatggatgttttatagcattttatctaaaaacagccccaagaaaaaggaattcagtttcattattgatatttaaaatggttataatctttcaggtggtagatggggagctccgcaacagcaggaattggaatccattcattcatttatcagtaacatgagcacattgcctagcacctagtaggcactcactaagcactggctgcaccaattcatgcacctttaactatctgctgagtacttagacacaattgtcagtgttaaactatattctgatttctgtattttaaaaatccttgggcttggcgtggtgtctcatgcctgtaatcccagcactttgggaggccaaggcgggcggatcacgaggtcaagagttcaag

SEQ ID NO: 21158 - DNA, 398 bp, Homo sapiens
catgtttctgaatttttaatacattttattaattcttgctgatctgtgaaacactaagaaaagtaaattgttttataattttgtctcttaatatcctccaaaaaattaattctattgctttttctttgcatacttcttggatactattttcctccctttgtgtcagtgacttatcacaggaagaaaaaaaaacgttccccatccattccttacttggtatctatagggctgtaagcgaagacattggctttatctacaaactgctgcagtcagattgttatggaaataggaattaattattgtagaagcagtataatgatcttctttggaatcagagaattaaaaccaggattcaaagcaatacccgtaagggaaagtggttggggtttatatcggaa

SEQ ID NO: 21159 - DNA, 452 bp, Homo sapiens
taaggaaattctacaatgctgctgtatgaatgtgcttgtgtctgttgccagaaacgaaggtgaaatattggcaagcagggaaaatatgtttgggacggaaggacagaaaatagggaacatgaaaataagactctagattttctgagggaagaaagacatcttgatcatttttttctgtcaccagtatctgacagaagaaatagttaaagataaatggtacaaagatggcactattgactttcatatctcttagtacttccaaagcaaaatactgtctttccactatctatcaaactataaaattgtttttgtttttatatttattctgtgtcatcaggataataagctatattcttcttatataggcaggatgataagctacacatgtaataagagttcaggtcacttttgtattaatagcaataatacatttacctattagcatgtcatag

SEQ ID NO: 21160 - DNA, 538 bp, Homo sapiens
ggtacattatatctctagaatgcatttttctttgctttcactgtcttatgtaatgtaatgaattgtagatgatggataggaagtgcattgttgccttttttgttgctggctagccaagtctttgaacaacatcagttatttactaatagccacaaatgtttacactgctaagaaaggaattattgactgggcgcagtggctcacccctgtaatcctagcactttgggaggccgaggcgggtggatcacctgaggtggagcattcaagaccagcctggccaacatggcgaaaccccatctctattaaaaatacaaaaaatcggccaggcggatcacgaggtcaggagatcgagaccatcccggctaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacag

SEQ ID NO: 21161 - DNA, 344 bp, Homo sapiens
acagaaggggttttacatggagcaaaaagacaatgtatttttaaatgtactttgttgaaggtgtgtgttgtcgagacaatacagcagtgaagagaaggcatgcaaagctgtcttgttggagtctggctaaagagcaccaaagcagcctggtgtgggatgtcctctgggggccacctggacttgctatgttaacatggagggactaggcaggggtatgaagaaggaagcccagcagagcaggaggcagcagcaacaatgagagattggttatccatatgacttggatctgtgtccccacccaaatctcatgttgaattgtaatccccaatgttggaggtggggac

SEQ ID NO: 21162 - DNA, 305 bp, Homo sapiens
aataggttttatgcaagaattaaaactgaagtgaaacaatggtggctttgtggctggctttgatgggctgatcagagcaggtcagtcagggttcagccagaggagtagaaccaataagatatattaagagatttattgcaaggaattggcctatgcaatggtgggggctggctgggaaggtctgaaatctgtaggacaggctgttaggaagggcaggctgtttgttaggaagggcaggctgttaggaagggcaggctggtggaatttctttttctttggagagatctcagttctgggtgggtgcg

SEQ ID NO: 21163 - DNA, 495 bp, Homo sapiens
cttatatgccccagtttaatcatctgttaaatggggttagcaataatagctcatactgttgatcatgagaaggatatatgacaagacatttacagttctttgtaacttatttgggacctaccaaagaaaatattataagtagtgtgttaatgtacacacagaaacattaacttgtgagttccacagatcttgggggtttcataagaagattactgagaaatctaaataacccagtatataaaactctgcatagcaaaatacctgatacatagtaagatgtccgtaagtattaattatcaatgtcattactttatgtatcacatatactgatatttatccaagcgtcaatcttgccttctttctcaataataaaatttcaatttttgtttgtggagacagtgtatccaggtaaaaagggcattttgcagtcttcctcgctgtttatgatggccaggtaattcagttctcttcagtgcagatgtctcctggggactt

SEQ ID NO: 21164 - DNA, 583 bp, Homo sapiens
  misc_feature 487: n = A,T,C or G
tgtcctgatgtaactccatggcaaaatggcaaggttatgaattcccctaacaattgcctacaaattctcatgttcagcaaccccaaatctcagatttttctagactctcaatgccttcagttattctgggaaaacaaaatccacccaaatgcaaactataatatccaagccttacagcctcttacaactgctactctagctacctcatacttgttcttcaggtcagaaggccaaaacacacttcgtttcttcactctaagtttaatatcttgccttaaatctgaggaagcattcttcctccataaacaaatgcatgtatttgtcttccagccaactgaactagaacttgtacactagtttacttagccctagacatccaaattgctccttccaatcaattccttccaatcccactttatagttctagcagagaaaactgagcaatccatctgattgccctgttcattggcctagggattgccattgngttaagcatgggaataataggtatgagcctcacagcccatacttattataccctctcaatggaacaccccaccaagctcaaacatatctcggacac

SEQ ID NO: 21165 - DNA, 544 bp, Homo sapiens
gaggagcctcctaggagatctttgacttgatcaggacaaaatcaggttttgccatattaggatagaggggatgagagaaacaacattgcacatagtttggataatgacgtgggtttgtaagacaactcttcaaacggtgtaaatgacaggagcacaggggccaggctggtatcagagaggggaacaaggaccagttcttagatggatttgtgtatcatttaaggaatttgaatttcacatagattggggatcccttgaagggtactcagaaggagttatattatcaggcagaaacatcactctggcggcagcatgagggatgggttgaaaaatttaaaacttgaagcggcaagtccattcaggcgactactgcaatagtcttggcatgaaatgacacattaaggcaagattgcccagggctttaacattgatattattttaaaaataaattgcctgtgctagtaatgtcctgtttctttgcttactggttgaagactcaatttttatagataatgcggaatagatttatacagccagtttagct

SEQ ID NO: 21166 - DNA, 600 bp, Homo sapiens
gggaagcttccaaacagccactagccatgttaccaacacatacctgtgcttcacagccagcaagcactctgagcatgtatgtgcctgcacccagcctggcaagtggtcatgtggcaacctactcccatgaaaggccactgcagagctgcatggccttgctgcacccacaaacattcacatgcagcccgacatccagtcctgcagcagctctgcctctccaacagactgccacagggatgcttggcattgctgtgctcatctagtttggtggctgccctgcctcactgaaaagaaagccacacagccaccttgctggcagcatctctgtaagctcaagcctggcccaacagccagcacagcagtagccactgactctctggagaggtagccagacagcttgtcagctctctgtgcccccacatgcccaacctgaaaaccaatccagtgctcccaccccaagaaaactatgccactacctcaaaagctctcacagcgtagaccactgagtcaatcacagacaccactgatgagtattacagccaaagaaactgcacagataccgtgctactgagtccacccagaatcaaagccattcaccat

SEQ ID NO: 21167 - DNA, 329 bp, Homo sapiens
cccacgttttttgtttccagacatttgtactgggacatgttcaagaggacactaagaaaacaaaatgatctttaacccatgtgtacatgtaggttccaaaagtctcaggcagaccgggctaggtcgctcacacctgtcatcctagcactttgggaggccaaggagggtggattgcctgagacgaggagttcaagaccaacgtggccaacatggtgaaaccctgtctctactaaaaatacacaacatgagctgggcgtggtggcaggcgcctgtaatcccagctactcaggaggctaaggcaggagaatctcttgcctgggcaaccagag

SEQ ID NO: 21168 - DNA, 589 bp, Homo sapiens
aggtagagaaatatggatcagggagtctcctccagtttttattaatagttaggggaatatctcttggcatttatattcagatccatggtgaagatcggaatgaagacaatagaaccataagcatcttttctttttttttgagacagggtcttgttctgtcacctgggcctggaatgcagtggtgcgaacatggctcgctgcagcctcaacctcctgggctcgggcattcctcccacctcagcctccgtagtagtgggactagaggcgtgtgccaccatgcctggctaatttttaaatttttttctcttttgtagattcagggtctcactatgttgctcaggcttgtttcaaactcctgggctcaaatctttctaaaggcattttttccaaagtgagtatctgaataagcacattattcaggtagtgaaaaccaatgcttagtgggaactttcttttgtctcaattactcaaaatttattatctcaaaaaagaatgctggctgggcacagtggctgatgcctgtaatcccagcactttgggaggccgagatgggcagatcacctgaggttgggagttcaggaccagcctg

SEQ ID NO: 21169 - DNA, 592 bp, Homo sapiens
tgttgggtctcaaaaattggtttgtggcttccttttcaaataagtcacatatactgaattgccaactgttaccaccctaccttttgtattaattcacaaatgtaggcaacctctaggtaggttcaatcttattgtctccataacgatcaacacacaactgataaaacaagcaccagtctcttacctttgcagactcttgagaaggtccctgacattagagagatttatggggtcaatggacaaatgctagatttaataaatacttaagatacaaagccgctgtatctatctcttggatcccttctgattgcccagtgtggagatcatggttcttgcaacttcaggacttggctgctgagaggagccaagaatgtggaaacagtgtagctcatttattgcttccatgttggtctgagattatgggaaaaaaggtactatcagtccatggttggattaataacaaggaagagcattaaagctattttgagacttttcttcaagtttgcacttggaaaatttccaatctcaagtaaagagaatagtggccgggtgcggtggctcatgcctgtaatcccagcactttgggacactg

SEQ ID NO: 21170 - DNA, 561 bp, Homo sapiens
cttaataaaatttaatggtattctttgatcaacctcaagtttcacaaaacacactgcactttcataagggctccccatggctgacagatcagccgtccaaaagaagggaagtgtcagagatggctctgctagactcacgtatttttcagtagaatctgggtcaggttgtggtggtcaggagatgcttctggagctctgggacccacaagcctgagtgtcatggtggagtattaggacaacttgaaaacatagtggcaagagaaggcttcctctctcccctgcagttcatcctccaccacacccaaagtgctaaatagatattggttaaatgaataatggggccgggcatggtggctcacgcctgtaatcccagcactatgggaggctgaggcaggtggatcacgtgaggtcaggagttcaagaccagcctgggcatagaggcaggagaagcacttgaacctgggaggcagagtttacagcacgctgagatggcaccaccgcactccagcctgggtgacagagcaagactcaaaaaaaaaaaaaaaaaaaaaatttttgggg

SEQ ID NO: 21171 - DNA, 415 bp, Homo sapiens
gtgggcacggagttatggagcctgtgggttcctgtccttgtgttcaatggctgtccttgtcacttgtggcacacctgggctgggcagggatgagtgtcacccaggcccactctgtaaggagagctgtcctctccaggcagtggcatctcagctgtgataactgggcaggtccactggccagaatcataccagacagaacagtgccagaggccacccccacctgcagctcatttatttgatccctactgactgccctgtgccaggcactgtggtaggccgcgggaatacagcagacaaaaacccctgccatgccaaagagggagccagaaaaacccacagtgagtaagtgaatcgatacgtaacacgttccatgcaaaatacactaggagaaaagtagagcagggaggggatgtct

SEQ ID NO: 21172 - DNA, 594 bp, Homo sapiens
attattaatacttcccagaaacccactagggaaccagaaaagcctggcactctgagtcatttcattcagcgaacctctgaaaagacaagccttctaggcaaaaagctttcctccccaactgccaaagggggaggaacctagaattttcaaaagctgagtatcttgtagtcctagataatttgagttcacttttagtttgatatgtctttgcctaaggaaaagactctcctgatgtgtgctgttattctccagtccactgtgaattttgttcttgccttgtcaccctaagtataaaaccacatgtctaaaatcacattttagatagggctataaaatttacagagtgctgttatatacattatctcattttactaaactatgaactcaattgccagccagaaaagctgatcagtgaatttaagagtttgtatttagtgaaacttttgaaactttgaaatagaagtgtgagtcagatagctgatgatttaaaacactaaagcctttctcaattgttcattagaatttaccaccactcttctttgtgacctcttctctactgctctgtaagcatctctcccataagttctctctctc

SEQ ID NO: 21173 - DNA, 471 bp, Homo sapiens
tggggaatagagtggctatttaggtctagcagcccttgggctcatttgctgaatgagatgggaagttattggacagtattgaacggagaagatatcatctgacttgtgctttaaaagaatctttgtgacagctataacaagaagagactataggggatcaaggatgttagcaggaagtccaatttagctgcaattacagatattcatatcaactgtggtagcaataaaaatggtgagagtggtggaattccggccatattttgaaggcaaagtcaataggatttgctaatgaattaagcagtatgcaatgtaatagttgtctcccaagactatgggtaagaacactacccactgaaacactggcagtgctttttaaaagcccagtgttgggccaggcattgtggctcatgcctgtaatcctagcactttgggaggccgaggcagtggatcacctgaagtcaggacttcgag

SEQ ID NO: 21174 - DNA, 509 bp, Homo sapiens
tgctttcagcaagaaactgaggttgtatcactaagaaaggggtgcttttccaagtgctacacctggaaagaatgaagcatttgttcgttcatgcttgcattaatattctttgagcacctgtgatgtgtcaggtctgcacgaggatctaggaatacagcaggaaacaaaagagccagcccctgccctaggagtttatgagcaagggggagagacagattcaaaaaatattcccataagcatataattacaagctgtgataaaacgtagaaggaaaaagtacagggaataactagagattatataataacaaggggacccaatatcccagtgagggtggggccgtgtgtgttcaagaaggctgaggcatgtttgagcttcgatgtggaggaagagttaactaggtggctcttcttctaggcagaaggcattggttgcaaatgagtccaggaaaagggacgaaggcatcttccaggaacagaagagcagctgtgaatggggcttaaaggatg

SEQ ID NO: 21175 - DNA, 586 bp, Homo sapiens
cagggatgattccctcttacaacattttgttttgttcattttgcttttccaagaggtagaaactgaatttacatctaaattcttggtaagaaaaattcctgaataagatttgagggtgtcaggtcttagaacagagatgctcatctcaggcaaaatggatcctaagggggagcaagccacactagacattcaacaaaaagcagcatcatgaacattttcaacagctcattgttaatgttcctcataaaaaggacaggttcacttgcactgaggattcttttagggtaagagccattgaatagcccttcttggggccaggcgcggtggctcacacctgtaatcccagcactttgggaggctgaggcaggcagatcacttgaggccaggagttcgagaccagcctggccaacaaagtgaaaccccatccctactaaaaatacaaaaattagccaggaacggtggtgaacgcctgtaatcccagctactcgggaggctgaggcaggagaatagcttgaacccaggaagcagaggttccagtgagctgagatcacaccactgcacgccagcctgggcaatagagtgagac

SEQ ID NO: 21176 - DNA, 602 bp, Homo sapiens
aactaaattactgtattcttcaactaatgggacacaatattcttttttttcttttttgagacagagtctcactctgtcgcccaggctggagtgcagtggcatgatctcagctcactgcaacctccacttccagggttcaagctattctcctgcctcagcctccaaagtagctgggattacaggcacgtgccaacacgcctggctaatttttgtattttcagtggagacggggtttcactgtgttagccaggatggtctcgatctcccgacctcatgatccacctgcctcggcctcccaaagtgctgggattacaggcatgagccaccgcgcctggccgtaatatcctttttttaatcccacttggaaatcacaaaggaagcattactaaattatgatttaattctgcatagttaatggaaaaatattttgccatgttttcaccttattacattttctcaatatcagacaaagacctgtttttttcccattaccaaagttgtggatcatttcacgtattttaaatggatttaatcctcattaactgagaaatacagttacctagatcctctatgctatctaaaatattgaccaaaaaaaaaaa

SEQ ID NO: 21177 - DNA, 307 bp, Homo sapiens
tatttctattattgtgatgaaaagaaagcaatacaagaagatgaagtgtttattaaaacatggttacttgtgataacatattcctgttgtacatgactttaaacatattcactgagggcatttgtccaaaacaactgtgaaatgtgtttgctgtgcgactcgggctaagttttttttcttctgattacagctctttttaatagactaatattaattcaaaatcatgttgaatgttgagaagttggcagccctgtttcctttttgacgtggttaaaaatgagtgtgtgtgtgtgtgtgtgcgcgtgtg

SEQ ID NO: 21178 - DNA, 525 bp, Homo sapiens
ggactccaccagtctgaccttagagccccacttttaaccctgtttacccagggcccccaggtacttcaaatctatattttgggccctgagctgttgcccacatttcactcagaatgtaatactcagaagcctgactgctttgtctctaccttgtcttcctggcttctgtaatcatttttcccctttttaaaccttttactttgaataattcaaatttatagaaaagttgcaataactggccaggtacagtggctcatgcttgtaatcccagcactttgggaggccaaggcgggtgtatcacctgaggtcaggagttccagaccagcctggctaacatatagtgaaaccccatctctactaaaaaaatacaaaaattagctgggcatggtggtgagcgcctgtaatcccagctactcaggaggctgaggtaggagaattgctcgaacccagaaggtggaggttgcagtgagctgagatcgcgccactgcactccagcctgggcgacagagcgagactccgtctctc

SEQ ID NO: 21179 - DNA, 493 bp, Homo sapiens
taagctctgtatactagaaactactattaaattaataatgatttctttattttgattattatactgtaattgtgttaaagaatatcctagttttaggaaatatatgcaaatatttagtggtaaagagatactatgtattcatctcaaattgaggctatctctcatataaatacatttttttaaattcctttagcagtctccttctttgtccatggatactactgtcttgaatggaatgggcactggaggcttgttaaatcactacgtatgcccatcaaaaagaaattgacaatgccatgtgttggccaagatatgaagcaggtcacattcttctaaattatggatttgagaatataaaataatacaatcacttcagaaaactgtttggaagtttctactaatgttaagcatacacttaccctatgacctgtcattgcacctccagggattgacttgtacacgaataattacagcagcactatttgtaagagcc

SEQ ID NO: 21180 - DNA, 569 bp, Homo sapiens
gacctgagggaaatgaattaacctctctgagcttcagtttcatcatctgtaaaacagtaacagtaataatagatctaggctaaaagtcatcacagtatgtagtaggcaagcaacaaatcttaatgccaaacaaatgcgagctgaatatgtcctttgaaaagactaagtattacataatgaaagtacttcattattgtctgcaatatttatattgacagaaccatattttcccaaagttaatgttatttctgggtgataaaaatgggcatttcttgataggaatttggtcctgtatctaagattaaacttcctttctcacatacatctgctctgtgttgccatataagtgatgggcagtaatgacatttttgaaatcactcaagccataatcctgctactccctcattccttacatagagatggtcaccaggaatactatctagttgccaatccctaatacctctctaatcaaggcacttgtttctttctcaccgtcttagttaagatatcctcatcattcaccagcagtttttaaactccagtgagcttcagaatcacctccagagccc

SEQ ID NO: 21181 - DNA, 359 bp, Homo sapiens
ggcctcccaaagtgctgggattacaggtgtgagccatcacctccggccgggggttaactaattaatcttgcctatctgtaaaagaagatgctgataacccctcatcagggtcataggagaattaaccagcctccagagagaaagccttcagctctgtgcctggtgcggaactcttcttcttgtggttattattgagaggctagagtgacctcccgttttgctgaaggccctctctggaccttctctgccaactttagtctggagctcccactgtatatcaaccctggcatactgtgcacttaccttttccttctttcctacctccatcaagaacacaggcacaggccgggctcacgcct

SEQ ID NO: 21182 - DNA, 502 bp, Homo sapiens
cacatgcacacacacacacagacacacatacacacagcatatggatatatatgtgtgtgtgtatatatatctccattgaagtgaaatagctagctaagtggtctaaagaaatcgatacagattccagaatgactcagtgttatacaagaaccaaaatgaaaatgacatctgaggggaagggaaaaaacataaaattgagaatcaggagacatggattctacattaactggtcagatgtactaggccaatcacttaacattaattgttcagatgtggtaggccaatcacttaactgggcctccactttttttttatcaatatggtgacagtgttggtagatgatcctaaatttctctgtcatttggacattccataatcacacttccaggtttgctcttgggtgagcatcaagtgggttggggccagaaaaggaaaaatttaggaatggtcaaggagaggtgctgccaggttacccgagtgagaaactggtagctgcagtagt

SEQ ID NO: 21183 - DNA, 516 bp, Homo sapiens
aatgtaaaaactaaggcacagagtggtagggaaaggattgccttagacaaagctaccattttaagttctggaccccagttgaattgtccacctggcgagagttttgcagggtggaaacaatgccttcagccagttatgaaataagcaaaagtctgttccctgagaggagacatctgcatgaaacctacaggcatgtgggaaccagatcttaaccttggtctcaatgcaagtatttgagaaattactgcaaacagcagtaactaccagttttgtcttttattattcagctttcttgttaacttcagagaagtgcaaatgtgaaatggacatcgctccatcccagcagaggaaaacataacatacagctaacagagacaaagactttctattgccaggaacaatggccaacactcatcactcttggtaaagacagtaggaaactgggattcaaacacacagtgaagaatttcagttagatgcaaggaagaaatttccacagggactgtgagtgataat

SEQ ID NO: 21184 - DNA, 437 bp, Homo sapiens
ccacaatgactatagcaagaggaaatatcatgacttcataaatataaagatctaacactggaggtgtagaggtgggaagcggtagagacagaagggtgaccatcatgtgactttattataaggagtattttatttatgtataaaagaaatacagttgggccaggcacggtggctcacgcctgtaatcccagcagtttgggagccagggcgggcagatcacctgaggtcaggagttcaaaaccagcctgaccaacatcatgaaacccagtttgtactaaaaatacaaaattagctgggcatggtggcgcatgcctgtaatcccagatacttgggaggctgaggcaggagaatcacttgaacccaggaggtggagtttgcagtgagccgaaatcgtgccattgcactccagcctgggcaacaagagtgaaattccatct

SEQ ID NO: 21185 - DNA, 526 bp, Homo sapiens
tgctcttccctgtgccttgctgcgtttttctctctttcctctggagccccattcttttgccacttcactgggccaggcttgttcccaaactatgagactttctcagtcctctgtgcttttgcccttgtggctgtttctgcctagagcaccccgcccttctcttcacctggcctattctgaggcttgtgtggggctacaggggagagaggagggcggctcagaccaaagttccagcagtgacagtgctgagggctcagattttgaatgttttgaaagtagcactaactgaggccaaggcaggtggatcgcctgaggtcaggagttcgagaacagcctggccaacatagtgaagccccgtctctactaaaaatacaaaaaattagctgggtgtggtggcgggcgcctgtaatcccagctactcgagaggctgaggcgggagaatcgcttgaacccaggaggcggaggttgcagcgagctgagatcgtgccattgtactccagcctgggcaacgagaatgaaactccgt

SEQ ID NO: 21186 - DNA, 532 bp, Homo sapiens
aaatctatctttttgtctatcaattatctacctatctatctatctatctatcatccatttatcatttatctatcatctgtctaccatctattatctgtcctatctatctattatctttcttcctatcttatccatctatccataccatctactgatctatgaaatctctctcactatctagctacctatctagctattatatatcatctatctataatctttcatctatcatctgtctttctatcttatccatccatcaatccaaccatccctccattcaactatttcatctagtgatctttcaatcaaatctaactacctatcatctattctatctatctatttatcaatctatctatacatccatttcctactggttctgtttctctggcaaatattgactaataataattctagtctcctaatgatgagatatcattgtcagatagatctatgaattcagtttgactaaaagcatcaatttcagcactagggatcaatggagaaaagagaaataaaaggaaggctgcat

SEQ ID NO: 21187 - DNA, 579 bp, Homo sapiens
gtttactctagagctatgggtcagaaaggggtttcagcatcagcgtctgcaacctttgtataacagaggataaggccgggcgcggtggcttatgcctgtcatcccagcactttgggaggctgaggcgggcggatcatgaggtccggaggtcagcaccatcctggttaacaaggtgaagccccatctctactaaaaatacaaaaaaattagccaggcatggtggcaggcgcctgtagtcccagctactcgggaggctgaggcaggagaatggcgtgaacccgggaggcagagcttgcagtgagccaagatcgtgccactgcactccagcctgggcgacagagcaagactccgtctcaaaaaaacaaacaaacaaacaagcaaacaacaacaacaacaaaaacagagcacaaaatcagtgatggagaattaaactctttagaaggctggttcagcctggtgcggtggctcatgcctgtcatcccagcactttgggaggtcgaggcagaaggatcacttgagcctaggggttcaagactagcctgcgcaacatggcaaaaccccatctctacaaaaaaaaaa

SEQ ID NO: 21188 - DNA, 573 bp, Homo sapiens
aaagccaatgtcagaagcacagcttagcgctgacaataaatgaacacttgaggtgcatgccctattttttccatcctttagcatcagggcagcttgaaacactgtgggtttctgccaccattctaccaaaacactccattactgacctactacattctgccaagtggttgcattttataggaacaaataaacaaagacactggtcatctcttcccattgaatgagaacagagatgtggccactatgatgactctccattgaggaatttggggcaatgatttttgcattcaatcccatcaactcacattaagtgagcaataaaggttcctagaaaatatgggttgggggagacctggtaacatctcacagctttctggagaatggcttcttgcctatggtctgctggggacaagcctgaagatgaggcttagaagatagaggggtgtaaatcagagaatgtcctgccaatcaaatattacctgcttcactcctttgatgcccccaagaattcagatttctctaccatgaaaaaaatatcagcacccacagggctgtcttctcaggccctctacc

SEQ ID NO: 21189 - DNA, 468 bp, Homo sapiens
ctgattctcatctggttctccctcatggtctgggatcagtcacttccattgcatgactatgcctgcctctcgcccacacactgctccctctgccagaggcacccttctccccctcctcttgcctggcttaactcttactcatcagttacttactccttccacccagcttaactcctcagtgtgctctgcttagatgcctcttctgggggcagggaggggcctggtctcgcactgctagtctagaagactgctttctctgtgctccaccacatcctgcacctccccagtcacagcagttacctcctggacggcaagctcactcttattcttgctcaccagtgtctaccaccatattataagacaatatcaagaaatcaaccatttgggccagatgcagtggtttacgcctgtaatcccagcactttgggaggcggaggtgggtggatcacttgaggtctggagttcgag

SEQ ID NO: 21190 - DNA, 358 bp, Homo sapiens
ttatgactttgactatattttacaacttgaaaaattttcatttttatggtgccatcagcctgctacttaatagaaaatgttttattgacatttatgttctttacctaatgatgtgtatttaaatgatggctgtcatcttcattagaactgactgttgaaagagtaataagaatgagaatacagaaacctggtctcattttaattgtacaaactgagaacataacattgggctgaacatttcaccaatttgactacaacatttaatttaaaaataatatatatctccaatattgtatgatcattattattgtgatttattatgcttactgacacatgaaatatatgtatatatgtatat

SEQ ID NO: 21191 - DNA, 596 bp, Homo sapiens
gcaaaatgtgaaaagatctaatcagaaacaatgaaaaagagtaagttatctgctgcagttcttctatttggtctcaccagaagctgctcacacagtcatttacttcagtttgtcactcctgagtctggcgctgccagccgcagagtgaaatcatttcaggtcagtcatgtaactgctgacccagagtttatcctaaactggggctatgaaaggtaaaggtaatgatatttcatgcttctgagcaaaaactcaagcctcgtgaggctgagggaagaattgccttgacctcaggccagagatgaagacgaatttatgccacttcttcctttgccataatattctttccttgtcctccccctgattacaaatataatacatatttattggccaggtgcagtggctcatgtctgtaatcccagcattttgggaggccaaggcaggcagattgcctgaggccaggagttcgagaccagcctgacaaacatggtgaaaccccatatttactaaaaatacaaaaattggctggatctgatggtacgcctgtaatcccagctacttgggaggctagggcaggagaatcacttgcacctgggaag

SEQ ID NO: 21192 - DNA, 545 bp, Homo sapiens
ctttatcactatagtagttacattagttcacttaactctcatgtccttcttatgtatgatggaaaaatatgcagtggtagatagaatgctgaatatgtattatctctcgtaatgataccacagagacacagtgttactgtgaaaaatatgtataatatttttctcaagaaaatccttacctatgagaccctatacgtggaaggtgaattgtttccttcaaagaggcaacttggtggatgttaagaagacagggaggacccactttgggatctggtgtcaagagtctagtcctatcattgtcacaggtttgctgtgatcagaagccggtcctttccatagtaaaaatcattctattgtgttacatggtatttacgaaagtgtggaacacatcagaatcaaatcatttaatgcaaaggaagcctcccacactttctaattttcttatagtgcttcaaattaagtcatgaaggatggctcgttttagtgctaatatgtccttgacacctctgtaacattcgccagcctcccttttttagaagagagag

SEQ ID NO: 21193 - DNA, 494 bp, Homo sapiens
cggggctgaggacacagcagccttatcgctaactgtggttctggccagggctctgcacaaggcaggagcagcaagctagttacgcagggccagtgccctcaacctgctctcctgtttttcctgtccttctcccttctaccaggtggctctttcctgctcaggacagtgctcttggacagaccctccagtgggcacttaagaggtaaggcgcaggtcaggtgtggtggctcacgcctgtaatcccagcactttgggaggctgagaccagtggatcacttgagctcaagagttcaagaccagcctggccaacgcggtgaaacgctgtctctaataaaaatataaaaattagctgggtgtgatggggtggacacctgtaatcccagctattcaggaggctgaggcagggagaatcgctcgaacccgggaggcagaggttgcagtgagccgagatcgtgccagtgcactccagcccaggtgacagagcgggactccat

SEQ ID NO: 21194 - DNA, 459 bp, Homo sapiens
taagtctccccttctcctcaaataactttcaaattgctgccaagaactatgttctatcttaaggcttttgagaaaaaactttcaatgaagatagccgcctaaagttatacaaatatagaagaaacgggataaaataaagcttagattggaaaaaatatttaagattctacaaaattcacgcgtaaacaagggaagctgagtaattgtatgttcaaatacttttaacaagtgcaaaacatgtaggcttaaagaaatagagctggccaggcatggtggttcacgcctgtaattccaacagtttgggaggccgaggcaggcagataacttgaggtcaggaattcgagaccagcctgaccaacagagtgaaaccctctctctactaaaaatacgtagatcacctgaggtcaggagtttgagaccagcctaaccaacatagggaaaccccgtctctactaaaac

SEQ ID NO: 21195 - DNA, 594 bp, Homo sapiens
ggtggtcactacttctggtgaaatcaactgcctgtttagtaaaaagaagacccacagacatttgctgagcatccatcatgtgccaggtgctatgctgggtgccttggaaggaaggccttcccaacttccagccaagatggggcaggcagacacatgcctttagctccacttccttctgaagtcccaacaaattatgggaaagaattaaagggcacaaggtcacaggaataaacagaaaaggaaataagaacatagccaacaggagatgtcagcaaaattctggaatctggaaagctgatgggtaatttatcactgatgggagattacagaaggtggaaagcaggttggtcaaagggcacagctccgaagcaagtccacttgtgccatgaatccccctaaggcttaggaaatggtggccctaggcatggcagaggccaacagaacagtagggctaaaaacaggaggaatctttgaaatgttttacaagtctgtaaaaggaattctactcctagatcccatccctaacctatttaagaaaccaaaagtttaacccgaaaatctttggacttagggacagcccagggcagagtatca

SEQ ID NO: 21196 - DNA, 515 bp, Homo sapiens
cgttcttgttgcccaggttagagtgcaatggcacgatctcggcttactgcagcctctgcctcccgggttcaagtgattctcctgcctcagcctcccgagtagctgagattacaggcatgcgccaccactcccggctaattttgtattttcagtagagacggggtttctccatgttggtcaggctggtctctaactcctgacctcaggtgatccacccgcctctacttcccaaggtgctgggattacgggcgtgagccactgtgcccagctggcccagctttttaatctcccagttcagaactcttgagcaatgatctagatattgtcctgactccagaatgtagaaaggtgattacttatgctagaatgaagcatatgctagaatgaaggcatagagaataacagataataaatagagagtaagcaagtagctggtatgcgggagtacagttggcttccttatccgagcattctgcatctgcagagtcaaccaacagcggatcaaaatactacaa

SEQ ID NO: 21197 - DNA, 526 bp, Homo sapiens
tcaaggttttggtgagcatattaccatgaggaagagcatggagtgggtgatttggacctcagggctaccataaggcctgatttccaagggaagaggaacatgagaccagagggctctgaattaaccctgttaacttgtcccaaggggactcaggcgactgttccccagctctagcaggagctggtgcatgttggcttccaggaatagagctcaatggtgcctctcacacatatggcctcccttgtaggagaaagctggttagtcctttgtccaccagaattgttttggaagtctcttgggaggcctataggtaaacttcctagcaacggatcagatgcactacttggggatctgtgggatccaccgccatgcctgagctcctgggctgtgattctctcacgccagttcccattggtctgtggatgacagggagtcagggaaacagactcagaggatgccctctaaaactgggaagcaaatatggagcagcagttagaaatcccgtgtctggggagttcttggaggg

SEQ ID NO: 21198 - DNA, 383 bp, Homo sapiens
gttactgaaatttttcaaccattgaaattttctctagaaatatattcaggtgcgtaggaagtgctgtttatttaataacacagggtcttcatatcagaggggtcgaatttagccctcatttgtttagtgtattatagaaatcatacaccaacacatctgctgatttttctcttccctctgagtcatatctgtgtctttaaccgttctctttgaacaactgtgtttgtattacctctcagggtttggatttcctccttattttttatctgtgggctattggtaagcattgttttaataactgcatttttgttgtacactctgctcattgtagtttttgtctttctcttggttgagtggaaaaaatgttttttttttttttttgg

SEQ ID NO: 21199 - DNA, 496 bp, Homo sapiens
  misc_feature 438: n = A,T,C or G
agacaaaacattttgtgattgaacccatacaatttctcattgtagagatgctttcccttcgacagtgcgatgctgtacaatgctacagcaacagtgcccatctctagtcacatagatggacactcctgcagattatctctccagtgtttcctcttccccccatcccttaacatctcttccacatttcccaattcttgtctgtttattgtgcatgctggttaattatttcagagctttcttcttcttcttcttttttctttctgagactgagtcttgctttgtcacccaggctggagtgcagtggcgcgatctcggctcactgcaagctctgcctcctgggttcacaccattctcctgcctcagcctccccagtagctgggactacaggtgcccaccaccatacccggctaatttttttgtatttttagtagagacggngtttcaccgtgttagccaggatggtctcgatctcctgacctcgtgatctgcccgtctc

SEQ ID NO: 21200 - DNA, 593 bp, Homo sapiens
agaggcatgggcacacagagaaggaagacagaagcagagacgggagtgatgcatctacaagccaaggaagaccaagaattgccagcaccatcagaagctacgagacaggcattgaacagattcttcctcggaggcccagaaggaaccaaccatgtcgacacctcagttttggacttcaggcctccagaactatgagagaataatttattttgttttaagccacccaattagtggtagttcctaacagccctaggaaaccaatgcaatgtaaattctataatttgtattcttgcaaaacatgaattgctttgtatgactgtaattttaatttacataaacaatatcatgctgtagattgcttctgcttgtttctttcatttcttgtagcactttctttgggatatatccatggtgtgggtacctctggtagcattcatttacgtgttcccaatccactcactagtgatgggctcccaggaggcttcagatccctgtccctgcaagcagggagaataaacatctgtacacacaccaaatgacttgtgcatgacaatttattttgttcatatacccaaacatggaattgctaagtc

SEQ ID NO: 21201 - DNA, 462 bp, Homo sapiens
gcctgtaatcccagcactttgggaggccaaggcaggtggatcacctgaggtcaggagtttgagaccagcccggccaacatggcaaaaccctgtctctactaaaaatacaaaaaattagctggtcgtgatggtgggcagctgtaatcccagctacttgggaggctgaggcaggagaattgcttgaacccaggaggcagaggttgcagggagccaagatttgaatccattgcactccagcctaggcgacagagcaagattctgtctcaaaaataaataaataaaaataaaaataataaaatatcataaactacaaataaaaccagatagactggttcaaatatatgctctggtattcactaatttaacttttgagagttagactgttttcctctgtgaaaggggaactataataactttgtatgctttgcgggaagatcatattacaatgtattgaaactcctc

SEQ ID NO: 21202 - DNA, 474 bp, Homo sapiens
tgatttaacataagggattaaccacaaagaaatggtgctgtcaattactatgaaattgaacaacatcacattagaaaagatatatgtatccactttagagatttgaagttgactcataaaatttacaaaatcaagcagcaaaaatattatatatccttacttctttgtagaacactcactctccttatgattgctttaggattaccactgagtacccctccccaacccagcttaggaaggaatgtgtctctggacctgagggaagaagaaaactataaaaaattgtatactacccatgtaaaaagcaggcaaagtaaaagctaaattttcagaggattgctaatatcagggactctgcaaatataaaattttctctaaatattcatataatttttgtctttaaattggggctagaatatcgaggatgaagattctgtcctttgaaaagaagactacaaatgaaattttatgatt

SEQ ID NO: 21203 - DNA, 322 bp, Homo sapiens
acagaaggggttttttatatcctttctggtaagctcactttaataagtttattgtttttggtttagcataactttgggtgactttaacatttctcagactgttatgggaaatgtggattcatttggacatgtactgacatctttcagatcatcacttttgtacattatatatttttaaaaggttgtatctacaatatttatgcctgtgtctatgataactttatttcaaagagatagaagagtttatggaggaatgtttcacatagcaagataaaatggtatgacagtggagcaggaaaattttgtagtaagacaggttaat

SEQ ID NO: 21204 - DNA, 581 bp, Homo sapiens
actaatgaaagaatagaaaagtcactgaaatgccatcctctcagaggttttaatcctcctgaagcaacagcaaataagtggacattttaagattagcatagaaaacatacggataactcaatataaatgcatgtcatagctcataaatgctctgaaagctccttctgagctattacagtgcatgctgtgaatgtgtattaacaatagtgcacaatcgtacattaaatacatcatatatttgcatatttagttctattcaactgttgattttaaaaatatactttctccaaagaactatagtcttggtttctagtagccataatttttccattagtgtctatcaaaatagtaacctagtttgatattattcaacttttaaaattgcatttaaattcctacaaaccaggaaattctctctctttctctctctgtctgtctctcttcctttctctctctctctctctctctctctctgttgctcagttacttagctatagctgaaattattattacttggaatttcaggaactcatctttctaaagattaacaacactttatacactttaacactctttagtag

SEQ ID NO: 21205 - DNA, 513 bp, Homo sapiens
tctcataggaattctaaccacaaacccacctgcacctacttttggtgataaaattcacataattcaattactcccacaacaccaaaataaaataatcttaaattgaatgcttagttccaaagtggccttggattgatggtgtcctcagggaccagacataagcaaattcaaatccttttttcaaagaagacactctagatacagaaactcagtcagcaaagatacaggagaaaaatgagcttgaaaaaatgatgacaattgtaattgcagaaccagttcaatctgtttcagctttgtcagtgataaaatgtaataaaatggtgagttgtttttcagttgccatgaatccccaggttgcaagtcaaacagcctcaggatatgcagatgaaccaagcttgcccaattcatgaccccagagctggcaagaacaaaaagtcaaccacatagggaacctaaatgtccagattggggaatggagaacacattaagaagcaatggggaacctgttttttt

SEQ ID NO: 21206 - DNA, 551 bp, Homo sapiens
ctataatttaccttacatggtaaagggatttagaagattaagcaaggatcttgagatggggatattaccctggattatccagtaatctaatcacaagggtctctataagaaggaggtagaaaggtcagagaaaaaaggcaatgtgataacagagtcggtaagagagagtcttgaagaggctatgctgctggctttgaaggtggaggaaagggccacaagctgagaaatgcaggcagcctttagaagccagaaacagcaatgaaatggattcttccaaaaagccttaagaagacacggagcactgttgacttattttggacttctcacttccacagctgcaggataataaatgtgtgttatcttaagccattaaatttgaggttgttatagcagcaataggaaactaataaagagaccaaaatcttcaaaaataacctactcaatatcaggccagataagtggaggtcagtcaaggctgggagaaggagggagatcactgaaatacatcactgcaatattttaaaattaaggagagtaactagaccctgaac

SEQ ID NO: 21207 - DNA, 484 bp, Homo sapiens
tgtcatcattacaaaaattaattattactctgggttataatacagtattgttctcaggagtttttgaggtttggaaagatatttatcttactaaaagctctagagtgctatgattcttcttattagaaggatgagggtaaagaaggggtctaaactgaatactcagttcccatggctctgattttagaggtcattatgtaattctcagacacctaagttttgaggctatccctggaagaaactaccctaaagtgggagagaacagaaagatctctttgagcacagaggacatctactgaagcccaaataattttatactatcagctttccagcctagcttattggcctaagccatcaaagcaggaacatacgagcttcaaggtgcaagatagtaaaatggtagaatttcttaggtcctgtgctattgaagctcaacttaaagaactgaaaggctggatcacaaggtcaggagtttgagaacagc

SEQ ID NO: 21208 - DNA, 592 bp, Homo sapiens
tgccttgagaaccattttccgctaaccttccagaacgtgtttgttctgtagcagtgctgctcagtctgggattcatgttaggattcattggaggacttatttaaaaataaggatgccgactgggcatggtggctcatgcctgtaatcccaacactttgggaggcctaggcgggtggatcacctgaggtcaggagtttgagattagcctggccaacatggtgaaatcccgtctctactaaaaatacaaaaagtagccgagtgtggtggtgggcacctgaaattccagctacttgggagactgaggcaggagaattgtttgaacccgggaaatggaagttgcagtgagctgagatcgcaccactacactccagcctgggcaacggagtgagacttcatctaaaagtaaataaataaataaaataaggctgcctaggacccaccctaagaatttctgatttaattcacttgaagtggagtgcagacatctaagtcagacctcctcaagcttttaactccagacatgtaagattgtccactacagaataatttgtaatagcaaagactggaggcaaccctcataggagcctggcta

SEQ ID NO: 21209 - DNA, 538 bp, Homo sapiens
ttccttatttgtatttatcagtcattttattgcaggcatggtaaaataaattttggggtctaggccattcattgactagactgctatctgtaatttatcaggttacttggacctgtctgccatcatcaagatatatggctggggagatagcaccataaaggaaacaattattgagaagataaatgacctgtgagagggctacaagtctctagagtgtgtgaggaaaggcagaaagttaccttggccaaagattttgcttgcatccatatatccagttggtttcgggcccaggaacagtgtattttcactgatagcttccccgtctttcaatttcattcttgttctcttagtcaatactccatagaaagtgcctctggccccacacttattattcctttggcctactgcagaaattagaatatattttgaatattaaaagtggcattcattgagcaacagctttatctagaaattatccaagtgtctcagagtgttttctgagtttaagacttagtggcaaaaaatggtggcatatgtg

SEQ ID NO: 21210 - DNA, 539 bp, Homo sapiens
atcataaacttcaacgtgaaggaacacacctggcctgtccaagtggctgctaagcccttgaaggtggtaagcccagactgagatgggctgaagtggaaaccacacaccagcctgccaagactaagtacaaaaaagaacacagacaactgcaataacttttgatattgatcatatggtaaaaatgatcatttttaaatataatgggctaaataaaatacactattaaaattcatctcaccattaatttctttacttgtcttaatgtggccacgagaaaatttagaattatattacataatgtaattacattacagctactagaaaatttaccatgattacacctcacattattatttgtgttgggcagcgttggtatataccctttgaatcagaacttgatccctaggaacaaatcctgaggaattaagacaggcgtataaagatgaacagatgagggtaatcaaggttgcctgtttagaacagtaagaaactggggggctgggtgtggtggctcactcctttaatcccagcactttggg

SEQ ID NO: 21211 - DNA, 535 bp, Homo sapiens
gtgagggggcagggccaggagcagggcatatgtgggtcatctctagccccagggtaatcagggcactagctctgtctggccccgcctgcgatgaagtagtacacgatcgcgttggggccctcatctgcatccactgcgcctgtcacgttgcccacgagggtgccgcgtggtgagtgctcaggcactgtcagcagctggtactgggggctgcctttctgcagagggagggggatgtcatcacttggggccaagggaagacccgagcttccagtccctgtttcagggccctgggcagtgactttgtaggtgctgagggagtttactgtccaggccttatggggtgagtagaaccgttgtaacctcaagggagcaaagcatggcccgcggacctgagctctgccctcacggagtgttgcccagaacccaaatgagtgcttaagtgagagaagcacacacgttactcttatatgtacatgcatgtgtatgcactcacactcagcagtcgccaaggaacatcacatcccatgtgcacaca

SEQ ID NO: 21212 - DNA, 414 bp, Homo sapiens
gagcagaaacttttgctaggctgcctctgctgtgagcaatattttaaaccttaaccacagcatttcttttctggctttcattttggtttttcccatccactttatggtcagttttcagtcttttgttcacagtagttacactttcatttctccgttttttatcttcatatttagaagagtcagttgcactactaccttttctaatttcctttttttcagcaacaacactgtttttacatttatcacacagaacttgcctgggtcgtagtttaatagcattcattattgaagtgggttcttccctgtacatttttcgtttgggtcgcttaattttccgaggaggtggctgaggtattgattggttatatgtgtccctgataaacaaagggggaggataaggtgctccttcatgga

SEQ ID NO: 21213 - DNA, 549 bp, Homo sapiens
aggctgtataacccttataggataaaaacacatgcacttgatctcgtaagagaacaattatcagccgggcacagaggctcaagcctgtaatcccagcactttgggaggccaaggtgggtgtgtcacctgaggttgggagttcgagaccagcctgaccaacatggagaaaccctgtctctactaaaaatacaaaattagctgggggtggtggcgcatgcctgtaatcccagctactcgggaggctgaggcaggagaatcacttgaactcaggaggcagaggttgcagtgagccaagatcatgccattgcactccagcctgggcaacaagagggaaactccatttaaaaataaaaaagagagagagagaaaaattatctcgttgggaagcaaaagaacgttgaaggaacaaaccagaaagacttaattggccatggtccccagggaagaaattccccatttctcaccaagtggtacctctgaaatttaaccttaagaggccaggtgtggtggctcacgcctgtaatcccagcattttgggaggctgaggcg

SEQ ID NO: 21214 - DNA, 537 bp, Homo sapiens
tggctccagggcactcactttgcattctctccttagctccctgtcctccaactgtttttagctctatgtggaaaatccaccaaatgatctcgtttttgtttaccactcaacctcagcttttggtgcatccgtggtttgaggtcccctcccctgcctctttcccttcatggtcctctgcccccacagacctccatctcctcatcatgttgctctgtccccttcttggtgtcccaggcccattttctaccataaagcccttcccccaggaccttccataacagcacgttgacctcacatgcacacgctgaactcacacacaaacacaatttttccttggattcactttgtagtacaaagccttaaattccaaggcttatcctcaataagtaaagaacacctcaagtttcaatggccttggactatgcctgtcaggcaacagactgtttgtggacagccaactacttaatctccccacgtaagtattggtacctaagtagctgtgctgtaaagctccacgctgatgccaataaagccctc

SEQ ID NO: 21215 - DNA, 514 bp, Homo sapiens
cagtggcacagtctcggctcactgcaacctctgcctcctgggttcaagcaattctcctgcctcagcctcccaactggctgggattataggcatgtgccaccacgcctggctaatttttgtattcttagtagtgacagggtttcaccatgttggccaggctggtctcaaactcttgacctcatgatctgccagcctcggcctcccagagtgctgggattacaggcgtgagccaccatgcctggcccaaatttaacatttttaagcaatttaagcacaaagtagctaaatatgtaattttgtgctaattcataggcagtattttggatttaaatacatcagtatttcacgatgttctgcaaagggtaccatcactgattggaggagtcccactgtatgaaaatgttgaaggtctgagtgtggtggttcaggcctgtaatctcagcacttagggaggcccaggtgggaggattgctggagcacaggagttcgagaccagcctgggcaatatagcaag

SEQ ID NO: 21216 - DNA, 242 bp, Homo sapiens
  misc_feature 181, 182: n = A,T,C or G
aatcccagtactgccaccaacaatgttagtatttgaaaatggcttaagacttattggtagtttttttgtccatagcatatattctactaggaccttatggtacaaattactgtgttttaaagttacttggaatagttctctatgtggttttgtcatcactggatatatagttaatattagnngtggatcacgaggtcaggagttcaagaccagcctggccaagatggtgaaaccccgtctct

SEQ ID NO: 21217 - DNA, 526 bp, Homo sapiens
  misc_feature 470: n = A,T,C or G
tcaaggttttggtgagcgtttaccatgaggaagagcatggagtgggtgatttggacctcagggctaccataaggcctgatttccaagggaagaggaacatgagaccagagggctctgaattaaccctgttaacttgtcccaaggggactcaggcgactgttccccagctctagcaggagctggtgcatgttggcttccaggaatagagctcaatggtgcctctcacacatatggcctcccttgtaggagaaagctggttagtcctttgtccaccagaattgttttggaagtctcttgggaggcctataggtaaacttcctagcaacggatcagatgcactacttggggatctgtgggatccaccgccatgcctgagctcctgggctgtgattctctcacgccagttcccattggtctgtggatgacagggagtcagggaaacagactcagaggatgccctctaaaactgngaagcaaatatggagcagcagttagaaatcccgtgtctggggagttcttggaggga

SEQ ID NO: 21218 - DNA, 487 bp, Homo sapiens
  misc_feature 420: n = A,T,C or G
ctactgtcattatgtctggctaacaggagaaactctgtgagtagctattaattaacaaagacaaagcacattaaagagaaaatggaaggagggagggaggaaggaaagtaaagtttgagaggaaaagaatatagattcataagtcctggggataagtaatgaagccttatgcttgctatattttttctttctggaaatatagtagttgtctgtggtgaaagaagaaagaagaaattacttgaacaaagagtttaaataaagacttgactattacaatgttaatgccaacatactacccaaaacagtggattgcccataataggttccataaatataattacgtttgattaaatcaaactggaaataccacagatttctggtattcttcataccactccaaaaggataataacagtaatanagtatttcatatatatacacacacacacacacacacacacacacacacacacacacacacacacaca

SEQ ID NO: 21219 - DNA, 504 bp, Homo sapiens
gagccaaatattcttatattctataatctgtgttcttcccaaccagaggtgttatctgcagagactttttttatcagactgaaatccgtcctgcctttttagaatgagctcatttttcttcactccagctaatgctgacatttaccaaatccagtcctgattaagtaagcttccatcaccaagaaaactggaaaaaaggtaggattcataagacagtggattcccatccagtgcttgtagctctgttatcctctttagaagtatctgagggttaacaaaattggaaattgtagaggaaacaaatttgcactgaatttagacctaatttacctgaaaatgggattcctttaaaatccacagtgagcccacagttttgtcctgtgactgagattcagtcacaccttgaccatgtatttatttcataaattaagccttcaggccaggcatggtggctcacacctgtagtcccagcactttgggaagctgaggtgggtggatcacctt

SEQ ID NO: 21220 - DNA, 442 bp, Homo sapiens
agaatgccctagagatctgagacttgcctgtcccataatcatgaatctagtttcttagaataaaatttggtatctccttctttctctctgtctctctgtctctgtctctgtctctgtctctctctctctatgtacatgcacatcctattgaataaatatgcatacatcctattcgttctgtttctctagagaactctaactaatacacttttttttcttatctcattgtgttctttagtcatccaatctttgaacttttgttgtcttgaaccgatggctattaaattgattttaaaattattcggaattttcttctgtaggccatgtgttcttattaggctggattctttgacaattttttcatgtagtcttcccttccatttcttccctttcttcctgtagccctcgctgtcttccttttctccttttttgtgtagtgtgt

SEQ ID NO: 21221 - DNA, 600 bp, Homo sapiens
cattatcttagactatctagactaaaatgccactcaaaaaaaatcaaaaaataaaaaagtgaaaatactgtccttttcatttaattacttatacctacactattattaagacacaacaaattttgttttccaaataactagctgtgggaaataagagaggagaatattacagattatcagaaagaaacaaagcaaacaagaatgattaaatattagtacacaatttgacacattttctgtattaaaattttatgtctaatatctggatttaaaaatttatctcaacaaaatattctttcataaagagttttagatggctgggcatggtagctcacgcctgggatcccagcactttgggaggccgaggcgggtggatcacttgaggtcaggagtttaagaccagcctggccaacatggtgaaaccccatctctactaaaaatacaaaattaggtgggtggtggtggcgcatgcctataatctcagctactggggggctgaggtacgagaatcacttgaacctgggaggcagaaggcggaggttgcagtgagccaagatcgtgccgctgcactctagcctgggcaagagtaaaactccgtct

SEQ ID NO: 21222 - DNA, 610 bp, Homo sapiens
gatgaactttaagctagggaatttcagctatcaaaaaaacccactgaaattgggagagcttcaaggaaaccacttcaccgttgttctcaggtaaagaactgcaggtgggaatgtagaccagagggtctggccagggcatcttgagtatgttactcacggttggtcataaggtcctggtggctggtactaacagaacaggagtggcagcaagggagggcagagcagggcctggcagggctgggagagcagatacctctgtgagagcaaatacctctgtaggatttgtgtggacaccttgccccttgaaaacctagtgcagcctttggaaagacaccatctccttcaaatattgtagtaaaagacaccgagccggctgggcgcagtggctcacgcctgtaatcccagcactttgggaggccttggcaggtggatcacaaggtcaggagatcgagaccatcctggctaatacggtgaaaccctgtctctactaaaaatacaaaaaattagccgggcgtggtggcagacacctgtagtcccagctactcaggaggctgaggcaggagaatggcgtgaaccgaggaggcagaacttgcagtgagccgagatcgct

SEQ ID NO: 21223 - DNA, 583 bp, Homo sapiens
gtttcaccgtgttagccaggatggtcttgatctcctgaccttgtgatccacccacctcagcctcccaaagtgctgggattacaggcgtgagccactgcgcctggctaattgtttgtatttttcgtagagatgaggtttcaccatattggccaggctggtccggaactcctgacctggtgatccacctgcctcggcctcccaaagtactgggattacaagtgtgagccaatgcgcctggccccattttgtatttttatagagtcagggtttccctatgttgcccaggctggtctcaaactcctgggcttaaacgatcctcccacctcagcctcacaaagtgctggaattacaggcatgagctactgtgcccagccaggaatcttaattgttgagacagcttcctgtggaggagagagggtagacccttactaatctaagttatgtctgtaactcgtcttttgacttagcgaatttggccttgagacatgagattcctaggacggggcaggacagactgaaaacaggaagagtggagaaccaatggcttctgtcccagcaaatagttgctccaggccactcccca

SEQ ID NO: 21224 - DNA, 547 bp, Homo sapiens
ccacatctctgaaatccagttttcagtgcaacaaactatgatttaattgctttgacctggcaggaaggaatatttcctttaaacctcaaacacagaagacctcaaaattaaagctcttcaaacgcataagatgcctcagcaatataacaaactcagggtgatgagagttttatgaagagtcagaagaatcatcagaaacagagggagtagattctaacatgtgaggaaggctgtgttatgtaacgtatggaacattggcggactttcagctccttggctgttcatctttgcctgtgctgggtctccacattctccttttaattggaatgtgtatttgaacagaaagtcattagaatagcaacttgtaggctttgtatgcaagccagtggttttcttgccaattttactgctgaacacttaaacttctaatggagaaaaatacttctcactgtggtgcgaagtaagctatcataaagaataggtcattagtggtggcagtttctaggagccgtggttattatccaagaatagaagatgctgaggaagc

SEQ ID NO: 21225 - DNA, 574 bp, Homo sapiens
gtcctcaaactcctgacctggagtgatctgcctgccttggcctcccaaagtgctgggattacaggcatgagctaccatgcctgacctcaatcatctttttattctccacacctggcaagttctagacacactgtggttccatacaagtttgttgaataaacaggagacagatagaaagtgggaactctggaagtagagaagattccagaaattgtgcatatttcccagagactgtggcccaattcctcagtcttgccagagtttctctatctcaactcaaaccttatgtgtgggcccaggcgcagtggctcacacctgtaatcccaacactttaggaggctgaggtgggcagatcacttgaggccaggagtttgagaccagcctggccaacgtggtgaaaccccgtctctactaaaaatacaaaaattagccaggcatggtgttgtgcacctgtagtcccagctactcgggggactgaggcacaagcattgcttcaacccatgaggcggaggttgcaatgagtcaagattatgccactgtactctagcctgggcaataaagcaagactgtccca

SEQ ID NO: 21226 - DNA, 602 bp, Homo sapiens
gatagaagttggtggaagaggagagaacggaaggcaaaccaaaagagaaattccaggcagaacaacttctgctttgcactggaacttttgctagaactcttgggaatgagtctctctttttctgcggggaccacttagcagggaggacacgcctggagctgcccgcctgagagagaaggccatgtggagtgggcagcatcaagacgggaagaaagccacggtcctgagaatgcagatttatttaatttgtataagcagaaaacttccagatcgagtcacaaaagactaatttgaattataaaaacagaatcaggctgggcgctgtggctcacgcctgtaatcacagcactttgggaggctgagacaggaggatcgcctgaggccaggagtttgagaccagcctgggtaacatagtgagaccccatctatacaaaaaaatacaaaaattagctgggcatggtggtgggcgcctgtaatcccatctacttgggaggctgaggcatgagaatcagttgaccccgggaggcagaggttgcaatgagccgagattgcaccactgcactccagcctgggttatggagcgagactcagtctcacaaaaa

SEQ ID NO: 21227 - DNA, 559 bp, Homo sapiens
aggttttacatcacacaccacgcaacataaacatctcctttaaaacttcttgtttttaatcctcaaatcttttctttttgccagtggcttcattagaaatgtttcctattggcctgagcaattcaatggtggtgcccctagattgtaaacaaccctcaggagaggaaaaagtccggttgttaattaaacagatgatcaaaattgtttttgtagggtgtgtatgcatgtgcatgtgcctgtatgtgtgtgctgggtggttctcatttcatctgggttcacttttgttaccttctttgctctttaaaacaaccccaagagatcatttagtcccattttgtagaagaaaagattgctgcacagaatgatttggaaccacgtctaaggttgcacagtttgtcagtaggggaagccacagtgccatacagacctgattctagtattcatgatgccagaaactggtcccagaaatgaaaggctgtggctttctcgattttcatagcagtgggtaaattcttctttctaccacaatggaccttcttcaacgggccctgagtaagtg

SEQ ID NO: 21228 - DNA, 586 bp, Homo sapiens
tattgttttaccaacacttttcttatgtacctgacttatatctggtaccctaatactttatgtgttttgaactttctagtgtcatgaaaagtgctaagatttggaagccagacagagctcgtttggctttgaatttgctaactatgtgtcttttgtattttctaaacatcatttttcctatcaaaaattgtgactaataatacctaccatctcacaagacaaattgtgagaatgaaagtaagaaatgtgtttaaaatgccagcatataatatgtattcatgttatggaagctgttactgctgatgttataattattactatttacttcagtgattcactagcagtgttttatttgactcacatattttttcttttacataaacattatgatgacaagaaatatgaagcctacaaaatgactttttttgtgtatgcaaagtcacagccagatcacaaattccaaatttcagtcaatgaagttttcactctagttatttctgattttcttaaactttatcttgatatcctcttactttcttttcctgagcttcatcttatcctgcagttactcttctctctttcccag

SEQ ID NO: 21229 - DNA, 442 bp, Homo sapiens
tactgcacattgcatactgaaatctgaaagaatgtttttgcaaaatgacttaatcatacttctctgagatcaaaatctaataacattactttcataacgtgaatttgttctatgttgacttttagtacttgaaatacaggcttaattaaaaatttgttggccaggtgcagtggctcacacctgtaatcccagcattttgagagattgaggtgggtggattgcttgagtccatgagttcgagaccagcctgggcaatatggcaaaaccccgtctctactaaaaatatacaaaaaattagctgggagtgatgctgtgcactgtagtcgcagctactcaggaggctggtgggggaggatcacatgaactcaggaagttgaggctgcagcgagccatgatcacgccactacactccagcctgggtgacagagcgagaccctgtctc

SEQ ID NO: 21230 - DNA, 576 bp, Homo sapiens
ggagcagggcgcagagggagaaaaaggactaactgtaaagcctgaaaggcttccatccaggccccggcctgcacctactcagtgcgtgatcttcggggatgaaggggaataatttcatcaccatccaggccccggccggcacctactcagtgcgtgatcttcagggatgaaggggaataatttcatcaccatccaggccccggccggcacctactcagtgcgtgatcttcagggatgaaggggaataattatttcatcaccatccaggcccctgcctgcacctactcagtgtgtgatcttcagggatgaaggggaataatttcatcaccatccaggccccggcctgcacctactcagtgcgtgatcttcagggatgaaggggaataatttcatcaccatccaggcccctgcctgccacttactcagtgtatggtattcaagggtgagggccaatgacttactcattcttagcctcggtttcctcatttgcaaaggctgatgctatcaaccttgcaggttatattaagaatcagagaatgtggctgggcgcggtgtctcacgcctgtaatcccaaca

SEQ ID NO: 21231 - DNA, 399 bp, Homo sapiens
  misc_feature 143: n = A,T,C or G
aatatcatatatgaaaacaggactttacactgtaaaaaaagtgaagtttacagtattattttaaaagcttattttaaattgaggtacattgacaataaaaaaattattcctaaaagagggggtcctatttgcacttatctgcnatttccaatagtatttctaacaggaaatcttaccagaaaagattaatttcagagcaagtaaaagtatatattctgcaatatttttcttaaaacagtataattttacgatcccctacacgaaaaactttttccgaaatttcgagatctccacaccactaaattaacagtaccaaagagttgctatcatgttactttcaaagtgactgtatatgaaaaacattaggacattttaagtgtttgaggggaaaatgtaact

SEQ ID NO: 21232 - DNA, 578 bp, Homo sapiens
tcagggagaccaggggggtgcaactagggtgtgggaagaaggaggaaaagaacatctttgataccagtttcttcccactccacgggagcgcagcatgcttcacttcaagacactcttcaaaagcttttcttttgccttctctaccagggacatttcaatgcagagaggccccagcctccaacctcctcagtggcctcaggaccgccctcttcttcagacaagtttcctagaacacagatttggggttgaagagtgctagacagagggcaggcaaaaggcagaaaaactaatagaaaaatcaaactgttgagccatttttattcttcaactgagcaaccaagtctccttcttaaagaaatggcttctcagccaaattcaattttattagagggcatgtagggcaaatatagaatggtaaaagaaagaggtgcatattccttattggaattaggcttagttaaatgctgaatttgaagcaaaaaagtagaatgtgaatttatattactccacccaaaaagatatttttcattaaaagtataaaaaacgtattttttaaaaaagtaaaatcaggctgggca

SEQ ID NO: 21233 - DNA, 523 bp, Homo sapiens
gcagggtgaggtgcattgcgttggcttccctgccagatgctgtaggaaaatacactggaggccaggtgcagtggctcatgcctgaatcccagcacttcgggaggctgaggaggtgggcagatcccttgagccaggagtttgagactagcttaggcaacatggcaaggccccatctctatgagaaatacaaaaattagccaggcatggtggtgcatgcctgtagtcccagcttactcagggggctgaggtgggaggattgcttgagcccagaaggtcaaggctgcaatcaagctgagactgcaccatgacactacagcctgggcaacaaagtgagaagctgtttccaaaaaaacaaaaacaaacaaacagaaaacaccagagacctggttcctaggttcatagcattctcccgtggaacataaacagctagtgtaagacctatcttcctccagaaacaagtgagttatgagtgcagatacagttcattgacagtcaatgtgatccataagctgggtgggacagt

SEQ ID NO: 21234 - DNA, 375 bp, Homo sapiens
ctatccctccccatgacaaaaagaaaagttacaacataaggcatattggagccagttcccagtcacagaaatacatttgaagatctacaatgttgcacaatgtgcaaatttggagaagtaattttgaggctaagtaaatggctggagactttattaaaatgtccctttgtctttgctggccaaactggcacctcaggatcacagaaggagcttttgtttcctccatgacatcaagaagctctgggtgcaaagggcagtcttcagagaatcctggaagcagagttgctcctgcttcagggaggatgtgcccttgccacctgcagggttagagggctttgggatgtgcccttattagccttgtttggttttgtgggg

SEQ ID NO: 21235 - DNA, 139 bp, Homo sapiens
aaccccaatttttttcgtctctttttgggccactgatggtttaaatgttgtgtctttgttattttcccaaaggtccttgagtttctccttttattatatttgtttctggttgtgtgtgtctgtgtgtgtgtgtgtgtgt

SEQ ID NO: 21236 - DNA, 407 bp, Homo sapiens
tgtgtctatgttcctaaagcactttgactctgagagagaggacaaactgaacctgatatatgatgtttgtgccccttgacggaggctgaattttctgaacttgaatgatcaatacaacagtgtcttgctaaaaattgtctggcagaaaatttttcattcatttttcttgatggcaagtaatgtattccttcatcagaacaattaaacatctttaatgatttttaaagacagggtgtaattacatgcacatgataaaaatttaagcagcaccaagggcgtacagtgaaaattaagtctctttcctgactggagatcatagtatgagtgtttcatggctcccttcagagagattccatgtctagcatttatacatgcacataaattcatttcctttttaaaattaacac

SEQ ID NO: 21237 - DNA, 500 bp, Homo sapiens
gcctagtctgaagcagtctgttatagcaatagaagatggaataaaaatgaggagaacacaaacattcagtccataacaaggattcgcagaattggaagcatgtgagtgagaaatgagtgctatacctttatttcaatttcggtaattgagatcttaggtgaaatatagagttaagtgagaaaatttactagaatgtctatagcactgtccattatccataatagtaaaaaccaaaaataattcaatgtccattgacaatggagtagatgaattacttgttgtacatccatgcagtaagaatgaacactccactacaaggacaaaatagataaatctctcaagcatcatgttgagcaagaggagctagacacaaagagtacattctgtatgattatttttatacaaagttcaaaacaggcagaacaaacctattgtgtaagaggaagaggacagtgattacttccagggagaagggagggaacagtgattggaaaggggca

SEQ ID NO: 21238 - DNA, 483 bp, Homo sapiens
taatgcctatggctattacaagctcttaagcttcctaatgcatttggttctttctgctctatatatcaacatctgctataaacattgaagaacagaaacagagtgctgtaattcttgggctggtttatgatgcagagtagaggggacttattcttctatattttaaaggccctgtagtattcttcgtattaataatgcctaacatttgtttaatgtaatatactattcaagtactttctaatacatgaccctgtgcaatccttacaatgtttctgtgaagtaatattattgtccctatttcacagatgaggaaactaaggctgtgaaaactgcaaatcagaaacatgagtctaaagcgtggatgtttttccagcatatagagcgtaggtgaaagacctactctttcaagatcagaaaactgctgattccaaaccatctagtttgtagcgggagaagagtatgtgagaattgagatagaaacaa

SEQ ID NO: 21239 - DNA, 464 bp, Homo sapiens
ggtaccagttattctctgtttcaaagactagagttcattataatttttttatcacataagaaatatttagcgtgtagccctacttcaacacttatccaattcttattttccacaaagaaagctcattaagcttattttgatgactcagaattagaggatacctctcaaatttcttctcccacatacttcactggttgttctgaactccaaagaaagaaaaatcagaaggaggccgggcggagtggttcatgcctgtaatcccagcgctttgtgaggctgaggcgggcggatcactagatcaagagatggaaaccatcctagccaacatggtaaccatcctagccaacatggtgaaactccgtctctactaaaaatacaaaaattagccgggcgtggtggcatgcacctgtagtcccagctactcaggaggctgaggcaggagaatggcatgaacccgggaagag

SEQ ID NO: 21240 - DNA, 527 bp, Homo sapiens
gtagtcccagctacgcagggaggctgagacaggagaatggtgtgaacccgggaggcggagtttgcagtgagccgagactgcgccactgcactccaacctgggtgacagagcgagactctgtcccaaaaaaaagaagtttctgtagcctgtagtcccagctactccggaggctgaagtgggaggatcactggaacgtgactgtcacttgagggtatgatggtcagctgggtttccacccctttgatgcacttcaaatcctgtgtatcccacaaagacttgctcctttctaaaggctatggtttacgttcaacagaatagcagcaaccaccataagcctgaaggctggctagtctttaatattctgccctattcaaagaaatgagtctttccctcattcctaaggatctcccaggtccattacaaaaaaagaaggagcagcaaggtgcagtggctcatgcctgtaatcccagctctttgagaggcccaggcgggcggatcacctgaggtcaggagtttgagaccaccct

SEQ ID NO: 21241 - DNA, 479 bp, Homo sapiens
ggtggcgaaaccccgtctctactaaaaatacaaaaattagctgggcatggtggcgggcacctgtaattccagctacttgagaggctgaggcaggagaatcgcttgaacccagcagacggaggatgcagtgagccgagatcacacgattgcactccagcctgggtgacaagagcgaaactccatctgaaaaaaaataaagaaaaagaatttcagagttttctgtctcaagaagtcattttcctacatactggaaacagggtggtcattcctaaaacctctgagtctgtccccactaccgcctaacttcctagccaaatccaagccttgagaaactccgctggaactgcctgctatttcccaactgtgctgacaacttcatgggtaaaagatgccattgtggccgggcgcggtggctcatgcctgtaatcgcagcactttgggaagccaaggcaggcggatcacgaggtcaggagatcgag

SEQ ID NO: 21242 - DNA, 597 bp, Homo sapiens
acaggtagaggccactttggtaccattgtattccccaatccaacccaaccactatacatacacacacatacacacacacgtgcacacacacacacacacacacacacatcaattgttaacaaggacaattttagagtataaccaattagtaaagatataattttactaagtagaacagggacctaaaatacaataataacagaaatagaaagcaaaaaacaaaagtaaacctcaacaattattacttatggacccaagcactctgcttaccattttacaaacatatctcacatgttctttacaacattctcacaagggcaatatttatatccttaatttacagaagaggaaagtgagacttagagaagaaaagcaattttccaatgtcaaatttctgcttgtggcaaagccaaattaaaacttaaatattattaggccaggcgcggtggctcatgcctgtaatcccagaactttggggggccgaggtgggtggatcatgaggtcaggagatcgagaccatcctggctaacacggagaaatgccgtctctactaaaaatacaaaaaattagctgggcatggtggcgggtgcctatagt

SEQ ID NO: 21243 - DNA, 470 bp, Homo sapiens
tacatgttcttcctcctgcgtagaaaggatcgtccctccactttcgccaactaatccctgctcaacttttcatctcagcaggaggcccattctctttggcaatcctctggcctccagcccatttattatatgctcacatgtcaacatgtacttcgtacagcatgtaacacaattgcacttttatattttaacaaattatatttcccatattgaactgtaagtctcctgaaagcaggaattttgttcttgctcatcatcaactttttcaacatccattaatattcctttaaattaggatggcaaagatcatatatagaaaattggctaagctgtggtccattcatgtttgctcccaattaaggagcacagctatgaaaaggaaggcttcaaattaataaccaatagatttttttaaaaagaaaactggccaggtactgtggcttatgtctgtaatatcagcatgttgggag

SEQ ID NO: 21244 - DNA, 518 bp, Homo sapiens
taactgcccctctgtggaggggatcccaatacccagaagctattgctgtcaaaggtgagtgggttagcaaaaatctctgacatttcatccagcagattgccaactaggcaagattctcgttaaagcctaaacgttgctctctctctctcttattctctctctctctgggtggtgtttcctccagcccccagaagtaccttggatgggaaagtttcatgactggttgcctggcttactgctgctgctgactgactatgtttgcagtgaaggtgctccaggccttcagcagcatcctcctagtgtttgcgtatgggcaggtggagcaaccattgagtaaagatggagcagggagaactgagtggtgaaaataaggcagcaggagagggcaaggtcacagtggaaagacctttagagtcaaacagctaggttcaattcctgggttcctaattaatcatgtggctttgagaacatcactttacttcaatgtgtgtctcactgggttggagtgagggataaat

SEQ ID NO: 21245 - DNA, 329 bp, Homo sapiens
ttcaaggatgtatatttccattttgcagatgtagtcactgaggttcagagtgtccgtgtggtctagtggatgatgtgggctttaaaaatatatgtgagataaaagaatgcgaatctgctagtattacttggtagatgaaatgaggtggctaggtaaggcatctaacgtgtcccccagcagggacagaggaaatctccactttgtccctccactgggagaatgtacactaccattcagaagctttataatgtgtaagacacaggtccaacccaagaatcaaatcagtgctctctccgcttcactggaggttttaaagggatgggggtgag

SEQ ID NO: 21246 - DNA, 370 bp, Homo sapiens
tacggctgaactcattcagggtcacacagctatatatggcagatctgggatctaaaccaacattaattttaaaattaatgctctttcctttatgtaaccctatctcctaaagatcaattatgaactccaatgctcacttaaggaaaagagagaattgtcaacttttaaaagaactatacaaggttgttacagtgaaattttaaaactggcctattaagctaatgttatctagctttaaaaataaaaacaaaatcaaggagttaaaaacagcataaaaacatgccaaagacttaccaaaatgtcaaacaaattttaaaggaaagctcttagctgagggcaaataataataatagacaggactcatatctac

SEQ ID NO: 21247 - DNA, 498 bp, Homo sapiens
gtttcaattttatgacacaacagaaaaaagaagaaactctttttattataatttaaaaaatataattggaagtgaatataaaactgtctttccaaagcacaggcaacttccttttgggcagacaaaaagcactaatcacttcggggggttccctgatttctttggcacagttaaaatgcattaaaagtatgactgatcacagagaatggaagtcccaagagaaagctggtttggattttatttcctttaagtgcacactttaatctcttagctaggagattttatgcaattgcctattttatgtatttgattccttgttttaaaaattgctctaaggtagatgctttttaaaaagcaaacaaactatttatttattcaataaacatggattatgcctgggtcacagacacactcatatcaggtgtctaggaattacctgtggtaaattttctctcaattacataattcaatttaatataatagaaacgtcatttttga

SEQ ID NO: 21248 - DNA, 542 bp, Homo sapiens
acaccatgcccggctaatatttatatttttagtagagacagggttttgccgcgttgtccggtctggtctcgaactcctgacctcaggtgatccaccagcctcggcctcccgaaatgctgagattacaggcgtaagccaccacgggtggcctaattcccttactttttaactaattcttcactgttacatttaatgatacagtgaagatccttgtttgtatatctctgtacatatttctaaatatttctgtcaaatagactctagaaatagacttactgaatcaaaaaagtacacacattttaatgttgatagatatcggttaactgccctccaaaaacactgtgccagtctccgttcctctatggaatataatagtactaaatttctggcaagacatgatggctcaggcacataatcccagcactttgggaggccaatgggggcagatcgcttgagctcaggagttcaagaccagcctggacaatgtggtgaaattccatctctacaaaaaatgcaaaaattagctgggcctggtgacatgc

SEQ ID NO: 21249 - DNA, 454 bp, Homo sapiens
gacaatgaaagtggtccagccatagaaacttatctcctttcctctctcctatcctcccttctcctccctgcctgttctttcctcctttccttccctctctcctctcttccctccttcctttctctccttcccctctgggtccgggctggtggaatgaggggaattagtcctcagcagcggagtgacaggaatggttctggatggcatggccaggctgcacttcatcttgggaggattcttatcctaacttggagttaacaaattaatccaatctaagggttcattcttatagtagacacttctgttttgttaaataaacagttttagcattcctccattcttcattctactaacgtttgggttccagagttccagcagaaaatcaagacgtggttgggcatggtgcctcagcctgtaatcccagcactttgggaggccaaggtgggtggatcac

SEQ ID NO: 21250 - DNA, 345 bp, Homo sapiens
attagggaggcagacctgatgttgaatatgaaggtgagaaaaaggattaagaaataattcttagtcatcaattttgtgtcactatgtacattctggtgccaggaatgtgtagagaaggctgaggaaataaaaaaaaatgacttaaattttgtatatgttgagatttagctgacaggatatatacgagggtgtacactaggtggtggatagagagcttatgattaattgtgatagagattagctgaatagagagcttatttatttattttattattattattttttgagatggacttttgctcttgttgcctgggttggagtgtaatggcgtgatcttggcttact

SEQ ID NO: 21251 - DNA, 515 bp, Homo sapiens
aggtgcggtgtaatcccagcactttgggaggtggaggcaggaggatcacaaggttaggagttcaagaccagcctggccaatgtagtgaaaccctgtctctactaaaaatataaaaattagccaggcatggtggtgtgtgcctgtggtcccacctactcgggaggctgagacaggagaatcgcttgaacccaagaggcagaggttgcagtgagctgagattgcaccattgcactccagcttgggcaacagagtgagactttgtctctgtttttaaaaaatgaagtgtctaaatgtcattaatattgcaatgagtaagtaaactccaagttatatatcagtaaaaatcagtaagctagataaacatatatcaaacaaatatcaaaaacattttgcagactgaaaacacattatagaagaatatgtataatagcaactatagaggctgggcatggtggctcacgcctgtaatcccagctctttgggaggttgaggcaggtggatcacgaggtcaagag

SEQ ID NO: 21252 - DNA, 492 bp, Homo sapiens
ctcccatgacacctggggattatgggagctacagctcaagatgagatttgggtggggacacagccaaaccatatcaagtagggacatgtggaaggattcgtggatagcactaagatgtcattgaaggttggagactacctttctgcaaaggccagtttctgagatgttgagttagatggtgtcatgggcaggaagcagtatcatacttgctcattacttgttatctagtccaactgcagagagatggcaggacaatttatcctagaaaacaggcagggccaaagcagcaatcagctgggatgggggaaggagtagcatagcttaagagctctactttgaccactatggaaaccaagagttttaagcttggccacacttgaattctaatcatatcatagagtgaacaagaactgtttcaatcatgatgtaatctgagaataaattcaccaacatgacctcgttgcaaatggggtcagtttttatttttaacat

SEQ ID NO: 21253 - DNA, 568 bp, Homo sapiens
gtccagctgatggaattttaggagactgcttgagaacattagttggaaacataaaggagtacactaggaagtgtctctggattccacagtcaccgggagccagggtgccctgtttgacttccgcctccgtaacactgtgttttgcactctccccactctgctttatataccagtgtctcccagcctgggctgcatcttctgaggtgactctcaaaaactttttaaagttactgacgacttggtctcaccttcagagattctggttcaatgggtctgggcgggtctgggcattagtatttcttaagagcccgccaggtggttctaatgtgcagctgggttgaaatccgaactttgtagttcttgggacttctttaccacctaaccgagtggccagtcttccggaaccagaggagcgcgtcactccgcagattctcccaagtggatcaacttgggatcacttcagctcctgcatagatgacaagactatgaaagtagaaactaggcctggcgcggtggctcacgcctgtaatcccagcactttgggaggctgaagtgggcggatcacctg

SEQ ID NO: 21254 - DNA, 267 bp, Homo sapiens
gtatgtgtgtgtgtgtgcgtgcatgcatgtgtgtgtaactttttcctttgccagcgggaattaaacttacttggtgaaagagacagcaagaaaacaaaaggcagtatttaacattttaggtgaaacagtgggggttttagacacgacaatggtgattacagttgatggataaatagatagcactttatgatcaattactctgagtattttagaatatatgaattgccttagagatatgtgctcatgtgtatgtgtgtgtgtgtttgt

SEQ ID NO: 21255 - DNA, 583 bp, Homo sapiens
taattttgcacatgcagttgtttctgcctgaaatggccttgccatcttccctatccaattgctatctgtccttcaagatcctgatcggtgaagcattatttctgcctccaggcagaaagaaggtgctattctttgttcatccataatattggtcatatttccttatggtaacttattttagtgtattagaaccatctgtttacttcaatatttcccttttattggtggggggacattttggactcagttgagaatctaatgaaagtaatgaatcttctcactggaaacatacacatacacccaaatttttgcccatgagcaatctcattaactactctctccccaagcccacccaccacatggacactaggtgaaaaaaaaactagtttacatactgctaggcccagcctggtggctcaagcctgtaatcccagcactttggaggctgaggcaggcgaatcatttgaggtcaggaatttgagaccagcctggccaacacggtgaaaccccgtctctactaaaaatacagtaattagctgggtgtggtggtgcgtgcctgtagtcccagctactcgggagactg

SEQ ID NO: 21256 - DNA, 524 bp, Homo sapiens
atatttcaatttcattctcttcttctaagcctttaggatttcagctattacatgattaattcactgagtgcagtatgtcacttcgtcatgtctcctggtttctatagtaagtgttcagtactcttaagtctaatgttttctttgaggcattggaagtcagacttctttttttcccccaaatactttagcttcattagctcatattttctttctgaaagtttttaaaattcctcatagaaacagacaggtttccatagttttctagcttctcaagttgatacatacgtaaacttaattgatatataatttgcatgccacaattcacctaaagttaacaattctatgagttttagtatacttatagagctgtgcaaccactatcacaattcattttagaacagatcagtacacctttctaggaattctttagttgaaactactgaactttccacagctctgagacatggtagttctgtttttgtctctaggtcaaattctaaggctgggcatggtgggatcacctg

SEQ ID NO: 21257 - DNA, 561 bp, Homo sapiens
gaaacaaaaatctgaggctgagctacagaggagaaagaaatgtattccttttcacatttgggtatgcttgagaatctctaaacagcacaactgcaccaagaattctcttgcattattactctgtactattaatttgtttgttgatagcagcaaatgagcttccacttactgagtcctgtgtgagcccagactatttcagcacttaagagtccttcaatgactacctcagaggtggatctcagggtgtctggggctcctatgcacatatgtttcttgttgtttacaaagctctttggacttaatctgaatgacagttgccctaaaaagctggagacaaatgattagccataaagttttatttttcaacatttaatttttagaataattaatttaataacagattttagggcatgtattccttgctacttagtggtttatgtctcttttaggagaatacctcattatgttctctatattgtcacataagagatgctggttctgcttttgattctaggagtcagtttaagtgaccatagatgatatacgtagtgtatatcatct

SEQ ID NO: 21258 - DNA, 512 bp, Homo sapiens
tttgagatggagtcttgctctgtcacccaggctggaatgcagtggggtgatctcggctcactgcagctccacctccctggttcatgccattctcccgcctcagcctcccaagtagctgggaccacagatgcccgccaccacgcccggctaatttttttgtatttttagtagagacagggtttcaccatgttagccaggatggtctcgaactcctgacctcgtgatccagccgtctcggcctcccaaagtgctgggattacaggcatgagccaccgtgcccagccatgatacagcatatttaagaaaaaattaaaaacctgaatagacctatagtaactaaaacttaaatataccctcctctttgctagccttcatcaaaaaaatcccaggtgagttctatcaaacattcagagaacatataattccagtccttcacaaattgatccagaaaacagaagaagaagaaatgttaccctgttcattttgaaacatgttaaaccttgggcagcata

SEQ ID NO: 21259 - DNA, 288 bp, Homo sapiens
agagtaagttttaaaagaagctagtggattttaaaaagggcaaatattatataaggaacatgaatattataattcatgttattttcatgttcatacagaatacttacaaaaattaacattttctggtccataccacaaattcaaacaattttcacggaaataacgtgacacagaatatatttcctaaacaaacagcaatgaaggcagatatcaatacaaaaacgaaagctagaaacataagtgtaataatattggttggaagctattttaatgaatattgtaatatgt

SEQ ID NO: 21260 - DNA, 505 bp, Homo sapiens
aacacgtgggtacatggaggggaacaacacacaccagggcctctcagggggacagggggtaggagaccatcaggacaaatagctaatgcatgcaggacctcatacctaggttatgggttgatgggtgcagcaaaccaccatggcacacatttacctatgtatcaaacctatactttctgcacatgtatcccagaacatgaaataaaatttaaaaaatatatacactgattcatgatctcctttctctccttctgaaacactctttaaaacattttagcatttccccctctgtcttccatgtctcctaactacatgtttcttattttccatgtctttattcctgtgttcattttggatagccccttctgacctatattacagtttactagttcactcttcaactgcttctaacatactaatattctgttaaaaccattcatttgggttaaatttcaattatgttattctctatggacattctatttgttttcttttaatcttcttg

SEQ ID NO: 21261 - DNA, 588 bp, Homo sapiens
agcccctaccaggctttcccacccatcctgtctacaaggaccaacagatcagtgctgaggtcagagtgtacgcacactggacattctgatcattcttgctagtttgctcctggtagcttaaaatcttaaaagggagttggtaatctcaccacctatgttcagccaacaaccaaacactagaatgtcctatttgcagagctttatacattttgaagcactttcacacacgttggaggctcacaggtgtaagcaaatgggcaggtatcaagactgggtttcttggctgtgcacagtggcttacacctgtaatcccagcactttgggaggccaaggcgggtggatcatttgagatcaggagttcaagaccagcctggccaacatggtaagaccctatctctactaaaaatacaaaaattaggctgggcacggtggctcatgcctataatcccacactttgggaggcagggcaaggggatcacctgagttcaggagttcgagaccagcctggccaacatggtgaaatcccatctctactaaaaatacaaaaattagctgggcgtagtggtgcacacctgctatcccagctac

SEQ ID NO: 21262 - DNA, 554 bp, Homo sapiens
ctagccacattcttctgctttattttgctagaattttgcttttgggggtataaaatatttgtaagccatctaagcttttgtttccagtaacatgcctacattgtttttaccaagaatgaataaaccaaaaagcatatattttttagcactggatttagtgatataacgtagttacaacttgatttagtactattcttttctgcatacatgatcatatattttagtttgtgaggttactggcctaaaacttttgaaatcactcaaggtggagattttatctctgtagcacagaatgttatttaattacagtgtaatctgatagggatgaaaagattaaaataaaatgagaaaagacaaaataaaatatagttaaacctgatttttttcttcattgagagtattttataaatgattacttttataaatctgcataataaacaacatttatattgcatatgtcttccatacataaattcaaaaccttggattcatccaaagccatgtggcattttaattaaaagaggtttggaaaatgtaacttgcaattatataaa

SEQ ID NO: 21263 - DNA, 437 bp, Homo sapiens
ctaacaggaaaaacgttcacaacacgcagcaagtttacaaaggaggatgcagaataggattccaacctaattaaaaataagtaaggccgggccaggtgcagtggctcacgcctgtaatcccagcactctgggaggccgaggcaggtggatcaggaggtcagcagatcgagaccatcctggctaacacggtgaaaccccgtctctactaaaaacacaaaaaattagctgggtgcggtggcgggtgcctgtagtcccagcttctcgggaggctgaggcaggagaatggcgtgaacccgggaggtggagcttgcagtgagccaagatagcgccactgcactcccgcgtgggcgaaagagcgagattccatctcaaaaataaataaataaataaaaaataagtgaatcctggtgcggtggctcacgcctgtaatcccagca

SEQ ID NO: 21264 - DNA, 555 bp, Homo sapiens
tcaggggaagggtggagccaggggtaagacacccatcacccttcttgcctcctgacccaaggcctgggttttccctgcaggaccctgactgggtggagggttagccagggtgacttagggatgcaatgcagacagcttggtaaaatagtcattctcagacttgggctctggagcaaaatattacccctagcctctgagctgctccggccacttcccattctgcctttctggggttgaacctggaagaacctagggtagaccctttctgtgacagccccttgccctaggaaggcctgaagcagaccagtctaatcacctcattttacaggggcaggctgaggcccaggcctctctggcgcccacaagatacattcgtcctgctcacctggcattcagaatcctttgccaagagaagcacccacatttcctgctccacccacagcctatcctcctccttttcccagactattggtctttgctcacactgttcctctgccacaaatgccctttcatgcctttccccctcttctacgtgggatgaattttaaaaattag

SEQ ID NO: 21265 - DNA, 566 bp, Homo sapiens
agataaaacagtatgtaactgttttatccgttctcatgatcatagtagatgcctatttgtgcaggcaaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaatatgccaataccccttatgaaaatagatataaaactcttcaacaaaatagtagcaaactgaatctaactacatgtagaaagattatataccatgaccaaataggatatattccaggaaaaacaaattggcttgtatgaaaatcaatcaatgtattatacctacattaatagaataaagggcaaaaagcacatgatcatctgaacagacacggaataagcatgtgacaaaatccaaaaaccatttcctgacaaaagactcaacaagctaggaacaggaggaaacatctt

SEQ ID NO: 21266 - DNA, 547 bp, Homo sapiens
aatcgcaaccggtgggaaagttcctaagcataaataaaaccatatattcaggatagcaagacgtccaatggggctttgtcatagaatattcatgtgattatcatagctggagaatgaggctgagaatatgttttgaaggacaatctattccccccaaaaaaatacctggatgatctcattgatgttagaaaacttaaaaaaatgttaaaatagaagattattataatttgatttaatatttataaaaatcaaacttccaaccctatggaagatgatgtggactgcaaaaattgcattaagcagcagaatttggctcacggatatacaaattaggagccttttctattattcctcataaaacataaggaagaattaaaaggtgcctgagatactgaagtaattgaatggggaattcttaattaatcagctaattatttaaaagatcatttattcatttaagaaattaattgagcacctacattataccatgtgtattttattttattttaaaattctatttatttatttgagacagagtcttgctttg

SEQ ID NO: 21267 - DNA, 440 bp, Homo sapiens
accaccacgcctggctaaatttttgtatttttagtatagaccgtgtatttttagtattcttagtattcatatacaatatttttagtcttcaccgtgttagccaggatggtcttgatcttctgacctcgtgatccacctgtctcggcctcccaaagtgctgggattactggtgtgagccactgcgcctggcctggaaactctttcattactgaaagaatcatcccttgaccacaggcaactctaaattcctttggggaagaatcagaatgattcttgctcagtccagctactctcttgaattgagaagtaactcaggaaccatttgctgtggatttctctttacaatgtggattgaggaagagaaggtccatgtgccaagaagataaggcagactcacagatagctgagtcaagagcaagaatcttaatgacatttgggtc

SEQ ID NO: 21268 - DNA, 471 bp, Homo sapiens
gcggcttctcctggtattcaatgccatgcttggcacatagagacttcaccagcggggcgatcttgtgtaagttgtgccggggcatggtggggaagaggctgaggagtgtgtagggtgggcagagcgtgaggactcagagggccatgctgctcccgcttcctcccaccacctgggcagaggctggctggggccctcagagaccctgtccacagccaggaccagtctcaaagtgtggctcctcgtgtgtgcccagtggggtgccacgtgtgtggaggggagggtgcagccctccgtgagcaggagggcgtttgtgctctatggagctgggaagatattgggtggccagagacaaagtgtcatgtttttcaaaaaagaaatgaaatagctggggaatgctaggaaaagaggcagtgaggtgaggcacggtggctcacccctggaatcccagcattttgggaggccgaggcaggc

SEQ ID NO: 21269 - DNA, 553 bp, Homo sapiens
tgtcctacagagctgggccaggcgcgcccagaacagggggaaagtgcgagtccactcttcctatgcatgtcctgcttcccaaattaaaagtcccagtgagaggaagctgccgctgtcctacagagctgggccaggcgtgcccagaacagggggaaagtgcgagtccactcttcctatgcatgtcctgcttcccaaattataagtcccagtgagaggaggctgccgctgtcctacagagctgggccaggcgtgcccagaacagggggaaagtgcgagtccactcttcctatgcatgtcctgcttcccaaattaaaagtcccagtgagaggaagctgctgctgtcctacagagctgggccaggcgtgcccagaacaggggaaaagtgccagtccactcttcctatgcatgtcctgcttcccaaattaaaagtcccagtgagaggaagctgccgctgtcctacagagctgggccaggcgtgcccagaacagggggaaaagtgccagtccactcttcctatgcatgtcctgcttcccaaattaaaagtcccagtgag

SEQ ID NO: 21270 - DNA, 490 bp, Homo sapiens
ttattctcagagtccattttgacagcaaattatatggtcacactgtggatagagaaacccaagactttagagcaggagtcatttaaaggagtaatggtagtgtgtgactgtgtacatagttcaaagtcattcttagtttgtataaaccagaaaatgaggctgagaccatattgctgggaagaacaaagctcactacattatcttgtgactaccaaagaaaaagagctaagattccattagcttgaatccacataaagcttaaagccaaattcgggctaattaaagtcaggctctgggaaaacaaaagcataaaagcagtaatcatgtctgagtaagatgaagtagcctgtgggtatgaagaaaacaaagaccaacaacagtcagaaggaaggcagaaaaagcactttgggaggataggagtagatacaggcatcatatcaagttgcctggatgagtgttgtcatccagtttctccattttgaggtttggg

SEQ ID NO: 21271 - DNA, 603 bp, Homo sapiens
tattaaattttccctgtccaaatttctgcggtgatttctgtcccttgcttgaactctgatacaacatctaaggacgctttggtctttgattcttgtctttgaaagacgatggcaaggataaaggagttgtgtgtgtgcgcgtgcgcgcgtgcttgccattaatacagacttaaaagcagcagagtagcagagtggctagtacagggtactccagccagattggctttgccacttcctagctatgtgccctggggtgaggggagttgcctcagtgtcctcatctgtaaaatggagatagagtggctagaatatacccagttaagtttgaatttcagaaaaatcacaaataatttcttaatataagtatatcctaaatattatacgggtatccttcctgtattcttatttgcgaaatctgacaagactagtattacatcataaaaggttaaattaaggccgggcgcagtggctcacgcctgtcatcccatcactttgggaggctgaggtgggtggatcacctgaggacaagagttcgagaccagcctggccaacatggtgaaaccctgtctctactaaaaatacaaaaaattagctgggcatgat

SEQ ID NO: 21272 - DNA, 511 bp, Homo sapiens
atttccaattattttcccacctttagggcagacagaagttagctcggttcaacgcccatgagtttgccacgctggtcattgacattctcagtgacgccaagaggagacagcagggcagttctctctcgggttcaaaaggtaactgctcaaacctccaaacacttgcattttttggccctctaaatttgactcaggtgttaaagttataaactaattaaagcagtcatcaacatgacagttctataggtttttggttttttgtttgtttttttactttaagttccgggatacctgtgcagaatgtgcaggcttgttacgtaggtatacgtgtgccatggtggtttgctgcacctattgacctgtcctctaggttccctcccctcagccccacccactgtaagttttattggtagtatattgtgataaatagtttacctgtctgagccctggtgaattaacaatatttcagagttattaactgctacacatatttatcttatatatgatttct

SEQ ID NO: 21273 - DNA, 597 bp, Homo sapiens
ggtttaatggctaagattgggaaacttgtaaattttctgtgacttttgatgatatatgatgtacataaattagcaggagaaaggaaaagtagtacgctagaaaacaaaacaagaaagggattgaaggcaaaatttcattaataatatattgctgacacaggaaagagaagggagtaattttgatctctggaaaagtgtttaaagaatttctttcacccctactgtgggctgagtcccaaccattctaagatcttgcaacatctggcctgatctaagccatgtgaacacttaatgtagtagggaaaaacattatttgtgtatgaaatttacatgccattttaatcattgcataatgttgtttacttaaatatgcaattttttttttcttttttgagaccttggcttaccacagactaaatagatagaagtaggtgctaatgtggtcttctcacagacatattccacaactcccaagaagtaatatgtatttgattcttcaaatactgttatacattgggtagcactcaaacactcattgtaggccagggatggtggctcacacctgtaaccccagcactctgggaggctgaagtgggc

SEQ ID NO: 21274 - DNA, 561 bp, Homo sapiens
gaggtgcacggcccctgcccaggctgggtgggaacatagaataaacagcagtggaatatttgtgtctgccatgagtgtgcaggacctagggcctgggaggagaaatgcagcccaaccctcagtggcttagctccagcagggaagggccaacgacatcggcagaggcactacttatcagaaccagctcagccccagaaagggtggggctagggtagacatcaggagggacttcccagctgtctgagttatgacaccttgccaaaggaggcagcagaatcttctcccactcatatagtaccagggagaattttctctgggttgatttgaaggctgtcctcttttggaacttgagaaggacagacagcagaatacctcttaagtccttccttaaaaggatttgggttttgtttggtggctcatgcctgtaatcccaaaattttgggaggccaaggtgggaggatagcttgagctcaggagttcgagaccagccggggcaatacggaaagattctgtctctacaaataatcaaaaaaattagctggacatgatggcgtgtgcctg

SEQ ID NO: 21275 - DNA, 345 bp, Homo sapiens
ggaggtttgaacaaaacaaaataatacctgaaaatgttgaatggatatgtaatatttgtgaatgtttatgttctctatttcaccattatttaaacatttatattttcaaagggagacaataattatattttgaaatcattttatttttttatagagtgctgtattttttcttttcaatttcaatttggtgagcaaacaaaatcagtcagaatattatacataattaggtttcctttttgagatttgttgaaactctttatcctttatgtatgtatttcaagtagtataataaaaaagaaatataaaatgattagatatacataaaagtattgtagattatgtttt

SEQ ID NO: 21276 - DNA, 588 bp, Homo sapiens
gagatcttgcagaataattttaaaacagtagtgggtattttctgcttttaatgggtatgtctagtatttcatatattgttgcttatagaacactattcaaccaagacatgtcaagactagttgtctctcaaaccattagtatttatattattcctttccagctacacttgtaggatgtaaaagaccatttccaggaatatggaactgttttactaggtggagggtatatataaccatataatagtcacagaaactacattaatactcacataaatcaaagcataaatgacatagaatcttggcagatttgcttaaggttaaatgtataactcttatcagcaggaggtgaaagaatatattcttagatacttggcacatttagaaaatataatctaatattctttttaaagaataggccgggcacggtggctcacacctgtaatcccagcactttgggaggccaaggcgggcggatcacgaggtcaggagatcgagaccatcctggctaacacggtgaaaccccgtctctactaaaaatacaaaaaattagctgggcgcggtggcgggcacctgtagtcccagctactc

SEQ ID NO: 21277 - DNA, 615 bp, Homo sapiens
ttaataaccacctggggtgaataattcccagatgtgattcagatcatcaactgttctaaaccggtcattaattctttgaaagtatattattaagtcttgataggtattacttaaatggcttataggctattttgtagtctttttattttgtaggtcaatatctttccattccacctttaaacttctattttagtgagagaatagtgagaaaatggattgtctaaaatacaaaaaatgagagcaaatgtatacactttctacctgtacttaagactaacgatgaacaagaacacagttcaattttcacaaccatttagtcttttttccacaactgattctgcccaaagttagtatcaaattattccagctccaatgagagttgcaaaatatagcctttaaacaatatcttatttaaaataatttgttacatgtacatctacttagctatccagccaacttttattgagcatccctcatatagcacttactatgccatctacctgacccagagacacaacacccaacccattactgcaagagtttacaatctggtaaaagatagacatttaagtattgtgagataaatgctatgatatgcactgagtttcaggtggt

SEQ ID NO: 21278 - DNA, 400 bp, Homo sapiens
agaatatacatgggggagtgtaagtgaggatcaaagatcgctgtgaacacaatgaagaggtttcccaggataattcccacatagaataaagagaagaagagaaaaaggaaaaactgcatttccaaggattgtgcaagtccaagtaatacaaattctgttaccagagagtcatttacttggtccactgaatcagatagaagggaagactgtgaagcaaccggaaagaaacgaaggaatcaacttagtgtgactgaaaataatgcgttaagtgttaatgatttaaaatttattattaacaaatcttttatttgatagtagattatttaaaaactagtgggaacccagggtataaaaggttaatgtaatatggacaaagctgtgctcagaggcagtctattgc

SEQ ID NO: 21279 - DNA, 442 bp, Homo sapiens
agattacaggtcatctttgaaggactcgagattgaaaaccataggtcttcagtctctatatcattttctttagtaactttgaacccagataatattaacattatgataaaaataatttcagattgatgtatgtaagaatcgtgtgtaatgaccaggtatgaggcaccctcataaaattccttgtaatcctctgaaacaggaagattatagtgattaagccatagatcttttagattatacattggtacatttacttcataacttctttacaggaacacagtcaaatgtcttagtattcagaaatacttcacctttggtttcatttataaagcattgactcctttgtataagaaatttagcctgttcatcacaaaacaatttaattactactctgggctgctcaagatggtttgtacattagtatttagatgaattttagatg

SEQ ID NO: 21280 - DNA, 455 bp, Homo sapiens
gtttctcaccctgtgagcccggggcttccacccaggggagcattcagcaaagaggcaccagggacaccagggaaagtgccctgctgtcgtctgagaagcacacatccttccctgggtggggcaatggtctcattacacacagccaacacatactctcccaccatctgcgtacacagactcccgctggcactgggactcaccctctgaagccgtcactgtgccggtggtgttggccagatccagaaggatggaggggaacgcaggatgcaggaggtaaaggtggtgaaggctgggcggctcagttcctaggatgatatcctgataataagcagcaaaaaggaagagcaaaggtaacgctacattcccacacgtgacagtcctcaggtgaaaaggcagagtagaaaatggtgattactcattcctctcagatgctaatgcctgatcctaactacaag

SEQ ID NO: 21281 - DNA, 421 bp, Homo sapiens
gcaccttttacttcttatgccccatacatactgctttgccctataataattttcattcttgccttgactagcttcaaaattttgtttaatgagcatcaccttttgagtaattttcctgatgttttaataacatcatagcaatcttaacagtattctataatcaattatttaattgaattgatgttttgcactatatcctaaactcaaggacagtgaatatgcatactatgtattcaataaattcttatttcaacaaagccaggatgcctttggaagctaacagtgtagttgatcactatgttcccagttctaaacatgatgtcttatgcatatagaagcttgataaatatttattgaataaatttttaaatgagtgtactagaacagatggctaatttccaataaaagtaatatctatagc

SEQ ID NO: 21282 - DNA, 378 bp, Homo sapiens
aaagcgtgagacgagaagggagagcaagtggaataagactggcacaaggacttgggtctgggcactgggtaactgatctgggaggggagggatttggatgctcccaaggagtggcgttgagatggtaaaggtgaatggaggcaagataaaccagaaaaaggagcccggagaagatgaaggactgaggccctgatggtttctgagcccccagcacgtgctccgcagatggctgtggaatgtgtctgagggagagagcgtatacttgataaagagttcagatggcataaattgtgggatgcaagaacaattctcatacctagggtcacgccactacattttagtaattctggtatgaaaattagaaatgggtgaggtata

SEQ ID NO: 21283 - DNA, 354 bp, Homo sapiens
gcaggagagagacggctgtcagacaccaaataattgactcttaggtggttttattcattgttgagaaatatggtagattgggtttcatttaccgaatgagaattcttcattttcactttgtaatttttcttagtatatagtcagcccactgtatttgtgtgttccacatctgtggattcaaccaactgcagatcaaaaatattgaagaaaaaatcgcatctgtaccaaacatgtacagacttttttcttgttattattctctaaataatacagtatgacaactatttccacagcatttacattgtattgggtaatataagtaatctagtgatgatttaaactgtgcaggaggat

SEQ ID NO: 21284 - DNA, 603 bp, Homo sapiens
aacagggcttcctttctagctcctagtgtaggacctgcttcccagaggccactccatgtccactgcttcaaagagtggtacaacttataaaaatagatccagaaggtgatttcaggattagatgctggtgtgttgcttacgaaatctcatcctcatccattctgagccaaattactgatcacatatttctcattcatacaaataagtaaattctgcaagtttatgccactaaacttttccacacacatagtaggcaaggtttctacatctcaccctcagctttagcctttgcttactctctggttgcaaaacagcaggaattaagggtaataaagttaacattctcatcccatagagatcagaggatgttcctgtcatctatcaagtaattgagactcagtgatgatagctgtattaattcatttctggaaagtaacagtgctaggcataaataaatgtaagaagggtggagaagtaccatatgaagcaagcttctaacaattaaaaagttttcaagggtattcccatcacagtgtcatcataaagagcactgtgcattgaatttcagcccttcttcttcctctctgtcccctccagttgctg

SEQ ID NO: 21285 - DNA, 551 bp, Homo sapiens
catataaagtaccctacaaattataattatttgagtaagggaccaaaattttgcaaggtaaatattactatcctttttgtttatttgttttaaattaatgaggaggcctggagcggtggctcatgcctgtaatcccagcacttctggagactgaagtggatggatcacttgagcccaggaggtctaggctacagtgagttgtatggcgccactgcactccaacctgggtgacaaagcaagaccctgtctcaaaataataataataatagggctgggtggggtggttcatgcctgtaatctgagaacttagggagactgaggcaggtggatcacttgagatcaggagttcgagaccagcctggccaacatggtgaaaccccgtctctactaaaaatacaaaaattagccaggcgtggtggcgcacgcctgtaatcccagctattctggaggctgaggcggaaagaattgcttgaacccgggagacggaggttgcagtgagctgagatcgtgccactgcactacatcctgggtgacagagtgagactccatct

SEQ ID NO: 21286 - DNA, 531 bp, Homo sapiens
actagtgcaaatttctggcaacagtatttcatctccccattatttatccagggcattgaaaattggcacacatcacagatccttaagtcattctctgaatcaggaggagaaaagaggagaacagagagagcttaccatatgtgccagtcactgggctgagtgctgtgcctaaaggatcccacttgatgcttgaaataaccctgcaagatcaaactaaaaactcatacacactcacacacacacactcacacacacacacatgctcaagcacacactagaaactacagaacaaagaaaacgttgacaactaatagaagtatagtgctggctaagcacagtggctcatgcctgtaacctcagtactttaggccaggagttcaagacaagcctgggcaacatagcaagacaccatctctacaaaacattttcttagataaaaatcatttttaaaaagtggtataatgcctaagggctcagggaaacagtacccctatggctgtatggtaagcagcaggcaaggctacttgtcag

SEQ ID NO: 21287 - DNA, 635 bp, Homo sapiens
atggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaacgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggctgaggcgggcggatcacgaggtcaggagttcgagaccagcctgaccaacacggtgaaaccccgtctctactaaaaatacaaaaattatccgggcatggtggcacatgcctgtaatc

SEQ ID NO: 21288 - DNA, 596 bp, Homo sapiens
atttaatcacaggcttaatctgcagttcaagtcagcaaatctggaaggtgataacaccaaaagagaacattggagctgtgggagggaacaactggggaaaacaagaggactccacagcagggaaaagagcaagaacacacagaccaacatctcatttggaggaagttcagaaacattggaaaggtcacacccagactcatgttcacaatatgaacccagggaaggtcagataatctccctttattctattgctttccaccaatttcagaattttcagttaaataacattttaatccacctgagggagctgaacatgattctctggaggagggaacaggtgaagagacaaagccaagcaggaaagaaaaacaaggtatcactggaggatctgaagtctctggtggacacagaagaacagacttcaactatgaagtccactgcaaaagtaaatgtcaaatgtagctttgagaagattcacagacacttccacaataaaggcctggcaaaggtaaagtatgatcaaatacaggcagaaaatgcataaaatgaaataataggccgggcgcagtggctcacgtctgtaatcccagcacact

SEQ ID NO: 21289 - DNA, 597 bp, Homo sapiens
ccagtttgggccaaattcataccagtcacagatccaaaatctccccttgacttggttctctgtctcttaactcctggaagagaggcttataattgcagctctgcagaaagattgagtttccactaataacttgttaagcacttactaagtactaagccacaatactaggcactttgaaacagacactatctcatttgttctgtgttgataattattatttctgttatttatatggagaaactgaagttcagagaatttacgccatttgccccaagtcccacagttaccaagccacaaagctggagttctagtttaattttctgaatctaaatccagggttctttatgctactgtacagtacttcttggtggctctattacaccaatgctttattctaattagtcaattgcatgaggttaatgataagaatttcttattgttgctaatagtttccattgcactatgtgcactatatgcaccaagttttatactgtgtggacttatttcagttggttctcccaagacatgtaggagacaggtattatctacattttggggatgagaaaaccgatgtatggaaagtaacacatctaaact

SEQ ID NO: 21290 - DNA, 544 bp, Homo sapiens
gagacagggtctcactctgtcacacaggctggagtgcagtggtgcaatcataactcactgcagcctcgacctcctgggctcaagcgatcctcccacctcagcctcctgagtagctgggactacaggcatgagccaccaggcctggctaattttttttctgttttattatattttgtcattctgcaccttcatgaaataatttttgttgttgtttttgtttttgttcgtagatacagtgtcttcctatgttgcccaggctggtctcaaactcctgggctcaagtgatcctcctgcctcagcctcccaaagtgctgggattacaggtgtgagccactgcacccagcctgaaaaattcttaaatttctacaaatcataaggatttaatgtattggctaaaattgaaatctctagatcccaactttaagacttaagacaaaagattaagttcattaataaataatctttggacacataagaaactgacagtttctgagtaaggaatagatagaaaacactagtcactgaaggtgattttttattctca

SEQ ID NO: 21291 - DNA, 589 bp, Homo sapiens
gactataaatccctttattcgtcattgtgagtcactaaatatgaactttatttatagctgtgtataattatatagtctttggcttgccataagcaattttgacaggagtaaatatcattagagtagaaaatctttcacctacacagatctatgcttcccagttaatattcgtgactaatatattgtgtagcactatggatgttaggaagcttttctccacgtacacagcaatggttcttgtattatagatattttattggctgataaagtatttttactggtatttatgtagtcttatttcccacatcacaacttccgacttaaatgagtgaagacagtttatttttttcttcagaactaattgaatgaattctgaagacttgctgtttaaattatgcaaacataatattttctcacatttatggctgtcgtaatgtttctgttgctgcctcaggaactgcattgtacttaatgtagttacagataatacaactgtcataactgtcataaagaccacgtgacaagccaggcattcccacagtcacacacctcaagcacatgtagccctataattaaagttggagctctg

SEQ ID NO: 21292 - DNA, 435 bp, Homo sapiens
aggatacacaagacacagatattactaactacctctagaatggggaacttttgtatctttttgcgttttttgaattttgggacttgtaaatatactgcaatcaaagtattaaataaggaataaaatagttcaatttaaaagaattgagatggtactctactcatatttttctttttaaaaaattatttaagataccaaagatcagcattcactaaatggaattaaacacactcagaaatattgataatacagtagataaggctgggtacagtggcttacgcctgtaatccctgcactttgggaggccgaggtgggtggatcacccgaggtcaggagttcaagaccagcctggccaacatgatgaaaccctgtctctactaaaaatacaaaaaattagctgggcgtggtggcccgcacctgtaatcccagctactc

SEQ ID NO: 21293 - DNA, 453 bp, Homo sapiens
gacagaaggggttggctggatcacagtatagaaagtataggtgatcccagccatcagctgaattctgtatgatttagccaagactaggatcccatgggcctaccaccttgtaaaagaatgtgctataataaggtagtgtgaagatttttttgaattcttaaatatagataatctggtgaaagagcttgggataaggaaggaagcacagatttggagtcagaaaagccacttttggtctgaattgccacaggttagcatgtgtcccttggcatgtcacttgactttgttgagaatcagttccttcatcaataaatgcccacttcactatgtgcttgtaaggatctaatgaaataccatccatgtaaattataaagcattatctcattttggggtattggcaatattatcactgtgaagaaggcattttaacaggctatatgggctgggataatg

SEQ ID NO: 21294 - DNA, 437 bp, Homo sapiens
catttgtacatcctgtcttcatgggcctggctgatcatcttcaaatttggagcttggaagtgaattattgtccacagtcccttgaacacttttttctgttgaaactgactttatcatttaggaattagtagtagtaagatcatatcttctgtgtcccctactgcttggaattataaaaaactgaaggctgaatattcaacacccctgttattaagcttatggtactctatttctggtgatggaatttccaagttttcacaactctgaatttgccttacccatttttacatatgtgtatatatctggctggatatatttttttatcactgtgaattatagtctactacaaggagaaaaagaagtactgattttggacagagagaaggagaactatttagaaattagtcccaaaacattagcatgaaaaaaggtcaatt

SEQ ID NO: 21295 - DNA, 432 bp, Homo sapiens
ttcaccgtgttggccaggatggtctcgacccaaagtgctgggattacaggcgtgagccaccgtgcctggcccaatgcatggcactcttattagttgtacacacagagtgggggcaaattaagatattagcttcatgagagatatgtagtgaggaaggctcacccaagggagaaggtcttgattactttcagcttgctcttattggcaaatgtctgaaagatattcaaaggaaggctctaagacatctacagaaaagccagggtacaaagggcagaggggaactataatgtccttcccctgccacgaacctagctcaagcaataaaggtggcacttgtgacataagggagcttggaaagacagggagtcactagacattgtgccaaaacaactcccacaccccaaccaatgttagccatagagaggcaggatg

SEQ ID NO: 21296 - DNA, 654 bp, Homo sapiens
gactgggaaaaaacaaaaaacaaaaaacaaaaaaaacgaacggctagatctagtgaagctaaaataccaggactagggtggttccttcccccatgaagaacaacttgagtcttcacatgtaattattctgcctcagcctggtgcctttttatccttaaccatataattaaatggttcacagctacagtgcaaataaagagttggtgttaacagaatatgtatgccctgtaattttcagctttattggatttcctggtgctaagcgctaatgctgaggcgctcacagtggaagaacaaccttcttgtgggagagttggataccttggaaacatattcactttccatccacctaagatcttcctcttccagcaccgccatcccctctactggccctctgcatagccgacttcatcattgttacctgtgcccatgtggttcctcaagctgagatccgctttccatagtgttccttcttatctgtccctcctcacagcctctccattgatgaatttgtgttgggacaagttgggacaagcaaccttcagagtctttctgccatttacttaactgccatttagtgtcatgaccttggcttcagaatgggttgatataagaaatggcctcggccgggcatggtggctcacgcctgtaatc

SEQ ID NO: 21297 - DNA, 408 bp, Homo sapiens
gtggtgcaatctcggctcactacaacctccacctcccgggatcaagctgttctccagcctcagcctccctagtaggtgtgattacaggtgcccacgaccatgtcaggataatttttgtatttttagttagagacgaggtttccttatgttggccaggcttgtctcgaactgctgacctcaggtgatccgccccacatcagcctcccaaagtgctgggattataggtgtgagccactgtgcccagcctgatgtgagtctataattgattatttaatgggaaaaaaagccaggttaggttctgggctccagcgaacacaaccaggactagagccagagaggcaagaaatattaacaatgtggaaacttacttagagagtatttgtctttcaaatgatctgatccttttgt

SEQ ID NO: 21298 - DNA, 608 bp, Homo sapiens
aatttttgcaagttggacatctctctggataaccatattactctctatccttgtacatctaaggaagatggggacaattcagacagtcatcatttggttctcctctttcttaatacttcagctgttcctagtagttcaatttgaaggaaatatcatggcactggaaacttttcttggcctcacattaaaattggacagaattagtgacactggaatggctggaattttattctgccatacttagcatgtcattggtaataactgttatgatggtacatgacttttaatgtcatgtcctgggattttattactggttggcataagccacagccatatcaaaactaattctgcatcttttggatttcttacagtgtccaggaagttattccagatgaagacttatacttttattttatttattaatttattcattttttgagatggagtctcactctgttgccaggctggagtgcagtggcgttatctcggctcactgcaacctccacctcctgggttcaagcaattctcctgcctcagcctccccagtagctgggactacaggtgtgcaccactacacccagctaatttttgtatttttagttgagact

SEQ ID NO: 21299 - DNA, 466 bp, Homo sapiens
ttcatacacagagacatttgaattaaaaaattaccatacaactctgggtcaacacatgcatgtgtgtggtcactcactacccctcacccagggaaaacatcactgatcaatatagaacatgcttcatttagagctctccccttccccccacacccaccctcacctaaaggccttgtggtttttcagttttttctcaacatgtcactctgggtaattactactcatttccaaaataaggaaaatcaaatgtggatccccatgaagcttattgatcgcaagggcacttgggccagatgaaatctaagaggttcttcatgtcttccgaaagaatcatcagtgtttcctgttctgtagaaacttctctcttctaatttcctttgaataaaatgctttccaactgaattagttatctaggggttgccataacaaagcaggatagagtggatgcggaggatgaaagtcaaag

SEQ ID NO: 21300 - DNA, 587 bp, Homo sapiens
gggctgcttgagctgggatattcatctttctcctgatcttggacatcagaactcctgattctcaagcctttgggtttggactggaggcaccagctttcctgggcctccagcttgcagatggcatatcatggaacttctcagcctccaaattcataactctaatacaccagtacaatggaaagattcctaaattcaaaagccagaaggctgggttcctgttcccaccctgccttttaccttctgtgtgttcctgatgaagacacttcatgctccactatttacttacctctgaaacgaagggctgacccagatcagttgttctctgacctgcttggagggactcagaggctgtggagagtgaatatttccatcagctgatgcccttctcaggcctcaatctcccctggtttgcagactgtggccctccttggcctctgtggaatctggccatttgaatcctgtcagccctgttctccatcaccaaaggactccggaggaactgtgccaagcaggctgtcagccacgggcaagctttctgaaaaagacgtgccaactgcagccacagaaagtccattcccttgaataac

SEQ ID NO: 21301 - DNA, 608 bp, Homo sapiens
ggcacttgccaatgtacaccagctcaccagcaccttccccacaccacagcctcctatgtgctgctttgcaagcatgcaatcacccatggccaccccccacattgcttgaccagcacacatgcacataggtagaccttgcctccacgtccttgctggtgcatgtgtgcatgtgcctcctcactgtgccaatgctgctggcatcagtgctccccactgtgatgccattgtcaatgtgaaagtgcaccaggagaccaatagctctgcccccctgccctgtgccaccattgctacccatgtgatcacatgcacggagaccaccagtcccatgcccactggtttcctgcttccacacagacactattggccccatctcttcacccttcgtgccatgccaccattgctgccactgtaaacacccacaagagggctggcaccctatgcctgccagcaacccccgtcagctgacaagtgcgcaccagactgcactgctactgctactggcaaatgtaaatgagcactgattttgttgccactaccagacaaagcactttggctagccccacccatcagagtgttgtgaccaacagagaacaccttgacctctgtag

SEQ ID NO: 21302 - DNA, 670 bp, Homo sapiens
tctatgtgtgattttcccaagattacatagctaataaatgtcagagctgggtttcaacaccaagagacttagaaaaatgaataccaatacaaattttaaaatatactaggtaataaaacaagggtaaaaacataagagatttattacatccagtggataaaaaaggaaaccaatgaagtgagtaagcaaatgggtcttaaacatagccctctgatgcaaatggctccatggcttctgggacctcggcctaagtgtctaatggagaacctcaaaggcaaagcatgaaggacaaaggatatgaccggaccttattttttgccaagctcatgaccctcaggcatctggctctgcactgtgcgcaaagccagcacgatcaacaatgaatagacctaagtattcaacagctctgcttttgcctggctcataaaagggcgctaacttggccgggcgcggtggctcacgcctgtaatcccagcactttgggaggccgaggcgggcagatcacgaggtcaggacatcgagtccatcctggctaacacggtgaaaccccgtctctactaaagatacaaaaaattagccgggcatggtggcaggcgcctgtagtcccagctactcgggaggctgaggcaggagaatggcgtgaacccgggaggcggagcttgcagtgagc

SEQ ID NO: 21303 - DNA, 528 bp, Homo sapiens
aaacattaatcagggtgatgtgatagacattgacagagactcctttgggttaaatgattataaatatcttcctgatgagtggacatttgcatgaatatagacattacttctctaatatgtaaagatcatacacacatgcaaaatgtaaacctatattaaaatctctagggacttcaagtaagaagtaataaaagcatttatagaggcatgtcttgcagaaaactgtgataatatcttcagagcagaccacctctttgtttttaattctcaaaacgcatacaatgtatgtatctctcaatacaataatattttagctagcagttatgtagggaaaatacatcttcaaatctcactatatcattttagcaaagtattcaggaaaatcctgaatgcatacattttgcactcaaaattctctgtcataaatttgaaaaactttattccatcaaaatattcaaagtaaaataaaacatatctataatttagccaatcattttttcacatacagaatttttaaaatatatagtc

SEQ ID NO: 21304 - DNA, 475 bp, Homo sapiens
gtgaggagacagaagaaccctcagattcatcctttactttgtgtttgacacattcccctttaccttcaacctcagaacccacaactgatcctcaagctagtttatctccaatgtctgaaagcaccctcagcattgctattggcagttctgttatcaatggtttgcctacttataatgggctttcaatagatagatttggtataaatattccttcacctgaacattcaaatacgattgacgtatgtaatactgttgacataaaaactggggatctgtctgacagcctgccacccgtttgtgacacagtagccactgacttatgttttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagc

SEQ ID NO: 21305 - DNA, 455 bp, Homo sapiens
atcatccactcatccatctatctatccatcatccactcatccatccatcatccatcatccactcatccatccatctatccatcatccactcatccatccatctatccatcatccactcatccatccatctatccatcatccattcatccatccatcatccatgttacacccatgcaaccacctatcatccacccatacatccacccaccttagcctccatcgacacatgcatccatccatctacccatccacccacccatccatcatccatccacccatccattatccattcacccatccattatctacccatcgtctgtcacccatccattcatctgtctaaacaggtatttcctcccccctcacttgcccttgtcaaaccatcaatctttctggggccatgctgcgtgtctcgggaagactgtgctcacctcaggctttgtgttgtgtggttt

SEQ ID NO: 21306 - DNA, 522 bp, Homo sapiens
tttatcacaattcagggaatcatgtatgggattatgtcaaaactaaacaacatctaggaagtaaaactcctaaaaaatcaaaacagctccaataatcttgggttttgaccagtacccagcctggatataataatctgattaagaatactgcttactcttcaattagaagagtaattgaagaggaagcgggaaaatgaaagatattcatttcttgagatccaagatggacctaaaaccatttttttaatttaatgactgtcactaaaagataattctaaagaaatatattaagcatctattatgaatcagaacatttggtaggtgttgaggacactggtaaaatgtcatacatgtgctttttagaacttactggtgttaaagtgtggtgaacaagagagcagtgaagagatagaaattaattgtaaaagcaaatatttaattttgatacagtttcaaatggtacttctgcctagccattggtcctatgccattccacctcatttatctacactggtgtaatct

SEQ ID NO: 21307 - DNA, 594 bp, Homo sapiens
ttcctgcctcagcctccaaaaatgctaggattacgggcatgagccaccacacctagcctcaaatagttgtcttaacaaataaatggttgaaacctgatatacgggaattagggactctgttttgtgaactgttcatttctggagtcaaaatggctttgatggtgaatttggttatctaacaattgtttccagaagttaggggttaagcagagtgcaccacccacaggccaccttacctgtcctgccttggcgttctcacagacaaaagcttcatagaatctggggaactctggagcattgtcattcacatctaagactttgattgtgacaggaacacttccaacctgggagggattgtctaaagggaacacaaggaaaaccaaatctgagagtttagtaatgccaaaagaaaaaaaaaagagtaatggtttttgctagaagtcggtatttacgactgggcgcagtggctcacgcctgtaatcccagcactttgggaggccgaggcgggaggatcacgatgtcaggagatcgagaccatcctggataacatcctggataacacggagtgaaactccatctctgctaaaaatacaa

SEQ ID NO: 21308 - DNA, 613 bp, Homo sapiens
ttctagtttgtaaacacttctaaagcagaaataattttattcctaattgtattcttcacttcatcccccaccacatacataacacacacacacactctgtctgtggtacatagacagtgtttattaaacatttttttggaatgttactgtaaagatatcagaatatatagacacatgaaaatcagtttggcactttaaggtcacactttttcatgcaggaattgttttacatagaatacagtataatttggccaaaaaaaaagcaagttagttatccaaaaaggctcaattcaataactttcttttcaacagcctgtgtaacatgcctgatattcacaaaaaaactggactttgtcatctgggctcttcaccagatcctccactaaggccattactttcagaatgtacaacctgctagcgaatattcatgataaactgaattaccaggaccactggaacctagctagtggttgccaccactgcatgttctttgctagtgagtagtggaagaagtagtgagagtagagtgttcagaaaggcaagcatggaatgattatttaacagaatatttgacaaatgtcagaaaagctattacgtatataaagctaaaaac

SEQ ID NO: 21309 - DNA, 570 bp, Homo sapiens
gacagaagggggccctttcatagatgattttatcttatttcagctatagttagtagtttaaggggacctaactcagtatatctcaaacctggtaataatggcatcggttagaagtgagtgagaattattatgaaaattattttaggttgggcacagtggctcacagttgtaatcccagcactttgggaggccaaggtgagaggattgtttgagaccaggagttcaaaaccagccttggcaacatggtgagactccatctctataacaaatttagaaattagctaggggctggtcacggtggctcacacctgtaatcccagcactttgggaggccgaggcaggcggatcacttgaggtcaggaattcgagatcagcctggccagcgtggtgaaactccatctctaccaaaaatacaaaaattagctgggcatggtggcgcacgcacacctgtaatcccagctattcaggagggtgaggcaggagaattgcttgaactcgggaggcagaggttgcagtgagctgagattgtactactgcactccagcctcggcaacagagtgagactgtctc

SEQ ID NO: 21310 - DNA, 475 bp, Homo sapiens
agaatcccaaaaagtgtatataaaagaaacgtaagcctcgtccagtttatattaaattgcctttgtctaaaatgggcatccacagctccaagtgtgtttggatttgcgtgttctctcgccatgaagccttgttctgacagtgtgatctattagcaacgcctttaaagtggcctggttttgattatttgtaaatattatggccagtgatggcttttcttcctcaattctgagtgtctcactactaatttcctgtgccagaatactttttcaccaatgtcctgtccttaaagtagcttaagttcataagggacttttaagtacccatttgtagttagcagatttttcagatgtcttttgttaggaatacagattttctgaaaaagccttttgctttctgaacacatgccaaaagattgtggctttgtcattcactttaaggaagaatgctacagtgattttgataggaaattgggag

SEQ ID NO: 21311 - DNA, 542 bp, Homo sapiens
caggggatccaggatcatcaccaaggtcattttcccagacagatgtgctgaggctgtagaaagtgctttttatttggttgggagcttgtgcataaatgcgagaggggctgcacatctgacggactagaggtgactcatggctgaaccggaacaggacatcggggagaagccagcagtcagaattcagaaccccaaagaaaatgacttcattgaaattgaactgagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtaccatctctgacagaaaggccctgctatgatagcaaagctgcaaaaatgacttattaaatactcccaggaatggccgcgcatggtggctcaccccctgtaatcccagcactttgggaagc

SEQ ID NO: 21312 - DNA, 483 bp, Homo sapiens
tggggggctccagacaagtaatttcaccttggtctcagttttcttgtctgtaaaaaccgaacaaatgcgattggattgtcacaagaattaaatagggaggagacagttgtgattaagaactcaggatctggagtcagggagatctgagttcaaattccagctctgacagttagtaaactaagtgagttctcagatgaatctcagagtctgtattcctcatctgtaagtgaatatattgatcctactcatctcaaagggatatcgaaattgtttagaaaggtaatgtacataaagtaccaaacacaaggtcatgctgtgtgtttttaaatgacagtacatatgacagtactttgaacttacacacacacacacacacacacacaccctgcaaacaaacaaaattcccaatgacacatgtaatgagaatgagataacaggggcctcttatatactattgaattcagcctgtctaaaaatctacta

SEQ ID NO: 21313 - DNA, 549 bp, Homo sapiens
ttagtctctggctagagattggagttcttgctctgcaattgggaaagggccctcataggcagaatcgagccatgaatattatctagcagtagatgctggaattaggctctctcccattgcaggactggagcaggaagagttgctgaagctgatgattctaccaggtggtgagacatgcagccaggaatggctttgaaatatgatctctgtctgcatgtgtaattgccagatgcacccagcctgcttccttggataatcagggtacaaaccagggtataacccttggtgcagttcacctcaaagggagcaggaattgcagcccaccaaagccccttttgggtcaaagaaaacacaagcacagtgccagtcactgaatgcagcatcaccaaagtccaggggaagacacacagaaggtgtcattgcttaccctccatttccgtcctcggtgcacttttgcagactcagcagcagctcttcttgttgggacccaggagtatgggctgaaagacactgcttctcaggcttcttcagtggctccaccaccactga

SEQ ID NO: 21314 - DNA, 541 bp, Homo sapiens
ttaactcaatatagtgttgctaagttcgtacttttgcttggtttattttattttataaataggtatcactcgcatggttccaaatgcgataggcacagagagtatatatgatggaattacatcctccttccctgcactcagcaaccgagatcttcccgctacgggcactcaaaggtttcattgtctgaaatatcagcctaaacgtagtttatgtttaggaagcaacaaccgtaaataggcccacatccaaacggagtggatttaggtttcactttttcaaggaaaaccatcaaagaatttttccacatacttataaaccatcccacgtatagaatccatttttactgacacaaatttagtaccaataaacgactcttcttctcaatttgttttatttaacaataagtcttgaacgtcattcccagttaacattttgaagagtttcctctctttcgttctgttttagctgcaaagtattcttccgtaaggatgaacgtactataatttattagccagccacttagtgatgtacaattaagca

SEQ ID NO: 21315 - DNA, 523 bp, Homo sapiens
atatgttatttagtataagttacaaaaaaagaccaaaggttttcagaatgtgtgtttattcttcaaggttctgctcatttcttttagcattgtagtttgattgtagtttctgatgctgctcttagtggtctgcaatcttcacctcataagatgctctaaattttctgacttttacgtgctggaagtctgttcaaaccagccttatagaatgctggataatactgcttattgtgatttacttccctggagatcaagctcatcttagaatcaagcctttccacatgaatgtgaggattctggatgctttattctttctctcatctctgtctctcttccatcagggggatggttttgactgatgagctatttttcccaattgcaaatcaactatacttctagctgtgagaaagggatctttctaatcaattgggtcttgccttctgcttactatgtgaattctaatgaccaagctctttatttttttaaaaaaagtaaaataagagaatttaaattaattacttga

SEQ ID NO: 21316 - DNA, 586 bp, Homo sapiens
  misc_feature 507: n = A,T,C or G
ccaacccacttgatgctcacccaagagcaaacctggaagtgtgattatggaatgtccaaatgacagagaaatttaggatcatctaccaacactgtcaccatattgataaaaaaaagtggaggcccagttaagtgattggcctaccacatctgaacaattaatgttaagtgattggcctagtacatctgaccagttaatgtagaatccatgtctcctgattcccaattttatgttttttcccttcccctcagatgtcattttcattttggttcttgtataacactgagtcattctggaatctgtatcgatttctttagaccacttagctagctatttcacttcaatggagatatatatacacacacacacatatatatccatatgctgtgtgtatgtgtgtctgtgtgtgtgtgtgcatgtgtgtgtgtagcatatatgtgttttcacccattatatgccaaaacctgtacatgtccacaatgggatgctgagtcagatttgaagttntctggtaaatacctgttcatcatcatgggactggtataatttagcacctaagagtctgacattgcatgacatcaaaaga

SEQ ID NO: 21317 - DNA, 510 bp, Homo sapiens
ataggcttatttttttgctttcaataatcaagattattcatcaaatttaaaaggtaatcactgagctatctatttctcataggaaaacatgagaaacttgaaaattaagaaagcagattgtgagaccattaaggaaaagaggacattacagtaatagagaatgtatggcaccttccactcacgtatcaatgcaatcagggtatatgcagcctttatcctggttcagacaatgtgatagaaaacagaaacaaataaacctaggcatagcttctgtcctcaagtaacaaactgcccagtagacagactgaaatagtaagaaaaatcttaaaactgtgaaaactaacttaatggttcaaaaataagaaataactaattaccttaaatttcagagaaagtttgaatgtatttttaacttaaaaatatgtgaataaggctgggcgtggtggctgacacctgtaattccagacctttgggaggcgaaggcgggtggatcaagaggtcaggagttca

SEQ ID NO: 21318 - DNA, 568 bp, Homo sapiens
cagattgcaatatgcaaccagaatagagagccactggtctagagaaaaagagagttctgttgtgattcagacccaaaagtatggggccagcagcggggcaagtcccagtggaaaagtcagctgtaaggcacggtacagaggaaaactggccagcagtacagtatttaatgtctgattggttgcagaaggtgaggaaaataaaacagaaggtaaagacttaagctaatgttttcagcctcagtgactgaagaaacgcagatttgacacggggaggaagaaacagccagagattagttccatttagacatgttgaggccagcgcggtggctcacacctgtaatcacagcattttgggaggctgaggagggcggatcacttgaggccaggagttcaagaccagcctggccaacatggcgataccctgtctgtaactaaaaatacaaaaattagccgggcgtggtggcacctgcctgtaatcatagctacttgggaggctgaggcaggagaatcacttgaaccctggaggcagaggttgcagtgagccaagactgcaccaacacactccagc

SEQ ID NO: 21319 - DNA, 546 bp, Homo sapiens
tttctatttctgccttcatttggtcacccctaatacatttacagttgttgtcagtgagagagtcagtgtgatttaagttattgattaattacttgaattggaattactgggtctttttactttcatatttacctgtttgctttattatttcatttcatcattagtgtagtcactttgacctaggttggattcctggttctgctgtttattactgtgttactccaaatttctgatcttcagtgttcctgtatgtaaagtggaaatgatcatatgtatctcagagttgctttagaatattaaatgtgaaaatatacgtaaagcatgtgacacataacctagaagttggcacttgtaaatactacttccctttattaccataattattctataaggttggaaggtcaaatattactatatgggatgaatcacttaagaccttactactagataccagaagtacagtttaattatattaaatatgtaaggtaagtttatgcctgccagaggttcatttctatattacacacacatatatatatatatatt

SEQ ID NO: 21320 - DNA, 599 bp, Homo sapiens
ggctcaatgtctatgtcttgtctgcttagaagacagacatgacagctaaactttttaaaaattctcataggattttcctgtgcttttcaggtccctctggccagaccaggttcatttgtaatggagattttgcacagatttcacaagctttgctaatcccctccataagaaagataagctcggggcattcagcttgacatatgtagtttccagaaattttgtcagtgtttcttagaacttgtttaaggtgccatgaaatatagcagtgaaatgtaaagtgttggaattgtttttctaggaaaactcattgtagatggagagcaaggtatctaataggatgtggaagttctaaataaatacaagaagacatgaggcagcagagagaaagagaaagtagcagagagaaagtgaaagtagcagagagaaagtagccaagagaaagtgatggtccattcatttgtttatgtactcaacatcttccagttactgcctactatgtgccaggcaatatgctcgatgtttgggggatatgttggtgaatgacagagacacatccctgtcctaacggaggtttcaccctactgggacacacaggcaag

SEQ ID NO: 21321 - DNA, 112 bp, Homo sapiens
gcagctactagagacagaagagtcattgtgatttagttgtttggtgaattgctcatactttcaagggtcatcggtagcataactgcaccttggtgcttggagaaagcagagt

SEQ ID NO: 21322 - DNA, 440 bp, Homo sapiens
tcataaggtgaggagagggaggtggcgttatcagttccactttttccaggctagagtgcagtggcccgatctcggtgcactgcaacctctgcttcccgggttcaagcgattttcctgcctcagcctctcattttatcttggataaaagagaagctttgaaagattgcctccctatgtgtacagtcactgtaggcatgtatttgtgtactgtttacttagtcatgtcaatgagggcaataaaaaacaaaaatcaggaagcccaacatggattgctacattttaattctttcaaataaggaagatcacctgaggtcaggagtttgagatctgcctgatcaacatggtgaaaccccgtctctactaaaaatacaaaaattagctgagcatggtggtgtgcgcctgtagtcccagctacttgggagactgaggcaggagaatca

SEQ ID NO: 21323 - DNA, 523 bp, Homo sapiens
ggcccattaagtgggtacaagaggattaaggggttatatgagtacccaacagctgcaccagctaagataaaacaaaggttcccaaatcttatgcctattagtatatggaatgaaatgatacattctttatccatgcagtaggatattcatatttaaaaagaaaattaaattagaaataaaagctcattcattcaaatgcaaagcattgtgcgaacacaaatgaagaaatgtagaaagaaatacaaaacatttccccttctcttgagaagcctacagagtctcagtaggcatgatttaaaagttcaaaacattaaataaaattaaagatttaaataaaagcctgagtcaccaaagaaattctgcaagttagttcatgaataactgctgaacaatacacgtggctgcaatgcaagtttcagaagtgagaacatttcagggccagaggttaaaggagaaagttgacgtaatcaagaccttaaagattggtctgaagtgtgtgtacgaaagttggaagtaatctgag

SEQ ID NO: 21324 - DNA, 596 bp, Homo sapiens
gggccaaggtgggcagatgactggaggtcagaagttcgagattagcctggccaacatgaagaaaacctgtctctactaaaaatacaaaaattagccaagtgtcgtggcacatacctgtagtaccagctactagggaggctgaggcggaggttgcagtgacccgagatcgcaccactgcactccagcctgggcgacacagcgagactctgtctcaataaataaataaataaataaataaataaagggagggggcttagtcctgggggcagatgagcctagaaggcgaggggctcaagggaaggtgttagagggaccctagagtgcacatcacctccattctagacgccgccagagacaaaactttgagaaggcagcttgggagtcttcccgagttccgagagtccagctcccagaactgaccatgttgggcccggcgccctctgctggtcactctgggagctgctcctccccttccccaaccaaggtaattccaaacgtgagagacccccaaaaggatcaccttggccaggcaccgtggttcatgcctgtactcccagaactttgggagaccaaggcgggtggatcatctgacgtca

SEQ ID NO: 21325 - DNA, 556 bp, Homo sapiens
acattgcccaggctggcctcaaactcctggcctcaagtgttcctcccgcctcagcctcctgagtagctgagactacagttttgcaacagtacacctggacaatttttttatttttattttttgtagggatgtggtcttgctatgttgctcaggctggtcttaaactcctgacctcaagcagtcctcttgtcttggcctcccaaagtgttatgattacaggtgtgagtcaccacacccaacatgtgtctatatctgtagatacagatacacacaccatttctacctgaatatatagcaatatatatgtgcttccacattctttgtctacatgtttttttttcctccaggatgaatctgtgatgatgaataaaaaagtgaataaaaaagttatttttattcaggtgtagataaactacttctgtttctctcaagctgctataacatgggccatcttgtttggttagaatgtatagtcaattccttagaatccagaagaggagtcattaattcttgctggaagataagggccaagctgtaacttctggcatatggagga

SEQ ID NO: 21326 - DNA, 439 bp, Homo sapiens
cctgacctcgtgatcctcctgcctcggcctcccaaagtgctgggattacagacatgagccaccgcgcccggccctggttctattttaaataaataaatacatgaaactaaaacacaattggaactttatttgctctttgatgacccttcatagcacctcaatttctcatggcatgcctcttgcttggtttacatcatagaatttctggcataatagtgggtcacctgaggtgaggagttcgagaccagcctggccaacatggtgaaaccccaactctactaaagatataaaaattagccaggagtggtggtggcacctgtagtcccagctacttgggaagctgaggcaggagaattgcttgaacctgggcacagaggttgcagtaagccaagatcacgccacttcactccagcctgggcaaaagggcgaaactccatct

SEQ ID NO: 21327 - DNA, 542 bp, Homo sapiens
tgagaaaaactgaagacagcagtatgttgttcgactttgtttaaatctctcttcaaatgataccataccttaccttacaatgaatgaaaaaacagcttctgtagacactaactagtttggggattatttgtacaggaatcttcttcaggccaggcaaatatttttgtttctttgtttcaatgtccttatattttactggaatttcatttttgctatgtatttcacgtgaggttttgagtttgtttctccacacttttaaagactcatttttaatccttaagaagtaaaatagccaaactgaaataatttttttaaattgtgccaggaggatcaggaagccacagagaagacccttggtagtggttagttctccctgggctcagtcctcagaaggtagggctggaagggaccttttgggggtcgcagatttccacccacttactccaggcagcccaggtgtctcttgtctttggcctgctgtcattttcaggacaggcttttcaggagttggactaatcttttgtgccagtttgcttctctta

SEQ ID NO: 21328 - DNA, 554 bp, Homo sapiens
cattttgtcatccaggctggagtgcagtgatgcaatcttggctcactacaacctccatctcccaggttcaagcaattctcctgcctcagtctcccgagtagctgggattacaggcacccaccaccacacctggctattttttttcgtatttttggtggagacggggtttcaccatgttgaccaggctggtctcgaactcctgacctcaagtgatccacccacatcagcctcccaaagtgctgggattacaggtgtgagccactgcactgggttccctctgagggttttaattccctggcatttctggtctgtcatagcagagtagcctttggtataaggcaccccagtccagagatggagatactattggcgatgggaaaacatcaggagcacaccaactggggcagcccaataaaaagaggcatggatatcacatcatcagcttccctgactttttatcataaaagtggttaatgcacatagtaaaaagctcaaacaccatgaaaacgcactaataaaagtatatctcggctgggcatggtggcttacacctg

SEQ ID NO: 21329 - DNA, 553 bp, Homo sapiens
agttctgctctttctgcctctcagactgtggacaagtaaatctttgcagccatcttatcacctgtaaaacggaaatgacaacagtccctacctgataggtgacttcctctctgctctccaggcctttgctgatgccccatcactctggtcctcttctcccgaccagactgtgctccagatggcagggtccaggttagtctggaatcattggcatctagcccagtgctggctgggaccatgtgttactaagtgcaggctctgcagccagacagaccaagtttatcaccctggttcccctgctaccagtcatgcgacctcgggaaagtagtttactttaagcctcagtttccttatccaaaaatggagacagtaggactatgaaaggacataaattaggtaattcacatgaaagcacaaagatgacagctgccaaacggtaagtattctacaaaatgctggctataattagtggtagtgacaggcagctgatacactgctgtttaataaatgtttccgaggccgggtgcggtggctcatgcctgtaatcccaaca

SEQ ID NO: 21330 - DNA, 540 bp, Homo sapiens
ctcactgcaagctgcgcctcccgggttcacaccattctcctgcctcagcctcccaagtagctgggactgcaggcatccaccaccacacccagctaattttttgtatttttagtagagacgggtttcaccgtgttagccaggatggtctcgatctcctgacctcatgatcaaccctcctcagcctctcaaagtgccgggattacaggcgtgagccaccgcacccggccatacccagttactctttataaactaaggtctctgtggttttgcatgtaattttcttcctctatggaatgtctttttacccttctctatttggaaaatcatacagtctctactaacttgttctaaatataagctatctctattcccctaaccttaacatgctcccccaaattcgatctgtattttcatccccacccttaccatcaagacaagcagaattaatgtcttccattgtttctccatagtcctaagtacctactggtactataccgtatgtcacattgtttaggcctgtgttaggtggtgagatatact

SEQ ID NO: 21331 - DNA, 586 bp, Homo sapiens
tacaggaagtgcctgtgccttgtgggaaaggaactgaccctcgggtcctggaggacaggaaatagaatggctgagtgggcctgggaatattatatgatggaaaggcaggaggtcatagctagtggcaagagacagatgctgtctcattgtatatgggaggaattaaactgccataggagtgaataataggactgataagtaacatttattgaatacttactataagttagacactcttctaatatatttacatgtattagctccattaatccttataataactccatatggttattataaggaaactgaggcacaaatagattaagcacatctaggaaacaactgagccaggatatgaagtcaggtcctctgactccagagtatacatcactctggagccaaagtaggctcctagcctctatgctggcagacctgaaactccagtgtgcgttagaatcacaggagggctgatgaaagcactgttgctgttccaaacctcctagtttctgactcagtaggtctgtgtggggcctgaggatttgtgtacttaagagttcccagataaggctgggtgcggtggatcgcg

SEQ ID NO: 21332 - DNA, 587 bp, Homo sapiens
aaggccccaggaggagactcaagccgtaggtggatgcccagaccccaggtaattacaaggccccaggtggatatcagattccagatgaacattaggccccaagtggatacctaggcccctagtaaacctcagattctaggttgacattgaggcccccagtagtcatttggacccatgttgacactcaggtgccaggttcacatgatgtcttaactggacaccaaggggccagtttgatacccaagtcctgtgtgggtgccaggtccagggttacactcaagccccaagtggacaccaggccctaggtgaataacacaacccaggtggtcattaggccccagaatgacaccatcccccaggttaacaggaagcccccaatgggtacctaggccccaggtggacatcaggcctaatgtggacacccaggatcaagatggacatcaggactcaggtggacatctggtgacaggtggacaacaagcctggtgtgtaccttgtccccgggtggtcatcaggccccagttcaacaccagtccctgggtggattcctcggctccaggtggacatccggtcttcagctgaacatc

SEQ ID NO: 21333 - DNA, 579 bp, Homo sapiens
acagaagggtggtaatggatctgccataactcatgtgacaaaggccactattagttattccattgaacagcaggagctggagcatgaaaagggtaacgatcagttcaagttcattcagaaatccttgactctactgtctcagcctcactctgaaatacatttttataggccaaggatcagcaaacttcaaccagcaatccaaatctacctccatgcctatctttataaataaagttttattagaacacagctatacccagttgtttacatattatctgtggctgctttccacactgtgtcagagtcgagtggctacaatagagactgtatgacccacaaaacctaaattatttgctctctggacctttacataaaataatttgtgacctctaatctagaccaccaatagttttgtttcttcctgcccttcttaaaattctgatcacaggccgggcgcggtggctcaagcctgtaatcccagcactttgggaggacgaggcgggcggatcacaaggtcaggagatggagaccatcctggctaacatggtgaaaccccgtctctactaaaaatacaaaaaa

SEQ ID NO: 21334 - DNA, 534 bp, Homo sapiens
ggtctcagacaattttaacaaatatttagagtacttaatttttctttgaattctaaatattatccttctttagttcaccatagttggatattttgagataactgtggaggaaacagcactgatcctggggccatgaaacctgatttcaagatctagtcccttctttaattttgcacaactaatttaatcacattcatccttaatttcatcatcattaaaatagcagagaataattcccgtttcatggagttgatatgcaatgaaatagcatatcaatgtatgtatgaatgtccccccacatagagtactacacaaatgaaacgtgtcactcagcataacgttatgtgctccttcctgcaactggattgcactccagtgggatttcgtgctggtgagatggctgtgctgctggacttcatgggacaccaatctttgaaaataagcctgatctggctgggcgtggtggcttatgcctgtaatcccagcactgtgggaggctgagacgggcggatcacctgaagtcaggagtttgag

SEQ ID NO: 21335 - DNA, 571 bp, Homo sapiens
aaggtatcactgaggtgagacgcagggctctggtggggggtgaaactcctggattttgaattagacagggctccgatcctgcctctgctgtgtggcctgagccagtctctgggagctcccatgagaatggggaggctgcagcagcccagagcgggcacacaggaacacaggcggagaggcaggctcactgtgatgaaaagtaagagcgctggggtcaagttgcctggggccaagtcctggctctgccactgcagagtgaccttgccctgcctgagcctcctggtcagcatcagcccagtggagaggcctccttaagacgcggggctgtgagaattaaatgaggctgtggtcccgcagcacctggtatggaaggggttctcaacacggcaaggtaatgacgattgttactaatatttacttgggtaaggtcggtgggggatgctggaacctcagcagcctgggatgggaaaagagacacagggaatctgggaggggctaggtggggtgtgccctggccatgggactgccctctaaggggctggtcaacaaagcaggcagacacctcaggctc

SEQ ID NO: 21336 - DNA, 597 bp, Homo sapiens
tacttttcaaaaatgttcctgcctattgtaagttccttgtgagcagtgactgtttcatggtattgtcacctgcacagttcctggcatttattcatgccttgataatgttaatgaagtgaatgaattaatatttggatgtctgtatccttcagaataattgtactgaacagcggcggtatatatattcatcgaataattcctgctcatagtagcaagcctccagtgtttcacctccaaaaatgtccagaataacaacagctatccttagtcaacattttccattaccaaacatttggctaaggaattcacactattgtttcatctgtttgcttcaacaatcccatgagcttagatagagtaacttgctcaaggctattaagtgaggtggtttgtaagtgacagaggtaggttttgaacccaagtccatagactgtattcatggccactatactataagagctggctatttggccgggcgcagtggctcacgcgtgtaatcccagcactttgggagtccgaggtgggtggatcacctgagattgggagtttgagaccagcctgaccaacataaagaaaccccgtctctactaaaaatac

SEQ ID NO: 21337 - DNA, 563 bp, Homo sapiens
acagagtctcagtgtgttgcccaggctggtctccaactcctggcttcaggtgatcctcttgtctcagcctcccaaagtattgagattacagatgtgagccactgcgcctggcctatagcagttatttataaccttgtattatatatgtaaaaatatttgttcctactttgtcattgagtcattaattcattcttgagacagggtctcgctttgtcacacaggctggagtgcagtggcaataacagctcactgcagcctcggcctcccaggctcaagcgatcctcctgcctcatcccctccccaaaccccagtagctgggaccacaaatcatgctactttgtcctttatcttttaactctgcttatgatattttttggccatacaaagttgtttaatttttaccttatcatttatccatcttttatgttatagttcaggttttgttatgcatagaaaaccctttcaaattcagtgattagtggccgggcacagtggctcacgccaaatcacgaggtcaggagtttgagaccagcctggccaacatagtgaaaccctgtctctac

SEQ ID NO: 21338 - DNA, 572 bp, Homo sapiens
gggctctccccgcggccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaag

SEQ ID NO: 21339 - DNA, 582 bp, Homo sapiens
gaggtcgatcttaggctactaggcctaagttatggcaccgggctgtctgcttgtagattttatttctgccttttagtttttactttttctttctttagaggcagaaattaggcataagacaatatgaaaggtagtctcctcctttactaaaaatgcaaaaaaattagccggcgtggtgctacacacctgtaatcctaggtactggggagggtgaagtgggcagatcgcttgagccccagaggccaggtcgcagtgagccaagatcgcgccactgtacaccagccttggtgacagagtgagactctgtctcaaaataaataaataaataatagtatctcctctgctcagaagtgtctcagaatgctaggcatggtggcccatgcctgtaatgtggcctctccatcaccacatctctcttctcacctcctgcgcgtgccccactagggcctctgggctgttcctcagacaactccagaacctcttttaggtcttctggactcaaatattatcttcctagtgaaatcttccctgcgaatcccatttaaaattgaaccacatggctgggtgctatactcccaatgc

SEQ ID NO: 21340 - DNA, 583 bp, Homo sapiens
gacagaagggcgaggtcaagagatcgagaccatcctggctaacatggtgaaaccccatctttactaaaaatacaaaaagtttgctgggcgtggtggcgcatgcctatagtcccagctactcgggaggctgaggcaggagaatcgcttgaacctgggaggtggacattgcagtgagccgagatcacactccagcctggggacagagtgagactctgtctcaaaaaataaataaataaataaataaataaataaaataaaaagaaaaatgggagtcagaatccagttggaaatgggaaaataattgtcataatcattgcaaaaaggctaagtgagttaagatcattttgcatgagtgaattaaacaatgaactcaaatctctgtagaaaatctcggtttcacttagaggaactttttgaccacagagaatataaactgttggaacacatgtcatctcaagtggttacaaaccaaaggaaaaggaagtctgtgggtcacgtgtgcctgggttgatgtgtagatgggttcgtacttgaagaggggatgagcagaagctctgggagctgagtgaaagtagtggcagct

SEQ ID NO: 21341 - DNA, 529 bp, Homo sapiens
cccagtgggacacagatctaaggcagacattaggccccaggtggatctgggtggaattcaccctgagggggacattcggccccaggtacgcatcaggcctcagctgaataaccagtccccaggtggacattaacccacaggtcaaccacagtccccaggttgatacctggtccccaggtggctactcaatctgcagggtaacattaggcccctgtaggatcccaggccccaagtggattcctaggcccctggtgaacatcaggtgcaggtgtccaagtaggccctgggtggacataactgtgtacaggtaaggagttgacctgtggggaggatgagcagtcagaagcccactggggtcctgcgtaggtcttctggaagggggaggctgaggggatggaaccttaaagaagcaacctcacttctttggcaacagaccctaacagaacttagaattctggtaaccaggcgaggcacggtggctcacacctgtaatcccagcactttgggaggctgaggcaggaggatcatg

SEQ ID NO: 21342 - DNA, 436 bp, Homo sapiens
ggacttgatgcagaattggtgcattaacatatgtatgcattacatatgtatacttgtgccatgctggtgtgctgcacccattaactcaacatttagccttaggcatatctcctaatgctatccctccccgctctccccaccccacaacagtccccagagtgtgatgttccccttcctgtgtccgtgtgttctcattgttcaattcctacctatgagtgagaacatgcggtgtttggttttttgtccttgcgatagttgactgagaatgatgaattaaaataaaaatgcatgcactttcaaatgtacttagtgcaacatattgaacttacattccagttttcctggaattacttgtgtcttgagctaaaggctgtatttggtataacagggaaggaaagaaattatttttcctataaaattagtttaaaaacacata

SEQ ID NO: 21343 - DNA, 549 bp, Homo sapiens
gcaagagataaatgaggagtaagagtgtcttaaatcatagaaaatgcatttcttgggaaactaagtggcagatcactatgggttacattcttcttgcatttgcctatctttattaagagatgaaattagcccaagaaagttctagccgaagacagaagggagcagtatcagctttcatgtatacactaaagggaaacaaagttggatcaggtgtgctgataaatgtttaacaacaggctttccaggtagaaaaagcccctatatgacattcctgatgacctgggaaaataccaccaaagtggagatggaaataagtgtgtacaactagctcttgtgatccggtatgaactgactgcggtgcactggttgtatgtaaaggaaacattatttagaaagtaaatattttgattttcattttcagcaatggaaacagaggcttagcaggatggacatcttgattaattttatacagctagaccatgagggagacagaagattaagaatagcagttatacatgccaacctctgcattagctttaatcctgattc

SEQ ID NO: 21344 - DNA, 547 bp, Homo sapiens
ctttctctctatgtattacacacacacacacatatagatagatagatagatagatagatagatagatagataggatattacatatatatatatttagagacgagagtctcactatgttgagtatatatgtatatatatatgtgtgtgtgggtatatatatccacacacatacatgtaaactatatagatatattacagataactatagcatctgtcccaacactctctaatatacatgtatatgatatacatatatacacgtgtagtatacatatatgtatattagagacagcattgagacagatgctgtaatttatatgtgtatatgatatattgctttagataaataacacttattttgtgtataatcagaaacaaatttagaaaacttagaaaagcataaaaataaagattgcttataattctgcgggtagatcacctgagatcaggagttcgagaccagcctggccaacatggtgaaaccctgtctctactaaaaatacaaaaattaggccaggtctggtggctcacaactgtaatcccagca

SEQ ID NO: 21345 - DNA, 493 bp, Homo sapiens
tagttgactattttgtatttcacttatctcttctagactattatacttccttgttttatcatttcattagctgcaatagggtttatgatatgcatatttaacttatttatgattgattggatgtaggaggaatggggggagaaagattccaaaatgacactgacatatgtggcctgggtaacaagaggaaccactctctgagatggagactttgaaggaagattagtttggggagtgatgaaagggctggatgatgtggtcagttttggacaagttgcatttaaagtgcttctgaggcatccaagaggagatacctggtagacatttctttacaaggtccagagctcagggcagtgtccggggctggggctggctctaggggtgaagggcagaggggtgactgttgaatgaatgggaacaaggtagtctgtggatgcagaacgtgcgatgggacaggaagagtccaggaccaaaccctgaggagccccaacat

SEQ ID NO: 21346 - DNA, 594 bp, Homo sapiens
agctgtggtatggctccaccatggcttcctgatccccagatcccagctgaagcgctttcttcttggtaccaccatgtgcaggggtggccttgtggtttccagatggtgacctctttttcttctttccttttactttttgtgtaacatactctgtaccagcctgggtgccatagcaagaacctgtctctataaaaacttcttaaaattggccaggcatggtggcacaggcctgtagttccagctactccagagactgaggtaggaggatcgcttgagcccaggaggttgaggctgcagtgagcagagatggcaccactgcactccagcctgggcaacagggcaagaccgtatctcacacagaaaacaaaaatacatttaaacaaaacaaaacaaaaatacatttaaaaactcatttataaaaataggacaggggaagctgtaggtataagaatgtatgctgggaagccgggtgcggtggctcacacctgtaattccagcactttgggaggctgaggtgggtggatcatgaggtcaggagatcgatatcatcctggctaacatggtgaaaccccgtctctactaagaatgcaaaaa

SEQ ID NO: 21347 - DNA, 563 bp, Homo sapiens
aatggacaacaaaaatgcctgctggtctaattagactggcccaccccatactctcaggtggaccctccctaacttgatgtgttctcagggctctgtgacaaggggtacgagcttggtaccaagctcctaggcagactttggaaagaatcgctgacccaactctattcagtagcttcttgccaggcctcctagaagggatggaagagcagcgcccagctaaaagtggtgtgccagacccaggctggtctcttcttgccggctgaccttagggactgactttgtccccccatctgctgtgctttcttccctgtaacacacagtggggctgggaaggcactaaagcctgaaggctgttggaggaccgccctgggctcagggctgagagaggaagggaggagtgcaacaaaggtcacagcaggtctgcctttgttccccagtgtggaggtagagtcccagctcctggagagagtcacatgtccataaagaagcttggcctggccgggcacagtggctcacgcctgtaatcccagcattttgggaggccaaggtaggtggatcatttg

SEQ ID NO: 21348 - DNA, 569 bp, Homo sapiens
acctcccaaagtgctgggattacaaacctgagccaccacgcctaaacttaaattcatttttatccagattagaatctatgcagggtaactgtgttgcaaaatgcaatgtgccttctgcaattgtgccatgctgtggtactgatcctgtgttccatcatcataatcactcccttgcacacaccttccatgtccttattcctttccccttctaatatttaatctggcaacaactactgattaaacctacatctacccacctactctgtacctagttctggaaggtaacaagcaactatgctgactgatttccttcgaaatgtatgtggcttcagtatgctcagcaatcctactctatttctctatcagttcattctaccacctttcaaagcaactgattcacaccttcctctctgcaaatccctagccttccccgagcgactcctttctcaattggtggattcccttctattctactggggacaatagaatccaacagtggagagctttctcattcacccaccaccaaatccactaaactccttgaatctgtagtactgtatattcttagc

SEQ ID NO: 21349 - DNA, 619 bp, Homo sapiens
agtgagtgaatcagtgatgtaaggggagtgtggcccaagatatgtgtgctgagatggactgcaatgacatgtggttactaactgcagaaagcaatgtctgcacctcaagtaactgattatttagtgcccttttctgtgttttcttctatgtacaatggaattatctaaagctatcgtatagttaatatttaagtgataaatatttttatatcatcatcaacacatttattgtggcttcattaaacaaaactatgtcacactgtcttaaagagattataggtatcttagtgagagctagtgtttaaataacaacttgtccagatcttccagtccatcatgtagtatcatttctctttgcatagaaacaaatactttcaaatgtttacccaaatcttatgacttgacatttttttaccaccagacctgcattacaagaggttctgaaaggagcactaaatatggaaaggaaaaactgtcaccagccactacaaaaatacacttaggtacacaggccagtggtgctataaagcaatcacaaaaacaagtctgcataataaccagctaacaacatgatgacagatcatatctgcacatatcaagactaaccttggatgtaaat

SEQ ID NO: 21350 - DNA, 525 bp, Homo sapiens
catttaatgagtgccttgtttgtgcaagatcacgtgctggccaacggagttatagagagaaaagaagtctcaatcccagctttgtgatcttctgatgggggagatagagaatagtgtgatgagtgctatgaaacagagggatgctggagcatcagagaggaaacaaggggcagggctggggaaatgttcctccccgaagggatgaggtctgggtggagtattagaactaaaaggagttgtacagacaaagaaggggaaaagcgagagttattttaagctggagtgtgtgtacagtgtggtggctcagtgtgtgcgaagaatgggtgtctggaagcattgtgcattgagacgactgcaggtaactgcctggtatgtaggagggagaggggttctgtggggtagaaagagattagctggggtagtaacagaggtgagatgcccatgtaaaggagttggattttacattgacagtagttatggatttgcaatttaggaagatcacttcagatttttggaagatggatc

SEQ ID NO: 21351 - DNA, 494 bp, Homo sapiens
catatctatctctgagaagactgtgagctacttgcgagaaggtggatgccttctttattattatttccccgacacctagcatagtgcctggcactagataggcactattcaatcactgtttgatgaatgatggcaaaatgcgtagtattgacaatatagtactggtacttcagagaatgggaagattgatatcggttagaatgctcacagaaagcctcatgaagaagaaactgaggagactcttgaaataagtgggacaacactacaattacagaatctatataaatagaggaaaggaggcaggatgagcttggctatttgcagggaaaacaaaaaggataaagtgtaatgagaatagacagtttatgttgagaatataaggtttgctacagagagagaaaatgtattgaatagtattgataccacatgaattacttagtatttcttctgccaaaaaggcaattttgcttgccttttctgacccttttgaagtc

SEQ ID NO: 21352 - DNA, 75 bp, Homo sapiens
ttccgtaggggggaagatcagtcatgagaagcagaaagtaactctaccttccttgatgccagggagctatgatga

SEQ ID NO: 21353 - DNA, 501 bp, Homo sapiens
catgtgacctaatgttctggagagaggtaaaattaaaagtacatgaaatggagcataggagttatgtgataccagaaaagtttacgttgaagcactcagctaaacaaagagaatgctacctctcagcttctaggcttgctttccagttacaaaattggcatttttcaattttcatacaaaaagttaaaaaaacaaatttatcacagtaaagtatcagatgcttggatgaaaaaataatatgatctatctggcaaggtattcagattatagtgtcaatcaagtgattccttatcaaatttataatttttggctaaaagtatattgcttataaaatataattccacaaaatttgcaattttttctgtgtgaactgtgagtgaatttttaaaagattgatttatttctttaataatcaacagaggctgggctcagtggcccatgcctgtaatcccaacactttgggaggccaaggtgcgtggataacgaggtcaggagtttgag

SEQ ID NO: 21354 - DNA, 459 bp, Homo sapiens
atttaatatatttgtatataactataataggaaccctctacatgcctcccacttttctaatttacttccccttttgccatagcactagtatagcctcatccgcatgggtaatgtgcctattgtcagcctaccaaaagatagtgctgctgctttatgagacaggtgagaagacccaactctcatgcctggggatcctttacggaaggaatagcacacacttttaaaacaacataccacagtctaaaagcatcattttgaaatgtaacaagcactttattgcaattactcattttgataaagtttattcttaggcgttaaccatttctaaaggatccccaaatcatcacttacttaggtgaaattatataaaatgacacatttctgagaaatgtttaggtccagtgaaccgtagttggtttatgggagtgatttcaagatagccaaatgaactttgatttt

SEQ ID NO: 21355 - DNA, 608 bp, Homo sapiens
gggttctgcgccggatccgggagaggggcgggcgccattgtgcttcgctgccgactgcatttcctcagtcacgggcctagaactccaaggagaaaggcggcgaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtagtacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagt

SEQ ID NO: 21356 - DNA, 589 bp, Homo sapiens
ggaaggtgggggcgggggaagaagacaaacaacttatatcaagtaattacagtagtttgtgctgagagttacaagaggaaaatgcagggcataaagagaacataaagccaagataactaatgttactgaagggtcaagaaaggctttcctggaaagtgccttccaagctgagagctgaatattgaggggaaagggaaagaatgctctggttggagggaattgtatgaataaggtaagagagaacacagaccatttaaggagccaaaagaagctcagcctgtcttaacgtgaaagaagagtgacaagagatgaagttggagacacccgcaggacaagacctcagagctgttcataagtcaggttaaggagtttgggctttaccttgaggcagtgagaagtcaactaagggagcatgtgagtgtgtgcacttgtgtgtgtgtgtgagggaatgtgtgagtgtatgcacttgtgtgtgcatgtgagggagtgtgtgcatgcgagggagtgtgtaagtgtatgcccttctgtgtgtgtgagggagtgtgtgagtgtgtgcacttgtgtgtgcatatgagggagtgtgtgcata

SEQ ID NO: 21357 - DNA, 513 bp, Homo sapiens
cgttcttattattatagaataatctgacctatttagagaggtgtgggcaccaaaggggattaagtctaaaagactccaatcaagaggacattatttctccactccattcaatttaacaaatattgatggtactttgactttgtaccaggcactgtgcacgtcttgttgaagatggaaatatgtatgaaatatggtctctgcccttaagaaatttacaattaagaaacaatgtaattggctgggcacggtggctcatgcctgtaatacctgcactttgggaggctgaggcaggcggatcacctgaggtcaagagttcaagacgagcctggccaacatggcaaaaccctgtctctactaaaaatacaaaaattagcagggcatggtggcaggcacctgtaatcccagctacttgggaggctgaggcaggagaatagcttgaacctgggaggcggaggatgtagtgagccgagatcacgtcactgcactccagcctgacagaatgagactccgtct

SEQ ID NO: 21358 - DNA, 591 bp, Homo sapiens
  misc_feature 510: n = A,T,C or G
ggcttgtatacagagatgtcttaattcttgccttgggtcatggctgtgggacagcatgatcagactgacttctgggagtcctggggccagaaggaagtgctccaaactcctaggggctggttttgaacaacctctgcttggccagcagatgttgggtagggaaggaagtgggtttcctggcttgtttctgacagaaagaagcaggttctgctttgaggagacaaacagcagtctcacttcctaggttcccgtgacctctgacctcagcctaccttctacaccacactgacctgatgaggctgtatcctggcctcaggggataaaattgtcccctgagagaagcttggagccagagacaactttgcagactgcctgttccaaatacatttgtgtctcatctgaggaactcagagagtggaaagtgatcaggaggtcacagggcccgatggtcacaggccaggacagaagccagggtccgtgagccttccgaagctcctcatctaccccggngcttcctccggcccctataaatccttctgtcccagaggctggagaagcctggcaggtagaggctctgggcatctcatcact

SEQ ID NO: 21359 - DNA, 534 bp, Homo sapiens
agctaaacgtaatcaatgttagtcccaaaattagagaactaggccttgcaagaagagttctgagtattttttacatgaagtgacagtccttggctaaatctgacttggagtattacattcaagaaaacacatctgatctgattcttcacactacttcatatgtaactactccaactaaaaagaaacaccagaccactaaaaacataagacaactcgttcacttacaaagtcagagtgcctcactaccctgttaatatctatgctgtcaaaaggcatgatgaggacaaaagctcaaaagctgagtattaaaactcaagttcttaaaacaaatgaggcctcttttccataaagtatcattaagtcaacacataaggaaaaagaccacgaatggtgaaagatgtgttgtaacatacatttaacgaagtgaagagaaagggcaaacaaaacatgacacaccacatgctaaatgaggtgtctgatcatgtcagtggctatgaactacttctttgagtctagcatatctggggaaaaatt

SEQ ID NO: 21360 - DNA, 595 bp, Homo sapiens
catttaatgagtgccttgtttgtgcaagatcacgtgctggccaacggagttatagagagaaaagaagtctcaatcccagctttgtgatcttctgatgggggagatagagaatagtgtgatgagtgctatgaaacagagggatgctggagcatcagagaggaaacaaggggcagggctggggaaatgttcctccccgaagggatgaggtctgggtggagtattagaactaaaaggagttgtacagacaaagaaggggaaaagcgagagttattttaagctggagtgtgtgtacagtgtggtggctcagtgtgtgcgaagaatgggtgtctggaagcattgtgcattgagacgactgcaggtaactgcctggtatgtaggagggagaggggttctgtggggtagaaagagattagctggggtagtaacagaggtgagatgcccatgtaaaggagttggattttacattgacagtagttatggatttgcaatttaggaagatcacttcagatttttggaagatggatcaaaggagttgagattaactaggagtgcaaaatgattggggcctgaaggaaggcagtaccagtgagtatga

SEQ ID NO: 21361 - DNA, 476 bp, Homo sapiens
tttttattggagtgggttggttttaaaacaagataggacttgtgagtttaaactaaagattcttagaacattctggaatgatatttatttttatgaaataatttctagtttaaacacatgaaattgattttagcttgcattctaagtcatctgagatttgaaggatgttccatgtcttagtcttatttattggggcaactttgcaattccaaaaattatatacacaaaatgaactcctcttgtttctgtgtcactttaactagaggctctatgtgcaagacaaaataccaatccttcagatttatttatttatttttagacggagtcttgttacatcgccaggctggagtgcagtggcgtgatctcggctcactgcaacctctgcctcccgggttcaagtgatcctcctgcctcagcttcccaagtagctgggattacaggcacgggccaccacgcccagctaatttttgtatttt

SEQ ID NO: 21362 - DNA, 430 bp, Homo sapiens
gcacataaaaatgttttgctttaagtagaccaggtctagagctagactctcctgggagatgaagttcactaggtgacaaatacaagataaatgttaccctctaaccctctgccccatgctgggacgacactgctggtcttctggtaaccaccgaagacaagtcttggttccttttcaggagcacaatcgtctgtattcctcctgctgcgccttctgggactgtgcggcaggaggctaggcagtgctgactctagggatacactatggccaccaagctctttttcccctttgtgtagatggcccatgatgatagggcagtatgataggagttaggctcctctcaggcggcacccattagacctccaggctataaagaagtagagtcaggccaggcccagtggctcatgcccgtaatcccagcattttggga

SEQ ID NO: 21363 - DNA, 468 bp, Homo sapiens
tgctttattcagactgtatacatatgtgtgtttcagtttcaaaacaaattgaaaccagctttctaagggtttgttgatcacagctttatttagagaagccattttgctactgttgagtcaaggtggaagacttgatgactttactagatcaacaatgaagtgagggtaacttacaactatgtattagaatagaaccatttatttaagggaggtcctgtaactcccatactttaaaaattaagtataacatttaacctagttctcaagatcggcgttggaaagggatgtgagatttcagaaatactctaaacttattggtaggagtagaagttactgacaaagtattcagcggctatacacaatttttaagatgagtgtgtgggaataggttgaaaagctaaatgaagtattttgtttagtaacagtgaactttggaaactaattagtggattaaatacaaaactattg

SEQ ID NO: 21364 - DNA, 551 bp, Homo sapiens
ggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagaacgccacccaaagaggagcaaagtgagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgagccaaagagttcagca

SEQ ID NO: 21365 - DNA, 193 bp, Homo sapiens
tgcaatgtgaaataagcacataagcaaagaacaatgcttttctagttcctcacagaaacatgcctaagttctggtgatcaccgcaggccttacccatggcctatcccacattcatagggagaaaactggtctaatgaggtcagagttgggactagcttttttttttttttttttgaaaaaaaattttgggttt

SEQ ID NO: 21366 - DNA, 552 bp, Homo sapiens
ccctccttgcaacagcacccagattctccttatgagaactgtctctgcttaacccattcttgcggcgcctatgtaggcacttagacgctccctcagactccagaatgagtacagcccacagacaagaggcatctttcttctatctggccacggactcaggcagttccaacacaaggttcttgaaggggaagtttgctctggggctcagctgtgagaaccccagcctagagtggccagtagctcccttggcactacggaaagcaggcctgaaagaaatctcactcccacaggtaaggtgtgcagacctctggaatggcccaaccatcctgctatcaggaattcatggcctcatctaaagccttccctttgtgagggctgatctactggtgggctgatctattgacttgcttctaactattggagtctgacaaaagtgagatgaggtctcaagagacagacctgctgtacatgagacaaagctagagaaaatatccaggtttcaggagttcaagattagcctaggcaacagaatgagatgcagtctctctaaaa

SEQ ID NO: 21367 - DNA, 522 bp, Homo sapiens
cctcatgtggctatttccaattaaaattaaattttaagtttaaaatgcagttcctcagatgcactcattaattaactaattagtgttcctaactaaattagctaataaattaaaataattagctaattaactaaaactgaatgaaatttaaagcacagttcctcagtgtcaccagccaaatttcaagtgcttagtagcctcatgcagtgagcggctattgaacaggacagtacagatattgaatatttccatcactgggaaagttctatcggagaacactggttgtgcagttgaggcacagggtctagggccagacagacgtgggttccacccttgtgtttcacttgacgggagactctgagttagctatggagcctctctaaggttcatctgtaaaatgagaataggacttcacaagcctcctgtgaggatcacagaacatcactgcaaatgacagggcgtggggcaccagggggaccatgagactgagctcctgagtgagccgcttgcaaacaccatgtg

SEQ ID NO: 21368 - DNA, 514 bp, Homo sapiens
acctcaaacattacaagcatggcattttttacacctaggcagatgccttaatttgacctcacttattcatttatttgtttattcaacaactatttattggacatttactctgtgtcaggcacaatgctaagtgctaaggatgtgaagataaatctctgctctactgaatttcagtctagtgggagagagagagacaagtaaatagtctatttctttactatatgttaagttatccaatagaggtagataccaagttttgtgggagcacaaacttcactgttgtcagtgaaggattcctagaggaagtgtatcctggggtgagtcctgaggaataaataagagtagcaagttaggattattcatagaattttactccatcttctgtgaagacggagaatacataccaaattgtggaggcaaaagaaagcatggcatggtctgaggaaaataggataattagggtagaagcaggaaaatgtttgttataagaattgtgtgtaggaatttataatag

SEQ ID NO: 21369 - DNA, 535 bp, Homo sapiens
agaagtggagaaacccaacagtggtttggaatgcacacagaaatactagcatgtaggtgcctcctgacccctcccagcagttggacatcatgctcccacccctttctcccttctaaagcactggccaaaccaaatggcttctttctctgtattgcaagtgtaagtcaatccaagagtacccttttggacataatacaaagccaagaagaaagttgatggatcatattggacggtagaaagtgtacaaatccaacccagcaaattgcttatcattatctacgttccagcctcagtaggtgccaacaaggagcagagatgaatcaatctttctgctcaagccctgtccaaattatggaacctctaagattgggggtggtttgtgacgtaacaatagataaccaaaacatacatcaaccttccacctatggcaaatgccttaaattctgctctggcaagatctggctgccaaatggaccttttggatctaatccttagggtgagatcagtttcacattgttctttgctaagtgctttt

SEQ ID NO: 21370 - DNA, 449 bp, Homo sapiens
ctctctatctccatgacattcctggcctcattccacttctagcttactcctcccctgggagtcattcagttgggtggtgaacttggtgacatcaatttaacatgcataatcctgcctcttcctctcggaagttggccagatcatagagaacgtgaagtttacccagctcctccagagacaggctctgtccccacagcagggtccaatgtggcctgagactggaaaggtaggtcctccccaggctgggatttacagcctcatgtgagtctcacactgagctcatcttagcctttattaaccatgaagatgatactttcattttccatctattgattcttttgtcctatttctcaatgtgttcagaactcaggcaagtaatggagtgctatttattgtgttctcctaaaaatatatatcacacccatctcacgttgggatctctacaaggc

SEQ ID NO: 21371 - DNA, 503 bp, Homo sapiens
gatattttcacttgctattagcagcaaacgtacaactttatctcttatttgacttcattatttggctttcaaattaacaacatgaaaactatacagaaattagtctgtgccctataagacagagatttagataatttgttcaaaacatgagatgatattcagatattctctcaaaggcaggactccaacaccacaggtggaaaaccaacaaaaggaagaaaacagaaaggtgggggagataaggagtagccaggaaaaagaaaatagtgataaaggaagagccaaaaaggaggaaagggaagatgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactacaggaaagtattaacaatttggcagataat

SEQ ID NO: 21372 - DNA, 365 bp, Homo sapiens
gtaatatttgcctcttcctgattaaatcatttcctattcaaactggagcatgaactatttcacacttgaaattcttaacccatatgcaactctcaagggctgaattgtgtcccctgccaactcctatgttgaagccccaacggccagtctctcagaatgtgactgtatttggagacaggtcctccaacgtggtaattaaattaaaatgaggcctttggggtaggtcctacttcaatctgactgatgcccttaaaagaaatttggacacacaaaaaggcaccaggatgcgggcatgcagagaagacagaccatgtgagaacacagcaagaaggcggccatctctaagccagagaaagccctattag

SEQ ID NO: 21373 - DNA, 493 bp, Homo sapiens
ggtgactaatagtggggtgtatggcatgtggcaagctcttcctttttaagagcaaaagacatcgcacttgtaaaacaggacaaatgaacttgtcccctcccatcagccccagagggaaaaccaaaggagaattccatcagaatacactcacccttttcatctacttgaactgtggttagcaagggtctaatcagagtcagcctcaggagtgagccttggatctcttgctggtgttttgcaacatgcctcacaggtctgtctgcatcccactgaaatgtgaaacaaaagagcaaaggatggattctacgtctgcagttctctttctgaagctttttattttaaatcaaaaataagctctctggattaaactgatgcactcaggacctgattgtcccccccacaatattgctttccctttagatgtaatgagcaaataaacaagcgggacagttaaacttcacatgaacattacattgacatatgtaatggaaac

SEQ ID NO: 21374 - DNA, 499 bp, Homo sapiens
acatgatatttagcccaaaactttcatttcggtcacatcccaaaagttctttaattaaaaagaagaggatcagggaatttatttattagtttattaatgaacttatttattatttatagatgtgtttataagataatctgttttcaaaagatttaagttgcttatgacagagggaatatagattattcaaaatggaatataaaaaccttccatgttaggtccatggcagatttgcatgtgaagaggaagatgcctgctttccagagttttctgaagaagcaaaagaatgtcatagcattgaaagctggccaggcccagtggctcacgcctgtaacccccagcactttaggatgctgagacgggaagatcacctgaggtcaggagtttgagacaagcctggccaacatggtgaaaccccgtctctactaagaatacaaaaattaaccgggcacagtggcgggcgcctgtaatcccagctactggggagactgaggcagga

SEQ ID NO: 21375 - DNA, 549 bp, Homo sapiens
atgaacacacagctcaaagaggagcaggacagaactgccgtctcatttgaatatctctctgggcctgattatttaaaaggacttgcatttctcacatgaaagttattttcttttctcaatgtccataaatgagaataaatagacgtaaaatagatcttttcgaggatgaagtaaatggaatgaaaaacaaaacccaagctgaccagaaatcatagagggaagaaaaggttataaatatatggatttttcaaagtgattttaagctattaggaatcagttaaatgttgggggattttgtctgagaatgagctaaaggagaatgtcccttttgccttctgaagtttccctgaaaatcactaataggaggcagatacatagtagaaaaggcatacaggtttctgcaatgtgtgtacactggagcccttagatcgaagacccagacacacgatgtgtgcagaagcttatctaccatattaagtttacagaaagaatggggtcttggatcacagggaaaaaaaaacaaggttacgtgagaaaacgaccctggct

SEQ ID NO: 21376 - DNA, 515 bp, Homo sapiens
tcttttccatttacaactgggtattggtttaaaaagcagccaaagactccagttgagaaaaactaagtaattggatatattttaatacataaaatgttacacttgttaaatgttactgaccatagctttctcatccctgcttatgatccttgttggcttttattttctaacattctttaggctgcaggtaacagaaagcaaactccaactaaactgaagcagtaaacaagtggaaggactccgaggtggctgacgagcttgacaaacaagctcacgggccctccctcaaggactagaaggcaaggctgaaaaccatcaggactctgcctctcgctggatgtctgcttcattctcaattttttcccatgaggttggaatcaaggttgtcagccatcactgggacttcttcctttcctgagagaaagtatcttcctagcttcagttggagagatcctagggaaggacacctatgtgacctatttggggtcacattcctgtcctgtggactggtgtct

SEQ ID NO: 21377 - DNA, 571 bp, Homo sapiens
ggaagttggtataggcacctttctgtgtgcttgtgggcctagtaatgtagaagaaccttaaaatggattttttaaagagagttgttcctcccattctttcgggagatgtggttttggatactagtactgaggaaagttccccaagattagttaagatgaaacgtcttagctcactttcatctgagaagacggtggatgagcaaggtggaaccaatttctgtcatagtaattatgacaaatacgaacaccaacaactagcttcagcgccagtcagcaaagtaaataaatactgtgcttcttccaactttcattccacttggggaaaaaaaaatatcatcatgtcaaacattacgattgacccatatgtcaaacctggtgaatatgtcatcaagagcctctttgcagaatttgctgttcaagctgaaaagaaaattgaagttgtaatggccgaacccttggagaagctattgtccagatctcttcagaggggtgaagatcttcagtttgatcagttgataagctctatgagctcagtagcagagcactgtctcccttccttacttcgcacctt

SEQ ID NO: 21378 - DNA, 430 bp, Homo sapiens
aagcctaactcaaggcaatgggcctgctgtgggccctcttcacaagctctaggttctcattcactaggtaccaggcactgattctgtgccaggttgtgcctggcaggaaggatgtaaatatgaaaagatgactaggacaacgtcccagctctcagggaatcgggcactctcctacacaggtgggaatgcaaaggagcagcacttttctagaagcagtttggctgtatctatcaaaaccttcaacgcatacaccctacagcccagtaactccacccttacgactttttcctagggaaatcatggaaaaagtaaacaaaggtcaatgaaaattcacagtcatcatggtactactctaatagcaaaaatcaaacaacacaaatgtcccttaatataccatacatgaattatttaaaaagatattatagcatag

SEQ ID NO: 21379 - DNA, 519 bp, Homo sapiens
aatgatatgatgtctaggattgacttcaacataatctgaggaggaatataggtgaaacacgattggccatgagcagaggcagggaggaggaaatctcctatgaaatagtacaaaaagagaaagagaaggaatgcaagaaagagaggataagagacagatgatacaatgagagaccaccatatgtccagcacggcttctagaaagagagaaaagagagaaaaggggtagagttaatctttgaagaattttccagaaatgaggaaagacattcatcttcagattgcacaggcctaccaggtgttaagatttaaaatcaaaactaaaactcaggcccagatatattctctatagactataaatgataaaaaataaaatcctaaaaaccataagagggaaagccagacaacctacaaacgaacaacgaccggcttgagagtagacttcctgtcagcaacaaaagatgcacaagaccgaggtgactttaaaagtgtcatgggccgggcgcggtggcaacggtgg

SEQ ID NO: 21380 - DNA, 541 bp, Homo sapiens
tacaggcattattggagtcgtgcaatctctcagtgttgtcatctctagacttccatttctagaaatatgacagaatggatatcccaaaaagcctcttactgcaaaacatctagaactgatttatcaagaacaacaagcagacttgtaaaagcaaatctgagctggtgagaaagagaaggaatttcctaggagtgaaaacaacaggaagaaagctgaaggcaaaggaagtcagataagccctaatagctttgtctggcctaccgagttgactgatcccaaccaaggaggctgggttttaaaagccactcagaaaaacaagactaagccttgagccagctccaattagaaagctgaaacttaaatgccaacataaatgtattggaaaagcagcaaggctgaaaaaaaagcactgatcattcatgttgaaaaattggataaagaaaagcaaatgaaatccaatgaaggttgagtgaaggaagttataaagaacagaaattggccgggcacggtggctcatgcctgtaatcccagcactttggga

SEQ ID NO: 21381 - DNA, 89 bp, Homo sapiens
agtgttgggattacagacaggagccaccacacttatttgttcttaccctcaaaatagtcagaatttaatcaaatattatgagacacagc

SEQ ID NO: 21382 - DNA, 546 bp, Homo sapiens
tcttaacttttctgaacctgtttcctcttttctgaaattagaataatccctccttcctagagatgttagcggaaggattcagtggtctacccttggattggaaaacattgtctttagagggtcatattgtaaatgttttctgttttgtgagtcatatagtctctgacactgcaagagcagccttagatagtatgtaaacaaattagcatggtcatatatgcccaggcagcgggtcaaatttgtcccccaggctactttgccaacgctaaatataaagctgttagcacactgcctgtatacagcaggtaattaaatgattccctaccaccaacactaccccctagttccatcgcttctggcaactgcataatcatcaagaggtagactttgggccgggtgcagtggctcacacctgtaatcccagcactttgggaggccgaggcaggtggatcacttgaagtcaggagttccagaccagcctggccaacatggtgaaactctgtctctactaaaaatacaaaaaaaaaaaaaaaaaaaaaaaatttt

SEQ ID NO: 21383 - DNA, 579 bp, Homo sapiens
gacctaagagcctggatatgacaactctacaaagccaatcaagcctttgagcagcctctacgacaagaggtccactgggtcacagcaaagtatagatctactacgggcaaggcattgtaggggacaggcttaagatacgtttcctgctgggcacggtggctcatgcctgtaatcccagcactttgggaggctaaggcaggcacactgcttgacctcaggagtttgagaccatcccagacaacatgacaaaaccccatctctacaaaaattacaaaaattagccgggcataggccgggtgcagtggctcacgcctgtaatctcagcactttgggaggccgaggcaggcggatcatgaggtcaggagttcaagaccagcctgaccgacatggtgaaaccctgtctctactaaaaataaaaaaattagccagtggtggtggcgcatgcctgtaatcacagctactcaggaggctaaggcaggagaatagcttgaacccaggaggtggaggttgcagtgagccaagatcacaccactgcactctagcctgggcaatacatctcgaaaaaaaaaagctgggcct

SEQ ID NO: 21384 - DNA, 593 bp, Homo sapiens
ttgtttgtttgtttgtttgtttgtttgtttaatgctgtttgagacctgctaaattgattttatgtcccactaatggattgagatttgtaggttttaaaacacaggttcaggctacaatggatataagcactacatattttttttcatatttcatacactatgtttctcaaaaaggaattttgctgcttttttttctttaatacttttttgtgaacagctgcatataagggtcatcatcactcttatcaatttacagtaaattttctttataaaaacagttaatttaggctggatttggtggctcacgcctgtaatcccagcaccttagaaggccgaggtgggcagatcacctgaggtcaggagttcgagaccagcctggccaacatggtaaaacgctgtctctactaaaaatacaaaaattaggctgtatggctcatgcctgtaatcccaacattttgggaggccgaggtgggtggatcacttgaggtcaggagtttgagaccaccctgaccaacatggtgaaaccctgtctctactaaaatacgaaaactagctgggcatggtagtgcgtgcctgtaaatcccaactactcg

SEQ ID NO: 21385 - DNA, 579 bp, Homo sapiens
ttgtgatgataatattttatgaagtgattctcttccctagccatttccaggaacaattgtataaagattgcattgaatctcattacagaaatttatccaaatataagtatccaatcctttattaattcatacattcattaatataatgaatatttgaatttttagtgtatactaggaactcactgaaggtagacttggaaacaaactaaataaattacctcacattatattttgaactgacgtattactatgaagaataaatgtgtacatgttttgagaagtaataaatgttatgaataaaagtaagagctatgtagacaaaaagttattgtcaagggtgcatggctacagtcataggatgggcaaggaaggaatctttgaggaggttacatttggacagaggcctgagtgaacttatctctctcaactgagaaccatatttctcaaatgcaaaaacatcaattgcaaagattctgatataggacgatacttggcattatgcagaaaagataactaaaccagagtgactgaagcaagataaggggaagaggggcttgggcagacaaagacatgtaggct

SEQ ID NO: 21386 - DNA, 614 bp, Homo sapiens
ggtgcagtctctgcttactacagtctagacctactgggctcaggtgattctcccacctcagcctcctgagtagctgagattacaggcacatgccaccacatccagctaatgttttgtgtttttagtagagaagaggttttgccatattttccaggctggtcttgaactcctggactcaggcaatctgcccaccttggcctctcaaagttctgggattacaggcataagccaccactccctgtgaaaacatggcttttaagcaagagcatgtacattatcataaagctttaaaaagaccacattagctggaatgtcaggaattgaataaagttgagggcagatacccaacaagcagatttaggaaattcatacatcacatgaaagatgaattaatctaatggatattgggttaacaataattgccaccgggtgcggtggctcacacatgtaatcccagcactttgggaggctaaggcgggtggatcacctgaggtcgggagttcgagaccagcctgaccaacatggagaaaccccgtctctactaaaaatacaaaattagcagggtgtggtggcacacgcctgaaatcccagctaccggggaggctgacacaggc

SEQ ID NO: 21387 - DNA, 614 bp, Homo sapiens
gatgctaaggtcaatgggagcaacttaggttaaagggtatctggagtgcgatgagcagctagcaattttaaatagggtgctcaaggaaggcctaatttaattttcatgaacagcacttacagagtttaagagatgacaagaggtaatatctgacttttatgagaaactctaaaaggataaatgcataggtaaaggctcaaacctaattttaataagtaagacttaaagaactaaatatgctgctatcagatgcttttcccctaacccatttattttaaattctatgcatatttatagaaatattaataatgtcaccactgaccaatggataaaagaagatatcaataaaccatgaagttatgcaattgggaaaataaacacaactttcttctttaagtaaaaccacattttactaccataaaatccccattgatttctacagttataccatttttcaactcaacttttcgccattttctatatagtgctgcaaacaagtttaatagctgatggtcctccaggcagattttatgcctttttgttgttgttgtttgctttaaatttttcaactgttgatcatgattattttactctagagatatgacatttctgct

SEQ ID NO: 21388 - DNA, 613 bp, Homo sapiens
aagctaagaattatgaggcttcagagcatttccccagaatgagaactagattctcctgcttcatatgtcccaatcaatggcacaactgcccaccctctatccctgcaactaaccaaaatccagatatttttatacctttgaaggaaggacaacattcacagagattcagtttcagtgagtacgttatgagaggctaatggagaacagctgcattccaaacttatttctttatggtgagctaataaaggatagattgctcacagggtgaaaagaagtgtgaaaatacatctgaatctttgaaacactgccacagatgacagcaaaataactatgccaataagatttgaggacatattgcaatctatgccactgttgcccactctatatgaaaacacaacacaattacaaaaactaaataacatttatttaacatttattaacctcttattgtgcatcaagctctgtgctaaacttcgggaattgaaaacaaatagaacactacccgtctcttcaggagctcacattttgttgtctgttggagacagataattgaacaaacaattataatagtgtggggaagtgctataataaaaccatatgcaagggcttacag

SEQ ID NO: 21389 - DNA, 615 bp, Homo sapiens
ctgtttgttcttttacattaaatttacaatgtatttgccatgtttcaaaaataaatttaattggaattttattgaaattgtatgagacatgatttagtccaagatgaacacacaacattattattactgtttccatccagctatgtcatatttctttgttttctctagttgtcttttatatcgctcaataaaatttgtggctctggtacatttcctaattatcatacattatatttcattatttctaattattataatggattgcatgtacatttactatgtaccagatattatgcaatatattcattatctcaattcataaaacaatcatgtgatttagttggtgttattactagattattaccattgtacaagtaaagaaaataaagacaaaagaaaagagactcagcaaaatcaaaccaataaagacttaattagaattgttgggcatatagtaaaaatttaatacaactcaatgaaggcaaaaaaacattttaaaaaatgaccaggcagatttgagaaggatccaaacagaaattccagaaataaaaacataattgttgaaattgaagacagatttgacagcagattacatacaattgaaaaggaaaatgt

SEQ ID NO: 21390 - DNA, 504 bp, Homo sapiens
gcatggcaggcttgtcttgaggaatattatcaggcatatgtaaacagacgctggggactggcttgtgcagttgaactggccctcttgcttttctatcactgccatgaagagaagaacatccctcaagtagtagattaggctaagaagtatgagagacaaacatagaagacctggattacaacttcatcttggagttaagcccagccaaccccagctaaatcagttgagtccaagctgacccacagatgcatgaataaatttattcaattcggccgggcgcggtggctcacgcctgtaatcccagcactttgggaggccgaggtgggcagatcacgaggtcaggagatcgagaccatcctggctaacaaggtgaaatcccgtctctgctaaaaatacagaaattagccgggggtggtggcgggcgcctatagtcccagctaatcgggaggctgaggcaggagaatggcgggtgaacccaggaggcggagtttgcagggagccgag

SEQ ID NO: 21391 - DNA, 564 bp, Homo sapiens
gagaacgtcgagatggagcccaactcactccagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatggcgaggatgaagtcattgctgtttccgaaaaggtgattgtgaagcttgaagacctggtcaagtgggtacattctgatttctccaagtggagatgtggcttccacgctggaccagtgaaaactgaggccttgggaaggaatggacagaaggaagctctgctgaagtacaggcagtcaaccctaaacagtggactcaacttcaaagacgttctcaaggagaaggcagacctggcgccaaatcttaaaggcagaccacgcaaaaagaaaccatgcccacaaaga

SEQ ID NO: 21392 - DNA, 565 bp, Homo sapiens
ataataactaatttattaagtacttctgtgtgccagggattgttcctaagcttcctacaagaataaatttatttaatcttcctaagaatcctgtgaagtggatacagttgagcatcccaaatcccaaatgctccagaatccaaaactttttgagcactgacatgatgctcaaaggaaatgctcactgaagcattttggatttttggattggggatgctcaaccgtaagtataattaatgcagatattctaaaatctgaaaaatcctgatatctgaaacacttctggtcccaatcattttggataagggatactcaacctgtactacttactctctccatttcacagatgaagaaagtgaggtagggaaaaagataagtaacttgcccaaggttacatagcttactgtctcctaaccattattctatgctacctttcatgggccctcatgttaagagtaactcttcagtttagcaaattattctgcattatatgatgagcttacatataatagcaataatagaccagaagcggtggctcacacatgtaatcccaacactttgggag

SEQ ID NO: 21393 - DNA, 602 bp, Homo sapiens
cactgcaaattagtaaacattttatctaagtaaatcaaagtttgctaagttggcaatatgcacgctgctcttttgaattttgtatggttaaattgtttcttaggaaaattttctggattcaaacatggcatccctcacatccccttagagggaatgactggaaagttggactcaactgggattgtcaactagagtgccaaatggggccaattcaaggaaggaatgttccaagtgataggaaataaatgatgacagtttcttaaagcctgggctagaaaacgggcacagtgtaattccactgtacacaactggtgaaagcagttgtacagccccctcagattcaaggggagaggatataggatcacagctctcaatgggaggaatgttaacaaacttacagcaattttcattccaccatacaatttagtggtggattaggagagaaatattctgagttcttccatatctgaaaacgtcttcagtctgtcattttttggaggtgcatataccataatggaggcccagataccattttaagttggaaaatagatttttctctcataacctcaaaaacaatgctccatcttttggtgtcctgtgct

SEQ ID NO: 21394 - DNA, 580 bp, Homo sapiens
taacataaacatatgctaagcatgtactcaaatagaatgtttgcctatataacattttaaaggtaagttttaaagtatcaagtgaaaatatttttgatttgtatgtatatataaatgtatgtgtatatatacattcttaatatggtatagcatgtgactatcacaattcctaatctagatattttactctgtgatcttgggcaaggtattttcctttgctcacctaaataggttttttaaaactttttactttatctattaaatgtaaagtaaaacaatctgtatcagagatttgtgggcagaattaaaggaagccagagtacttggatcttcaggccgggcgctgtggttcacgcctgtaatcccagcactttgggaggctgaggtgggcagatcacgaggtcaggagatcgagaccatcctggctaacacggtgaagccctgtctctactaaaaatacacaaaattagccgggtgtgttggcgggtgcctgtagtcccagctactagggaggctgaggcaggagaatggcatgaacctgggaggtggagcttgcagtgagccgagatcgcaccactgc

SEQ ID NO: 21395 - DNA, 517 bp, Homo sapiens
atgtagaaatcagtatggtgggtgatggtataaggaaatctcagttttatatcctgctccatgaggatataaaacttgtatcaagctcagtgttttcccaacctagctataaattacatgttcctcattttgtctgagaccataacaactttaatgtccatgttcttacaaacagtctcctcaaggcaatctaggcttcttctagtatgaacctcaaaacccttccagcctcagctggacgtggtgcctcacacctgcaatcccggcactttgggaggctaaggcaggtggattgcttgaggtcagaagttcaagaccagtctggccaacatggcaaaaccctatctctgctaaaaaatacaaaaaaatagccaggcttggtggcacacacctgtactcccagctactcgggaggctgaggcaggagaatcgcttgaaactgggaggcaggggttgcagtgagccaagatcacgccactgcactccagcctgggttaacagagcaagactctatctc

SEQ ID NO: 21396 - DNA, 452 bp, Homo sapiens
ctgttgtccagggtggagggggggggcacaatcttggctcactgcaacctccgcctcctgggttcaagggattctcctgccttagcctcccaagtagctgggactatgggtgcctgccaccacgcccagctaatttttttatttttagtagagataggttttcaccatgggggccaggctggtctccaactcctcacttcaggtgatccacccacctcagcctcccaaagtgctgggtttatagatgtgaggtatgattctcaatgcaaatccgattcagtcttgggacacatatttatgataatatccttttctactttggaagagttaaggatagcaaattaaagcaaaccattttcttacagtataggtaatagaaaaaatttacatcaattttaccattattggtcttgataaacatagttgtgaatagatatgactcttgctttagt

SEQ ID NO: 21397 - DNA, 579 bp, Homo sapiens
aattagataaactgccaactatctaataatgggaaaagaaaggggttaaacttcgacacaaaatgtggaagaaggccgggcgcggtggctcacacctgtaatcccagcactttgggaggccgagatgggtggattacctgaggtcaggagttcgagaccagcctggccaacgtggtgaaaccctgtctctactaaaaatacaaaaaattagctgggtgaggtggtgggtgcctgtaatcccaacgggaggctgaggcaggagaatcgcttgaacccaggaggcagaggttgcagtgagccgagatcgtgctattgcagtccagcctgggcaacaagagcgaaactctgtctcaaaaaaataaataaataaataaatgtggaagaaatgtaaagactgtatatttctgctaataaatttgaaaacctaaataaaatggctaattgtctaggatattacaaattaccaaaatggaatcaagaagagatataatacagaatgtacaacaacatgaagaaattttttaaagtatcatagaactgaccccaaagagtactgaggtcagacagttccataggtga

SEQ ID NO: 21398 - DNA, 435 bp, Homo sapiens
gtacaggaactgaaagtgaaattttgcttatacttccaagatgaatggattgtgacattgttgatcgattctgcttggttgtcctaacaatttatgtaagtgacctcacatcattttggatctgatgatcttagcttacagattatgttacagcctattttgtctgcctctatatttgtagttacaaagtatgggaatgtagggcaaggttaccagtaaagatgtgtgtgtgtgcaatttccagcttcaagagctttggaaaaaagtgcagtaaccaaatctgtcacattcgaaatatataatatttcctgtgactacttctggtaaactgccctatcatagaaaactgaaggaatcagcaaatacccatgagctttgcttagaattgttccactatcattgatatcctgtgtatggatatgaatgactatggat

SEQ ID NO: 21399 - DNA, 468 bp, Homo sapiens
cctacaatagttttataagaatctatctcttgatagatgtatttaaaatgatacatttaaaagttgacattatgtaacaaataacattaatccaagattgccatgtaaacactactgtaagcacatatccctcttgaagagcattcatagagataaaagaattatagagttttaaaaaagactggcactgaactttgaattttaagtacaaaagaatactagttataataaatagaaataggcatagagaagataatttcaacacctaaaaacagattcgatcataaaaactaacattagttaatggattataactaagcaatattttgctttaaagggaaggcggggagaaaaattgaccttttgtgtttgtttgagtaaatgtatatttggcacatttccaaaaagattttggatggaagaaaatagcacaaagaagcctatgtttaaatatcacagttgtgacat

SEQ ID NO: 21400 - DNA, 593 bp, Homo sapiens
tgtctacaatattgcttgaggcaaatacactctatttgctggtcactgcgaattctaagcagagaatatcatatagaaaatataaattgtgcccttccttgagtacatacaccaaacaggaggaatactggtacaaaagtagatacatataccagtggtacagaaataaaggcaaatacttaaaacaaactgatctttcacaaaacatacaacaatataaactgggaaaaggacaccttattcaataaatcattctggggaaactggatagctacatgtagaagaataaaactggatccctatctctaacctcatataaaaaatcaacttaaggtggattaagacttaaatatatgacttgaagccataaaaattctagaagaaaatttaggaaaaactcttccagacattggcttaggcaatgaactaaggactaagaccccaaaagcaaatgcaaccaaaatataaataaataaatgggacctaattaaactaaaaagcttctgcacagcaaaataataatcagcagagtaaacagacaattcacggaatgggaaaaaatatttgcaaactatgcctctgacaactagtat

SEQ ID NO: 21401 - DNA, 468 bp, Homo sapiens
cataacagccaataaggttgctacattgaaggggatgaattttacttaaattatatttattaaaaaacagtaattgttttacagtcatgactatttatatcctctaaatttttgagacagggtctcactctgtcacacgagccggagtgcagtggcatgatcatggctcactgcagccttgacctcctgggcccaagtgatcctcctacctaagcctcccaagtagctgggaccataggcatgcaacatcatgcctggctaatttaaaaaaattttttttgtagagatggggcctcactatgttgcccaggctcgtctcgaacttgtgggctcaagcagtccttccgccttggcctcccaaagtgttggcattataagcatgagccactgaaaactttatttatttattttttgcccagtcttatggtgctaatgaaacttaattttattactctatcacacctatat

SEQ ID NO: 21402 - DNA, 560 bp, Homo sapiens
atacatacataaattattagtgggaatttggacaaatcctagctttactcaaaaccatgaggaaactcagctacagcaggatagactcaagaaaagcaaggatcatgcccttcagcagaagggatagttaggccagcccattgtcccaatactatgatgaaatcgaagccaggatcagggtgctgagaactgcactgggtagattttcactgaattaagaggaaaaagaaaaggtaatgaacattatgagaaaagattagggaaacagaaaacagacccaaaagacccagtgtatgtgtaacagaaatttcaaaaatagaggctgaaacaacacagatggaagagaaaaaataaatagaacaaaaatttgcagaccaaaataaattcttgagtctttagtttgaagtacagtgctgtaagaattaaagaagaatcatacctggaaacatcctgaaaaatattcttaagtttgtctttgaatacagacaaaaggacataaatatcttttagtaagaagttgcagaggccgggcgcggtggctcacgcctgtaatcccaaca

SEQ ID NO: 21403 - DNA, 384 bp, Homo sapiens
agcttctaaaagaaattttgcaacatcttacattgcatagtgcataggaaacaaagactcaccaggacaaagctcccaaattaagcactaggttagtttctgattggagaaactgttccgaggagctctgaaaaatagaactacatttatcaaagttttagtgttgataagaagggcacccgataggttttcattctcagctatgagtccacagacacgactagaggtgaaataagtcttattaaaagtaaaatccagtctcgacccagttcaatcacagaataaatggagatattcaacccctcaagctttctttctagcaaatgaaagggactctctatgatttgaaaataaaatcactctatcttgagtgtgtgtgtatgt

SEQ ID NO: 21404 - DNA, 593 bp, Homo sapiens
ggtatccacttccaaggtggcttgctcatatggctggcaagttggtgctggctgttggcaggaggcctcagctcacaatgcaggctttcataggactacgtgagtgtcctttcaacatggcagcaggccttccctagagctattgaaggatgagaaaacgacaaatcgcaatgtcttttatgacctaggctgggaagttatactccatcatttatgcaatatcctgttatcacacaggtcatccctattcagtgtaggttggtactacacaaggacatgaatatcaggaggaagagaatctctggaggccatcttggagcccatagtccgccttctgccccctaatgattcacgtcttcgtctgttcctgctctctaagagccaggaggcagacttcccttgagctttcttgcagctaaagtagagcatcattagcagtaaaaattaagatatcatcacaaaggccaggcacggtggctcacgcctgtaatcccaacactttgggaggccaaggtgggcggatcacctgaggtcaggagttcgagacatgcctggccaacatggtgaaaccctgtcttcactaaaaatacaaa

SEQ ID NO: 21405 - DNA, 505 bp, Homo sapiens
gtttgtcctgtgtttttatgtatgcacctacccatcaaaatacaccttattaagtgtacttgtagaaatgcgcttgccatacattcagagggggttgggttatatgagtttttatctattgaatatttcctcttggagatttaaaaattacattaccatattcaaagttctatgacgtcctccattaacaaattagtataattttgtatagtccacttttgaaaacttatttgcctttggaaaatgtagagtaaggctataatactagaactacaggacttcaagttcaactggaaagccatagtaaagcaaatagtaaggaattagcctgaagttagtcatatgggtcaatgaaactaaatagaatacagatataggtacatatacatcatatttaatttctgacaaagacagcaaggtaagttagtagagaaagcatagtctttcaaaaaattattctggataaaatttaaaaacaatcctcaatgctttgtacacaatatgc

SEQ ID NO: 21406 - DNA, 598 bp, Homo sapiens
tttccgggggaaggagagtgtattaatgtggcccatactgtccagcctcctggagcacagagcagtggacaaacagagctgagtgtatcttgggggcaaatggaacactctatgcatataaaaaacacttgcatgtactccataaatatgtaaaacattatgtatcaataaaagaaaaaatctagctcaaacagtaaacactcctgccacccctgaaactgacatttccttaagagggacatccaactgtgacctaaacacaatgcatcctgtcccctcccagaagctgaggtgtccatactcacagagggtccctttgacagctggtaatggctcccagagtctcttcctggaaggcacattgagcctggcaggcacccaagggcacatgaatctgacccctctggggattgctgtcagctgctgcagatggaaggtgctgcctctgcggcatctcaccacggagctcccattcctcagcaaccccccatacctgctggccaaactgggggaatagagacatgagggactttgacctgaatcccaagtaaaattactccaaaatatttgaaaatttgaaacaacaaatcatcccatc

SEQ ID NO: 21407 - DNA, 468 bp, Homo sapiens
ggtacggctgccaaaagaccacagaagggtttgagaaactctgcctgtatcttattgtcaagttgttaatatttatctttataaaatgtatcctaaatatatgcatgcagaattctggatcagagatagatttcatatcaaacggggggtagtaaatgtaataagtgcgctggtacccctagctccagtcttactcctgaggtaacgtgatgagagccaggtcaattgtcctacaggagaaggcaagaacaaggaaactgatttctcctgttcctaaaagggtaggaggcagttgccccctccgctcctgagaaagtctcctccttatccaatccttttgtgtggaaataaaatctagccagaagctggatagcttgggtgtctctgccttaatgatcttgagacttctttaaattcccagccttggcaggatgtggtggctcacacctgtaattccagcattttggg

SEQ ID NO: 21408 - DNA, 588 bp, Homo sapiens
atttttatgtatagggatagtgattgtctgtttatttcttggaccttagtttttaataacttctttttagattcattgtgaaagaacatcttgtcattttgaaagtaattttgtggtttgaggatataaaaacacagtacttttctatccaagatattatgtgttatatgcagtatcccctcaacgttagggaaaatcctaggttcagttgcttcctgaactacctcaagtcatggaggagctctgaaaacttctgctttgcttcacagggtcatggaccctgttaagagagaacccttcagggaattagagaatcctaattaagatttgcagaaggccgggcgtggtggctcacgcctgtaatcccagcactttgggaggccgaggtgggcagatcacaaggtcaggagatcgagaccatcctggctaacgcagtgaaaacccgtcgctactaaaaatacaaaaaaagtagccaggcgtggtggcgggtgcctgtagtcccagctactcgggagactgaggcaggagaatggcgtgaacctgggaggcagcgcttgcagtgagctgagatcacgccactgcactcca

SEQ ID NO: 21409 - DNA, 605 bp, Homo sapiens
agagcaaattcacctttcctccacatttttgtggaggctgagggccagttggatgctgcccacctgcattggtgggggtgatctatacttagtccactgattcaaatgctaatgtcttccagaaacaccctcacagacaacccagaaatattgttttatcatctatctggatgccccttaacccagtgtggtcgacacaaaattaaccatcacacctggtgggggaaacttggctaatacctacctcatgggaatcaaacaggatgttcccaagcatgagcctggacatggcaaatacacagtaaatggcaaattccctcacaaaccatccagggaacccactggaaccattgcagaatgctaagaacatctcctggtgtgtttggggattggacaacattcttgtagcaaatatctttaatcaaaaagtaacttaacacatatctttgagcatgtatatgttccagtaaagtatacatgctaagaggggtttgaaattatcttttcttctcagcactttacagtttacaaaatacttcaatgtgaattttagtcacgttagctcttgcaacaacttaataatgtaggatccccgcatataaatc

SEQ ID NO: 21410 - DNA, 495 bp, Homo sapiens
cacagtgtcatgcctgtaagcccagcactttggaaggccaaagcgggcagatcgcttgagcccaggagctcaaaactagcctgggcaacatggcaaaaccccgtctctaccaaaaatgcaaaatttagccgggcgtggtggggggcgcccgtagtcccagctacttgggaggctgaggcaggacaatcgcccgaactcgggaggcggaggttgcagtgcgccgagattgcgccactgcactccagtctggacgacagagccaacctcgtttccaaaaaaaagtgagttgtgcactgggtcgccaagatgtcgttcccaaagtatactccttcacccctggccactatgccctcaaaccagccgaataggacatgtcttcggaaacccagcgggcgcaagccaagtgattgaccattaagagcctggctgaaacctgcttaccctaactgccgagggctcatcgaaaatcctgccttgattccttggacctatgca

SEQ ID NO: 21411 - DNA, 524 bp, Homo sapiens
tttgttccttcataatctttaagtatttgcttaaatattactttcttaagtgaggtctaccctgatcaccctatttatatttgcaaatccctacactccctatcaccctcacctgtcttattttttttccatagcatgtatccccatctgatataatatatactttaaaaatgtattcgcttgtttattggtttgtttcccaccaacaaaatgtaagatctttgaagtcagggatttttgttttgttttgttcactgctatatcccacatatatagagcagtaccttatgattagtaggtgctcaataaatatcttgttattaaatgaattctttcaattttcagatcattgctttttaaattctgaattcagagactagatgattgctttttatcactacacttctcagttaagtttgtggggtaacaacatgtgaggtggtgcccgcgtttgttactggaacagctaagtgatttgactgtttcctcatttgggagcatttgggaggaaatatgcacatttg

SEQ ID NO: 21412 - DNA, 594 bp, Homo sapiens
gaagaggctttgccggaagaacattttggcagtagccctcagagaggcatatcttcagcccataaacacactgtgattggaaaccaaaggatgaattatctatgaacattggttttaagccctgcaacaggggcataatagggaggtggactgtgttcctgccagctcatggtgaacagctgttactccaccaagccccttcctgaaagacctaagttcatcccaacacaatctcccctgctcctcttactcctgcatcccagcattcctgcacccccaacagagtgggagcctccattcatcatcagcctacctgagctggaactgagttttactctaagggccacctactgtgtggcagcctgaactacaccaccaaataaaaacttgctatcagaaagatttagagctagtctaaaagataagcttcctaagaactccccaccttcagccctccaagtgataatattggctcatatatccaatccatcattacaacaagcagtctctgagaaagccattgcacagaagctatcaacaaccaagaaacccatacagacctcagcccactgaaagcatccagaaatataaagc

SEQ ID NO: 21413 - DNA, 579 bp, Homo sapiens
aaacagatatattaccaaaaaagtgttcaagacctgcattcctgaacaataaaaatacttgaacaatatttaatattaagaaaatgtcaattatccttaaattgatgcacaaatttaatatgatctcagttgatataatgtggattgtgtccctgcccaaatctcatattgaaatgtaattcccaatgtcgaaggtggggcctggtggaagttgattggaccatggggatggatttctcatgaatagtttagcaccatccctcttggtactgtccttgcaatagtgtgtgagttcttgtgatttctggtcgtttaaaagcgtgtagcatctcattccttgctctctcttgctcctgccacgtgaggtgcctgccccccatttgcctcctgccatgattgtaagtttcccgacacttctacaaaagccaagcagattccagcaccatgcttcctgtacaacctgcagaaccacgagccaattgaacctcttttctttgtaaatcacccagtaccaggtatttctttatagcaatgtgagaaaagcctaacacaccagtaaaaatagatttttatttggga

SEQ ID NO: 21414 - DNA, 580 bp, Homo sapiens
gtagtacaatgaccaggtttaactgtttatattatttccaatctatacttactgctatatgaaaatatctgaaccatgttattcaaaatacattttacaaacataataattttaactttttattggtctatttaataaaaggctaatcaagatcaaattttattttatctgggacattgacaactcgggaaaaacaagtttagctttgaaggcttaatagatatagctctgccttgataaaatcttttggcttcttcattcctttaattcttcatttcttcctttaaagtacaagagtgcattacgggcagggtggctcatgcctgtaatcccagcactttgggaggcccaagagagttgatcatgaggttgggagttcgagaccagcctggccaatatggtgaaaccccgtccatactaaaaatacaaaaattagccaggtgtggtggcatgtgcctgtagtcctagctacttgggaggctgagcagaagaattgcttgaacccgggaggcagaggttgcagtgagctgagatcaggccactgcattccagcctgggtgacaaagcgagactctgtctc

SEQ ID NO: 21415 - DNA, 538 bp, Homo sapiens
ttaagtgaaaatggggtgtgagccctctacctctaaaattacatgattatttaggatcatattttgaaaatgcacttgaaggatggatatatattgtaggttcaggactgtgagagaggaagctggttggaattcatgtttcatttcaactacctcagatccttcatgtgacctttatcgggcaaccattgtctggtaccctgcactgcaatacttttttacagttattattatactttaagttctgggacacatgtgcaggtttgttacataggtatacacttgccatggtggtttgctgtacccatcaacccatcatctacattaggttttttttctaatgctatccctcccctaacactccacccgccaacaagcccctgggtgtgatgttcccctccctgtgtctatgtgttctcattgttcaactcacttatgagtgagaacatgtggtgtttcgtattctgttcctgtgttagtttgctgagaatgatggtttccagcttcatccacgtccctgaaaaggacatgaactcat

SEQ ID NO: 21416 - DNA, 569 bp, Homo sapiens
ggtaattaaaaaagggtatgaggaccaaaaaatacacaaagattatgtagcaaagcctatagcctgaaaaagtaaacattgaaatttgtatgtccataaaatgtttacaaaattcagtacatattacacaccccaccctaaaaacatctaagcaaagtagagaatgtagaggtgctacagattatattctctgattatgacacaacaaaactagaaattacagcatggaaatttaaaagctttctcttaaataattctatgtcaaaaagaaatccaggccgggtacagtggctcatgcctgtaattccagtactttgggaggccaaggtgggcaggtcacttgaggtcaggagttcaagaccagcctcgtcaacatggcgacaccctgtctctactaaaaatacaaaaattagctgggcctggtggcgcatgcctgtaatcccagctacttaggaggctgaggcaggagaattccttgaacccagaaggtggaggttgcagtgagctgagattgcaccactgcactccagcctaggtgacacagcaagactctgtcaaaaaaaaaaaaa

SEQ ID NO: 21417 - DNA, 476 bp, Homo sapiens
cgagtgtgaatttaataagcatttattccaacctacatcatctgattataaaactcaggtggggttttgtcattatgtccttaatagttccatcttcactgtagatacaccattaatccatgttaatagttgtctataaaataaactgtatgatgattgctagaatttggcatattttttgaagttgttacatatgactaaattttaggccaggcgtggtggctcatgcctgtaatcccagcactttgggaggctgaggtgggcagatcacctgaggtcgggagttcgagaccagcctcacccacacggagaaactccatctctactaaaaataaaaaattagccgggcttggtggcacatgcctataatcccagctacttgggaaggctgaggcgggagaatcgcttgaacctgggaggtggaggttgcagtgagccgagatcgcgccattgcactccagcctgagcaacaagag

SEQ ID NO: 21418 - DNA, 517 bp, Homo sapiens
gtataatttttgaatatatatttacagaatgctaagtatacatcatgtatgagcaactacatttacatgcactagaagtgcttgctcagaaacttttcttgtttttctaatgaagtacttggtcaataaatgtttagggggttctaaaactcaaagggattccttatcttagatacatcttccagataaccaaattagatgaaaatgtgtttaaaatgtttctactcatttaaacataaaatatagtctgctcctaaatgggcaaactgaagtagcatgtttaacacatgaactgagaaaatgtatagcatactaaatggtattctagagaataaaagcaagaatgtaagaaattaaatgacctttactaacctatcttatgtaaatttatcatgtgattattcacatatatatttttagtttctgaactaattaccatacacacacacacacacacacacacaaacacacacacagacacacacaaagatagagagagaattttgtcatctctccc

SEQ ID NO: 21419 - DNA, 372 bp, Homo sapiens
caaaaaagcatgggggacctactctgtttaagcattgtagtgggtgctggggataattatgtgtaagacaagatccctaccttctaggggttcatagtctggaggcggaggtgaggggaagctactttcaactaagcacctagtaacttgttaagacataaagtaattggcgagtctgattcttccacaaggttttgaatccttgagggcagggactggtacaatactggtatagccacatatttcaaccattgatgcattccatgcatgtattcatgcacttttacattaccacttggtgattgaacatacatagggtgtacagtgaaggaacagcccacgtgattgtttctccaggttgaaggagggaga

SEQ ID NO: 21420 - DNA, 616 bp, Homo sapiens
caggttactgtgtacagagtcatccacacagatgactgaatactgaatttcctttgggtggtttgattgccccatctagacctgacctgagagtgctgacatccatcaaggcgcagaccaggcagtcatgatgcttcaaaaggagcaaaagaactaagtgctactgagcagaactctgtgccaacatgaaaataactgttaagaatccttttctgttcatatatggggtaaatttcagaggctaggttaagaaacgacattacaccaaattgcaacgatccagttgcagcttgagaagaaagcactgagatgaaatatttgtttcctcatgagaggttattatctctggcagccttctgagtgatttgttaaaatggaacacaaaccaaaagatgaatccgatgagacttcctagttgttacaaatggggcaaggtataaattgtgaggctgactggttcttttcacatgtacttgggcaacagcacaggtgtcctctgggcaaagaaggaaatagattgctgttgaaggaatatatatattttttaaatgtcacagcctgagtcccaaataatgaccttgatgtgcccctgccaaaaaaaaaaaaaaaaaaaaaa

SEQ ID NO: 21421 - DNA, 521 bp, Homo sapiens
tcagtttttcccacttctgcctgcttttttcttcagacatcttatggtagcgtcttgctaatgaggaatttggtttgagattttgtgtagttttttacttgatgaaatgtcccagttttagtttaacattgtccatcaccatccttaagatataacttgctgtttaaatacgtctgtcattattgttgattatttactaaagtttcatcagacaggtggggcaaccagggatttctattaagtgagaacaaaatacagcgttaataagtgactcaaaaacctccaaaacattatgctaagtaaaagaagtaatatatgaaaagttacatatggtatgattccatttatatgaaagatctaaaatagatacatccatagtgaaataactcagaatagtagttgccagaggctgagggtagggggagaattgggagacagtttaatggacaagggtttcattaccttgaagtaagtgaaatgttttggaattagaggtagtggttgggtgacattgtaaatgt

SEQ ID NO: 21422 - DNA, 557 bp, Homo sapiens
gaccgtcctgaacctcacacctctcagagccaggaaggcatttctctagatgagcacagtcccatagaaatagactgtgagtggccgggcgcggtggctcacacctgtaatcccagggctttgggaggccgaggtgggtggatcacctgaggtcaggagttcgagaccagcctggccaacatggcaaaacctcgtctctactaaaaatacaaaaactagccaggtgtggtggcgcatgactgtagtctcagctactcgggaggctgaggcaggggaattacttgaacccgggaggcgggagttgcggcgagctgggatcgtaccactgcactccagcctgggtgacagagcaagactctgtctctaaataaataaataaataaaataaaataaaagagaaagtaatagactgtgagccaggaggcaggaggatcgcttgagcccaggagtttaagaccagcctgggcaacatagggagaccctgtctctacaaaaaataaaaacaaacaaatgaaataactgggtgtgcaggtatgcacctgtagtcccagttactc

SEQ ID NO: 21423 - DNA, 509 bp, Homo sapiens
tggcaccattgtagggatctttctctttctcctgatctcaaagaaaaggtttctatatttcaccatttctatatttcaccactaagtataatttttgctgtaagttttttgcagataacttccatcagaatagagaagtttgccaagagttcgtatctataaatgaatgttacttttataaaacattttttctggctgggcgcggtagctcacgcctgtaatcccagcactttgggaggccgaggcaggcggatcacgaggtcaggagctcgagaccagcctggccaatatggtgaaaccccgtctctactaaaaatacaaaaattagccaggcatggtggcacacgcctatagtcccagctactcgggaagctgaggcagaagaattgcttgaacccgggaggcggaggttgcagtgagccgagaacgcgccactgcactccagcctgggcgacagagcgagactccgtcccacaaaaaaaaaaaaaaaaaaaaaaaaaatttttggg

SEQ ID NO: 21424 - DNA, 464 bp, Homo sapiens
ttagaatcctggagagagacaaaggccactaaaaagagacaaaatagatgttacaaagcccatatactaaagccaacattctctataaacagacccttaagttcttatttatactaactcattttcgtgacacaattgttagatgggaattcagagtaaaacacatttttattttaaagaatcatctatgctcacttatatatatttttcaataggtaattcatatacccagaacaaaaattaagtgaaaaggaactttctcttatcaaaagtaatcactattacctatataccttgtgacacaaaattttctaagtttatcttcccacactgaaacaaatgggaattaggagaaagagttgcatacaagcaagaattgccctttgacaggagggaggaaacaacaaaaaaaatttaaaccaggcagaaaaatctcaaaaagcatgttcacggtaatctccgca

SEQ ID NO: 21425 - DNA, 557 bp, Homo sapiens
  misc_feature 483: n = A,T,C or G
ggagtaggatagttgtaatccctttactataccactgagttgattgattaaattgaaagttatgagtcaaatgcccccagagcatcttggaaccttcctgagtctgtgcatattcatatggtcctaatgaccttccactggaaggaaaaagtgtgtgctgcctgcagggaacacatgaagaaaggcttaggacgaagcaaaactttttcacaaccaccagcaagagtttaattaaactctgtctaacattataagcttgcctcaatttaagagcaaaatgtaccaggtttttcctgcacatggagcctcccagggtcttgcagctcaagaagcagaaggctttcattttacatctggctccttgaaatggggctaagaggctttctggagggttttgctggctgggacagttagtgtttacagatgtgagtggctttcagtcattgaatgtaaattgcatttgctttgttgcacacaccctgngaaaaccaagaggaagaagagaaataatgttcctttatccgcccacacacattgacattcaaggcacagtcttt

SEQ ID NO: 21426 - DNA, 640 bp, Homo sapiens
ggacgaaaacattccatctataatactaagactcatcataattaaaattctgaaaactaaagatagagggaaaaagatctttaaaagcaccagagagaagttatgtattacctataaagaaaaatcaactcaaatgaaacgacagcagatttttcatctgaaagcttgaaggccagacgaagtggcacaacattgatcaaatgctggaagaaaagacctggaaaccccaaatcctatatccagtgaagctatcttcaagactgaaggggaaatacacacatttttttaaaatgaaaaaaaagtaagaggatctgttcctagaagacccacctatcctgaaagaataggtaaaggaacatatctgtaacagaaaaataatattaacaaaaggctgggtaccttcagaaaggaaataacaacagggtaatgggcaaaagtagaagtaaacataacagacaatccctcacttcttgagtatcttaatcatactttattggtttatttgtttgtttgttgttttcttgagatgagatcttgctatgttgcccaggctggactcacactcctgggcttaagcaatcctcctgcttcagtgtcctgagtagctgagactacaggcattcaccaccattcctatcta

SEQ ID NO: 21427 - DNA, 600 bp, Homo sapiens
atggaagactaagtgtctaaaagcactcctcctacaaagcacctagaaatactagataaaacataacattctctgaaataaatagctgagctcaaagaatatgagaaaattccctctagggcaaagtgcaaagggaagttaaaactagatcaataaacatatgaggggatgttactgcagcccagaatgatgaaggtttgccaattttattaaacaattttaataatctcaaggcttgggatttaatatccaggagattaggtcttggacccttgtaagttgaaaagtaggaacttagagacccacataaaatctataccctcctttaagataaaatgataggcaagaaaaaaatattcccattggcatagggaaattacaaagaaagttgttttggcctgggttctgaatgaaaataaagttctcccctgagaatgtgtaatcactgcctctaacacatgggtttgcaaattgaatccattcctatgtggccctggagcatccaagcaaatgaattaacattaaaagaatctggagacagtgatatgcctgggaatctgataaaagcaaaatcaaacatcttatgaaggataaaccctc

SEQ ID NO: 21428 - DNA, 613 bp, Homo sapiens
tgagagggacctccctgaaccatgagttttcctcatggagaataatagagcaaggtgagcaaccagcttgccgagtcttttggggcaggtgtttaaagatggctaggaacatgaagtgcaggggctatcagtatcagccacacagttgctgccactggggaccacagcagcctttattgctgagaaccttaatagtcattacagctgccacaaaccccccttggcccccaaacaagagaaggggatactgctgtgccagcccagactggagccaccagcatccttgacctcctgccactgctgccacaaacatacctgggcatggcccacccatgcatacccatgctcctgaccctagctctgtggctggtctgtgagcagctgtgccttgcacacttgtgccactgctgtaatgggagcctgatccttggccactggtgccactgccaacacaagtgtgcccacgttccaaacctggtgccaaaaggaatcccattagccattaacttctgccgttagggaaaagaaaacaagtggactcatggagccttcaccacagaggactccaacagccctcaccaccactgcacgcacccacaaccttggccactga

SEQ ID NO: 21429 - DNA, 615 bp, Homo sapiens
aatggactttcctagcctctaaaaaattagtgatgcaaaaaaagctattaacttctaactggatctgtgctctttacacttgccccagtacagtggataatttctagtaccaacctttccttatctacttcacttgtaatgtacatgcctgtcaatgcctagcctgattaactgatttttgttttttagagttgggacactcattagaaatgcaagatctcaggccttatctcagacctactaaatcacaacttgcatttttactatatcgatgaatgatttgtctgcacgttaaagtttgagaagtcttgccttgacaccatggctgcacattaacaagctatggagctctaaacactgttacctgtaccccattctagtggaaccaaatctttggatgtgaggtctgtgggggctaggcatctgtttttttcaaagctcccaggtaaaacttaaactcaaattgtctggtagatgaccatctacgtcagaatgagataacaacgcttgtgtaaatgcacattcctaatctttctccagagatttgaattcttagccatagtgtaagtggttgaaagttcccaatctatcagctcacagcacacagtaaagcta

SEQ ID NO: 21430 - DNA, 491 bp, Homo sapiens
  misc_feature 416: n = A,T,C or G
ctataatacaatgaagaactttagagctgtttataaaaattgaacacacttattacagagaaaatgaaacaggggtcagtgaatttgcttaaggtaaatactacatgactatctgttaaaatgtaatggaggccgggtgcggtggctcacgcctgtaatttcagcactttgggaggctgaggtaggcggatcaactgaggtcaggagttcaagaccagcctggccaacatggcgaaaccctgcctttactaaaaatacaaaaattagccgggtgtggtggcacgtgcctgtaatcccagctactcgggaggctgaggcagggaaaatgcttgaacctgggacgcggaggttgcagtgagccgagacggcaccattgcactccagcctgggcaacagagcaagactccccgtctcanaaaaaaaaaaaaaaaaaaaaaaaaatttttgggggcctttttttcggtaatcccaaacttaaaaaaacccttggg

SEQ ID NO: 21431 - DNA, 613 bp, Homo sapiens
gaatattagtaagttgcttaactgggtaaagaagtagcaacttaaatatatataatccattatgacacagggcttaaaggccagagagaaaacatactgtttgggacctatagttttatactctgttgtttcaaatctcattatttatcaagaagtgtaaagagccaaccaaggtgattaagggggaaaagacttctgaaccaaatatgtttactcatcactctgaagtacatgggcttatgcagaaatgctaaccctgctacaaatttacactgttcagcaaatactgggtctctatgttttgtttattccaattgtgtcctttagtctctgagtctctgaaagcatggtacaggttgaatgtagccatctgtgatgtcctgtctgatgtatcagagttatcttgacaacagacagcaaagttatagatgtactttgtttcatactaatctggtattgagacctaaggaaactagaataattataaagggcagtttttgaagaaattccccatgctatgtttaaccaggttgataatgacagaatttgcaaattaaactaaattaaaaaatttctaaggttataacatttatactaagatctgtgattcctt

SEQ ID NO: 21432 - DNA, 562 bp, Homo sapiens
ccaaattcccagaaagggctcacggtctcagcctgggatggtgcagttacctgcagggatgatggaagattccagtgggaagaaggcaatgcctgactgccatccactgacccctgctacctccaacatccaccaagggaaccatgggggggaagaagacctgggagttccatgtctgtgctgctacccacgcccactcccaccctagcaggtccagtcagtggggactgagggatatgagggtaaaagggtggaaaaacaggttaatggtccaggcacagtggctcgcgcctgtaatcccaacactttggggggctgaggcgggcggatcacttgaggtcaggagatcaagaccatcctggccaacatggtgaaaccccatctctactaaaaaaatacaaaaaattagtgggcatggtggcacgtgcctgtaatcccagcgactcgggaggctgagccaggggaattgcttgaatctgggaggcagaggttgcagtgagctgagatcgtgccactgcactccagccggggtgacagagcgagacactgtctccaaaaaaaa

SEQ ID NO: 21433 - DNA, 527 bp, Homo sapiens
ttgtcatcttgagaatctagtcaagtttagattttagaaaatgttttccagtgaagttttttttagggtctcaggtttatttttttctttatgtattagttttaagatgggctttacattttagtaacataggggggtgttcttaaaatatgtaggttaattgtataaattataaaatttgcatagatacaaaaacacagaaaaaaacaaattatccatgatgctactgcccagaggaatctttttgatactttagagtatgtactttcgtttttttttgttttttagagacggagtctcgctctgtcacccaggctggagtgcagtggcgtgatcttgactcactgcaacctccgcctaccgagttcaaatgattctcctgcctcagcctcttgagtagctgagattacaaacacgtgccaccttgcccgtctaatttttgtatttttagtagagacggggtttcgccatgttggccaggctggtctcaaactgatgacctcatgaaatccgcccacctcagcctt

SEQ ID NO: 21434 - DNA, 620 bp, Homo sapiens
ttggctctatctcttctgtgggaccttggacagttcattcagcctatctgagccttaatttccttttctataaatgacaatttttagagtagatgagcttcaaatttccttgcagtgctgtagtgctttggttctattttgttaaagattctgctgcacattaaaaaaagtgacaaggggccaggtgcggtggctcatgcctgtaatcccagcactttgggaggccaaggtgggcggatcataagatcaggagttcaagatgagcctgaccaacatggtgaaagcccgtctctaccaaaaatacaaaaattagccaggcatgatggtgcacacctgtaatcccagctacttgggaggctgaggcaggagaattacttgaacccaggaggaggaggttgcagtgagccgagatcgccctactgcactctagcctgggcgacagaacgagactctgtctcaaaaaaaacaaaaaaaacaaaaaccaacaacaaaaaagtgattaggccagatattatggctcatgcctgtaatcccagcactttgggaggctgaggtgggtggattgcttgagcccaggagttcgagactagcctaggcaacataatgagaccttatctcta

SEQ ID NO: 21435 - DNA, 627 bp, Homo sapiens
attacgctgctgctggtcttgtcctggctcatgggactcctttcctgggtcacttacatcatctaaatccgcactgcccacacctggacaccatgtgctttgattgccactgaatgtgcagctccttcttggatgcatgctagcctgctacaccagtgctttttttggtagcagctggaactgggtttgtccctatggtacctgttcctggccttctcacttggctttactagtaacttaccatgccctgttcattccagaggaaagtccctgttcctaatggtattctttggcctggaatgccctctcatcgctcctacactcctccctccctcaagctcggctcaaaatttatttcttctgtgagtatttcttgctcatttcagacttcacaactttcagtaggaattaaacaaatatttgttgaacagatggaggtacagtatgggatagacaaagggcagccaggatacactgaaggcaaaaggaggggccaggtgctatggctcatgcctgttatcccagcaccttgggaggccgaggtgggcagatcacctgaagtcaggagttcaacaccagcctggctaacacggtgaaaccctgtctctactaaaaatacaaaaactc

SEQ ID NO: 21436 - DNA, 559 bp, Homo sapiens
agagttgtaggttgtgttagggcattattgtgttgctataaatacttgaggctggataatttataaagaaaagagttttaattggttcacagttctgcaggctttaaaggaaacatggtggtggggtggtatctgcttctagtgagggctcggaagctgacaatcatggtgggagctgactagcagccagcatgtcacgtggcaagagcaagagagaagggggaggtgccacactcttttaaacaaacagattccccatgaactcggagtgagaactcactcattatcgcaaggacagcatcaagccattcatgagggacgcacaacccccatgacccaaacacttcccactaggtctcacctccgacatcggggattatatttcaacatgagatttggaaggaacaaaacacccaaacctgtcatagatgtacatttttcttctagtttgaagtgaaaccaggagaactgtgatgtacatagaggtttaagaatgagaaaactgaccatggaagttatttgaagcatttgttatatatttcagtatctatagagaatc

SEQ ID NO: 21437 - DNA, 539 bp, Homo sapiens
tcttaacttttctgaacctgtttcctcttttctgaaattagaataatccctccttcctagagatgttagcggaaggattcagtggtctacccttggattggaaaacattgtctttagagggtcatattgtaaatgttttctgttttgtgagtcatatagtctctgacactgcaagagcagccttagatagtatgtaaacaaattagcatggtcatatatgcccaggcagcgggtcaaatttgtcccccaggctactttgccaacgctaaatataaagctgttagcacactgcctgtatacagcaggtaattaaatgattccctaccaccaacactaccccctagttccatcgcttctggcaactgcataatcatcaagaggtagactttgggccgggtgcagtggctcacacctgtaatcccagcactttgggaggccgaggcaggtggatcacttgaagtcaggagttccagaccagcctggccaacatggtgaaactctgtctctactaaaaatacaaaaaaaaaaaaaaaaaaaaa

SEQ ID NO: 21438 - DNA, 448 bp, Homo sapiens
cccagggaccacagtttggatatgcttggcatagttgctaaaaatgtattgagtgatacagttagcatttgtgcgctttatctagccaggctctctagcttttgtttttgaaacacgtatgcagtggtttgtaacacacattgggatttttcaaggacaatttttaaaaattactgtttgttggacaggcgcggtggctcatgcctgtaatcccagcactttgggaggccaaggcagatggatctcgaggtcaggaaatcgaggctatcctggctaacacggtgaaaccccgtctctactaaaaatacaaaaaaattagccaggcgtggtggcgggcgcctgtagtcccagctactcgggaggctgcggcaggagaatggtgtgaacctgggaggcggagcttgcagtgagccgagatcgcaccaccgcactccagcctgggagacag

SEQ ID NO: 21439 - DNA, 532 bp, Homo sapiens
taagctcatcaccatttctgttactgtgaatctgatgcttggcatttggcatcagctacagagtgcagggattcggtacaattttaacaattgtagagaatggccctaaaaataagaacttgtgggctggaatcatgttttatggggcaagggaatctgggaaggaaaacaggtgaaaaataatgaagtggggggagtgtaattatcaaaaactttgagggtatcacacacttggcagccttatcaatcaaggaaggaaattaatgaaaaagttaagaactctctacagagaatacatgatgcagttagtaattttaaataggcatggttaggtcctgtacagatttgtatctgatcctcttagggggtgcggctacccaaggctgcatttttcatcctgtggtattaccttacctgaatataggactccagctctagatatcccatctataaagtcaaaataaaccttctcactgggtgcacacaaatattcttctaactgtagcaatgaagaaggggtcaaacagatgga

SEQ ID NO: 21440 - DNA, 611 bp, Homo sapiens
  misc_feature 558: n = A,T,C or G
atattgaggactttggaaatacgttgctttcaatctaaaataattaatataccatatatttaaaatgacttttagtggatatctactgtctatgagaataacatcaacttagttgaggaaaccctcagaaaaattatatgccaggacagcttagttctattccttatggtacactggcaacataatagcaaatgaataataaacttagctgtggggaaagacaggaaaacctttcagtcattcatggatgtaaaaaacacaggcatgctgattatggtgtcttcgtgcacgaatgctgtttcaataaatttttaaaaattgtggcaacatcagaggtttgtaaaatggcaggaaaatgaggttttgaaagataattccaatagtggagtagtatatggttttattggaacttaaaaagattgcctaaacatgaccttagaggaatacataatctagaaaacgcatactaataacaaatgtgtatgtggttgccttgtatttggtactagaatatggttcttagcttctttgtgggagaaatctcatgacttgatgcanattataatgctggtaaaagtgacactatttcagtaggaattaacaattttggg

SEQ ID NO: 21441 - DNA, 597 bp, Homo sapiens
gacgacagaggggctaagtaccattcgggggggggagccactgggttcagacgtgctgcaaaattaggctccagacaagtttttctgattgcaatgctgctctgagcaggccatccacacctaccagtgaatcgaattgctctcgcgggcaagcaaacaggcgtccattaatggtgagcgtggtggaatactgaaacatcattaggtttgagcaccaccttttctgtgaacataaaaagcatgagattgcctattaaatacatctgagatttgctgcactgccctaatcacaccaacaaattgccagcttggtgaattaccggaacacgcagagtgactgcataaaatagagtactgaagggatccacggaataaaaaagacggcattcatgcagccctgcgccactcaggatgccttcagaaatggccacaaaaaggaatagagatgccagagggtcaattcacccagttttgtgctgcaaccataattactgagcacataaaacccgcacttgctatttatctcacaagttatgtttccagatggtaatcacacccaggactttggacatagaaagatcactttttaaaaacttt

SEQ ID NO: 21442 - DNA, 508 bp, Homo sapiens
cctgatgcacatatgaaagacgttttcctagagcatgtacctaggagtgtagttgctggttcaacttgatgagatatttccaaattgctttccaaggaggtttaccaatttgctctggtattagcaggatatgattctgcatcctttataaattttaaaaaaaaagtgttttttttgactgggtaaaactttcaagtgctgcaaaattcaaaactattaaaaaatggaatgtaggccaggcgcagtggctcatgcctgtaatcccagcactttgggaggccgaggtgagtggatcacatgaggttaagagttcaagaccagcctggccaacatcatgaaaccccctcactactaaaaatacaaaaatcagctgggcatggtggtgcacacctgtaatcccagccactcgggaggttgaggcaggagaatcgcttaaagctgggaggcagaggttgcagtgagctgagactgcaccactacactccagcctgagtgacagagcaagatt

SEQ ID NO: 21443 - DNA, 682 bp, Homo sapiens
gcagtctcggctcagtgcagggtccatctcccaggttcaagtgattctccttcctcagcctcctgtcccatgcctggctaatttttttgtatttttagtagggacggggtttcaccatgttggtcagtctggtctcgaactcctgacctcaggtgatccaccagcctcagcttcccaaagtgctgggattacaggcgtgagccaccacgcccagcccacacttcttcaatatttaataaatgtataatatattttcacgacaccaaggaaatgctgctctcatttctcatttcaaaactatcctggacgtcctcacatgtacatgtatcattttacaaatgaattcaacatatacatataattcaacatatataatgtcatacatatataactgaattgaattcagtgtccatatatgctaagtacttagagatgttggatttattattccaggaaaagaaagtaaatttggttaagtttcaacattaaaaccctgttgggatttcaataggaattgtgttgaattcatttaaggaagactttgccatgggaatgaagtctactcacctctcaacaagttaaagatatactatttacatgaagtggctgtgattagattataaaagtaaacaagctaaatgcatatggagaagaactggaaataatttttttaatttactcc

SEQ ID NO: 21444 - DNA, 569 bp, Homo sapiens
atatgctagcaggcgggtgggggcctgtgcaatgctctgtgtggggtggccctgcctgccactggcagttggtttggaaatgttgcagtgactctcaggagtcatacttctctccttccctttctatataattgtaaacttacagaaatttccttcacccagagtcaccattgatattttccctccatttgctttaatattttctttctgaaccatctgagagaaagttggagatacaatgccttcttactcttaaattttaatttcagtgtatacttccccaaaacaaggccactttcttacataagcacagttataaaactcaagaaattgggccaagtgtggcggctcacacctgtaatcccagcattttgggaggccgaggtgggaggatcacttgagcccaggagtttgagaccagcctgggcacagcgagaccctgtctccattaaaaataaatttagccgggcatggtgtgtgtgccatgtagctagtagtcctagctgcttgggaggctgaggcagaaggatcacttgagcctaggagttcaaggctgcagtgagccatga

SEQ ID NO: 21445 - DNA, 568 bp, Homo sapiens
gaaaaccaggaaaatgtgctgaggagtcaagagcagacaatgtttcaagaagtcctaacagcattaggcatacacacacacacacaaaatcaaagctacaatactacggtattcaatagaaccatatgcctcagatataactcaatccctttatcccaaaatctaattccacttcttacagtcccaacctgatgaatggcatcacccagtcacctaatccttctccttcacccgtatcaatacaccattaaatccaaaagattcaactcattttatatcttttatttcttatctgttctttcctccatatggcttccaactaaattcaggtcttcatctctcagcaggatattgaaataatcccttatttgtacccctgccccttggcttagtctggtacaacccatcttctaccttggtgccagataaaaatgtccaaagtatgtatttgattatattactttctctgttaaaattcctcaggacctaaagtgctggtttctaggcattgggatttcatcgctcagtaactcccccttaaaaaaaaaaaaaaaaaaaatttttgggg

SEQ ID NO: 21446 - DNA, 603 bp, Homo sapiens
aaacttattctacaagagtagcgcctaatggccaaaataaggtacatttggatatgcatatgcccaaagctatccatgacaaacataaaatttagtggaagctttttctgctgaaatttatgaaaaattcataatgcatgccatgaaagactctctttttaaataaagttacttctcatattataaaactgatgaaactattcaatttttatccaaaagttttgtgtagcttcctgggagttttccatactaatgtctcattatactacagaatttccatgggacagactggcttcactatatgcagcatactgaaaataagagctgtactccagaataatccactatagactaataatccattaattttattacatcactgttacacctgtatagcattagcttatattgtctcttgaattaataaattattctggaaaagtaattaaccatctcatgtttattattttgacaagttaactccattgcctaaacttctatacttaaatattaaatagtaaggaaggaactgtctggtagaaacaagtgtgtgtgtgtgtgtgtgtgtgtgtgtaaatttaaatgcatgtgcaactctacgta

SEQ ID NO: 21447 - DNA, 405 bp, Homo sapiens
caagaatgatctacaacttattttgagaaataaagtagacaaaaaggaggaagagccagtattttggaagaaagcagcaaagacacaaaagcatctccacttgggtacaggacatcttgtacttcacagatttgattggcatagagggagcagctttcagccagggtctgaagacctatggctttcactccaacctgggccactttggtgttttccccctctgttttaaaaatatactgaggccgggtgagttggtcggatcacagggtcaagagatcgagaccatcctggccaatatggggaaaccctgtctctactaaaaatacaaaaattagcttggtgtggtggcgcatgcctatagtgccagctactcaggaggatgagacaggagaatcacttgaaccc

SEQ ID NO: 21448 - DNA, 637 bp, Homo sapiens
caagttattggttgggtgccggacacatgaatttcacacatcacttgtgttatttcacaaaagccaaacttagggagtaaaagtatcttttcttagccttataaaatgctgaagaatgcctcctatttggccccttctctgaatatttatgattcactgaaggtctttcccctaagtgccttttgaatcacatttaataagtcttcatttatttattcatagcaaacatttattgaatggcaatatatcgatgctgggatataggtattaataaagcatggcctccaccctcagggagctcagagtcaaatggatgaatcacatgagagtggtgaggttctgtgctgagcctgcccgcactgccccgccttgccccgggcacacccactgagggccactgctgcaagtacctgggctccttcctgagggctccctccggctgccaaggtccatccagcctatgaggctggtggggcaaagggagtggggttagcacccctgggagcagcccacagacttggtggatgattacccagcatccaagtcaccagcaggtcggagggatgaagatacacagaagccaaacagtgccccgatggaagctggaaacctgccatttaagggatagtcgacagga

SEQ ID NO: 21449 - DNA, 471 bp, Homo sapiens
tttcacttcactgagctgtgttgtgagggaaaaaaagatgatttcatttttcagttgctagcattaacagagagatatctgctttgcagctcttcactggtgagttcacagtgtccttgcatctcaacaactctttccccacagtaggatttacatggtaataatttattcagaacatttgaaatactgtttcttttaaaaaacaggtcactggaaaacactgaaatcagacaaggcattaaaacaaatttaatgaaactttcaacaaatgaaactggcaggacacaaggctttgcagcaggaatagcagcctaaactgcttattaggataatctcctgctgagcattttacctcttatgttgctttttgtgtcccctactgtcttgtttttgttagatacttttaacacattctgtactgcctgacaaagagaaaaaagggggcaacccaaaaaaaaaaaaaaaaaaaaa

SEQ ID NO: 21450 - DNA, 472 bp, Homo sapiens
agtggctacttttctgagttgtggcaatttcttaagcttagagacaaatttttaaccctgaatagttttaggcaattattttctttaagagacagggtctcccaatgttgcccaggctaggcttgaactcctggcctcaagcaatccaccctccacagcctcctgaggagctgggattacaggcatgagccactttgcccagcagttttgggcaatttttatgaacagaacaaaatgaaaccaaggatgacagaataccatactaggctcagaagatttggactgtggctccaactctgctcttggacaaatccctaaacatctcagagcatcagttttgcacctggacgacgagaagctggactagataaatccaggggccctcctaggccaagggcccttgatcagggaggccagcccccctgcctgtgacccacaaagtctcagggcacagggaaacagggagaagcgc

SEQ ID NO: 21451 - DNA, 600 bp, Homo sapiens
tgcagctccgcttcccgggttcacgccattctcctgcctcagcctcccgagtagctgggactacaggcgcccgccaccgcgcccggctaattttttgtatttttagtagagacggggtttcaccttgttaggggggatggtctcgatctcctgacctcatgatacacccgcctcggcctgccaaagtgctgggattacaggcgtgagccaccgcgcccggccatagtgagccctttctatctgaagaattataaggcttttttcagctttgtgaataatgcttttatcatttcattgactatttccacccctctatcttaactatcacctgcctctggaaatcctattagaaagacgttggtcttcacagatcttaaaccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaatattattttgaatcttactttgaaa

SEQ ID NO: 21452 - DNA, 533 bp, Homo sapiens
gcacactgacttcctgtggttcgactagcaatttatttttttcttccacaatattctacatattagtccttgtatacttcttgacttttccaggtttgtctatttatgtaaactgcattgccttacaaattattattttaaatttattttaactttatatcttcatctaaaccataattcattacattctaaaaaatatcagaactggtcactaatcattttcatgaaatagtgtccaactacatgccagatagtaattctaatccaaatatttctgcaacacagaaatttttattttcacttgacagattaaaaactgaggctaggccaggcacagtggctcatgcctgtaatcccagcattttgggaggtggaggtgggcggatcacctgaggttgggagtttgagaccaacctgaccaacatggagaaaccctgtctctactaaaaatacaaaaattagccaggcgtggtggcacatgcctgtaatcccagctactcaggaggctgaggcaggagaattgcttgaaccca

SEQ ID NO: 21453 - DNA, 581 bp, Homo sapiens
aagctaaataaagggggcttggggatggtcataaaatcaaataataagaaaaataattgaaggaaaaaacggcgagaaatgccaagcccattaaaaaagattttaaaaccacagaatgtaactgtactactttaattccgttaacattcatggtaatgtattacaggcactgggaagttcagtaagcgttcacatttataaaatacccaatctatcagactgtatttacaccacgaaaaatgacctgtattagaaagttctctaagaactttaaattttctccagtttgcccatttagaggaaaccctatataaaggaagagatacacagatatatttcgtccattccctaatcaactcaaacggaatttgggactcttctgtaacacagtcttcttaatttgttaagggatacagtccaaattctaataattactgtatagcaaaacatcaaattgagtaaatatccccctccctaatttttcctcaacaaaatgctacaaggacatcaaaatatcaagcctaacatgttaattatttgtattatgaaaattgagaaaacacaaggatatcataggagag

SEQ ID NO: 21454 - DNA, 413 bp, Homo sapiens
  misc_feature 1, 2: n = A,T,C or G
nnatcaagagggtgtgtggaatataagaaaattacatcaattaataagacatgaagcatatttctgtaaaaggatttgtaaatttgtctttcaccaaatttaaatgccctatatatttgtcaacagcctatttaaacaacagaaaattctatgaagtcttcagtggcctattgctctgcttttgaatttcttaggtgcttttgcttttcttgttgtctgtcttttaaatcagtttatgtctcatttatcaagcacataagtgagataaaagcagatgatcagctttattaaccctaataagaagttgcttgattggaaaaaaaaaaggtggaattaacattaaaatctggtggctcttcatcatcattgtttgtggatttcagctttttatttctttcttcagtagcaaaagt

SEQ ID NO: 21455 - DNA, 642 bp, Homo sapiens
actggatgtgttattatttgaaaacttgctcaattctagagaggttaaaatcatttatcaaaggaagagtggaaagagaggactgacattggcaaaaccatgttgaatggaggattgaagtagataaatatgatctggctgctttagcaattattaaagattgcagaaagcagtgtagcatagtaagaacgaacttcaaaatcagattggctttgagtctctcgttctgccacttactggttgtttgaccttcagcaagttatgtaactctcaaagtctcagtttcttcctctcaaaatcagaaatagtaggagtaactaattcttagtgttgagaagtgaatgagacagagcatgctgagataaattaaattctcaataaatgttgactaaaacaaacagccataatgatggcccacacgtaattggaaaagtttttatattaatatacatacattttggtcaaaattttacttttaattagagataatttttgcagaggaatttttctaggtgtgacattcaacttagagtttccgcccaactatttggcagcttctctggaagcagagtataaatgataagtagttcactgtcccatcagttcctccaccacctaattctaccatctgtcctcccatct

SEQ ID NO: 21456 - DNA, 631 bp, Homo sapiens
agtaattggatgagttctcttaattgaatgcaatagagaaagcgcaaattctggtcttgcttctgatatgcattaatactacataatttttgaacaaccttgagacaagaagtgacagacgtaagactggaaagctcccagatcatcctcaaaaagagaatagtctattcaaatactgctttcagaatagcataaattgttacagtagatcacacaataacaaaagaataatcagagtaaccatctccaaaaatcttactaaattgggtgatataaaaaagaaaagaaagcctgaagaagtaattttggtttaggtcataaaattaactaaagagctgagggactgttaaagtccagaagccatgtgtaatgatggaagacttttaaattcctggcaaattttcaagacacataaaggaaaattaggactgttcctcctaacagattttaattataaaagcattttattcaaaattagttgaattattttaccctctcttgtatattctgcaattaattgatgatctattacagaacacttggttcttctattgcttttcacctaaggatctctacatattacagacattttaaaagtaactgaagacctaagctcatttgggaaaaaaaa

SEQ ID NO: 21457 - DNA, 567 bp, Homo sapiens
taatacctcaccttatgccctaattgtatgcctctcagctcctgggatgggtttgctggcgagcttaactgtaggagcacacttaatgctgatacaatgcctataatgtacaacctggaatcatgaatcactggatctctttgactagtacaggagagcaagtgagtttgaaaattacttggagctcacatgtaaaatgttgactacattgtggccacagaattggattggtgcgaccaggatgggcctaaactcctgccaccatccagatgcaaacattgctattgataatgaatgggtaacacaagggttttgagatggcaacaaacctgtcataggccataacagcaataagaaaacactcggctgggcatggtggctcacacctgtaatcccaacactttgggaggctaaggcaggcggatcatgaggtcaggagttcaagaccagcctgaccaatatggtgaaaccccgtctctactaaaaatacaaaaattagctggtcatggtggcgggcacctgtaatcccagctactcgggaggctgaggcaggcgaactgtttgaac

SEQ ID NO: 21458 - DNA, 556 bp, Homo sapiens
cccaaagtgctggtattatgggcgtgagccactgcaaccggccccactgatgctttctgtgtcatttaaagctacataagaaaaccagtcttgttacttttatagtcattccacattttacaatactactgtttgatctcctctgatatttatcatacatggctttgaattactgttgaaaactcagaagtcatatcaattctcaaaacatgaaggaaaaatatgcagctggatctattctgaaagagcaatttttaaaaatgttttgaagccaggtgcggtggctcacgcctgtaatcccaggcactttgggaggccaaggcgggtggatcaccggaggtcaggagcttcagaccagtctggccaacctggtgaaaccctgtctctccgaaaaatacaaaaattagctgagcatggtggtgcacgcctgtagtcccagctacccaggaggctgaggcaggagaatctcgtgaacccaggagacggaggttgcagtgagccgagatccagccactgcactccagcctgggcgacagagcgagactctgtctccaat

SEQ ID NO: 21459 - DNA, 561 bp, Homo sapiens
cgacaaacatttccctatgtaacaaacttgcacatgtacccctgaactcaaaatgaacatctaaaaagatatatatttacatacacacacacacatatataatttcatgaatgttatcagtttatagcagtatatggtaaatctacgtatatattttaatctatgctggattctagtgaccacttctttttctaagtatttaaattatatataagatataccaatatcatatatttcatcatataagtttcatcacattgagctataattcaaagaatttgctgtgttctattacctgtgaataaatttcctgtttatattttggctagctacgcactactcctcaattactaatacaattggctcttgcacaatgcggaagttagggaaactgacctctgcacagttgaaaatccacatataacatttgacttccccaactgaactaatgaactactaatagcctattattgacccaaagtcttgtatatatacagttgattaatacataatttgcatatgtattatatatggtagtcttacaatagagtaagacagaac

SEQ ID NO: 21460 - DNA, 537 bp, Homo sapiens
gttcttaccacgtacatagcaatcgttaaaatagcagtatttaaacttctgattccattgtctttaagttctcaatatggttgagagtcaaaatgtctggatttaaaccctggctccactgcttatgagcaggttgccacatctctctggatcttagtctcctcatctgtagaatgagagaattgaaagcatctaccaactctgagttgcaatgagaatgaaaaatgataaggcatccaaagtgcgcagaatagggttgagcaggtaataagaatacaataaatgtgagctatattattatcaccccaatgtatgtttctgttagagtcaagcttattgatttcacagggctgccatgaaaactagatcatgtaggcagaatgcctagcaaagggtctggcataaaacagacatttagtaaatagtcccattctgcaccaaatcactcctccctttccatgcctccttgcttcatttgaagagtccttttcctcatatatttttccttttctgtattgactactatactacaattct

SEQ ID NO: 21461 - DNA, 601 bp, Homo sapiens
tgccaaaatttaagttggatgggaatgttaatgtcctacacacgatattatttatggaagtaataatgtcaaactataattttttgatgtcattgttatatttaatcagcatgggaggacatgacttgttgatgaggttttccctggggaaagaaaaaaaatacttccagcataaatatactgaaatgatgcttaattttggaagtgaggtgagaaatggggaagccagacttagattagatggagaaaaaccttttctcttagaaatggaaagatagttgaattcctagactatggctattttcaaaagtcattaaccacccacaacatgggaaaaactcatctaaaacaattcctgatgttctttgcccttaaaacttacttgggatcagtgacaactaatccttccaatggttcagtccaatagacttggagccgtccagattcctttcctttactcacattgtacatccagtctgtaagctcttgttattctatggagacactaaataaagaactagaaactgactaaaataactttaattatttcactgaaaattagtcaaatatctacagcatccaagagagcaccactcaaaaa

SEQ ID NO: 21462 - DNA, 345 bp, Homo sapiens
acattaaccttgcaagactgctttggacatatgtattaaaaacatatgcatctgatcttcatgtactagcaggggggtgtatacacattccaagatttaaagtgaaatatggttctcttatcaaataatctcctaggctttgtcagtggagtgcttaacaccaggctagtctcatactagaggtgtaattgtttttggaatttattggaaattgagttcctttaaaattctagaacaatagtctctacaaacaaacataatggaatttaaacacacacacgtacacacatgcacacaaatgcacgcatgacatgttatgggatacattttaacagttttagagtt

SEQ ID NO: 21463 - DNA, 588 bp, Homo sapiens
ttttgcaggtgaggaaactgaggctcaaagaggtgaaatgatagttcaaactcacataagtagaacccagcatggatgttagcatggtattattattctttgttgctgttgcattgtttctagatgaggaaaccatttctaaggggtcatggagctcagaagtgcagggctggggtagccatccaggcaagcactctccaacagaaatacaacaagggatcagggtgctgtggctcatgcctataatcccagctctttgggaggctgagacgggaggattgcttgaggccaggaattcaaggctgcagtgagctatgatcgtgccactgtgttccagcctgagcaacagtgaaaccctgtctctaaagaaaaaagaaaaaagaagccaagcacggtggctcatgtctgtaatcccagcactttggtaggccaaggtagggggtggatcacttgaggccaggagttcaagaccagcctggccaacatggtgaaacaccaactctactaaaaatacaaaacttagccaggtgtggtggcaggtgcctgtaaccccagctactcgggaggctgaggcaggagaattgcttg

SEQ ID NO: 21464 - DNA, 559 bp, Homo sapiens
gctgtgtaagagatgatttcattctgtgttttattaccattttttacacattgtctctcaaacactagattttcatatcctcagtcacagaccatggttccatggtttatacatcattttgaaattttttattgcattttagagccaaggtctcactctgtcatccagcctggagtgcagtggtataatcatagcttactgcagcctcaaactcatgggctcaagcaatcctcctgtttcagcttctcaagtagctaggactataggcacatgccaccatgcccagctaattttttattttgtagagatggggtcttggtatgttgccagactggtctcgaactcctggtctcaagtgatcctcccacatcagcctcccaaaatggtaggattacaggtgatgacaagattattgatggtttgtacattttttatcatcttgcttccccagccctgtgcctaatactgtcagtaattattattgttacggctaattattgctgcatgcttactttattgtaagtactgtgcttaagctaatagcatgtgttattaactt

SEQ ID NO: 21465 - DNA, 593 bp, Homo sapiens
tacctgaggcaggccagggactagggaaggtggcagctggacaaaggtatgaaggaaggacgagatgaggcacaggtcctggtattggaaagaggcagaggtacctcggaagcatgccatagaggttagacgggacctaagagggcatctggtccaaccggattcgtgttaccagcgagtaaactgaggccaggagagggactgctacgagctgctccagcctatcacctataaagactacagtccctttgtaaaataccatacagctctcggagaactcccagttggcgctgcaggataaaatccaaacttgttggcatagcattccagccacttgttcacttacctttcccatttgagctcctaggaataaacagaaaaacatttcattttctaaatatcaccagataacttcacttttggtaacttgaattattaaaaaagtcctaccgtccctcatctcttgccacttccccaacattactggaggctctggctacaaataatttgttttccttgactactcaactttctttggattatttactttttctctaagtttctttactcctttttgctttgttcattctttt

SEQ ID NO: 21466 - DNA, 499 bp, Homo sapiens
ttggaatacaaccatgccagtttaatttatgtattgtatatctcagtttttatactacatcagtagaattgagtagttgaaatagagaccgctggcctgcaaagcttaaaatactctctagacctttatgaaaaaagtttgctgactcctactctagaagatagactgaaatgaaggtgaaaatatctgaaaataaaatacaatgaaaatgaataaaaaagttattgctatggtaagacaaattataaattgagctaaggaagtagcaacaggaatagagagcaatcagatgatacagaatttggtgactgactggatagatcatgaaggcaaggagaaaaccaagatgagtctgatgacagagtggaagttggtgccattaactgaggtaagaaccatatgataaacagtaaatgagtgtggatgtatgtatgcatggctgtattttaaaataaggattgggtggtggctatgtataagagtacaatgaaaatcatga

SEQ ID NO: 21467 - DNA, 582 bp, Homo sapiens
ggagtaggatagttgtaatccctttactataccactgagttgattgattaaattgaaagttatgagtcaaatgcccccagagcatcttggaaccttcctgagtctgtgcatattcatatggtcctaatgaccttccactggaaggaaaaagtgtgtgctgcctgcagggaacacatgaagaaaggcttaggacgaagcaaaactttttcacaaccaccagcaagagtttaattaaactctgtctaacattataagcttgcctcaatttaagagcaaagcagaaggctttcattttacatctggctccttgaaatggggctaagaggctttctggagggttttgctggctgggacagttagtgtttacagatgtgagtggctttcagtcattgaatgtaaattgcatttgctttgttgcacacaccctgggaaaaccaagaggaagaagagaaataatgttcctttatccgcccacacacattgacattcaaggcacagtcttttcaggtttattgggtccctaagcaacctttgaagagatctgtacatctgtccggctgtccctactccagcggacatgga

SEQ ID NO: 21468 - DNA, 627 bp, Homo sapiens
ggcatggtggcctgtgcccgtagttcccaccactcaggaccctcttgtcttctgagtagctggaactacaggtgcaggccaccatacttcagaggtgggaggatcatttaagcccaggaattcgaggctgcagtgagctgtgatcacatcaatacactccagcctgaggaacagctcatctctttaaaaaaaaatgcagttagagccagggatggcgggcttgtgcctgtagtttccactagtgagcctgaggtagaaggatagcttgagcccaggagtttgagaccagcctgggcaacatagtgagaccctgtctccaaagttactattctaaatggttattaatttattcacttctgaagctgatgaaatttaagaaactgaaaagtaaatataatgtggaccctcattatatactgtggataagagtgatataaaagaaaaattagataatgacacaaaatacacatttataatcacatgccaaactaggcaagaccacaagcatttttttggaaatgatttcaggttaaagtggagtggactggaggccgggtgcggtggctcacgcctgtgttcccagcactttgggaggccgaaggcgggcggatcacgaggtcaggagat

SEQ ID NO: 21469 - DNA, 510 bp, Homo sapiens
ggccgcgagaagagacagaagggaccatggaacatatgcgctttgtcctacatagtcagtatcctcattgctcctgagttttcttcagtggggcctaatagcgggagataaaatgatctagttgaaaagcagaggtaggagatgggtagctaggactgtcattatttctacataaagaaaccacaggggaaaaagagtgtctttggttgacttccggggagttgttgcactagcctaggatgagaaccacccttaaaagaaagctttgcatttttcaacacctcgattacattaaaaagtatttgggtcaacaaccgttagtattcatttgtaaagctttattgttttttaaagggaagcatatatgtaaggttgataggtcgataaacatttgtatgcacttacataaatagaaacactttatctgcacacacatcatataccaaatattaatatgtttacctaaaactaaaattttcccattaatgtttaatttagatttgaatatat

SEQ ID NO: 21470 - DNA, 529 bp, Homo sapiens
ggcctacggctggagagacacgagggtactccccttctcatgtgctaccctctcctgcccctcaacacacacctgtgttttaaccagatagaactacctggaagcttcttagaaggtaaaacctctagccctatcttcagacctatgaattgcactttatgagtatcccagggtattaaatatgcacattgaagtttaagaagcactggtctggctgggcgcagtggctcatgcctataatcccagcagtttgtgaggctgaggtgggtggattgcttgaggccaggagttcgagaccagcctggccaacatggcaaaacctcgtctctaccaatatataaataaataagggccaggcgcagttgctcacgcctgtaatcccagcactttgggaggccaaggtgggtggatcacctgaggtcaggagtctgagaccagcttggccaaccagcctggtgaaaccccatctccactaaaaatactaagattagctgggcatggtagcaggaacctgtaatcctagctactt

SEQ ID NO: 21471 - DNA, 586 bp, Homo sapiens
  misc_feature 508: n = A,T,C or G
cagccatggggagatgtgaccagttaggtgacaaggaagcaatggagctgcctttgcatttgaagctcaagattcatatgagctggtccttgccaagaaacaggtgcacactgaggaggaccagagtggtggtatgctagagctgtcatggatcatggcccacaagagccaattgctactttttcagaatgtttgcaaaccagttactaaatgtggccatggaaggctgggcgcggtggctcacgcctgtaatcccaacactttgggaggccaaggcgggtggatcacctgagttcaggagttcgagaccagcctggccaacgtgccaaaaccccgtctctactaaaaatgcaaaaattagccaggcgtggtggtatgtgcctgtagtcccagcgactcaggaggctgaggcaggagaattgcttgaacctgggaggcggaggttgcagtgagctgagatcacaccactgtactccagcctgggtgacagagcgagaccctgtctcanaaaaaaccaaaaatatgaataaataaataaatgtgaccatgattaaaattatataaacttaagtgaatattaaaatca

SEQ ID NO: 21472 - DNA, 430 bp, Homo sapiens
aggcaggagaagcttgaactggggcagcagacgttggggtgagcagagatcgcactattgtacttcagcctgggtgacaagagcgagactccatctcgaaaagaaaaaaaaaaaatgaaaaagtggggaaaggcaggtaaaaattaaaaaaactggaaactcttaagggaaaaagagaaaaccaatccagatattttagaaatcataatacagttaaaggggctaaaccatcttattaaaagatggatattgtcaaattggattttcaaaaaccaagttatatatgctcagtgcagtggctcactgctgtaatcccagcacttcgggagaccaacccaagaggattgcttgaggtcaagagtttgagaccagcccaggcagcacaatgaggacccatctgtacaaaaaataaaaaattaggccaggcgcg

SEQ ID NO: 21473 - DNA, 301 bp, Homo sapiens
catggtcattcttgcacccagtagtatattgaaagagatggtatatggctttatttcctcacctataatgtaatgtgtctctttatgctcataattcctgtgcctgggtcatagtaggtgctcagtaaatacttggtaggtggatacattggctaattattaattaatgaatatcctttaactactttctaaaatattgtcaattggcatcatgtaagactgaatttcttttcccggataggactccagtccctggtatggagatgaggagaggaaaaaagacaggggtgatggtaagagc

SEQ ID NO: 21474 - DNA, 376 bp, Homo sapiens
ggtcatcagagaacagagttttttatttgtccagtaatatcatttagtatatatttttgggtgtagataaaatctaaataatacagatagggccgggcacggtggctgatgcctgtaatcccagcactttggtaggccgagataggctgatcactcgagatcaggagtttgagaccagcctggccaacatggtgaaatctcatctctactgaaaatgcaaaattatccctgcgtggtggtgcatgcctataatcccagttacttgggaggctgagtcaggagaatcacttgaacctgggaggtagaggttgcaatgagcgaagatcatgctactgcactctagcctgggcaaaagagcgagacccaatctcaaaaa

SEQ ID NO: 21475 - DNA, 431 bp, Homo sapiens
gggccatagtcccctgtattaggtatactcaattagttattctagcacatagctttttaaatattggccaaaactggctgggcacggtggctcatgcttgtaatcccagcactttgggagctgaggcgggcagatcacgaggtcaggagttcgagaccagtctggctaacacagtgaaaccctgtctctactaaaaatagaaaaattacctgggtgtggtggcaggcacctgtaatcccagctacatgggaggctgaggcaggatacttgcttgaacccgggaggcggaggttgcagtgagccaaaattgcaccactgcactccagcctgggccacagagtgagactctgtctccaaaaaaaaaaaaaaaaaaaaaaaaaaaagggggccctttttttcggaaacccaaacgttaaaaaaacctttggggg

SEQ ID NO: 21476 - DNA, 525 bp, Homo sapiens
gttcaaaccgggacatagggggaacatggttttaacatcaaaaaaataaattgtttttaagagagggagagaaggcttccagcaggagctcttgaaggcttctaaccccgcttgctccccctgatgtcagagaataaatgcctgacaggagccagcagttagcaagcagccctgcagatattataggctatgttgtaggagtgggaccaattacccctaagatgttgggagggtccacatagcctgggcacagggatcctagggactccctcatttaccccgacccttgctgcaagttgcttgctgttattgatacctgcagcaggtgtctgggccggcagatcctgtgggggcttctgctagggccagtggggaggagagaaatgtgacagctgtctgcaaatgttggatgttggagaagctgtcattggaaagggagcaataggcatctctggggccccagaatatgtaattaggactgggagcaggcctaaaggagaccactttcttattattaaaaaaaaa

SEQ ID NO: 21477 - DNA, 407 bp, Homo sapiens
  misc_feature 341: n = A,T,C or G
gttgtttaggttgtcacttgaagcactgaaagatcaaatatgttgataaacacaatacacaatgcagaactaagcaaaggccatgtgtggacttcatagtgaatatcagaatgtaaaggataaagggaaaaatcctaaaatcttttagagacaaaacatgtattacataataaggaatgataatcagactgtcataagccttcttatcaaaaacattgaacaaaaaaagacaatagagcagaattttcaaagtactgagagaaaattactttatatttagaaacatataccaagctaaactgtcattcaacattgaagatgaaagataactattttcttanaaataatgatttagaaatctcagtactctggactttctctgaaggaattattaaagtatgtactca

SEQ ID NO: 21478 - DNA, 542 bp, Homo sapiens
ggattccaggacctgcagggtatgtgaggtatgtaaaagctattttcataaggaaacaagcaggttgcacatataagcccaacacagattaggtgctcagttgaatcacattttgcagaaagttgtggtctgcatgtatgactatacctttagtctagctttacaaagacataaaacatgtcataatcataaactaaggataaaaggaccttaaaatctagtcatcttaaggctgggcatgctggctcacgcctgtaatcccagcattttgggaggccgaggcaggcagatcacttaaggtcaggggtttgagactagcctggccaacattgtgagaccctcatatctactaaaaatacaaaaattggccaaacgcggtggctcacatctgtaatcctagcactttgggaggctaaggtgggtagatcaccagaggtcaggagtttgagaccaacctggccaacatggcaaaaccccatctctattaaaaatataaaaattagcctggtgtggtggtgcatgcctgtagtcccaaccactcg

SEQ ID NO: 21479 - DNA, 497 bp, Homo sapiens
ggatcaaaaggagacttaagtgattgagaaaaacatagtggaatccggaaagaatgacacctgaaacaaagatggtgagtataataacccatctatcctgtgtgtggttgttttttctcagaatgagggagaagctataaagcaaagatctttatctttatttacaataactcataagtaatataaacactgacttggctcttattataactgtatctagggtaccatgaactttgagtgactgagtgaagatggcagacccatactgtatctaactatagacactttttgaccaataaacaatggggcttgcagccaggcacagtggctcatgcctgtaatcccagcactttgggaggtcaaggccggtggataacttgaggtcaggagtttgagaccaccatggccaacatggtgaaacaccttctctactaaaaatacaaaaattagcctggcgtggtggcacacacctgtaatcccagctatttgggaggctg

SEQ ID NO: 21480 - DNA, 554 bp, Homo sapiens
gtaattaaacttttggttagaattaaaccacaaaaagcagggcatgaaaagtcagcatttgtttctccaggtacagtacttgcttattgtaatatccacataagataagacaataatactcctaaattgcactctaaagagctctcaattacaatctcagaaaaaaggagctccaacttcccattcatgagaggagtccattcaggaagcagacctacttacatagcagccaaggaaaaccacagcagctagtcaaataaaccaagtcttttttccttcaatctgactcaaaaaacaaacaagaaaaagctaatagaatgaagtagagagatcaatttaaacagttagattaaaacaaaaataatcaaggagaataaaaatgaattgttaaaggaagaaaatatgcattcataaaaagcatgaaaaaggatacgataataaggaagagtcaaataagataattgtcaaggaaaaacaaaagacttctaaagataaaaactgacataagccttcagaataaaatgctttgtattattagtatatgaatttgaaaa

SEQ ID NO: 21481 - DNA, 605 bp, Homo sapiens
gacagaatggcttgtgcctgtgggcgcagggactcgggaggctgaggagggaggattttttgaggccacaagtttgaagctgcaatgagctataattgcaccactgcactctagcctgagtgacaggatgagaccctttctctcaaataaaggaaaaagaaaaaaagtaataataacaaaatggaaagagtaatttaccaattactgagggagtctagaaaggttaagtataccccctctaaattgggaataacagtttaaaaaatattttattggtaaaaaataaaagccactttttatcctgagagagtatgtagaacttgaattttggtttaaagcacttattactaagcttaacgtaaatactttggcaaattgattctaacaaagatatccttctcatgacttaaaagagccactaattttacttttgaaatatgtttaatttttatattaaaagctaggatggctgggcgcagtggctcacgccagtaatcccaacactttgggaggcggaggtgggtgaatcacccgaggtcaggagttcgagaccagcctggccaacatggtgaaactccgtctgtactaaaaatacaaaaattagc

SEQ ID NO: 21482 - DNA, 548 bp, Homo sapiens
ccatcaatcattccatgtaatcctcacagccccatctgctagatgagtaaataaaggtttacagctggaaactgacttgcccaaactctaatagcctgtgtgtggcagaccctattttgccttttgggaagtgctgtgagcatcagtagttatcccaaggccaagaaaagatgagcatggtgttttgctttctcagttatcacactttattacaatactgatgtcatttttatttgccctctgtgatgagcattaattatattacgggaaaggggagaaagccaagtattgcaactttagaagtaaagaccactcccttactaagaaatctttggagacagcaaggaattttaaaaaagtaatggtacatgggcccggtgcggtggctcacgcctgtaatcccagcactttgggaggctgaggtgggcggatcactagtccaggagttcgagaccagcctggccaatatggtgaaaccccgtctctacaaaaaacacacaaaaaattagccgggcgtggtggcgtgtgcctgtagtcccagctactcg

SEQ ID NO: 21483 - DNA, 320 bp, Homo sapiens
ctccagttgcaaccaggaaaggacgcgtgggacactggggtcagagtgttggcctaagttcccgagttcttatgttggttctgctgctgcccgtgctcctgaacaacccatgtaacctctcagtgcctcaatgccattctccagatgatgagacctacacaatgcaaacattcagtgtgaatgtttctttttctttaagaaaatggaacttgacatactagataactaagccccataaaatcttcatcacaagattcttgagagcaggaaactcatggtgtgtatgaaatagaagttgatttatttaaatatgtatatat

SEQ ID NO: 21484 - DNA, 593 bp, Homo sapiens
aagggaagccagcgcgctgcgttccttgttctgataatgcacttaggaggcagcgtgcaagcagcagggagccctcccctttctttacagaagagggctagaaatggccactccatgcatggaaggatgccccgtgtcgttagtcagagggaggcatgtgaggtaccactccctgcaagaagggtaggtgtgtggagaaagtggcatgcttatacccaactgcaggtgcaaccactttggaaaacagcttggagtttcttataaaaatcaagcaaacaactaccactcaacccagcaattccgccctaaggtatttacacagagagatgaaaacatatgtgcacacacaggcttgtgcaggaatattaatagcagatttctttacaatagcctcaatctggaaaccgagaaaacactcatcgaggagcgggagacaccaactagggtgtattttacaacaactcatctatggaatgaagaaaacaaccacaacatgcgcacagcaacacaggctgcactcacaaacactccgctgcacgcgcacagcaacacacagtgctctcacaaacactccactgggtgaaagagacagg

SEQ ID NO: 21485 - DNA, 374 bp, Homo sapiens
cattcattctcctgtggcccactgtgaaatgcctgctacatgccagcattttcgttatttcctgcatcaaatgcttattgagcacactgtgcattgggccccattttaagtggcaatgaccaattctgaaaatgtcaggatatttaagcttcaggagctggcagcacaaaggggagaatctcacatatacagaaagacaaaggctcgtaagcaccttcggtaagcatctttgcaaggtaaagaggagtgggaaattttaaattaaggccactgtggtgtgaccacagttagtactctggagccagtacaatttagtttaaatgctagatctgctgattatcaaacttctgaaaaaaaaaaaaaaaaaaaaaaaa

SEQ ID NO: 21486 - DNA, 537 bp, Homo sapiens
acttttagaatcctggagtggcctaagaaaatagaaaggtagaaagtggcaattatagcccacattcctactaagcagctataaatgcaaaaatatgctgatatatcaattaccattataataaaaatacaaaaatataagttacacaatgtaggcaatgtatttgttaacacttatggatatctataactatagatatagattaatctatatagctctagattattatatctataccatagatatctataccatgtagatccatctatatggtatagataaaataaattggccagagttttctactttagtgtttatagtttcttttttttagaatagtgggcagaggaatttaaactaaacacattgggcaaagataatgtataggattttgtgtcaaggaaaaatgcccaatttaacagttaagtagcctagtaacatatgccacagcaacatgtcttgtcccaaacaatgcgcatagttgaaagagaatatgaaaaaaacaacaaaccagtatcaatgccacctgaaactcat

SEQ ID NO: 21487 - DNA, 381 bp, Homo sapiens
gaagatctcttcaaggatgtatacaatctgtacttaacagcaattaactctggctggcagaatgttgagtgatttttaaatgagtgtagactgggcacagtggctcacacctgtaatcccagcaatttgggatgccaaggggggtggatcacctgaggtcaggagttcaagactagcgtggccaacatgaaaaaacccagcctctactaaaatacaaaatacaaaaattagccaatcatggtagcaggcacctgtaatcccagctctttgggaggctgaggcatgagaatctcttgaacccggaaggtggaggttgcagtgatccaagattgtgccactgcactccagcctgggcgacagagggagattctgtcccaaaaa

SEQ ID NO: 21488 - DNA, 338 bp, Homo sapiens
ttttggtaaaataaagggccatatcttgggtagagcagtaataattacattaattaaagttttatttcaaaatgtgcataagtagattaactgaattattatactttctttcaatggggatgctatttaattagattaaaaccctttaatgtgaaatacatgtttgaatttttatatgtgattttatttgattggacaatttatttccataataacttgggttagtgtgttgggtcttaaccttaaaaagtttacatgttgcttaactaatatttgagtctatttcacacatcttttggcagtgctgttttaaaatctctcacaaagacaattagtaa

SEQ ID NO: 21489 - DNA, 569 bp, Homo sapiens
  misc_feature 475: n = A,T,C or G
ttgacaataaataatatattctaaatttttaaaattatttatctatatgtttttctttaaataatccaaagtttctataaagtagtatgagtatttaaatatataacacattaattagctttatgttatttaaaggataaaaccatttcaagaaggactattcttagatagtccatctataactactacaaaatacttcataagaccttattttaaaagggtgtgaatgtgaatatcctgataagcttatctatttttatgcttttcagaacagacttatggtttgtcaaaattctaatgctaatgcatgacagggagaattattagtcctcaaaagctcaagacccctcgaataaaatataaaaaggttgagaaaataataaggaaggatttttgtctaatgtcttttaacacactcctccccaaccattacaagggctattcaaaatatttactcaaagcctatttgtagctnttcactgtatattcccacccataaatacatcaaatatattaatcttgaactaaaataatagcattattaataatgtaactttaaatcatttaaa

SEQ ID NO: 21490 - DNA, 541 bp, Homo sapiens
agggtgaatgagtcactaaggccagccaggcttcaaggggggccacagacattaagacagtcgtgtcaaaggatttgggacatgatttaaaacctacacacagtaagattactcttcctttcttgtgcagtctctcactcccatctgtggagttaataactttgttttttcagttatctaaattgcctcaggtattctattagttttctattgctgtataacaaccaaccacaaacttagtggcttaaaaaaacaaagcccatttatctcaggttttataggccacacagtattgctagattcttctgctccaggtcttacaatataaataaatagatatgggttgggcagggtggctcatgtctgtaatccctgcactttgggaggctgaggtgggtgggtcacttgaggtcaggagtttgaagccagcctggccaacatggtgaaaccctgtctctactaaatacaaaaatttgctgggcgtggtggctcatgcctgtaatcccagcactttgggaggcccaggcaggtggatcgcttg

SEQ ID NO: 21491 - DNA, 465 bp, Homo sapiens
gtggttagaagggggggaggggggaaatgggccttcctggggagacagaggatgatgcaatcactgaatgaatttgagaatgcaggtcagaatcttggggatatcatgctttagagagaagagcaagggagactagaagggtgagaaaggttaatgcagagaagtagaacaggctgaagaaaaatggccatggaagcaaaaagtgttcatcttcagggagaatgtgcctgatcactccagggaaatagaagggagaagatgccctaggcagagagaagacagcgagatttggcaactcagggatataccactaatcttgagggggcatgtgtgcatccagtgggccataaatgctagatttgaccctagtggaggttcactcttcattagagacgagaggaaggagtgcaagatgatgtggaatttgaggacggagatcatttaagactaacttgagggatgttt

SEQ ID NO: 21492 - DNA, 596 bp, Homo sapiens
tacggctgcaagaagacgacggaaggggagccctggacgaggccctgcaaactacttgtgaagcagaaaagacagcccaaactttccggccagcggccccttcaaatccaagggtggcctgtttcacccacattctactcggctccccgaggactgcaggttgtcctataactgctggtctgagaaacactttggtcatgctaggtggcaagaaaaccatttgccaccaaaacaaagcactcccccaccagacacaagtcaggagagaaagctacctatgaagaaaaatcatctgagtatttatttaaaaactacatgctgggcacggtggctcacggctgtaatctcagcactttgggaagccaaggtgggcggatcatgaggtcaggagatcgagaccatcctggctaacatggtgaaaccccatctctactaaaaatacaaaaaaattaaccgggggtggtggcgggcgcttgtagtcgcagatactccagaggctggggcaggagaatggcatgaacccgagaggcggagcttgcagtgagccaagatcacaccactgcattccagcctgggcaacagagcgagactctgtc

SEQ ID NO: 21493 - DNA, 593 bp, Homo sapiens
cttttggcttgttaactttatgaaaagttgtgtactggactatatatttccctgggaaattagcaaaatagtgaagtagtcaggcccaactatccagcatgaaggagaaatgtcatttcacataattttcccatgtagcaaacatataattattgaaatgttgaaacttattaacagtattttgagaaaaaccataaaaatgttttatatttagaactaattttaaactttattttacaatggcaacattaatagtcatcagtaattgtgcattccatatccttctgtgttttatcacaaattttattttcctgattatggatgtttacttttaccccataatgtttgggggatttggagctaacattaatagccacattattctgatactgttactttttcacagtattcattttgtacctctaatattttaatatttcagtggaaggccactattataaagaactccttttaaaaaattgtgtatgtctttattttcagaatatttttggccaaaaaagtatcttttgacacatttgtagtcactgggtagaatagaacatcatatcataacgtttatattttcaaatatt

SEQ ID NO: 21494 - DNA, 589 bp, Homo sapiens
tctatagatcaaaatgcgttaatttgaagtagtaataataatgatgcagaggatgacgaggatgatagatgattactatatgtgagacactattctaagtgttttacatttatttacttatgagaccctcactataatcctatgaggtaagcactattattatataatatggacgtacaaagagcttaaataattttcttaaggaatatagctagtaaacgtcataatcaggattgtgaatcagtctggctccagaaccagtgatcttaaccactgtgctatacagtatagggttactacttgtaagccagttttatgctagagaaaagctatctcacctctaaacgattattggttttagaaaatgtgcctctcttttaaatagtgattcagtcttatagctaatggtctattaaggttactcatatttaatgacaataaaactgcacctcacatgtatgataatgtttttgttggccgggcgtggtggctcacgcctgtaatcccagcactttgggaggccgaggtgggcggatcacgaggtcaggagatcgagaccatcctggctaacatggtgaaatcccatctc

SEQ ID NO: 21495 - DNA, 497 bp, Homo sapiens
ggccaagactattgttttaaagtgtgaaaattgatattgaattcttgtgtttatataataaggtctcctataatttctgtttggaatataaaatcagcaactaatatgtattttcaaagcattataaatacagagtgctaagtgaggggactgtgaaatgtagtcatataaagaatataataattatactggattatttttaaatgggcagtctaacattatattaaaaggtttcatcagtaattaattatatcaaaatgctccaggccgggcgtggtggcttatgcctgtaatcccagcactttgggaggtcgaagtgggcggatcacttgaggtcaggagttggagactagcctggccaacacgatgaaaccccgtctctactaaaaatacaaaaaattagccgggcgcggtggcgggcgcctgtagtcccagctactcgggaggctgaggcaggagaatggcgtgaacccgggaagcggagcttgcagtgagcc

SEQ ID NO: 21496 - DNA, 502 bp, Homo sapiens
gatctgcctgcctcggcctcccaagtgctgggattacaggcgtgagccactgtgcctggctaagacctagagaaaaataggtttaaaattttgattattgcttgtacacattataagcgtttgggccttgaagtatttccctcttcaaattatattagactaaaacacacatacatacacacacacacacacatacttctgtgacttagtagttgcagttaaaagttaaatgcctacatatactgaactgtgtgataaatggctacgctccatctttcagtgctgggcaacagcatacctctgttcttcctgcttcacccaagagcactgaataaactcttcccttctaggctgctggcagaaacatcccagattctcttttctgtggtgttagcattgccaatatttatcacaagaatccccacatccatactaggccttcagagaaaagggatgggatacccactctgctgagtccagagagagatggctaacttttact

SEQ ID NO: 21497 - DNA, 582 bp, Homo sapiens
tacatcttagtttccgtctttggttcagtattcatgatgatttagggcattaaaggagagacagatatgctaacatccactcttgtgccatgtgtcttaacaggactccacataggcccatctgtaattctactccctctagttagaggctttagattggcaagtgggttgcaaaattccttttatgttttccctgatccccatgttagcctgtttgcctctctagaaccaagagcattcttgtgtgtaaatttgaaatttctgtcactttatcactcatatagtctcctttggcattcccatgtacatctgagatttgaaatttctatcactttaggccaggcgcggtggctcacgcctgtaatcccagcactttgggaggccaaggtgggtggatcacgaggtcaggagatcgagaccatcttggctaacacggtggaaccctgtctccactaaaaatacacaaaattcgctgggtgtggtggcgggcacctgtagtcccagctacttgggaggctgaggcaggagagtggcgtgaacccgggaggcggagcttgcagtgagctgagatcacgccactgc

SEQ ID NO: 21498 - DNA, 584 bp, Homo sapiens
aaccattatagaaatggttatgtctccagtcacgatggtgacaaggaatctgggaatgcagacagacatgaatgatatttccagaaatgagaagttctgaaggaagaaatgcatgggagtctgcagatggggatctgaaagggtgagagagtgataaagatcagattcccagtcccacttagcatgtaggtagcaagaaatatgaaaagcacaacctgccactgtgggtcacttgtcaatccaagaagaataaattctattactgccttgcaatttcttattacttattactttctttctttattatgttactctttattttagctataaaataaatgaagaaataagaaagctataacaccagtaaagaaacttaaacacacacgcacacaaacacacattttaagaacatcattgttatcttttcttttacaataaaatgattttgtggtacatagacccacaatattttttaacaattttgttatttattatgtcacatattaattcattacttgtatatttctttcattacattctcatatattacaatacaaatatctctcttctgaatgttcaacata

SEQ ID NO: 21499 - DNA, 559 bp, Homo sapiens
tcattacattattttccttgtgattaatttgctaaacggaggtgaacaaagtagtcctaaactaaaatttatttaccatttctcctttaaatacaaagacaaatatgatctattcatgacattataccactgtttctgttatttcccatattaacttggcgtagttgtttaaaacattcttttcttctttgtagatgaagaaaatatgacagtgaaataacgattactattgatcagtcatagttgtttaaaataatgtctaatgggctgggtgcggtggttcacacctgtaatctcagcactttgggaagccgaggcgggaggatcacgaggtcaggagtttgagaccagcctggctagcatggtgaaaccccatctctactaaaaatacaaaacattagccgggcatggtggtgcatgcctgtactcccagctactcgggaggctgaggcaggagaattgcttgaacccgggaggcagaggtgtaatttatgagaggagttcaagataaaaagaactggaaggctgggcacggtgggtcacgcctgtaatcccagca

SEQ ID NO: 21500 - DNA, 583 bp, Homo sapiens
tactacatagatggaacagggagtggttgtgtcacatgcaaaatatgatggagccaatttggatcttattatttatgttttacttaattataagcttaattctgggccatgttactctactctccatcagacttaaagtatttttttaaaaagtcaagaaagcaatggagactctagtggaaaatggaaaagaggaatagcttgcatttttgtataaaattttattaataatggccataatatagaatttttttttaattagaaagaaaaatgtctaatgttcccagtagattataatatgtaatattccctggaaaccaagcaacaccatatatctgtaaattatccatccgaataggaaacaaaggcatcccagatcatttaaattcagcagtaatccccaaagctcaatttaggcatggttcttaatattctactccaaaacttcaatatagtttatttactatttatcttctaacagagtgaatagcataaaataagcaacttgaagaagggaactctaaaggaattaaaaatgtaaaatgtaggccaggcacagtggctcatgcctgtaatcccagca

SEQ ID NO: 21501 - DNA, 587 bp, Homo sapiens
cgcctcttcctatgttgtaagtccttcctgtggtcttgaactccagggctcaagcaatacctcccgccttggcctcccaaagtcttgggattaaatgcgtgagccactgcacctagtgagaattatggagtaaggactttcctgtgactcacagcctctgactggaggacttacctgcagtttcttaccagctgtgggctcttccccattcttcctcccgcacgttgtaggatgtgtcaaactagacctcttagcttgttatcttagtaagcagtcttatttttgtgtcagacaaaaggcttagaatttgcctgtgccaggtcgggcgtgatagctcaagcctgtaatcccagcactttgggagtccaaggcgggtagatcacttaaggtcaggcattcgagacaagcctggccaacatggcaaaaccttgactctactaaaaatacaaaaattagttgggtgtcatggtacatgccagctactcaggaggctggggcaggagaattgctggagcccggaaggcagaggttgcagtaagctgagagtgcgccattgcactccagcctggaggctggagtgacagagc

SEQ ID NO: 21502 - DNA, 204 bp, Homo sapiens
taaaaacaaaactcctcaatataaggtgtactaaaatttctaaacatatttttaaatgcctggatgtgtcatgctacttaaagctgagtttatatgtccactcatgtttgatcacatcaaatgtaccggggggttccttatttttaatgagtaaagggtggtttttaaaaaagtgtatgttagatatttaacagagtagaaatg

SEQ ID NO: 21503 - DNA, 590 bp, Homo sapiens
aagtggggccttggcggtgaggagaggtaaaagtaaggctgggaaggcaagcagccgcctttgtcaaagtgctgatttttatttccttctacgtacaatgggaagtcactggcaggcttaggaaaggggagtgaaagattagagctgcatttttaaaagatgatcatgtgaggactgggcctaaggagcaagagcagaaacttagggcaggagttttgaggcaggagatgctggcctggtctgggatagagaacagtgacattatccaagatatatttgaaagatagaatcagcaaaaatattggcaaatgagagagaaggaggtaccaaaaatatctcctaattttctggagctcctaggtaaatagtgtaccatttactaagataagaaatacttaggaagatgctacaggatgaagcatcaagaattcagtcttggaaaccaaacggcatcagcatagctgttagaaggacagtcagatttactaacttctgtgttagcatctgtgccactgtttccatcatctgtgaagtgggaactatggtagaacctatacggttgctggcatgcagtaatctcagtaaaatat

SEQ ID NO: 21504 - DNA, 326 bp, Homo sapiens
tcattaatccaaatagactacagagatatgtaagtcacatcaaccattgttaatgaatccagcttttgttgtgttgttgtttaaaaatgacagatggatctgttataaccattcatctcctcttattctgtggtagatagtcccataaatgagttagtgatattgtgaataaatcatagttgctcaataggtaaaaactctaagttagtgcttttctatttatgttgcatttttattcatatactgtatacatttcttttgaagcgctaatcttcattaaatcaaaatgttatatttttttaattttatagtacttgtagtaaacc

SEQ ID NO: 21505 - DNA, 369 bp, Homo sapiens
ctttgtcttaataaataacattatattcacatgaatattgagttaaattgattcattttgtgtgtccttttaaagattgactttggaagtctccctttttaggagattttagaattgtgttggagaaattgggaatttcattaacaacatatagtcaatgcaggtaactgtttcaggcgcttcctcaaagcaaggatgacccaggagaggtacaatcatcttagtgtgctttatgtgattcatatgaaattcaacccttttggagtttcagttcttagcaaaataccacttcctgtttttgaggaaaaaaatggcataagaagtcatataaaaagactcataaggcccttggacatcaaataactctta

SEQ ID NO: 21506 - DNA, 591 bp, Homo sapiens
agatcacaagctcaggagttcaagaccagcctggccaataatggtaaatccccgtctctactaaaaatgcaaaaatcagcggggcatgttggtggacacctgtactcccagctactcgggaggctgaggcaggagaattgcttaaagctgggaggtggaggttgcaatgagccgagatcatgccactgccctccagcctgggcgacagagcaacactccatctcaaaacaacaacaacaacaacaaaaaacataaaataactcaaacttaattaaatataaccctaatggggaatgattatttgtcaacaataacaaagatatattactcagaacagagataagagtccaacaagaatccaagagtcttactttttaatcacaaaacaaatcctttcctttccaagtaatatcctctcaaggccaggaattctgtaagtagatagccttcttaaaaaacattcctggcgggacaaggtggttcatgcctgtaatcccagcattttgggaggctgaagcgggaggatcacctgaggtcaggagttcaagacccacctggccaacatggtgaaaccccaactctactaaaaat

SEQ ID NO: 21507 - DNA, 582 bp, Homo sapiens
tagactcaaagtgagggtcggggcaagcgcttagccactgtctcatttcacctttctcttagcttaatggaatggtgggcaggtgctccacttcccaatacccacactacaagagcttctagccctttatctcatcaccactgaagtagacctcctgagaaactctctaaaggtgctcctcaaactcagcaaatgtggaagagactctagaattccaaacccagcaaagcaggtttttgatcaactcatggaggaaaattcagatatatctcaggaaaacagggacttaaaaatacatatgaaggccaggtgcagtggctcacacctgtaatcccagcactttgggaggccgaggtgggtggatcacctcaggtcaggagtttgagaccagcctgaccaacatggagaaaccccatatctactaaaaatacaaaactaggcgtggtggcgcatgcctgtaatcccagctactcgggaggctgaagcagaagaatcgcttgaacctgggaggcagaggttgcagtgagcctagatcgcgccattgcactccagcctgggcaacaagagcaaaaaactccgtct

SEQ ID NO: 21508 - DNA, 579 bp, Homo sapiens
catttccactctttggggcctgtaatcactcatgatagccctttaatgtgtcccttagactctatgatatttgatagtaaaagaggtattgaaagcatattttctggtcctcctgctttcagattcttccttctgtccctacttctgagatggagactgagtagggagtcaccaaactgatctggagaagatgaactagatatgctcagattatggaccctggcctcagtggggagaaactggaattctaacccaccagtccaactgtcatatccaattttaaactctggctgcgaaccatggctcacacctgtaatcccagcattttggaaggccaggcagaaggatttcttgagttcaggagttcaagaccagcctaggcaacatagtgagacactgtctctacaaaaataaaaataaaaaacatgtctggcagcagacttctcagtggaaagcttacaggccaggcgagagtggcatgacatatttaaagtgctgaagaaaaaaaaaaaacttttatcctagaataatatatccagggaaaatatccttcaaagatgaaggagaaataaagattcc

SEQ ID NO: 21509 - DNA, 557 bp, Homo sapiens
tgaatgtcagtgtagctgacatgagtgttttttattatatgactgtgttctttctataaaaatcaggcattgagagaagcccagatgtgaagcttggaacaataaaaccaaaggaagaatacatcagaggtttgtaaaacttagataatatggaagtaattaaccattagactcacgatatgttctctaacagtaaccttgaaactccatgttttgtgtctaatgacttctaggacacataaagacaaaaggaaagaataatatgctttcagagcatgaagaacttgctttagagtccctgtgtcttttgactcgaatacacaggtttattatatcatgcagttatgaatctgaggaaagtatgacatgatcgataggtctaattctaaaatatctgataaagaagttaataccaaaattagtgagtttcctaactttaaagtgaaataactagataaagaagaactaaatgcaaagctagcagaaggaaggaaataataaagattagaacagtgttaactgaaatagagaataggaaagcaataggagagattagt

SEQ ID NO: 21510 - DNA, 456 bp, Homo sapiens
ggtcggccacgttcagcggacacgggagcaagatggcgattccgggcaggcagtatgggcttattttgccaaagaaaacacagcagttgcaccctgttttgcaaaaaccatcagtgtttgggaatgattctgatgataatgatgagacctctgtgagtgaaagccttcagagggaagctgctaagaagtaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaactggaaaaaagaatggaaaagaaaatacagagagaacgagaaatggaaaagggggagtttgatgataaagaag

SEQ ID NO: 21511 - DNA, 527 bp, Homo sapiens
accccatctctacagaggaaccgtgacattagccgagctgtggtggtgcctgcctgtagtcccaactactcaggaggctgaggtgggaggatcgcttgagcccaggaggtggaagctacagtgaactgtgatcatggccctccaaggcctgagagacagagtgaggctgaggtgggaggatcgcttgagcccaggaggtggaggctacagtgaactgtgatcatatcacggccctccagcctgggcaacagagtgaggccctgtctcaaaaaaaaagaaagcccgttgggacgcgggcaaggagactgagcagaagatgggcatgagcctgactatggggagtcctgctggccatgcagggaatttggattttattggagaaacagaggaagcctttggaaggtttcacatcaagggaactgtgctcaccttgcttcctcctaaggagaccacagggttcagcacagctgcacccgcagtaggggcttggtgctgctggccaacttggagcagctgaagttgcctgc

SEQ ID NO: 21512 - DNA, 568 bp, Homo sapiens
gagaggccaaggcaggcagggggcttgagcccaggaattcaagaccagcctgggcaacatggtgaaaccccatctctacagaaaaatacaaaaattagctggatgtggtgatgtgcacctgtagtcctagctacttggaaggctgaggtgggaggattgcttgagccctggaggttgagtctgtggtgagcagtgatcatgtacaagctgcaccccagcctgggagacacagctagactctgtctcaaataataataataatacagaaaaaaactatggacctagatattttattttatgtatcgtagtatctttcttacatatcagtttttataataatatttatccatgataccatctgtaagacaggaattgtgtaaaaataacaatgctggctatgcacagtgactcatacctgtggtcccagcactttgggaggctaagacaggaggctcacttgagaccaggagttcaagaccaccctgagtaacatagtgagaccctgtctctgcaaaaaaattaaaaaattacccaggcatggtggtgcgtacctgtggtcccagccact

SEQ ID NO: 21513 - DNA, 536 bp, Homo sapiens
actgagttttggaagcatctcccacaaggagtatttttgttttagttttagaagcaggtaacaacagaaaaataaaacaaaatacagcaaaaacccctttcactttggctactgtagatcagaacatccgggtgcctcctggataaattaggaataagactttttagactttcattacatgcagtgttatttgaggaacaccgtttatcctaatgagcatgattataacctgggtctactataccaacagcaggctgctaattcttgccttttgtatgcttatttcccttctgatttgaacttaagaattctaaaattatgccaggcacagtggctcatgcctgtaatcccaacactttgggaagtcaaggtggagtatcgcttgaggccaggaatttgagaccagcctgggcaacgtaatgagaaccccacctctacaaaaaaattaaaatattagctgggcgtagtgatgcctgcctagagtcttagctacttgggaggctgaggtgggaggatcacttgagcccaggagatcg

SEQ ID NO: 21514 - DNA, 525 bp, Homo sapiens
gaataggaaagaaaggaaagaacccctggaagagatctaagtggcgcctgaaggtcaaagagagaaaaaggaaccctgttaacctgattctgggacttaatagtttcccctctttggggtgattcttcccccaaggtgggttttccgcatgagcagtgctttccttacccttaggattgagcacacgcagtgtcctcagaaagctatacatgcccatctgaggcttttttccgttttccgatgccacgtgtccccagaacgtcatacttcaccatttgtctcttaacacacatgcccaagaagctgctgctccctggggcttgcatagcattgaacacttttaatattaacaggtgtggaccatcaggagattgtatcttggcggggcacggtggcccacacctgtaaccccagcactctgggaggccaaggtgggcggattacctgaggttgggagttcaagaccagcctgaccaacttggagaaaccccgtgtctactcaaagcacaaaattagccaggcaag

SEQ ID NO: 21515 - DNA, 420 bp, Homo sapiens
gaaaccccgtctctacttaaaacacaaaaaactagccaggcgtggtggcgggtgcctgtagtcccagctactctggaggctgaggcaggagaatggcgtgaacccaggaggcagagcttgcagtgagccgagattgtaccggggggctccagcctggacgacagagagagactctgtctcaaaaaaacaaacaaacaaaaaaaaattgtcaacttgtcctgaaggagcaaaaagagtaactgaataactctgatatttttcttcaatcctgattcaatcacttattctttcagaaaacagaaaattttaagaaatggcatttactggacttaaagacttactcatcatcttcccataatcccacctccagaaaatcaccattaatacttccatctacaaaaaaaaaaaaaaaaaaaaaaa

SEQ ID NO: 21516 - DNA, 582 bp, Homo sapiens
gttagccaggtgggcgtgtgcagaggggtggaacccacagacaccccagcccaggagccattcctgatgtgggagatagtgtgtggtatctccagtgagccccctgaggctcactcatccaaagggcctcagtctcgaacgacaggcacggtcaagacaaggcaatggcacctgtcctaaaattccttacacacctctaggaaatatatccacagataatagcttcgccttgtagtgcatgaggtccttgaatgattcctcaccctcttttggtccagttatctttctccttctatgtagcatttcaaacactccactcacagtagtagccttcatcaggaaactcagaaatctaaaccaatgactttggggtcaggctgctcatcagaatcgcttgggagatagtgtaacaatacgattcctcggccctgttcccggaaattatgatgctttcggtacaaagtgggcccagaaatgtgtgttttagaatgctccctggggctgggcgcagtggctcatgcacgttatcccaacactttgggaggccaatgagggcagatcgtttgagcccaggagtttaag

SEQ ID NO: 21517 - DNA, 435 bp, Homo sapiens
  misc_feature 368: n = A,T,C or G
gatactttctatttaaattcggatttacatagtttttacttaatcttattgataatatatctgcatctcctttctcccacaccaaaaatctcaaacaatacccaacatagttattcatttgttttatcctgtaacaggggggtattttcaaaatgactttaccaacactaccatcaacagtatataaccactgaaaatagtttaaaattatttttagatacttttaaagtccttgggttgtgtcgacgtacagacaaaacagtgttttaaaattatttggaaaatgattacttaaaataatgaaaacttcttttgccattctttcttgttgtcaggctatatggatatacatccaaatgactggattntaaaatcacttggaagagtttggtaggttcatattgtcaacccataatgcaagtcagttagtttcat

SEQ ID NO: 21518 - DNA, 383 bp, Homo sapiens
atacatatcagaaggtatatattgaatagatcaagtgagtatcctcctgagctacacaagttaatgtgatttggagccataaataacaaactgtttcatctccattgccacctcatgcatctccattcttgaggggtatcgtaatatggtggtttgatttgaagttgcctggacacgagatacatccatgaaatcctacaagtaccagattcttcatttggaaacttgtgctcattccactgcaatatgctgcttctgagagaatgagcatgcccttctccccagtccccaccatacattttatcagggaaccctgagtatacggaaccgaggactgctaaatttttctgggaaaaggggagagactggagattaggaacatg

SEQ ID NO: 21519 - DNA, 556 bp, Homo sapiens
aacactgatcttaactgctttccccaaccttcccccaattcgctgttatctgatactcagtaaactgccagagatgcattaccaaaataatatggaggtggtcaaaatcatcatgaagaatgtagacatggaatctgtttgcctgcggtcaaatcccggccccacctcttactcgctgtgagaccttggatgagtcatttaaacgctctatgcttttgtttcctcatctgtaaaataggcttaataattgtacgtatttcctgagattgataaaaattaaatgggttaatatttgtcaagtgctaacaagagaggttggcatgcagtcactgttatgtaagagttaactatcattataagtaacgcacaggccctgactttgagtttccaatgagtcactttcttcagataccacaaaaacttttgggagatattgttctctgcctcatctgacagtcttctgggaattaggaagccatcaagatgaactctgagcaagagtgaaagcagttcatgactggatagctctaattcacctgcttctaatttcatccat

SEQ ID NO: 21520 - DNA, 459 bp, Homo sapiens
aaagaatatttggcaatcgttaaagtatccaaaaaaatgttttttgggaacaggaaattttcatccgattgaacatttaggtaaaataaacttctctctccattccagaggtacattcttatttttatgaattggctagtgactggagctggttaaaaaaatggtgcaaactctgtgagttcactagcactttgttaaatgaaattgatcacttgtaaaatacagtaattgcattaaacaactgtcattaaccataagatccccttgatgatgtctcttacacagctccacagggaaagcactaaaagtacacacatgcacacacatgcgcacatatacactagccaaaatgtttcctgagtataaaataagacaggagaaaacacagtagagtagtagagactctcagcaggaaccacatttgaaaaaataatgataaatgatatcatgataaaaatg

SEQ ID NO: 21521 - DNA, 336 bp, Homo sapiens
actgaaagaagccagaggagtggcagtagggtactgtgacaagaagcagagaaagagacattgatttatcgttagaacacaccactgcagaggtttaggaagagcaattttggcagaggacaagggctaacatccagtgagcctagcactagggtgattcatgaatatcaggctgtgaagaccatcagatcttcacccaccagatagaatgaccgagagatcccagggggctgtaattcttatgtccaatttctagccttgcattattgaaaaaaaggaggctgggcatggtggctcacacctgtaatcccaacactttgggaggctgagtggggg

SEQ ID NO: 21522 - DNA, 316 bp, Homo sapiens
gtgtggaggaggcgactgccaccgtggtgtgtgagggcggatgagcagcggggccgtgggtgtgcgcggcgtggcgcgccagtcctgatgccagcatgggttgttcatcaccgctgctgtccctgctgtcgctcctggttggtgcgtggctcaggctaggtcattgaaccgccggccacgccgggggcgctgggaaaggggatggggccctccgccctggcgggagagagcctgaggcccctctgcccgcttccgggatgcgcctgcagccgccggctggggaggtcgctctcggtgcgcagggtgcctcaccgac

SEQ ID NO: 21523 - DNA, 283 bp, Homo sapiens
tgaagtagggctcacaaaaatgagaaatagaattgccaactaaagatacacttgtgtccagatgactctgtaaagtgttatcagaccaaaactgacgcggttagcctttaccatcatgttgatcagggggtgtcagttgaaaaaccttatttttgagactgctacagtgtgaagcatctcaagagcaggtactgagccctcggtaatagcctttgttctgtaaggttttgaagttgtatatattggagatactagacatttaagataaatgtgcatttataga

SEQ ID NO: 21524 - DNA, 499 bp, Homo sapiens
tgtccagtttcctaatgaaactctttaaagtggattcagatgtcacttccatttgttgaagaatgcaggttctcactgtgtagtccaggctggagtgcagtggtgcagtcataacttatcacagtctcaaaatcctaggctcaagttacctttgcccttcccaagtagctaggactacaaaagcagcatctacagctttcagaaaggcacagcaagaacaaaagatctctttctagaacatggttaaagaaaatataaaatacttacctgactagagatgaaggccctcaaaccagcaggtgaagagatattctccaacaccacttccacgccaatcttcaccttctccagggtagggagaataccctttggtggaaacccagaacactcacagccacagacacagaaaaagaagatggcttatttcacatataacccctagagggaatctatggtctacctatctggaaaaatcgaaaggaagtttggagttgatgat

SEQ ID NO: 21525 - DNA, 603 bp, Homo sapiens
gatgaagaaagagcttcctgcaattcaaggactgtacaaagctgaaacgcagagattttcatattatttgggagactcagaaatgagcttttaaggttgttccttgacttgcgggtcaataagcgcacaatggtgaagaaaaggctgccttctagtgacacggtgttccggtttgagactccgggcagcccaaggaaggccaacgtggaggcctcacgcagctccacagacagccccagctcggtgttcctcagctcagaggctgagaatggtgtggaggagaaaaagaaagcctgcaggtcgccaacagcccaatcccctaccccatctgtggaggcggactccccagaccagaaggaaatcattagcctatggtcaaaatccagttttgatggtgcctctttggcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctcttt

SEQ ID NO: 21526 - DNA, 573 bp, Homo sapiens
gggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaaga

SEQ ID NO: 21527 - DNA, 556 bp, Homo sapiens
ggtataagtaggtaataactggtagatgtagtattctcatctgccctcaatacttttccttgccaaagaaacatctgtaattcaaggttagtaaagaggaggtagataggtttaatgaaaagagcttgagctttagaatcaagaagacttgtgtagacattctgggccccatttattcctcctctataaaaaggtataaaacaatggttactttttaggaattctgccacaattgaattagatgatttatctaaagcaccacacatagtatttggcataaattagcgcgttaataaataacacaagaacttagcacttaaaacatgatacaatttcaagtattattagcaataaactaagaaaagtatctttgggctgggcgtggtggctcacactataatcccagcactttgggaggccgacatgggtattacctgaggtcagagattcaagatcagcctggccaacatggtgaaaccccgtctctactaaaaatataaaaaaattagccgggcgtggtggtgggtgcctataatcccagctacttgggaggctg

SEQ ID NO: 21528 - DNA, 611 bp, Homo sapiens
cagccaaactaaaccttggaatatttctaggattatgaaaacattatgatgtatgattacttactaagaaacaggttaaaaggttaagtattaagagaaattatcttttatttaaaaataataaaagaaaaatttaagcaaattatctaaaccatgaaaatgaagacaatgatagtagacaacaaaatattttacctaatgtttaatatgttttaaaactatacatcaacattgtgactttattaagcattgacattcaagtaagagctatttattttaaataaggtaatttatcttgtttccactagactctagttattatgccatcataacacatacctttgctcctctatattctaacccagaaattgtaatcatcattatcttttaagtcagcagcagcagcactagcagttattgatcacatacaatatacaggagactaactgatttccctactttatttactttttaaatgtttaatcattggctatatattgtaagccagttcagagctagaagtatgcaatactcacctttgtgtcaacactttaaacatataactcaatgatttgataaataagataatctgaatacattgattttaaaag

SEQ ID NO: 21529 - DNA, 601 bp, Homo sapiens
cacctctaccattcccacctcccaggctaggaagcggtgctcagcgaggggagatggctgcccgccgtggcacgggcgtccttgcctcatcagcactctgttctgcctcctgcaagtcccttgccagagcttggcagctggttcacttccgagtgaaggttggctggcttattgttactattgtcttcaaaatacaatgtgtatttacacagagacacagtagcacctagcaggttctgtcctgggccctggaaggtaaaggtaaagaaaaggaagatggctgggcttggtggctcacacttgtagtttcagtactttgggaggaggccgaggtgggagactcacttgagcccaggagttccagaccaaactgggcaatgtggtgagactccatgtctacaaaataaaaaaaaattagccaggtttgggccgggtgcggtggctcacgcctgtaatccctcggcactttgggaggccgaggcaggcggatcatgaggtcaggagatcgagaccatcctggctaacacggtgaaaccctgtctctactaaaaatacaaaaaaatagctgggcatggtggcgggcgcctgtagtcccagctac

SEQ ID NO: 21530 - DNA, 611 bp, Homo sapiens
ttattagctgggcgcggtggctcatgcctgtaatcccagcactttgggaggctgaggtgggtggatcacgagatcaagagatcaagaccatcctggccttcgtggtgaaaccccatctctactaaaaatacaaaaattagctgggcatggtggcatgcacctgtagtcccagctacttgggaggatgaggcaggggaatcgcttgaacccgggaggcgaatgttgcagtgagccgagatcgcaccactgcactccagcctggcgacagagcgagactctgtctcaaaaaaaaaacaaataaaaaataaaagtaaaattacatcgagagctgacttacggcttcaaaaattgtttgtactcagtgtacccttcaaaggatgaaattctaacaatcttagtcctatttgaaacattttagtcctatgcaattaacatttctaagtaagtacagataagccataaattctataaccatgttagaagacagactgaatcttgaacatttataactaacttatccaattttatggtaaatttttgaagttctgtaatctgtacagattaatataactctgaagattaatctatagattactataactgaaagtcag

SEQ ID NO: 21531 - DNA, 697 bp, Homo sapiens
atctgcaagggacaccaggaaatgtagtttcattttgggcaggcacgcaccaatcagaggtcctataaccaagaaaagaggggagaatagatatcgtgagacaggtgaagtctcagcattggatggccttcctctagcgagcttgaagtgggctcagccctggtcagaagggagggcagtggccccggtgcatgaagggaaacaagcctttgttgaaaatgtcctagattctaatctctgtactggatgctttcttatgttctgtcccccaggcatcacagtccccgtgtgatgtgggtattgttatgttcaagttacaggcaggaaaattgagattctgaggaagtcatgtgccggaggtcatacagctgggaggcatgacgtgctgtgactctagagctttggaatggagcctgtgctctttccactaccttacacctcccttgcatctgggatccaaagctaggaaataaaaataggcctctttaggccgggtgcagtggctcacgcctgtaatcccagcactttgggaggccaaggcgggcggatcatgaggtcatgagatcgagaccatcctggctaacacggtgaaaccccgtctctactaaaaatacaaaaaaacttaaccgggcgtggtggcgggcgcctatagtcccagctactcgggaggctgaggcaggagaatagcatgaacccg

SEQ ID NO: 21532 - DNA, 591 bp, Homo sapiens
aacagaactgatccctgttctccaaacgtgccctgtgcttttctgccttcgtactcaatattctgtccacctgcaacttttcctgtccaccccatcttcaactacatacacctcaaaatccagctcctgcctaccctaaattactctgcctaccatccccccagagtgcatttctatatgcaccttcactattatccggttaacacttggcttcaagctagctgaaaagattgacgttttttgaagctaaaaagaaacttcaggtggaatttcccattctcccagctaaacataataaccctcttaatgcttgtacttagggtgatcctagaactgtctcttcttccaaaatgtttcagttcattgccaaagcactgttgaggttaaagattgttaaaatgtctcacctagcttaaaatcaaattttaggacttcatcaaaatttgaaatgttttattcagggatcaaaatattggtccccaaacactgggcttctcccaaaatatttctcactcccctacatggcttacacaaagaaacaaacacacgaacacacacaaactcagaggcccaaagcaagtcacctgcatt

SEQ ID NO: 21533 - DNA, 404 bp, Homo sapiens
atccagaacctttaaaaacaggagtgaactttcaggggactccaggtgactcttggctctattctgtaaaggaacccttatggcatttttgaatcactactgtaatatttctcatgggttttcaagcaaaaccctcatttggaaaagatggtaattgaattcaagaaaggagaagtaacttgttctaggtcacacaaaataataataagcctgactcaaaccctggacttttgacactcaggccactgctctttttattattctaggatatcttgctatctgttggaacttgatgtgatgaaagtcatatcctagctcagcactattcaatatgatatccacaggtcacatgtggtccctgggcagtggaaatgttgttaatgtgattgaattaaaatggaaaa

SEQ ID NO: 21534 - DNA, 556 bp, Homo sapiens
atgatcaacctgtaaagcccctagatcgagcagtcttctggatcgagtttgtcatgcgccacaaaggagccaagcacctgcgatcagctgcccatgacctcacctggttccagcactactctatagatgtgattgggttcctgctgacctgtgtggcaactgctatattcttgttcacaaaatgttttttattttcctgtcaaaaatttaataaaactagaaagatagaaaagagggaatagatctttccaaattcaagaaagacctgatggggtaatcctgttaattccagccacatagaatttggtgaaaaccttgctattttcatattatctattctgttattttatcttagctatatagcctagaattccatgatcatgaggttgtgagtatatctcattctttcgttgtattttcctaggtgtctttactctcttctctcactttgtgacacaaggacatgaatacatctaaattttcctatttctgatatgactgttttgatgatgtcattacttctataaccttaagtgatagggtgacatgcaatatg

SEQ ID NO: 21535 - DNA, 215 bp, Homo sapiens
acacttggtgggtgtgggaaaggattcaaatgtaggtctgttctcttcttcatctatcatggtccctgtcctggaggcaagtcgtctggggctcagaaaacacccctgttgccactgattggaattccaagggtctgggtgaagtggggatgggcctccagcttgcctccagcctgaaaaaatagtagagggtgttgaggctgggaagggaggtg

SEQ ID NO: 21536 - DNA, 510 bp, Homo sapiens
gattcgggtggggacacagccaaatcatatcaccttcctaactattcttgctgtggtcacctttcagaccttgacaacattttcactgaactttcctattagttttcagtgagacttcctgtctcctctttttctctcctccaatccgttctatacactgtttctagttaaaatccatacaaccccccgcccccacccaaagaaattcccagcttgacatttgtgataatttcacatatattttaaaatttagacttgtcttaccctgagggtaagtttggttctcacaatccaaatccattttccaaaaacatttattacatttttatccctgctctagcaaattaccatggatttagtaactcaaaactatacaaattgtgggctggacgcagtggctcaggcctgtaatcccagctctttgggaggctgaggcgggtggatcacctgaggtcagaagttcaagaccagcctggccaacatggtgaaaccccatctctactaaaaata

SEQ ID NO: 21537 - DNA, 234 bp, Homo sapiens
gctgagactgcagtgagccatgttcataccactggacttcagcctgggtgacaaagtgagaccctgtcacaaacaaacaaacaaacaaacaaacaaaaaagaaaagtagtattcacgttttggacattcctatctaaactaggtggaaagagaaaatggagagtactgggttctaaggaggcaggtattctagggtaagtaatttggtattttaatttaagcagaaagacatgg

SEQ ID NO: 21538 - DNA, 491 bp, Homo sapiens
tcggacccagagaggttgtggaccctcggggcctgacccacgggacccattcgtgaggctggccttggcactccctgaacgggatggaagtggggttcagcccgtctgaggactcaagagagggcgggactttgtggcagcgcaccggcggggcctcagccgcgtcccaaccgagctagacgggactgccctctagtggggagtgcttggctagtcgcgagtccagcggcgacgcgcgactgtcggcattccctttgccggtaccaggtgcagactgagggtcggtgctgaggctgctctatcaacacaggctaggctcaagggtagtgtagctgcagacagactggacataccagcaacaggaaaataccagggaatgagggccgtgggctagcttggggaaagtcagtctcacaggaggtgacatcaagatgcaatcaagaagaggggcattctggccgggcgcggtggctcacgcctgtaatcccagc

SEQ ID NO: 21539 - DNA, 469 bp, Homo sapiens
catggtggaagattacaggtcatctttgaaggacttgagggattgaaaaccataggtcttcagtctctatatcattttctttagtaactttgaacccagataatattaacattatgataaaaataatttcagattgatgtatgtaagaatcgtgtgtaatgaccaggtatgaggcaccctcataaaattccttgtaatcctctgaaacaggaagattatagtgattaagccatagatcttttagattatacattggtacatttacttcataacttctttataggaacacagtcaaatgtcttagtattcagaaatacttcacctttggtttcatttataaagcattgactcctttgtataagaaatttagcctgttcatcacaaaacaatttaattactactctgggctgctcaagatggtttgtacattagtatttagatgaattttagatggttgcaggtctgtagt

SEQ ID NO: 21540 - DNA, 536 bp, Homo sapiens
gctgccttctctacctcaccccccgcccccagcacggtggcactgtggctctggcgcctggtgacttctccctccccggcctcaggtttgcttcactcttccaagggccttcttggtgtgactgtcctgtcctggccacgtccactccaagcagctggtccaggtgtggggcagcccccaagctcagcagaggacagttttgagacttagaggaggacggcatcagatttacatgaagtcagccatctcaagggattaccacgtcaccgcctcctctcacaggtctgagagctggtcccctggagggtgcaggtctcatcctaggtagaacagtcccagcctagcttcaaagcgctcctgctgccagaaagggtagaaaaccatgctgaatgccttcactgttgcctggaatgggagcctcagtttcaccatctgtaaagtgagattaatgaaagggacccacagagggctgttagagccagtaggcggccaggcgcggtggctcacgcctgtaatcccagcactttgggaggctg

SEQ ID NO: 21541 - DNA, 553 bp, Homo sapiens
caagttgtcaggctgaggtaggtggctgtgctggaggctcaggccaggaggccctgaccagtgaggagtagaaggggccatgaccaacattaaaaactatatgactgcttttccagaaggcagcttgccctgtgctggaggcccacaatagtcataacgatcttcactccctcctgaccctgaaggcagttgggtagtggctggagctgcaatagcagcaaaaacagcagatatgtctattgcctctgggagcttcatcccagagaaatgcagagctgctgccagtcaaagaggtcaagtgggtgtttcatggctgttctggagttccaggtcagtgtgctttgcccagagaggtttaccagaggcaaggcatgagtccctctgctcctcagaaccatgaatgtagccactaacctttggcatgcagagaacttggccttccttgttggtgaagctatggcaactagcactggggtgcttaggggtctaagacctccgggacttctcatgtgcctgatctggagctctgcccagattctatgcagctctcctt

SEQ ID NO: 21542 - DNA, 523 bp, Homo sapiens
atcacgaggtcaggaggtcaggagttcgagaccagcctggccaacatagtgaaaccatgtttctactaaaaatacaaaaattagctgggcatggtggcacacacctgtagtcccagctactcaggtggctgaggcaggagaatcgcttgaacccaggaggtggaggctgtgatgagccgagattgcgccagtgcactccagcctgggcaacagagcaagactccatctcaaaaaaatatatgtttttacaaaaaaaatcaatatgatattttgaaaatgagatcactgaggtccattctggaaactggtcagggtgtactaaagaaataaaccgcatacttcataaggccagggcataaagaagggtggcatcatttacacctttggcaaaatgagacttaaggtgccccagtgtcgtgtgggagatcctaagtctgtgttgaaaacaatgactgaggctgggcactgtggctcacgactgtaatcccagcactttgggaggccgaggcaggcggatcacctg

SEQ ID NO: 21543 - DNA, 281 bp, Homo sapiens
gatacagcaacgacgtttgtcactgcagttactaggtaagcaaaggaatgacatttgaaccttcccggaaaggaaacagcttgtttgttttaaatccgtaggaaaagtactttgtttcacttgactgctttgtggaaatgcaagaggtatcatgttgctgtcaaaacagtcagtagttttgtttcctgcatcaacatagagtgaaaagactaaatgaggccctattacttttattaatatggttactataataaagagaatgggtagtttcaaatttgtta

SEQ ID NO: 21544 - DNA, 300 bp, Homo sapiens
gtggagagtggaggtgggtgtggattctacttctacttcccgtcggagacagcagagttgatgaaaggtgtgctaacagggtgctcatcgagaattagattgagactcaagtcacagccaacttaaatggctggaatgcatacaggtttatttttttcatacaaccagatgttcaaggtagatatttgttacctatcactggttcctttaatctgcaatgctcactgctgtacgccaaatgtttgtgttaccctaaattcatatgttaaaaccttagctccaatgtgatgggatgagggg

SEQ ID NO: 21545 - DNA, 525 bp, Homo sapiens
ataaaaaggggaaatttgtccacagatatgcacacaggtagaacaccatgtgaacatgaaggcagagatccaggtgatgcacctacaagccaaagtatgccaaagatgaccagcaaaccaccagaagccaggggagaggcatggaacataaggtttctcacagttgtcgaagaaaccaactctaacaacgtgatctagaacttctagtctccagatctatgagataataaatttctgttgtctaagccaccaagtttgtggtacttcgttgcagcaagcctagcaaactaatgcacacatattctatattttgaagaaaaaattcccagagaatcatttttaaaatggttaaattaagcaaaataaaacaaaccaaaaaaagaaaagtcccaactacctgaaatatttaattgtcttaggaaactgacttaaaaatatctaatacaggccgggcgcggtggctcacgcctgtaatcccaacactttgggaggccgaggtgggtggatcacaaggtcaggagttca

SEQ ID NO: 21546 - DNA, 558 bp, Homo sapiens
tatataaaaattatattttatatttcataagagtgttaccactgggttggaaacacagtccaaagcactgggttcctttggaaatctcttggaaacgtgtgtttcatttcctgcaggacgtggtgctgatgagggccttgcgagacatgaacttgcccaaatttgtgtttgaagatgttcctcttttccttggtttgatttcggatctgtttcctgggctggactgccctcgcgtccgctaccctgacttcaacgatgcggtagagcaggtcctggaggagaacggctacgcggtcctacccatccaggtaaagccaggaaaatgacctcactgtggccgtgcatcctttccattggctttttgtttttgcagttctttaaaaaatatatgtacagtaaaatacgcataagtttcaccatcttaaccatttttccccatttttaaatcacagtaaaatacacataacaatatttaccatcttacctacttttaaatgtagagtttgttaggccgggcacagtggcttacgcctgtaatcccagcacttcgggaggctg

SEQ ID NO: 21547 - DNA, 550 bp, Homo sapiens
tgattttgcaaaaattactcaatttctacagtggatgtgtttggaacacatcacaaccctgattgccattttagagagaagcagacacaacagcagcatgcatgggatcactgaagactacatcttcagtcagttatcttggcttcattctgattgtttatgaggattaaactttggagcaatcctagatgagttattctcaaactttagagtgcacgagagtcactcagatggcttattaaaacagactgctgggtccaaatcccagacttgctgattcaataggtcaaggtggtgcccaataatttgcatttgtcataagttcccacgtgatgctgatgctgctggtctcagaatcacattttagaaccactacctaagctaagctaatggctatcctcagctttggctacatctgcacttaattaaaagatggtgacctcttccccacatgccacatctatccagatgttaacttcattatacaggattcatgcctagtgcccttttgattaagctgcctcagtggactcaactaagcatttcccat

SEQ ID NO: 21548 - DNA, 540 bp, Homo sapiens
aaaggaaaataaccagcccaaatgtctgtgtgtgtgtgtgtgtgtggtgtgtctgcctcccttccacctcattcacagtgggcaacctgtattataagtttcttacctatctttccataaatattctctatatagaagagcaaacaggttgtctgtttacacaaatgttacatacaatagaaattcttttacaccttgctacctgatttaacatatcttggaattcactctttgtcatacacaaagatcaatcttattcctaggattggctacataatactccttcaaatggctatgccataatttagttaaccagctctgtactgctggacttggctttgtttccaatcttttgctattacagtgttacagtaaataccgtgtagctcacaggctaatcagagaaaggcaaagtcacctggcagctaagtgcaagagatggtaagagcagacagctggcagttagggtaagctttcctggggtagggtcctgaaggatgagtaggagttcaccagataaagaagtgaatgatgggtctg

SEQ ID NO: 21549 - DNA, 510 bp, Homo sapiens
ttttagttataagccacccaatttatgtgttttgttataagatcccccaatggactcagacaatttggctggccagttctggctctgggtctcccatgaggctgccatcgtacatcagccagggctgcagtcatctcaaggcctgactgggggcatcttggaggctggataccacaagtacctaccatgagccaggtggtgtacaagtaatatatagcaacaacaatcataatgtacaattggaagttatttcatgtttactatgtgtccagatgttaagtactttccctgagttacctcctttatcttcataaaaaccctacaaatttggtctggttatcatctcattgaagaggttagaaaactggggcttagaggccaggcctggtggctcatgcctgtaatcccagcactttggtaggccgaggtggacggatcatgaggtcagaagatcgagaccatcctcgccaacatggtgaaaccccgtctctactaaaattaaaaaaaaaa

SEQ ID NO: 21550 - DNA, 460 bp, Homo sapiens
tgagtggtgactgagtccccaacagtggaatggcctccatgcctaggcttacatgtgagagacagggttcctcccccattgctgagcagcactgtggtgctgctacctgtctggggctgtgggtggcaaccccgcactgcagccacagccaacaccagtatgcaccagccaggaccgaaagagtcatcccaccactgctactggcatcacccataccatgccagctgcccggggactcatgaacccactcacacacctggcccaccactgccactactaacatttaaacaaaccatctgaaggtccagtaactgacctgcctggtactgctaacaccagtgccactgcacacagccccaggacccaagatcaggcacactcagcccaccactactaccactgaggcctgaagactagcccaactggcacccctgtcctcagcaaaacttcaccatagccc

SEQ ID NO: 21551 - DNA, 238 bp, Homo sapiens
aaacaactgactatcagcaatttcataaggttcttaacctaatagaagaaaatgcagagaaaaggtttggcttccttcaaaggttgtaagtacataaaacctggtgccaagtttccccttgtgggaggaacagtgtttagcaaaatacctcgatatttgccttggtttgaaaggtgaggctccatgaaccagagtgaaacagtcatgtgagaaaagtaacaggaagtgggaaaggagg

SEQ ID NO: 21552 - DNA, 539 bp, Homo sapiens
tatgcatatccttattcactcagtaaatacttagtaaataaagaattgaaagctgatccacaatttatgaattaagtatattttgtctatatacaaatgaggacattaacatgaattacaacataagtgcacacatattttgaagtatgctcatattgtgtttcacatattttgtaataacacaaagcagtaaaaaagagttcaaataatttatttcttgggtactttctttaggttagttaaaacctaacttcacagtctgtaactgagtcagatacacagaaaatagcagacctggggaaaaaaatgttattattttattcagtataagaacttcaaagtttgaacgcattattttccaaactaaataaaagtattcaaaaaattaatataggctgtataagcttatatgacttagtcttaatcataaggaccttaactttttactctgtaggtacattatataaaaaactaagagtaaatttcatgagttttataattttattacatattctgtcttagaaaggaactagttcctt

SEQ ID NO: 21553 - DNA, 482 bp, Homo sapiens
gcagcatacacactccactgatcacctttgggagatgctagtgaattctcattatttttaaaagatatacaataggaaggtgagcattcattcttattttcttgtatcttcacttcataggaactcaatagttgaagaagatgtatttctttttaaggtaagtattctagctaataaatagaaaatgaatgacagaatatgaacatcatacaatgcctacattaatgaatctatgcaatgatcatcaatggctgcaaatatcacagaaagagaatcaaccaaacattatactacatgtatacttactttgatacatggccgccttttgtttatgtccagtttccaaaccttctagattgaggagtttaagtgctccaggaggagtttgagtgctccagtgttcatctaacaagttgtgtaaatcttttgttgtgcctaacaacactgacttattcctttaaggtggcaatggaagagttaat

SEQ ID NO: 21554 - DNA, 566 bp, Homo sapiens
gttgaatgaatgaatgagtgtctgctgccttaggtagaagagattcttggaccatttcttggcttgagaatctcagagaacagggctagagcaaaagctgaaagtcagttctcaggtttagggaccaactctgttgatatccattcatgggatttcactcatgaaaggaatgtggatgtgctacttggatgtgctagactgactccctacgacatagatttcaacctttattttgcttcccaatgacatcttctggttgattatagatgttaatgccaagattttcacatcccgtccaaacaatatgctaagtcttataacagaatgtaccctggtgcccatgggaactcagaagagagaatttcaagtcattttttaaaagggcatcacatgattgttaggagaaataactaatacaagtggttttgacaagaaattcttaaatatttcataggaataacagtgtcatcattctttggatcatcatgatatgagtcatcaattatgctattgggttcaattcaatttaatctaataagaatgaaatgagcacccacttcaagcct

SEQ ID NO: 21555 - DNA, 519 bp, Homo sapiens
tgctaaatttcacccctttcaactccattacttaatttcccctttgagatttgtttcctctcttcatgactctttggagttgtgagagaccaccaactcagatattgacccactgaaaagtcactaacacaccaatggctccggaaagtgctatttcttcagacttcttaagcagatagattaattagaggccattttgtcaaaatacagactaggtagagaacagagggacctagatgggtggagtctcctatcaccagccactatgttacatcttctattgtgccagagcttaacaactcacttgagaatgctaaatatcaacctccatttgagaaacacttcagtagaatcttcacttggcaaaactaaaagggttttggctttcatttctttaaggacatgtgtcactgatttttgtgagtgattctaaacagccagttgaactcttaggaagcattcaaggattaagcatctagtgaaggccgggcgcggtggctcacgcctgtaatcccagca

SEQ ID NO: 21556 - DNA, 406 bp, Homo sapiens
cacctgggaggcctggggagtgcccccctctgtctatcactctgggtacacatacatatgatcaagaagcatgacgaaagactcaggctatcagccactggcatcaaaatatgctgtccagtggcccaaagactgccctgttcaccacagcctgcacccacaggtacaacagaggagcctggggacaggccttccctgcctggtggcacctcccacagtgattgagtgcactgtctggaggcttggggatccatccaccctgcttgctgcttctggcatgcactgcaccatcagggggtctaacaacagacccaaaccactgactgcctgcactcaaacacattgtttgagggtctggggattgcctcacttggtccaacacagcctgtgcccacgtgcaccattg

SEQ ID NO: 21557 - DNA, 419 bp, Homo sapiens
ctaaatataatacaaaatataataagtaatatcaaaatgcaatgcatggctactacacctctggatttcattttggttgtacttgcatggaaagagaagtactagctggttagatgtgaaagaattgtggtaagtttcagggacagaccagaacagaaatgagaaagatttgtttattttagagaaaaggaagatgcattctcagaaaagtcaaaattaacaaatacaaagtggaaaaacaatatgtacgctatggatttgttaaccatacttcatggtttatttgagatagtacttgcttactcatattgttcttcccaaaattgttaataacacactcttttacttaaaatgtggttaaatttggaaaagtaattatatggtcatcttctctatggaggcatcaaggagacagatca

SEQ ID NO: 21558 - DNA, 555 bp, Homo sapiens
acgagcgtggcaggagcctccaatctgcttccaagagttgagaagtggtacagtacccaacacacacatacatctcatgaagaggcaattgtagttatgtaagaagctaaaaatattttttctttcaattactgtacatgtattatttttcaaacagctacaagttgttaggatgcaaatactaatgaagtcacttggatctaactacttaataaacaaaaccattaggtatttcttttggtctaggggtaccacacaaataattactgagtcactaagggtgacgtgagcagagaaagtttgggaatatctggcctaatcgaataatgtatatagaaacatacgctccaaaactgaaaatacctagcactttgggaggccaagagcaggggattgcttcagcccaggagtttgagaacagcctgggcaacatagcaagaccttgcctctaccaagaattaaaaaaaataaaaataaaaaaaccaaacacacacacgaaaactggccaggcatgatggtgcacctatagacccagctacttgggaaggagggggc

SEQ ID NO: 21559 - DNA, 566 bp, Homo sapiens
ctgcccgtccaggctcaggtttggtcatgtgacttgctttggccaatgaaataaaagcagatgtcaggtatacctgacctgagtaaaagctttaagggtcgacacgtgtgttttcacatctttctattgttctttttttctccatcagaagaatgcaatatcccagatgggggctgctacttctgactctggatgctgagatgaggaagtcttatggagcagtcatgtgtcttaaagccagagcagagtgagaaacaagcttctgtggcgagaacctcctctgataaaagctgactgacatgccaactacctaagggatacacccgcctccaaactaagaactaggagagggactatgacccatgcccccaaagcatccacagtctagacctctcattagttcttgcataagggtttataaaccaagggagtgttagaggccacagtgagtttgaataaacttcacagcccgatgcagtagttcatgcccataattccagcactttgagaaactgaggcgggaggattgcttgaacccaggccacatgatgaaataacatctctac

SEQ ID NO: 21560 - DNA, 555 bp, Homo sapiens
tgcagctgctcactcctgtaatcctagcactttaggaagctgaggtgggcagatcacttgaggtcaggagtttgaaaccagcctggccaacatggtgaaaccctgtctctactaaaaatacaaaaaaaattagccgggcatagtggctcatgcctgtaatcccagctattggggaggatgaggcaggagaattgcttgaacccgggaggtggagttgtagtgagccgagatcacaccactgcacttcagcctgggcaacagagtgagacttgtctcaaaagaaaaagaccaaatatctagctattcataattttaaaggtatctgtgaatgcaaacaaaacaaaacaaaacaaaagaaaccagtatatatctcttgctttacaatgattggaaagggaatgaaactgaggatttactaaaaaatagttttcatttatataatattttaatttgtgcatgcacaataaatgttgcatatatcagaaaagaaaattaaatgtgtatactgtacaaataacttaaaatcactgtataagaattacttttggccgggta

SEQ ID NO: 21561 - DNA, 433 bp, Homo sapiens
ggtggtggtgatttttaacacaaatggtggtgccattctatatggtctgctttgcagtttacttttttccactcagtagtgtatcttgaatagtcttcccatatcagtacttaatagtctcattcttttaatgcttgtatatagtattttattacattatatgaattttgttttgttttgtttttgagacagagtctcgctctgtcgcccaggctggagtgcagtggcacaatctcggctcactgcaagctctgcctcccaggttcacgccattctcctgcctcagcctcccgaatagctgggactacaggcgcccgtcaccacgcccggctaattttttgtatttttaggagagacggggtttcactgtgttagccaggatggtctcaatctcccccaaagtgctgggattacaggcgtgagccactgcacc

SEQ ID NO: 21562 - DNA, 533 bp, Homo sapiens
aactccaacctatatttttaaataaaatcaatatgattccccttgtatattttactactttctttctaatttgtgtcaatgctgcactgatcaataaattacaaattcttacacagaaatttctgaaatgtagccttttattattacttatatttttaattgccaagtattctaagtcatgttttggtacctgggctagaatacaaccctttctttatattttctttaattaatgtccttattctagaaaatgatgataattagtgcctacccagttcttgccaactactttctaatttcagaaatttttctaattttttgagatttaataaatacagccataatggagaattgagagggatgccatggaatattctgctgcatctaaacaatgtcatgtttgtttggtaattgtttttctttgtaccgattattttagttgctgtggctgttcccataaatatttgtacacagctggacataattttgcagtgcttatttccctgttaaaacccctactccacccaaagaac

SEQ ID NO: 21563 - DNA, 335 bp, Homo sapiens
ttcttttctgcagcttttttctcttcacttgagacccatgtatgtgatgatagtgtaatgataaattatccatgtggcgtccctccagtcttgttcattattcaagtgactctccttggtttagcaacaggttaagaggtatctatgacattttgttcaggttaagcagaaagaagaaaacaaaatctacattctctttttcatattttaaacacagccaacaaataatttggaaggacccatgattagacagagaggattttatgccccttcaagagtaattgagattctttaattgtatgggggaatgagcatatctcaaggggaagggagaa

SEQ ID NO: 21564 - DNA, 564 bp, Homo sapiens
agggctgactggagatgccagagatcacacaaatttgggacatagcagagtggagagaactcacaaagtatacctagaacatgtggctgagggccatgaggatgaatctttcctagagtaagagtcactgtctaagtctacaggcaaaaatctaataaataagcacaaactaacaaaagcccaggtttgacaggagaaaaagggtggtcaaataatttaactaggcatcaagacatttaacagaaataaaggttaaaatgttatgaaaatgaaagactgaatttataaggaagacttaacaatcctaaatgtgtacacatgacagcttcaaaatactttaagcaaaaactgctcaagtagacagatctagaattacagctggagattttaacataactctcaatacattgtatgatgagtaaaaaatcagtaaggacacagaagatgtgcatagtcacaagctccaccagttgatctaattgacatctgaagaacactgaaccaccgggcgccacggctcacacacttaatcccagctctttgggaggccgaggtgggcggatt

SEQ ID NO: 21565 - DNA, 575 bp, Homo sapiens
gggaggaccagggaagtctttcccaaggaagtgatgtttgaggtaagaactaaaggacaaaagatgttaactctgtgaagagagaatctgaaggtaaggggtgaaaaacaccccaggcacaggggaatgtgcacaggccctgacagaggtgggagagagcacagccaaggggaagttttcctgagaaacctaacgttcaagcaccagggagaccaaataaacactgtcaaatgcaacagacaagaggaaaaattgaactaggataaaaagtcaaaatttcaagtgaagctaacacctacatagcatttgtgtgccaggtacagttcgaagtgccatatatatatgttaataactcaccacagatctataagtggatactattattacacctgtgttacaaatgatgaaataagaggccgggcttggtggctcacacctgttatcccagcactttgggaggacaaggcgggtggatcacctgaggtcaggagtttgagaccagcctaaccaatatggtgaaaccctgtctctactaaaaatgcaaaaaaaattaggcgggcgtggtggcatgtgcc

SEQ ID NO: 21566 - DNA, 568 bp, Homo sapiens
cagtaagttctgtctatctatacccacagttctatctatacccacagcattatgtggaggctacaaaaagctttaaggcaaaacttcatgcaaacttgaaacaaatactctaacacaaataacaggggatcaaaaacaaaacaaggctggacacagtggctcatgcctataatccccagcagtgtgggaggccaatgtgggtactttgagcctaggagtttgagaccagcctggcaacacagtgagactcccgtatctacaaaaaataaaaaaattagccaggtatggtagtgcatgcctgtagccccagctactcaggaggctgaggcaggaggatcacttgagcccaggagtccaaggctgcagtgagctatgtcagcgccactgctctccagtacgggcaacacagtgagaccctgtctctaaaacaaaacaaaacaacaaaaaacatactcatgaactgttaaaaatcaatagtcattaacagaaaaagctctgtaaaggccatcagatgacttacaaagttatctggttccccctggttatgatgtcagctatacgaccacag

SEQ ID NO: 21567 - DNA, 576 bp, Homo sapiens
ccctattctgtcattaaaagtgaaataaatgtgcagagttgcaaaaaaattatcgattcgttcataaagatttgtattatttgtatttaataacaactttgtaagaatttaatatttattcttataagtatataaacaaggccgggtgcggtggctcaagcctgtaatcccagcactttgggaggctgagatgagcggatcacttgaagtcgggagttcgagaccaaactgaccaacatggagaaaccctgtcttcactaaaaatacaaaattagccagctgtggtggcgcatgcctgtaatcccagctactcaggaggctgaggcaggagaattgcttgaacccaggaggcagaggttgcggtgagctgagattgtgccattgcactccaggctgggaaacaagagcgaaactgtctaaataaataaataaataaataaatgtaaacaagaaaacaggctgggcatggtggcttgtgcctataatcccagcacttcgggaagtcaatgcacgcagatcgcttgagctcaggagttcaagacgagcctaggccacatggcaaaacctcatctctac

SEQ ID NO: 21568 - DNA, 568 bp, Homo sapiens
tactcttttatttatgactttcataggtactgcagcacttttttatgaagtagtcttctgtgggattcatactgcttataattgtgatcctttcacctagttggaagcacctgtcaccctggaggtgttcctagattagccctctcttggtataagcagggctctaactcttaggccagctttctttcaccctaggattaatttcatcaagttcattcactgagccagtttatatttactgattccccactgtgggctgaatactgtgggagtacatgtaagagctcttctgtattatatcatctagtgggtgagaaactctgtaaaactataatgtaaggagaataaatgctcagtagagctttgggaaggtttcacaaggagtggcatttgagctgaattttgcagaagtaaaattcattttgaaaaactagataataggtattccaagctgaaggaagaacctgaaaggaagttttgcatgctatagaagttcatagaaggtttctagtcagacttacataggttcaaggaagaaagtagattgtaaactgagggttaagaataa

SEQ ID NO: 21569 - DNA, 437 bp, Homo sapiens
ttaataatgcacaacaaatttacataaacaaaatttttaagaggatccagaaaactctcatagaatcttttcaagactttatttaacacattatataaagttggaaaaacctactttttccaagctatcagcatttagattgttttaaatgtcttctatttttaaaaattaaggttagcaacccaaaacttttaaaataaacactttgtaaataatgaaaatgagaacctatcatatcaaaattaccacaaggtaaatttattactgtaatttatttaataaaagaatgaaaactaaactccaaattaaagaagttagaacatagaaataagaaaaagtaaattaataatcaattcaaattattcaaaaaatagtaacagactaatttcttatggatataataaaaggtatagaagtgtacaaaataagtaatgcaa

SEQ ID NO: 21570 - DNA, 531 bp, Homo sapiens
gatggttggcccctgccctaggggcccctgtgggcacactcagagcctctctgcccaaaaccagaggcggtccctgggtgttgtgcgtggcaggaggcgggaggcactggctctgctccccaggagtggccttaaggcagtcagggaatgcacctcacactcgggcacagaggtgtctccagagcagagctcggaccagagaatggaaggcataaagcatccctggagggctgggtggccctgggagagtgcaggtcatcctgccatgggaatcagaccctggcttgtccccaccatcaggccctggggtgcctgtcatcccccctcccagatgtcatgctcctcagggtgagaactggctgtggacctggggctgccactccccagctcagagaggggtcattgtcctggcgggcagagggcctggatcctcgcctgtgagttagagactcgtgcgcccctgagtgaaggcagtagagagctggttcagtttggccagaggagaattccatccaccccctgagtgggagg

SEQ ID NO: 21571 - DNA, 533 bp, Homo sapiens
ctgtgcagctgtgggacccaggctgggacatgagccatgggagcactggaccctctcccattctcccagtcccagcatggactggttgtgtgacctggataggacccctccactctctgggcctcagtttccccatacagaaggcttggatcttttggtatctggggagccccccagctcttcttacagcactttgaagcctcacgtcatggccccactcccaggccaggcccatccagggctctgcagatgaatgtatggtcctcagcctggtagtcccagctttgagaggagccccttacccttgcctggcctgctctcccattcagctccagggattccaagggatactggcagcaccctggtctggctagtcttaggtttcctccctcagatggggtcctgccgcctaggaagaggtgggagcagccacctcaggcctggcctggtgctggcaccctcagtgtgaagaggccggagtcactccgaacagcacagctgctccacacccacctctgtgctgatcttacagt

SEQ ID NO: 21572 - DNA, 488 bp, Homo sapiens
catcatataacaaaagttgttaaaagtgctatataccatataatgttgcatctaaactgggacacttatctgagatgcttttgcgtgggacaaatgctatattagaaatgactaggactggccaggtgcagtggctcacacgggtaatcccagcactttgggagactgaggcacgtggatcatttgaggtcaggaattcaagaccagcttggccaacatggtgagaccccgtctctactaaaagtacaaaaattagctgggtgtgatggcatgtgcctgtaatcccagctacttgggaggctgaggcaggagaatctgaacctgggaggtggaggttgcagtgagccgagattgtgccactgcgctccagcctgggcaacagagtgaaactctgtttcgaaagaaagaaaagaaatgactaggacagcaggagtaaaaccccaaggcattaggtctctgattttgttaagcttttcttttgctttgct

SEQ ID NO: 21573 - DNA, 399 bp, Homo sapiens
tatcccattgttacttctttttaaaggattttaaatttgttttagcctaaacttttacatatcccttgtaaaagtaaataaaaatatgagaactaatttgtcagcatagaatttccagacatgcaatacaaatttctttaacttgggacatttgcaagtttaaaataaaatgggtctttcaaaaaatggtgttgtatgggagtggtggttcacacctgtaatcctagcactttgggaggccgaggcaggtggatcacctgaggtcaggagttggagaccagcatgggcaacatgtagaaaccctgtctctactaaaatacaaaaattagccaggcatggtggtgcatgcctgtaatccctgctacttgggaggctgaggcagcagaatcgcttgaacct

SEQ ID NO: 21574 - DNA, 536 bp, Homo sapiens
ttcattacatcttttctatattttcataacatattctacaaaggacatgttaatgtatttgaataacagcataacatattctattaaaggaaatgttcttttttgtttttcattacattctattcaaagaaatattaatttctaaaatgttacattttaacgttctcagatacattctatttgctggacaatatctcaaagaaaaaatgctaaaagtttaaagctacaatagatattattcccttttaactactattttaatgaattaattttttagttccattttctcatacttattggctatgtaatttactgaacaaaagcaatagtcataagaaatccaagtaatagattactgagcatgttacctaggcatatttccactgtcacacagaatgaagtctcagtgctacaatccagttaatcagaataggaacaagtagtacaccttttttataaaaacaattttcttgaaaaaaattttctctgagtattctaatacatctttttttgttagtcaagagcaaaattatttc

SEQ ID NO: 21575 - DNA, 458 bp, Homo sapiens
  misc_feature 156, 157: n = A,T,C or G
tgtgctattaaagacatcatattattggggtgtcgtaaaactggccactgttgttgcctacactcacccttcgggttacagagtgactgcaagagagatttggggtgactagaggccaatggacctagccatttggccaaggggcgtcaatggtannaggagctggattagcatggggtggagttcagtttttcttagaaatgtgcgactctgcaaaagtgtgcctttatttttggcacaaattgctatagcaaattacatagcttatcagatgtggttttttgggctcagtggagaaaccagtgcagggacttgtctttgttcttcattcccagttgggaatttgggataaatcagtgtcctgttataattcaggaacaaacttgaataataagaaactcacattactctaacttaacaaagtagaccttagtcttaaagagatttccattctccct

SEQ ID NO: 21576 - DNA, 540 bp, Homo sapiens
ggggatcctgctgaggataccaagacaaatgagatgttcctaccctggcacaactcaccatcctgagcaggagtgtcagggccacttagcaggtaatttaatttagggttagggttccagtgaagccagatataaggagccaatgaaccctgaagccattgcattctttgtgccagagtacattcccatccaccttggggaatggctaggaggctggttctggggtgtacttggtgtcattactgggcagagatggtgaacagcccttggacaattctccaggctttctctcccctgccttggaggctgtggaggcctcatgttgagtggaaggaaccacaggttagaagcactggaatccttgagtcacagcatggaggacagctgccctcatgagctgttactgctgacccagactcgtgctaaactttgcttgaatgacaaaccaactttgttgacataaatccctagattgggggattaattattacagcaattactctaggttatctggacaagtacgccatagataaagccctg

SEQ ID NO: 21577 - DNA, 404 bp, Homo sapiens
atgttcatgatccattgcttggtgaaaaattcacttacaatacagtgtaagtgtatatagtagaatcccaatttcataaaaacaaaataaaaaatactggacttccaggaccaagactgtcaagaaagaattaactgctgtaactgtcaaatcaaatgaagctgtacagtccgattagaaagtttgggtctgaattattgataggtgtaaaaaaactaagcaaaaaccacaaatcattattaaccctaagggaaacaaaattctacgataagagaacaattgctttagtgcacaacatagttcagttgtgaataacatttgcaagccctcagaagtgcaaacactgagcactgatatcagttaaaaggttttatgatacaactattctatgagaaaatgggaga

SEQ ID NO: 21578 - DNA, 534 bp, Homo sapiens
tttactttattacttcttgcttttgattgatataaagcagagtcctggtaggcatattgtgtatacttgcaaagatgcagaactaaacagttgttaatattaaaacaaaagtcctgtaaacctcagatggtgagtgtaatattttagcactaacaccaaagcctcaaatatgaaaagatatcaaaaacaccactagcaaacaaaagtaaactctcagccggaagcagtagttcatacctgtaagcccagcactttggcaagctaaggtgggaggattacttggagtcaggagtccgagaccagcctgggcagcatagtgaattcacatctctacaaaaaaatttaaaaattagcatgcctatagtcctagctacttgggagtctgaggtgggaaaatcgcttgagcccaggagtttgaggctgctgtagctacgataatgccactgcactctagcctaggtgacagagcaagacctagataattacattctgtcctgctcctgtttacactaaaatcactaagttaaaatgctt

SEQ ID NO: 21579 - DNA, 408 bp, Homo sapiens
gtgaggacatccattaaaaggttaggatcctgtgacctatttatcagtctagtgaataatatatgtatgttttcaaatgttaaacaactctcaaattctggaataaaccccactttgcaaggtgtattgtactttagtgttttgctgtattttgtttataatgcttatctaagatttgttcaaatgaatctgctccgtggtcatctcctgctaccataggcatgcagtattgatgctcatctcttaagaaataactgtcgtccaggcatggtggctcacacttataatcctagcatgttaggaggcgaggcaggaggatcccttgtgcccgggagttacagatcagcctgggcaacatagtgtgacactttcttgttttctcactcaaataacaaaaatagtgccagg

SEQ ID NO: 21580 - DNA, 538 bp, Homo sapiens
atattgattgccatcagctttttcctcatagcagcatattgtgacttcctatatccattaacatatttatttcttaatttttaatggctgagtggtgtggtactctgatgaaatttatagtttatttagccagtctcctttattggacatttattttcaggtttgcattagtaataagcacagtggtcatctttgcacaattctttcttaggatgaatttctagaagtaaaatttctggatcaaagagttcacatttttgaggctttaaatctaaatgccaaactgtagtctccagaggttgtagcaattcacattccttccagtattaaagtgtactcattcttcctatcatggatagtagacattttcccaaatcattgttaacctggtcatttaaaaaatttcatctcagtcaggcacagtggctcacgcttgtaatctcagcactctgggagaccgaagcgggcggatcacctgaggtcaggagttggagaccagcctgggcaacatggtgaaaccccgtctctactgaaaata

SEQ ID NO: 21581 - DNA, 545 bp, Homo sapiens
tggctctgctgatgccaatgagcctggaagaggaccctgagcctcagatgggagagacactcgagtcagccccttgacttcagcccggtgagacccaggaggacctagcagctcacactcagcctcctgacccagggaagctgggaactgatcagtgtgttgttgtaaacaccaaatttgcagtcatttgttatgcagcaaaagggaaaaaaaaatagacgtatccggatatgttcaacttaaaaagacgcccacctacccggatacacctggggtggtgggtactgtctgtccctggggacgcaagaagcccacactctccagtctccctgtagttataccagggctcagtgtcagtgagttaaggccagtggacttcaagaccttgcccttaaaaatatccctcaacggccgggcatgttggctcacgcctgtaatcccagcactttgggaggccgaggcaggcagatcacccgaggtcgggagttcgagaccagcctggccaacatgatgaaaccccgtctctactaaaaatacaaaaaatt

SEQ ID NO: 21582 - DNA, 456 bp, Homo sapiens
gtgttcaactcactgagtttatctagaggtctagctttctaattttttaaacaagtgtgtcacattacacatacaaacatgaccgcttcctggttattgagcctttgggatttttctaggtttcactctgtgttctttgtatcatgaacatctttgaacagaacatttttgagattatccctttgagtttattctccaaagtgggcttagctttagttttacaacaaaatcaacaatcaagaatattcagtttgtatagaacacattcattcattttttttcttttttttgagatggagtcttgctcttgtcgcataggttggagtgcagtggcgtgatctcaggtcactgcacccgccgcctcccaagttcaagcagttctcctgcctcagcctcctgagtagcggggattacagacgtgtgccaacacccctggctaatttttgtatttttagt

SEQ ID NO: 21583 - DNA, 505 bp, Homo sapiens
tgggcaaccaattcattttattttaaaacaaaaattcactacacaagatttttttaatataacacaacttttatttttaccttcttcaacaaaactcctccatatatttataactcatccacatatttatatctcttattttctgattaattacatgtcctatatataatttaaatataccttgagttagacagagatattttacctttaataagaacactttaaaaaagtgtttttctataattttatactggaaattatccagatacataatatcaaataatagcctttgatcctaaattatgacaagtttgtttatagcatttagttttttacatttgttataggagttactaagcaattattttaggctgggtatgatggttcaggtctgtaatcccagcattctgagacgctttggtgggtggatcacctgatgaaaggagtgtgagatcagcctggccaacatggtgaaaccccatctctactaaaaatacaaaaaatt

SEQ ID NO: 21584 - DNA, 536 bp, Homo sapiens
accacagcacaaagaaagggccaagacaactgttctagtgagtgggagagagtgtactcttccaattgcacaggcatgaccatagttcatatgaactaagttggagatgcctctctactgctgttctagcacttagccagcagacctgcattttactttcccaaggaatagacgaaaggcaaacctttagatgttggtgccttgggaagaatatagcctttggagggccctgggtcagagaagtcctaacagaccataaattctgtcccttcttactaccatgtggtagcactatttagtaactgtcctgcagaatccaatggacgcactcctgctggggaatgtcattccatgttaggcgtcatgttgaaacatattatttcatactctccttctcagtcaatctccatgtcatggtatctaggcatctatgagctttgagaaatatggataaactatggcaaactaaatcaactatctttaatcaaatacattccttttcctgagcttagattaccagcacaaactctcatttc

SEQ ID NO: 21585 - DNA, 558 bp, Homo sapiens
accaatatgcttttctgagctagggctaattatcattctttacttatctacgaatacaccactgcctgagtctatcagttctattggtcaaacgtcatctaacataacaaacatgtcttcataacaaatattcttatattttttatgtcctttaaacataccttctaacaattccctagtttaggtcaccataatcttttacctacattcttgccataattttctatcatatttccctattttgagacagaaaaattattttccacatggcagccaaagtgatttttctataatacaagaataatcacatcactccctcccatcaaactcttcaaatgccaacaattccttccaggttttaatacaaagttcttcatgatttggaaattatttatattcctagaatcatttctccttaaggtttacctcttactctatgtaaaagccccacctattcttctctatgagtcttagaaaacaccatgcttattctcctgtctagaactttatataagaaatctctctacttgaatttctcctcctcttctccttcatatt

SEQ ID NO: 21586 - DNA, 475 bp, Homo sapiens
gtgttgcccaagctggagtgcaatggcgtgatctcggcttactgcaacctctttctcccgggttcaagcaattctcctgcctcagcttcccaagtagctgggattacaggtgcatgctaccacgcccggctatttttttgtatctttagtagaaactaggtttcaccatgttagacaggctggtcttaaactcctgacctcagatgatccacccaccttggcctcccaaagtgctgggattacaggcatgagccactgcgcccggccaggaatttattttaaggacataatttaataggttcaaaaatctcatattcatgaaaactttttgaaacctataatagcaaaaactaaaaatgaggttaaatgtttactaatagaggaaggcttagtaaatcatagtaagtaaaaatgatgaaatatgtagccattaaaaataatactttacaggccacgcctataatcccagcactct

SEQ ID NO: 21587 - DNA, 482 bp, Homo sapiens
attggtaacttccctgtctgatgagttttctccacctccatctatcttgggaaactgcagtccttcaatttaacttcctcatcagatgacagctgcaaaccagaacagacacgtcccaatcctagatgaaccgctttgcttcactgggaaatattaaaaagaacctaatgattcaccaaagagcaccacatttaaagaaaagaaaattatcatttttagtggcaaagacaaaattagatgagagaaaaacctacttcaaacagaaaacaactaaaaacatttttctaaaaatccatggtacatgctacaacatggatgaaccttgaaaatattattttatgtgaaagaagccagttacaaagaaccacatattgcatgattccatttacatgaaatgtccagaatatacaagtctgtagagacagaaggtagattagtggttgccaagggctaggaaggatgagacgattgggggttaatgg

SEQ ID NO: 21588 - DNA, 545 bp, Homo sapiens
tttattcatccacgtgaagtctagaatcacttcactggatcttaagacaccccctcatgaataaaatttagaataaaattaagtcaaacctataaattaattttgaagaaaaatgacatctttataatatgagtgtccttaaccagtacaatggtgtgtcagccccctgatttattcaagtttttatttatttctcccaattgatcactgtcatcttctccatgtatatactgcacaattcttattaaaaagttagtattttggctgggcacggtgctcacacctgtaattccagcactttgggaggccaaggcgggcggatcacaaggtcaggagatcgaaaccagcctggccaacatagtgaaaccctgtctctactaaaaatacaaaaattagccgggtgtgggggtacatgcctgtaatcccagctactcgggaggctgaggcaggagaatcgcttgaaccagggagtcggaagttgcagtgagccaagattgcgccactgcactccagtctggcgacagagctagactcagtctcgaaaa

SEQ ID NO: 21589 - DNA, 561 bp, Homo sapiens
ttgcccaggctggtctcaaactcctgggctcaaactatcttcctgcctcagcctccaaaaatgctaggattacaggcatgagccaccacacctagcctcaaatagttgtcttaacaaataaatggttgaaacctgatatacgggaattagggactctgttttgtgaactgttcatttctggagtcaaaatggctttgatggtgaatttggttatctaacaattgtttccagaagttaggggttaagcagagtgcaccacccacaggccaccttacctgtcctgccttggcgttctcacagacaaaagcttcatagaatctggggaactctggagcattgtcattcacatctaagactttgattgtgacaggaacacttccaacctgggagggattgtctaaagggaacacaaggaaaaccaaatctgagagtttagtaatgccaaaagaaaaaaaaagagtaatggtttttgctagaagtcggtatttacgactgggcgcagtggctcacgcctgtaatcccagcactttgggaggccgaggcgggaggatcacgatgtca

SEQ ID NO: 21590 - DNA, 275 bp, Homo sapiens
tggagtgtcctgcccagaaggcagcatggccatttcttgctgcttttgtgtgtggttgttagaggcagactggggctgagtcggttgttgtgggtgagttggggagcactgtgaggagcgagcactggacatagatctcagaggccaagtgcccgccctgcccatacttggctgtggccttggccaagtcctaagtggcggttagggtacttgtaccataaaggtacagaagagtatcttgagtatgttattatttgtgtggagagagggggcag

SEQ ID NO: 21591 - DNA, 253 bp, Homo sapiens
  misc_feature 1: n = A,T,C or G
naagattggagtgtcaaatattaccaacttatttaccaagaatttggtttttcttaaagtctaaagtgtttactattagctttccacagggatataggagtttgcagaggttgtagttttttaagggaacatcaatgaattttcttgatgcatatgcctgtttctaccattttacattgttaatttgcctctaaaatgagtaactcttacaatggggtttaaaacctgaagactattgattgctaccttgatc

SEQ ID NO: 21592 - DNA, 494 bp, Homo sapiens
gagtatgatgcacagtcttcattttcttgtcctcagtcactgggagggtgatcaagaaagagaaagaaagcatggtagctggccaggtgcagtggctcacgcctgtaatcccagcactttgggaggccgaggcgagtggatcatgaggtcaggagttacagaccagcctggccaacatggtgaaaccctgtctctactaaaaatacaaaaattagctgggcgtggtggtgggcgcctgtaatcccagctgctcaggaggctgaggcaggagaatcacttgaaaccagaaggtggaggttgcagtgcaccgaaatcgcaccattgcattccaacctgggcgacaagagtgaaactctgtctcaaaaataaaaaaaaaaaaaggatggtagccttacaagttctatgccatctatttcaattccctgctttttgtaaacagcataacttcccacatacccccaaaatttatctcaaaattaaacctgcacaaaagt

SEQ ID NO: 21593 - DNA, 520 bp, Homo sapiens
agcaaacacaaagagaggctcaatctcccaaataattaaaacataaattgggccatatttttgttcctggtcttccttgaggaaaatgacacaatgcttagtagcaaatgagaaattattttgcaaatctatatcctcaaaatgccaccaaacatgggtcatgcatcctgctttcttgcattttgatcctattgctatgacttagtgtggtaattatattacaaagctattattcgatgaaatgaaaatggcaaaacaatttaaatgcttgtctaaaaagactctgttagaatgcaattatgagtgaaattacaatggcaaaataattgaaatgcaagtctggaaggcacagttatgaaagcattaaaatgctcctgttggggactcacaacactgagtgaaactatacactcctggggacatatttttaattcactaaagcaggcaacatttatgggcagatgagaatatctgtgctccaattgttctgcagcattatctacacttctaaatgccacct

SEQ ID NO: 21594 - DNA, 565 bp, Homo sapiens
gatcagaggtgtctataccttgaggaatgaggggctctccagagtgatttctgaggcaccatttatgtcaattagatagtgccttgtggaagggacatgagaaaggaaactgtaggttctggtcaagttcctggttacctaagtacacttccaggagtgaatggaccttggagaggccacttggagtgagaggttatgtcacagacttggattggcatcagggaaccatgggagagaactggagatgcatcaagactaatctagtgaattaactccaagaggaatgggtctttggtagcatcctgtagcacacaagagtggtgtactctgtgctctggagagacagaacttagcggggtctctgtgactaaggaacccagggagtagatgatgaggccctatgcagactcttcagtggcaacagttgtttggcattgccactgctgaaggctgtttctgggtgtaattacctctgtgggttgtcattgctgttgagagtgacactttggagccataactgttggaagttgttgccatggctaatggggaaattgtcagtgggagt

SEQ ID NO: 21595 - DNA, 530 bp, Homo sapiens
tcctagttttctcatggcagtgtcttgatcattcactaccctaagtctcctctgggtgctttctaatttactcctaatgttctttctaaaatgctcacctaaattctgtataatctggacaacacatggtacagtagaactattttttgcccatgctcttactgctgtatattactcttactgctggatattaccataaaacctaacattgtattaggcttcaattagagttcacatcagagtgttgcttcatatatttaaaagcacagattttatagcaattaattaaatgaacataatttaaaagagttgctgttaactataaacttagaaaagtctatacataaaaatctttatgaagaaattcatcctcagataccgtataacagcagaatgtgttatatactattatgactgtaattcacagcatacatatactatgtggcattgatataattatggtcacagaaaaggtatatttgttaatacttattttatttggatataaaaacttaataaacatgtaaatg

SEQ ID NO: 21596 - DNA, 493 bp, Homo sapiens
tgagccgagatcgcgccactgcactccagcctgggcgacagagcaagactccgtctcaaaaacaaaaaacaaaaaacaaaaaaactctttaccaaactcctgtttatagaccctcttgaagaaaaacataacgaaaacaataaatggtgatggttaatattctaaaggaagtcatgccaagttccatgttcactttttgttcagaaagaaaaatttcacattacagaattcatagaaagcataaatttcttatgggaaatctatgtccaaaagtttctcagctttctgtttgatgttgcaactaaataagtggaacctgttcattaagccccaccaatgaagtaacagatgccatcactgtccatcaaaaatggccagaatattccataattacacaggcagtaggaagaaaaaaaatggccagagtagctcacgttcctttgaggcctagaactgttcgaatccagagaatatagatatgcttagactcatg

SEQ ID NO: 21597 - DNA, 555 bp, Homo sapiens
atgaaattaaggcaatatagcaattctgaaggaaggtttcatttccttgaaaaagaataacgtaaggccaggcacagtggctcatgcctgtcatcccagcactttgggaggccaacacaggcagatcagcagaggtcaggagtttgagcccaacatggtgaaatcttgtatatactaaaaatacaaaaattagccaggtgtggtagtgcacacctgtaatcccagctattggggaggctgaggcaggagaactgcttgaacctgggtggtcaaggctgcagtgaaccaaggttgcgccattgcactccagcctgggcgacagagtgagacatcatcccaaaaacaaacaaacaaactgaagataactcctttttcttctaacaaatctgggagaagttagtgtaactaattcatgtgcatgaaaggaactttgctgagatgttaaacatccatcagtcaaaagactagctgagactgggcatggtggctcacgcctgtaatgctagtattctgggaggccgatgcaggcagatcacctgaggtcaggagtttgag

SEQ ID NO: 21598 - DNA, 555 bp, Homo sapiens
gcccccgaatccccaggacgtggggcaatgtctggagacatttttgattgtcacaactgggagtggggattgctactgaaatctagtgggtagaggccagggatattgctgtacgatcctacagtgcacaggacagccaccacaaggaactatctggccccagatggtaatagtgtcaaagttgagaaacgctagtctagtcctaagggctggtcctgcatcccaggctcttattcactgagcttccttggctctctgtgcccaggccacagcagcgactttcctaacatccaagagctgttcctttcccaggtgaaagccaaaaagactgtgccatctctgggctcaacttgaacactactcttcacctctgatccccaacttcaagggatacacatgagcccaggcagtggccagcctcaggtccacattctcagagggaccctgcttcctacatgagaggaaggccctttccagcctctgggttttcagtacaatcaccataatatccacatctcaggttccacccacttggcatagggaggacacagggta

SEQ ID NO: 21599 - DNA, 558 bp, Homo sapiens
ggaattcagaatactgcagttaggatctctcagctttttaccccattcccttcaggggactggataagcaattcatactgcgcactaaataactttcttggaaaattgacaatgagtgataatcccacatatctaactattgttcaaaatgtagcattgtcagaagactttgcctagatgagaggaatggaatggaggacctgagtatgagattagtaactccattaacagaacagcttggagggcttgccggttagagattatcttcacagactgacaagtcattcctattttttatgttgccagcagagttaagtctcttagtagcagggatgattccctcttaacaacatcttgttttgttcattttgcttttccaagaggtagaaactgaatttacatctaaattcttggtaagaaaaattcctgaataagatttgagggtgtcaggtcttagaacagagatgctcatctcaggcaaaatggatcctaagggggagcaagccacactagacattcaacaaaaagcagcatcatgaacattttcaacagctcatt

SEQ ID NO: 21600 - DNA, 500 bp, Homo sapiens
gtatggtgatgtgcctgtagtcccagctacttgaaaggctgagatgggaggatcctttgtgcccaggagttctgggttatagtgagctatgattgtgctattgcactccagcctgggtgcccagtgggaccctgtctctaaaaaatacagtgttgttaccggaagacattttgtaagatttctagatagattccatgtctacaggtgttatagacttgctgtcatcaactatgtctgattcaggtaggaagaggtgccaaagtctcttaaaacaccttgaattccaaggtgaaatgagtctgctcaaaaaccaaacatctcttgagtgttcctaagtagcaatttctgtatcccagcccaatgcaatcatagactagcaaaacttacacttgcaaggcatccccactgtgctactagccctcatgtatgtttatacattgtcaaaaatttagctcaggtctgtgaaaaacaattttttcttccagaactgtaataaagtc

SEQ ID NO: 21601 - DNA, 307 bp, Homo sapiens
tggaattacaggccaccgtgcctggcctactgttgctgtttctaagccatatacgtccctcgcccagtgagaaagaataaaatgcgcccttatttgaggaaataatagaaaatgtatttatttggccaataagcaactgtttaaaactgagcaaccctttgtaagagagggctttccaagcatccctattagtcatttacactttagtatggatatgcttctttttctcttacctgctccctaaatattaatttaacacagggtttacatgggggagaaaagaggaatatatggtttttggaggatg

SEQ ID NO: 21602 - DNA, 539 bp, Homo sapiens
tctcagaagagcctttgagagcagttggcctgtgcttagccgtgtccgagacccatggtccagaaccctcctcatatcttgaaagcctgcttctccatttaccagtcttagggccttgagaacaggtctctgaggagagaactagagaggacaattgtgagagtagaggggacaaatggccttcacccctgctctgtgaagtgacccaaaggggcctggactgtgttgtcacttggtttccctagcaggattaggtctggtgtaatacagtaacaaaatgcaaaatagcagtggcccaagcgcctcagaattcactgtctcgtggcagagacgcctagaggctggcgcccagggcaggcaggacccaggtgcctcccattcttgtgcttggctgtccttggtgacagctccaggcagtggctcttgaggaaagaggggtgggaaaaggggaaccctcctgcccaaatcaggctctttaaggaggcttctggaagtctccactacttccagtggtgtagccatgaccagctgtccatgtc

SEQ ID NO: 21603 - DNA, 443 bp, Homo sapiens
tcccacctgggtgacagagcgagactccatctcaacctaaataagaatcgtttcctcaaaaagcttgggatatatcttaggattcactctcgcccacatttcacaaaattatactaagcaacagaatttcatgtttagaagagattttctcagctttcttcttcttttgacctgtcacatgatcagggtggaggaagaattaactgacctgacctaggaggattttctattcatttaaattcataaagttcgtgtcctttgccaaacaaatgtgcataacaagtaaagtatagaatgggtcagagaagctatctggtctcaccttctaaatttaccaatgagaaaattgaaaatagtcagaatcaaaaatgaaatctaatgattcccagatggttgtttcttccactataacatcatattattctcctgcattatcatttaac

SEQ ID NO: 21604 - DNA, 497 bp, Homo sapiens
catctaatttaatatgcttgttttccaatgaatggccagccatttcaatatatactatcattttcttcttcttttaattgtttccttttacagttttatcatatgcttttattgtatactaagtttccttgtatagttaggtgtatttctggatcttagcctctctttttaaaaaaattttaatttaattttatttttttaagacagagtctcactctgttacccaggctggagtgcggtggcaggatcctagctcactgcagcctcaaactccttggctcaagtgatcctcccaccttggtgacctgagtagctgagattataggcgcatgtctcttttgttgattctttttgtctatttctccacccataacacactgttttagttaatgttttgaaatactatatttcaaaatatagtatattttgaaatctaatgctgagagtcttctgttattggttttattaactaaaaaaattattcctatatatggaag

SEQ ID NO: 21605 - DNA, 566 bp, Homo sapiens
tcgttgtgataaggaaaagggggtatagtttgtggtgtggaacaaagttagtcaaaaacctcaaagttgaaaactgatatttcatccactgttggtggaagtagctgacattccagttcccctaacaatgtagtgttggtgttaccaagcagagagctgatcttccatgcttcatctgacagaaaacaggcagtgtttttattcccctggaagacaaatactggtgatgctgaacaaagagctgatctactacctctctggcagaagcaaatggtactctgattcccctgccaggatagtgtcagcaaggtcaaatggtaagttgctccaccacattcatctggtagtgtgaggtagtgctagtaattgttatgatacactcacaccccatataaacctggcagcaatgagattgaatacagtagagcaagtcagggctagtcagcactctggttccctatacccctaatgtcagtgaaaaccagtgagtagctgaccttccatcctcatccacagtcagtgagacagaacaaagggaaacatgatgggactagatggtactcaac

SEQ ID NO: 21606 - DNA, 420 bp, Homo sapiens
tttgagaaatacaagtagaagtaactgcagaatactggattattatgtttatgtcaaaatggaatgaggaaattctgtttagggtgatgaaacattttggaaatagtggtggtggtcggacaatactgtgaatataatcaatgccactgaattgtatacttaagaatggcaagttactgtatatatattttgccacaataaaagaaaagttttaaaaaatggaaagaacttcaaatatcaggtttattggcagaaggagaccacagtcctagttctggctttgccactaactcgctatgggatttggccaaatcttagtggttgatttctggacctacagatggaccaaacccttcatttgacttaagcaggtgaagcaaactgttggaaggtctcatggctagcgtgggcttgaatcca

SEQ ID NO: 21607 - DNA, 601 bp, Homo sapiens
cagtcaatgactaagttcctctggactttcacatggatcgtaatagacaacttcatcctgtttttctaaaaaggtattaatgattgttaaaaacatattttattatttgtaaaaatacattgaatttttttaaatgtaaggaaaataaagatcacttgtaatcccaccactgagaatcactattaacatataaaaaatctgtgtataaatgtaatatacatatacacatgtgtatatatacatgactatacacatgtatgtaagtagcatgtgtgtatatacatgtaagtagtatatgcatgtatatatacctgtatagacatatgtatatatacacatgcacacacacacacatactacttacatagctacacgtatcaatggagttctaaaagaacactttccatgggatggaaataaatttttaggccaggtgcggtggctcacgcctgtagtcccagcactttgggaggccaaggcaggctgcacacctgaggtcaggagttcaagaccagcctggccaacatagcaaaaccccatctctactaaaaatacaaaactagttgggcacagtggcgtgtgcctgtaatcccagctactc

SEQ ID NO: 21608 - DNA, 580 bp, Homo sapiens
catgcaataaatacgttgcatgctgcggaggcagggaaggcattcttctgcatgttgtgtcctgcagtggagggaaaggcattcttctgcaggatgcatgctgcagagaaggagggaaggtgttcttctgcatgttgcatactgcaggggggaaggcactcttctgcatgttgtgtcctgcagtggaggaaaaggcattcttctgtaggttgcatgctgcagagggagagaaggcatttttctgcatgttgcatgctgcagaggaggagggaaggcattcttctgcatgatgcatgctaatccatggacatggaggccatgaaagaggaaggaagaggcagtaacaatgggtactccaatcgcacagcttttcaagcaagtgttgtttgctttattcttttcctttcaaaggagagagaaaacccaaaaccacctccaattacaatatgtggaagatgaaataaaagaaagtcaagttaatttgtggcctttaaaaaacaagaggttgagcatggtgtctcacacatgtaatcccagcatgttgggaggctgaggctggaggattgcttgagtgcaggag

SEQ ID NO: 21609 - DNA, 309 bp, Homo sapiens
gattcatgtgacgggcccctctgcttctcccccgccccatcatctccagcgcgtggtgggggaactgctggggaaggcgattggcatcgatctctccatcccttccgaggcccgacttcggaattgtcttagaagaaagaaggcaagccaccattttacccacgtaaatatatgaatatatttctgacattgaggtgttccagaagatgataaagaaatgatagcagctccagaaataccaactgattttaatctactacaggagtcagaaacacatttttcttctgacacagattttgaagatatcga

SEQ ID NO: 21610 - DNA, 528 bp, Homo sapiens
ttgcaccaacctgatagagatatagcaggcagacacacacacacacacacacacacacacacacacatacaatttcccagagcactactcaccaatgaagtactaatgaaatagctccccctgaaccacaagggtcattggactgcagctccctccctcctgcagaatgaagtccaagctccttagactgacttggccacaagctacctttctggccttgtcctttgtctttgtgcgcattatgttctagtaacttcaaactgcttgtagtttcccctgcacatcatatatctttgcttttgtgcacgctgtttcctcttcctgggatgttttccccactggccttatcttccaagattcagtttaggtatcatctcctctttgaatctctcttgagtcaccaaactgggctaagtgttccctccttgtcatcccacagttcccaattactgtaccccacactcaccacataggattctaattatctgtatagatgttcacctcccagtatattaaagagcttctatg

SEQ ID NO: 21611 - DNA, 553 bp, Homo sapiens
aacactgatccattaacaacttgaatagtttctctgcagatcctgggttttctgttgtataactgaacttcaggctttaggctgggcaccatgactcacacctgtaatcccagcactttgggagactgaagtgggaagatggctggagctcaggagtttgagaccagcctgggcaacatagcaagatcccatctctatattaaaaaaaaattttgagctttagattgaccaggggaagggtctgagccaagaaatgctcagtgatccacatgtatttctttggcttagaatcacaaaaagaaatcaagtacaaacctttgtgattatatactgaggatttatgtattaaaagtaatggaaaagatggcaattacttttacaccaacctatacacagttaattcttaattagtcatggtatgggctagaaagagataggaatactataacataaaacagtaaccgtacataaatcctcagtgataaaagtcattctaaaaattgtggagtgtcctgaaatacgatttccaaataaaaaacaatcatcattggct

SEQ ID NO: 21612 - DNA, 629 bp, Homo sapiens
ggaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactttaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgc

SEQ ID NO: 21613 - DNA, 589 bp, Homo sapiens
tatttaaagacacaaagggctggtttcttcatttctcctgattcacgtctgtgcttttgtgtcacttgtgatgctgggtgaaagaaggtgcctctctgatgtgtgctagtcattcccaaggcgacagctctgtcagagataaaaataaggaagtatccttttttatctcctttgagatgctaacaggctgctttccagattgcattccagtctacagttggttagcagatttgtgtactggttccacctgggcatataaattactctctccactcaaagtgctttgtagagcacaagaatttatcgtgtggagaggtaactatggtctgctacagttttatcggtgtctgtggaataatcctgagcttagagtaaattttagcacaccaagcaatttatataacaaccaacctccaattatctaattttcagaaacaatatatgaaacaatgggcagcatttgttaggcacttactatgcctctgagatttggtggggaatgttctgtgacagggagacaaaacaagcaggaagcagccagaggtccacacactagggctaggcaggctgtaaagactctactcagttc

SEQ ID NO: 21614 - DNA, 666 bp, Homo sapiens
  misc_feature 538: n = A,T,C or G
aggggtggggaggagagctctttcagtgttgccttaggtgtgtgtctgtgtgtgtcctaacccagtccttcccacactcccccacgtgctgatcacgtcgagcacctctaaggctgggtctttgcattagaaagctatttgttaggggtacagggggcaaagaaggcacctggcactcatcctcacctccaactcccatgcttgggcaggatgtctttgtccctgagtgaggtgacgagctttgctggccccacagtcttacctgcctggtcgggtgagccaagggggaccctgtccatgatgtctgggccaagatgtccctgttggcgaccctggagggtcctctgtcctgctgctgctcctgtggtcacgtagggggtctgctcctcatggacccaccacccccgtgtagttgtaatgcaagtgaggggttctaattttgtcagctttatcttagtgaaataaaggttaatatcacagaaccgaaaacaaagcttctgctcattactagggagtttcagctactccctttccgcanaacaataaatccaatcttaacattttcagctttctcatgattctcactctctcttctcaggtgagataatcctaacaatattcttggagaaattctatgtgtatgtgtgtgtgtgtgcgtgcatgcat

SEQ ID NO: 21615 - DNA, 567 bp, Homo sapiens
gctcttgagaaggtagaattaagatcatttcatatttcccctttcagttaggagagttcttcccatatctcactcgttgtattgtaatagtttcacaaatcacagatagagacatttagaaataactttgaacataaataattgcattatagttgaaatgtgtacaggcacgtgattcaaaatttgtttactcagataccagaactatttgattctttcaaataccatgcctacaattcacagtttttagaattacactgtgatttagcataagtacatttcagtgaatactgaggcaatgcctttggaagagaattgtttacagcaatctattttcctagactgattgcctagatatttcatatagcttatttatttatatagatgtgaatttagctttgaaatataaaaccccatggggctttacatgtgtgtaaagccctcctaggctatagtaggaaaaaatgtgcacactacaaaggtacaattaaaagccatattggctgggcacgttggctcacacccataatcccagcactttgggaggctgaggcgggcagatcacct

SEQ ID NO: 21616 - DNA, 577 bp, Homo sapiens
tacgttgacagtataaagtgttgaattcaaaatattctgatttaaaatcagattgcagcgctctgagaattaactgaaaggcatagaagtttaactattcaaaccttactaaaaaatgctaagaatgcctgtttatctttactacaataccatagttaaataatagttcagatacatttctcattgactcttcagaataatcttgggaaattgctagtgtagaatttcctttatgggagacacattagacagtggaactcaggttaagtgggctagcagtatagtatatttgaaaaaccaagacagacctgagttcagatcctgactttgaaatttatagccatgttctctgaagggagttctataacctctcctaagccccttctgttagaggataataaaagtagtactgggctgggcacggtggctcatacctataatcccagcactttaggaggccgaggcaggcagatcacctgaggtcaggagttcgagaccagcctggccaacatggtgaaaccctgtctctactaaaaatacaaaaattagctgggcatggtggcacatgcctgtagtc

SEQ ID NO: 21617 - DNA, 574 bp, Homo sapiens
aattctagtattcctcccatgtgcagtattttattttatattgcacaatagataaaatataattttggtttctccttttttattctaaaagagtaaaagcagttatctcaatatgttatgttcattctagtgatgactttactatcatgtactaaatgtgttttgtttaaagtagaagttaacttcacgttatactgatttgtccccccataaaccaactgtatgtcatcatataacaaaagttgttaaaagtgctatataccatataatgttgcatctaaactgggacacttatctgagatgcttttgcgtgggacaaatgctatattagaaatgactaggactggccaggtgcagtggctcacacgggtaatcccagcactttgggagactgaggcacgtggatcatttgaggtcaggaattcaagaccagcttggccaacatggtgagaccccgtctctactaaaagtacaaaaattagctgggtgtgatggcatgtgcctgtaatcccagctacttgggaggctgaggcaggagaatctgaacctgggaggtggaggttgcagtgagccg

SEQ ID NO: 21618 - DNA, 544 bp, Homo sapiens
gacagatggggagttacaactacatagttgattaataatgaaaactccccattgttgcaaaataccaattttcaccatgtaggtttccattataagagcatttcttactccttcccacttttactttaccctaggaagacagatgcagagtgaggttgctttacaaactcctctggttcaaagaatttcaattttaagatacaccattatggtcagtcagccacaagacagaatattaaattaacataaatcactggcaaaattttatattacattaaacatatgatttatgaagagagtggtatagactaggagccaatatagttttaataaaaataagtcatgctaaaacaatctaatttctctttttgattctattggaggaatatgggcaagtgaatgatctagtctcagaggagcctgacaaagcctctcaaggcatctttacgttaagggtaaaatgatggctctctgaatacacagactgcatattacttttcttaatttacccccctcgtgccaggtacacagcagatgcttaaag

SEQ ID NO: 21619 - DNA, 638 bp, Homo sapiens
gggtgcaagcctggacttcttcaggaagtcgcgggccacacagcctctgagaactttgctgatgtgtaagtgactgtgagaaacgagatgcgatgggcaaaaccctcctcagcgggacctccacccacagactcgactccggacacagccctgaccagccaggcgataaccccgtcattgctggcctggggctggggcagcacccatttacccatggacaggacagtgtttccatatttagcaatcagcatgggtgtatgttgcccaccagttgaaagtcaatcccatttgcagctcttttagggtctgagtgactctgaaaggctgcaggctgctgtggactcctgggcagctccttgttctttctccagctggactttctcacttgtccaattctcttcccagaaggagggatcagcagaagggcttagcaacctcgtccccgggcacaaacagccatttccacgggtttatatggaaaactaccaagtggcaccaatctcgataaagagctctctttttcgggttatttagaacgttgtgaacctgagtctccctgttaattccgttttggaagataaagcgggcacctgcacctctctagtaagaatgagcagggcatgatacctgaaaacaca

SEQ ID NO: 21620 - DNA, 622 bp, Homo sapiens
tgaaatggaaaagtgtccagactcttgtgcccatgagatggagtctgttgcagatcatgaaccaaataaaagaatattgggcagagtaaatttgtctttaaatgatagccattatggacagcaagataaaggaacatctctcagagaaacgcaagaaatgactgaaggatcaagactagaaccaaactctgagtttggcaaagaaagtacctttggaatttcctcaaaagagttgatgtcttgccatgatgaaagctctgtttccctaagaagcctgaaatccattgaaataatgccttctcaagaaaattcagaaactaatgttaacagtgaagaaactgacctgaaaaatctttgtaaaccaaaagatggtgaaatgctttgtgaaaatgtaaaggactgcacagtccttcctgagatgaaggaaatagtttcaagagattggagtaattctagtgacagagacagcgtatgtacctgtgtggaaaagaatgcttgcaaagcttgtcaccctcacgagaattcctctgacagacatttgcctttgacagtgaaaacagatattaaagtgaaaggagaagaaaccgaagagcatcagaggggacgactggtttacttaact

SEQ ID NO: 21621 - DNA, 608 bp, Homo sapiens
agactcagtctccttaatgattcttcagttacattctacagcttcattagtagaaccttatgaatttagcaaaaatctgggctggtttactttctgttttttgaaacagggtctcactctgtcacccagattggagtgcagtggtgtgatcccagctcaatgcaacctccatttcccaggctcaagtgatcctcccacctcagcctcctgagtagctgagaccacaggcaggcaccaccacacctggttacttttttttgaatttttattagagatgggtttttgccatgttggccaggctggtcttaaactcctaagctcaggtgatccacccacctcagcctcccaaagtgctgggattataggcatgagccaccatgcctggcctgggcaagattacttttgtattctctatgaggatgagtttgactaagcaaatcaataatgtaaacaaaactgaactacttaagagaaaaaattattctcacacatttaacatatcagttatctttcttgtcatgttaaacatacatgacatacaatataccattttaaagtgtagaattcagtagtgttaagtgcactcacaatgttgggtaaacatcact

SEQ ID NO: 21622 - DNA, 469 bp, Homo sapiens
gactattcttaccagcatttattcttactagcatttgtgacccagaattttcagagcaaacaagcaagcaaaaagcaaaattaatttaaatttcatttataattacttaattttcattcattgaaaagtcatcattctaaaatgagatttctattttaattataattacagatgctccttgacttacgatggggttacatttcttgttttttttttgtttttttgttttttggtttttggagacagggtcttgctctgttgtccaggctggagtgtagtggcacaatcatggctcactgcagccttgacctctcaggctcaagtgatccgtgcccctcagcctcctgagtagatgggaccacaggtgcatgtcaccatgcctggctaatttttgatttttttgaatatatggggttttgccatgttaccaaggcttgtctcgacctccagggctcaagtcatcctcccg

SEQ ID NO: 21623 - DNA, 616 bp, Homo sapiens
ggctaacacagtgaaaccccgtctctacttaaaatacaaaatattagtcaggcgtggtggcgggcgcctgtagtcccagctactcgggaggctgaggcaagataatggcgtgaacccaggaggcggagcctgcagtgagccgagatcaaaccactgcactccagcctgggagacagagcgcgacaccgcctcaaaaaaaaataaaaataaaagtaaataaataataaataaacctaacttcccagggtgtttagaggtcaggatttgacactcttaccaccatagcccaggtttaaattcttaaataaataaaaaaaccaaatggagacatacacaatgctcccgatggggaggaatgaggggtatgatgctgtcactgcctaaatgcgatttatcagcaaacgcaatccagtcaaaatccttctggacttttaaaattagaatttgagggccaggcgtggtggctcatgcctgtaatcccagcaatttgggaggccgaggggggcagatcacttgaggtcaggagttcaagaccagcctggccaacacggtgaaaccctgtctctactaaaaatacaaaaattaaggctgggtacagtggctcatgcctgtaatc

SEQ ID NO: 21624 - DNA, 522 bp, Homo sapiens
atccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaagacaggtaaatctcatttaatggtaatatattccaagaaacgcatcattaggtgattctgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccccaacacccaagccatggaccagcaccggttcgtgtcccgttaggaactgggcacaaagcaggagatgagtggctggccagccgagcattactgcctgagctccacctcctgtcagatcagcagcagcattagaccttcacaggagcgc

SEQ ID NO: 21625 - DNA, 597 bp, Homo sapiens
caacctctgcctctcaggttcaagccattctcctgcctcagcctcctgagtagctgggattataggccagtgccatcacagctggctaatttttgtatttttagtagttacggggtttcagcatattggccaggctagtctcgaactcctgacctcaagcgatctgcctgccctggcctcccaaagtgctgggattacatgcatgagccactgtgcccagcctgctggtgggagtataaactggtacagtcacattagatatttagcaggatataatgaaactgttgatgcacaagtactcaggcttggcatcccacccctcagtacatacccagggataccctcacatgagtacacagggaggtgcatgaatgaaatgtccctagctacaccgaggggctgtagtaaaaaacgggaaacaggctgggcatggtagctcacgcctataattccagcactttgggaagccgaggtgggaggatcatttgagcccaggagtttgaaaccagcctgggcaacaaaggaagaccccgtctctgcaaaaaaatttaaaaattagctaggcatggtggcatgtgcctgtgatcccagctactt

SEQ ID NO: 21626 - DNA, 528 bp, Homo sapiens
gaagaataaatgtaccttcccttaaaaaacttattaattgtagcacatcagtcttagtcatttttttgacctttctctcaatttatatttaccctggatacttttcttttgtcttgtttattttaagcatggcttaatttttcactggagcaagagcttaaaaacgtcagagtaagaagagaacaattacatttgtgacagttatcaattacttgaacattattcaagatagaatatattttccaattaatgttaaaaacagaattgtagaattacttttgagtttgattcactttgagaaatctaagaaaaaatttaaaaatccattctgtcaccttttcccccgtcatgtagggatgttcttaaagtcaaagagagttgctgtttggaatactctctgactttgaagcctgtggaaaaccacttatgaggtacagggagccttatgttgagttattttcatttgcatctccatatgaaaaagcaaatggaggccgggcacagtggctcatgcctgtaatcccagca

SEQ ID NO: 21627 - DNA, 399 bp, Homo sapiens
tggtttttgcatgatgtaaatggattttatcagagaacgctaacgtatgaatattgtttgccattctcatgaccaatacacataataggaaagactaatcagatcttgggactctttgaataccatatgtagccatagaatgcctctccatacagcagtctaggaatatactaccaaactactattattgtcttgttagttaaaatctacctatgtctagactggaggactacaatgtcaatttaagctttgtgatttcagttgtttaataagtttggcagatctggttgaccttaacaatatctgtaattacaggagtctctgattaaagtatatgaattatttgaaggcaaaaactataccttatatttctttgtacctgcaaagttctcaagttat

SEQ ID NO: 21628 - DNA, 531 bp, Homo sapiens
acctattgggtattatgctcactatctgggtgatgggtttaattataccccaaatgtcagcatcatacaatatatccatataaaaaaaaccctgcacatgtaccctctgaatctatatatatacacagagagagatttttagagttatacaataatttattatctacacagcacatgtaaggtagatagaaaatgcattactagttccacctttatcaaatgtaaagctggaggtttagatttctcttaccttactaagaaaactaaacatcaaacccaagttgagtttattaaccttcatgatgcagaatcccaattttctatatgaaactatgagttctcttatggcaggagttatgatttctgctattttctcaaatactctcaaactcggtgtgtcgctgtagaaggtgcccacaaatgctgagccaatttttaatactttgagaaatataggactgacgtatttttgatttaggaagcatgttaggtgtttctgttatattatctcactgggaagtgtaccacatt

SEQ ID NO: 21629 - DNA, 545 bp, Homo sapiens
gtaagtagaaatggataagcccccaaatattatagacatttcaaacacacgtctttcagcaatagataaaagaaaaaattaaagagtaagtttcaaaagaagctagtggattttaaaaagggcaaatattatataaggaacatgaatattataattcatgttattttcatgttcatacagaatacatacaaaaattaacattttctagaccataccacaaattcaaacaattttcacggaaataacgtgacacagaatatatttcctaaacaaacagaaatgaaggcagatatcaatacaaaaatgaaagttagaaacataagtgtaataatattggttggaagctattttaatgaatattgaaatattttaaaggtgaatagtcaatacaaataaaccaaacacttttgtaaggccactaagatgcatgtgtaatgtgtaatgcctccttttataaggagtaaatctgtagcatcacctgggctatttgacaactgcaaagtgaatgtgagaaggagagaaacagagagagagagagagataaa

SEQ ID NO: 21630 - DNA, 447 bp, Homo sapiens
aggtaaatacaaatccacattcttttcaaaagtaactgcatgaacatataaatgttagtttagaaacagactcgtctttcgacaaagagtatgaatatttatggatcttagagctctttggagattcgaagacaaaaatcccttgtccctgcattcttaagcacaataaaaaggacaacaatatttcattaattctgtctattttgcatctaaggtcagtatggatcagtgaactggccaggcacacaagttaaattatctgttctttgaattctcaatcaacaaatacttaacagtgcacccttgccaatacaatctcacaagtttatgacgtggcaactgccctcaagcaagctaagggggacacgacaaatagacttacataagtctttatcattaattaaatttcatttcaagaatggtcacaagggagtatttagatgtatc

SEQ ID NO: 21631 - DNA, 624 bp, Homo sapiens
catagaatctgattaaaaaacaaagtactagctaggcatggtggtgtgtgctgtattctcagctacttgggaggctgaggcaggaggatcatttgagctcaggcgttccagctatgatcatgccactgcactccaacctgggtgacagagtaagacccagtctctaaaacaaacaaataggccaggcgtggtggctcctgcctgtaatcccagcactttgggagactgaggtgggaggaatgcttgaggccaggagttcgagaacacctgggcaacatagcaagaccctgtctctacaaaaaataaaaaattagcttggtgtgacagcatgtgcctgtagtcctgcttacttgagaagctgaggtgggaggatcacttgagccaggtaggtcgaggctgcagtgagccacgattgcagctttgcactccagcctgggtgacaagagtgagaccctgtccccccaaaaataaaaacaaaaacaaacaaacaaataaaacaagggtctggttaactatctcacaactggaaaaccaggcagtcaattaaaaaggatgggcaggagctgtatgtgctgatgagaaaaaatctcatggagaaccctgcatttacagaagtacattgag

SEQ ID NO: 21632 - DNA, 560 bp, Homo sapiens
cggctgcgagagacgacagaggggataaattacatttttttttaaaacaaagactaattataaatgaaaaacattcataagacaaaacaaatcttatggtaacaatagcttgtagaaccaagtggagtgatatcttccagttactggggttaaataactttccattagaattctgtgcttaattaaattatcatttcagaatatgaacaaatctttaaaagtttagatgataaaagcttaagagtattttctactttaacaattatagatacaattctatataatagttaataagaaatgatatggaattgggattgtatgaatagtcaaagcatattatgcatttttaagtatagataaatattttgaataactttactttgttagaaaaaaatgtatatttaagtaagtaaaataaaatgtagtaggtgttcactaaatgaaaagaaatataatctatacttccaaatcagcaaagaaaataaaggcgaattttgacagtggtagcctttatttcctttgctgatttggaagggcaagagggtgttgatgaggtgctg

SEQ ID NO: 21633 - DNA, 609 bp, Homo sapiens
atctcgaggtcaggagatcgagaccatcctggctaacacagtgaaaccccgtctgtactaaaaatacaataaattagccaggcacggtggctcacgcctgtaatcccagcactttgggaggccaaggtgggcggatcccttgaggtcaggagtttgagaccagcctggccatcatgatgaatcccctgtctcgataaaaatacaaaagttagccagacgtggtgatgggcacctgtaatcacagctacttgggaggctgagacaggagaatcacttgaacccaggaggtagaggttccagtgagctgagattgtgccactgcactccagcctgggcgacagagtgagactctgtcttaaaaacaaataaacaaacaccttcaaaaaccataccttattttatcctttatcctgtgcatccttgggttctcaaactcctgctgtagtgttcgtgagtgacacagtgatgacttctttgtcttacatttttagtatctttatttaggtatctaaatatttagatatttattaaaagatactaacacttattaaaaagtattgttactttatttttatgcttccttgcatctttaaaatactgatgatcttt

SEQ ID NO: 21634 - DNA, 592 bp, Homo sapiens
tctcaaaaaaggcaatctaatttgctgaacctacaatctagctgcaaaggagtcttgcaaatttagtttttggctttacagcctcttcagtacaataaggcacactagagacagactggaatagatactgaacaccacatactcatcaaggtagaaaagcaagcagataaaccaacaatattaggtctgaggcatgagtggaaaaaaaaggagaccaaacaaaggaaacagcacaaaggaaggagtgatttttttgtgtgattagagaggcaatatctggggttgaaggatgaatagagtctaaagaggcacatagaagaaaaacattctaagcaggaaaaacagcatcagcaaaagtgttagtgcctcttcctgtcctcattcctgaaagtgacaacaaacatcttgggtgtcaatttcctgttctataaggaaagtaggggaagctgtaaagctttctttcctttaataattattaagtaccttcaatggtctctgcaaccagagagtatgtttaaagaatgcaggtctgttttgtgtcatggatacaggaatatgctgagaggagcacagtagggagagaggaattaat

SEQ ID NO: 21635 - DNA, 424 bp, Homo sapiens
tcctgcctcagcctccccagtagctgggattacaggcatgtgccaccacacccggctaatattttgtatttttagtacagacagggtttcaccgtgttagccaggatagtctcaatctcctgacctcgtgatctgcccgcctcagcctcccaaagtgctgggattacaggcgtgagccactgcgcccagccccatctttttcatttctatcctcattattaccacccttcttatcgtcagcaccaccaccaaaatggacactcattcattcatccagcgagaatgttctgaatatctccttcatatttgaagatgataagagctggtggagtgcggggtggggcgggggttaggaaatacaacagggagaagcagggaggaagagaagtgaaggagttggaggccaggtgcgatggctcacacc

SEQ ID NO: 21636 - DNA, 518 bp, Homo sapiens
gctcctcccggggtttgtagcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggacttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggataaatcatacggtgattttagatgatccatttgatgaccctcctgatttattaatccctgatcgatcac

SEQ ID NO: 21637 - DNA, 542 bp, Homo sapiens
cccagtctagaaccctatctagcctctgtgcagatagagttcgtacccaggtacctcttcataccctggatgtatgaaggatctctggctcagaggcttctggaaggtgtgctgctcccacttactctgtgttctggtagacgcccactgagatgttcagcccctccagctcttccttgagcatctgcaggtctgagttgacgaagctcagctccagccgcacttgctcccgcacctttgggtttgcggccactctgttcaaagagaagagggagagaagtgccctcagccaggtatcccagcttctgggtgagcagacccaatccccagtccctgcagggaggatcagggcacggcttgcagaggagggccgggagtgtcgggtaaggtatcccacggacacagagcacctgcccagcttgcagcacacctgccagtacgtggagctggggacacaggcaatgacactgtgagctgcagacatgaactctatgacatcctacaaaaactctgtcttgagaagagaaaacaaaactgctcct

SEQ ID NO: 21638 - DNA, 591 bp, Homo sapiens
ttccacctaccagtctccctttctcaattacattctatttttcatcttgtggccagaatagtattttctttcctacttaaaacctttcgctggtgctctgctgtccctgggataaagtttgaatggtacatgttcttcgtgatctggctcctgctgatctttccagctgtgcctgtctaaaagtcccactcttcctccttcccttcccagcatccaagtctccacagctgagctcagacgaacttgggattgcactccatgtgaatgtggtcttctgccttagtcgctcttgtcctgtgctgctcccccaacaatagcttaccttgtgatgaattctgacttaccattaaggtatccccctggacatcacttcctgagattggtgcctctcctatgtatttctgaatgtgtccagtgctacctgcttattagttggtgcaccccatttctaagctggtaagaaccatgccttattcactgttatattcccagcatctaaaatccttcctgccacattgtaaggggttctgcaacacttgaataaatgaatgaataaattactttctatataatagttcagtagttctgaat

SEQ ID NO: 21639 - DNA, 515 bp, Homo sapiens
taacacagcaaataattccctttggcccttgctctttattgccttccaaatatggaacaaaatgcttaccattttcttcctcactgtctagtcaaacttactcatcactcctcctaatcttatctcattcagccattctaattacccttctgtgaattcctcctggctgtctacatgtaccaagacttccgagcagagtctcatcagagaagtagggtatctaagacatactttatagaggctacaatttgaataacaggaacaaagaagaaataactcctttgtccaccttcaaaacttttgatacactgcaagagcctgtaatttgtaaaccatttaatctcacaggggggacctaggattctcagagtccgctccatcagggcaactatttacagcagactttcctcagatatacttgttcactttgtgctactccctttgatgtaggtataattaagctgattgcagccccagttggccactatgttcaaagaaaaaacccagtagcaatt

SEQ ID NO: 21640 - DNA, 657 bp, Homo sapiens
gtgcatattaaaaattatagattagcaagccacaaatttctgttccgaaaaatgttttaaagtaatgtggctgaagtattagattattaggaatattttgagtgttctaacaagagtgccaaaattaatttggagagtaacgactgtttctactctttggactcttgccaacatttgtgggtaaggtttaaggagaaggtgcctatctttcccacctcactcagtagtagttttctcatccttgtaaaatacttagggagattctgtgttgtattgcttgaacctcacaggtttaaaagacaggaaggtgaatttttgcactcaaagaagttatttactaattttagaatagagactgagggaatacaataagcagagatagagtgatgtgaatgaataaggagtgtatgtgagagagagtgagcacaggtatagcaagagattattgtcatctccctattttatataatcaaatagttgaaattctaaaaattcagtttatttggccaaagattaatttagtcagtcacaggtatttgttatgaatctgttatgacctaatattgcgctaggtatcaggaattcattcagtagtgaaccaaagtgcctacctttatggagcttacattgagtggtggatatcaataaatagtaagc

SEQ ID NO: 21641 - DNA, 487 bp, Homo sapiens
ccttgctcctggggacagcccaacactcagaccacgagttcctgatgcattattgtgagaggtttctgcacgcagccaggtggcatcaacgggacagtgagtaggggagccccttcctaacacccttagggaaagagtccctctgtgcaggaaagcaccatgccctagaacaggctagggatggagctgcattccagagtccatctccatgtctccgcacttccgtttttctccacgagctttttaaatttagtttttgtcaatatgtgtccctctcattccagcgacatgccttctgagatcacctgccaatcgtcttaaaacgatggggagtcgttacctatagtttcagcaccatgtatgggctatatttcattctttcttccctgcactatatgaagtgcaacttttatcatcatcacacacacgtatgtgcatgcatacacacacgcacgcacacatgcttgcacacacatgtgttcaagac

SEQ ID NO: 21642 - DNA, 454 bp, Homo sapiens
ggcacaaaatacacacaaatacttaacatacacaattttgcataaaatctcagtgagttgactctctaagacatatctagagatctaaggactccagatgaaaagcaactatcctaacataatcccaattatttcaagaaattaaaccaaattctcaaaacaaatttaccttcagtttacttaatttgaaaagtacttgtatgtattacttaaagtcagacagacaacaatattgtgatgcagttataagaaagtggcctgaccttaggtgaaggaactccagaagtaaaaattgatgtctgacaaagatcttcttacgtgtagtaaatgaattctgctctccaaatatgaagtgaaactgcatcaattcaagaaatgcctacaatcccttcagcatggtggttccactgaaaggcccttaagaataacggatattttactcacatgttttgag

SEQ ID NO: 21643 - DNA, 486 bp, Homo sapiens
  misc_feature 449: n = A,T,C or G
cgtattcctcctgcaggaggaaatcctcccaactcccttgtaggtgctgaaggaactcaccttctctcagacctcgtggctacctggagagcccctgggattagctgagtgaacacagatggtaggaaccacactgccaaccattgtaagaatgaggaagctcagtggatgatggctgctttccatctctcagtcagaatgtccccagtgaaggacaggactcaagggtcaacacaattggccaaactccaggcagtcaccttagtactggctgcctgactgacacagggccgcatcttcatatttgttacaaactatggtgccactggctgagttgtccctttgagggtcaaggactctgggactcttgcctcacagagacccaaacttaaatcaaaaccagagggctgggcatggtggctcacacctgtaatcccagcattttgggngtggatcacctaaggtcaggagttcgagaagagcctg

SEQ ID NO: 21644 - DNA, 107 bp, Homo sapiens
caaaatgaaacataagcaaccaggcaacagaagaaagtagcaaaaggctattcctccccagaacctgacattcaagactcctctggaagtgaagctcaatcagtaaa

SEQ ID NO: 21645 - DNA, 570 bp, Homo sapiens
ggagcccccctgaactcaccccattctacacctagattctgcccaccctgagattagaaggtttgggccctagattacattggcttcaggaccatgaacctcctgggttgtcttgggcacaagaggccacaccaaagctttctgactccccccaagtccacttcacttcccatggcctgccctggcccaaccccctcccctgaacctagggccatggattaaagattagtggactcctcatagacccctgggagaggcaggacaaggggtggattctaaacaaaaccagtctgggcacagtgactcatgcctgtaatcccagtactttaagaggtcgaggtgggcggatcactctaggacaggagtttgagaccagtctggctaatatagtgaaaccccgtctctactcaaaatacaaaaattaaccgggcatggtggcaggtgcttgcagtcccagttactcgggaggccgaggcaggagaatcgcttgaacccaggaggcggaggttgcagtgagccgagatcgcaccactgcactccagcctgggcaacacagcgagactccgtctc

SEQ ID NO: 21646 - DNA, 643 bp, Homo sapiens
cttataaatctttctagaaacacattttaagaagatgttaaaattgaaagcaaaagttctctttaggtgataaataaaatgctaacttattaaccgtattatggcttccttaccttaaaattgagcaaacccattgcagtttccacaaaagggattaaattcattggttgttcaagttttcggccttttaagtggaatgaaaatttgtctgcaaactaaaatcagaagtgtcataggtgattagtggggaaaaaatgtacaatcacggaaatgtagacccagaagtagtatttaagtcaagtctttgacctgaggaagtaatatccaagcctctttcgtccacacaaaagaatttttttaaaaaaataagaagaaagtccaaagaaaaaggtaatgaagttcccaccaaactaaatagtaaaatcctaagcattacaatttttttctcccaaaggagcaacttgaggcctaggagttagaactggaaggagagagtataaacgctttccctgaaaacgcatttacttaagacctcttgccctcgcttcgttaaatgcaaatggtaggcccttaaaacaatgaactcttcctctacctgccattctgtttttgtttcgtgcccagcactgacatcagtgcaact

SEQ ID NO: 21647 - DNA, 435 bp, Homo sapiens
atacttcagttctcaagaactctcaaaccttctgttttccaactgccacctatctatatctataccgtatatatgtatatattttatatatgtatgtgaggtagaattctgatttttttttcacataaacaacagaactgactgctggagaggagtgtgcagcagagacagctgagtgaagaacatggttcaataaattaagccttagagtggatcacttgagttcaggagttcgagaccagcctggacaacatggtgaaaccccatctctaccaaaaatacaaaaattaactgggcatggtggtgtgcatctgtagtcccagctactcaggaggctaagccaggagaatcgcttaaatctgggaagtggaggttgcagtgagccaagattgtgctatcgcactccagcctgggtgacaagagcaaaactctgtc

SEQ ID NO: 21648 - DNA, 623 bp, Homo sapiens
  misc_feature 524: n = A,T,C or G
gaatggcaggaatgaagtaggcagatggcagggatttgccatggagccatatctggggctcttatgggacttgcctcttccctgcctctaaaatttcaggtttggcaagtattggtgaggatgtggagaaattgaaaccctcgtgtgttactggtgggaatgtcaaatggttgcagctgctgtggaagacaatttggtggttcctcaagtggttaaacacaaaattcccatatgacatagtagttccacacctagttctaggtctatacccaagagacttgaaagcagggacttgaacagatacttgtagcttaatgttcatagtagtgctgttctcagcggccaaaaggtggaaacaactcaagtgtccagcagttgatgagtggataaacagaacgtggtctgttcatatgccatactgtttggttccatcaaacaatatgtgtcagcattccattcctctttatggccaaataatatttgccaagtattgaatgaaccatggatgaaccttgaaaacattntaaatgaaagaagtcagacacaaaaggacaatattgtatgattctacttatatgaggtacctagaataggcaaatacacagatacagaaagtagaatag

SEQ ID NO: 21649 - DNA, 528 bp, Homo sapiens
gttataactaactagtattatattatgctcttggcctgattacagaagggaaaggggctatcataccagacaatggcagaatgaagcaacaaggagtagagttacagaacatgatactgtaactgggactggaggtactcttttagagttaaagaatagtaaactggacaaaatatatgaaactttttttgaagtactgaacatcaggcagcacagtactgtgctccgcaagagaagagaaggagccagaatgagtcctgctttattcccaggttctccgtgacagcagtagagaggaatcccagagagagcagacattgtcattgcactgaggaaccagataaaaatcaaaaaaggttaagcagctggaatgtgtagtagaagagaacgtttacagaaaaaggaaccaataatcagcctaaggtttctcccaagtccctaagtcaaaggtacataggatgaaattctaaggagctcagcaaaagactctaccacggagttggaagaacacttccctggcatcacatg

SEQ ID NO: 21650 - DNA, 609 bp, Homo sapiens
caggcgcggtggctcacgcctgtaatcccggcactttgggaagctgaggtgggtggatcatgaggtcaggagatcgagaccagcctggccaacatagtgaaaccccgtctctgctaaaaatacaaaaattagctgggcatggtggcatgtgcctgtcatcccagctattcgggaagctgaggcaggagaatcgcttgaatccgggaggcggaggttgcagtgagtcgagatggcaccactgcactccagcctgggcaacagagcgagactccatctaaaaataaaaattaaaaaataatctagttacttcttttatcaaaaagaactcacaatgtatagacatgaacctcattaaaaattatgcccaatactttgggaagaatatttgtgcagcaattcataatgaaaaagcctgtcctggccaggcatggtggctcacgtctgtaatcctagaactttaggaggctgaggaaggcagatttcccgagctcaggagttcaagaccagcctgggcaacacggtgaaaccccgtctctactaaaaatacaaaaaattagccgggcgtggtggcatgcacctgtagtcccagctacttgggaggctgaggca

SEQ ID NO: 21651 - DNA, 533 bp, Homo sapiens
tgaagatcgaaacagctgagcaagttggcagaaaaggaagtgagtatgaaagctcaggtacagaaaaatacgagtgctcacttttatacaatgaaatagcaactaggtcaatggaaaaacgtggaaaattaccagagatgatatctatttctgtggaaaattgaaggcaatttgaccactttttcattattgtatttcacaactaggtattaccttcctaagtgactgttgagtatatatattttccttcaaccatttatatataaatgttcttgcttctgacttaattttgggggaaatgaaaggatatcatacataggaaggaagagaatgaggaattgggaggtgacgagaagaaacaagttgaacaggagtaggaagcaagtactgaaaagaattgaaaagaactgaaaagcgcaagagcaaatcattagtttacacattttgactttcccccagattcttggctctgtaggtcctaaggaagatctttttgttttcctggacaggatgatatgagggtgaagctcaag

SEQ ID NO: 21652 - DNA, 453 bp, Homo sapiens
aagttagaagactgagtaagaggtcgaaagggatgggagttatgtgtagggactgaaaacaggtttgggagagcttaatgtttgcttttatactatgactcttcatgttttctcttcaaccatcctaaagaagtctgataatggaaaggcactcgctctgcagtggccaggacaaactttgtacaaaatctgtcatatgatgaggagtaggaaatgaaagaaacggataggaaatattcaggaaaatggagtataagaagtgtgatccagttatgggagggcactggagaatttacaagcattacagtgggaagttttattccttagtggaattgcaagtaacatagtgccttaagaaatttgaatcatttagcttatgtacttaatctgagtcatttctgacaatgttatctaacttcctcttcccccaattcaatttaaaaaccacacatt

SEQ ID NO: 21653 - DNA, 649 bp, Homo sapiens
gaagcctcacaaaaggagcatcctgacacatatggtgacagtaccgtcctagcatggtctcaagagcgggagtggtaacccgcaaactttcagaccttcagtatcctgttggcatgaagaaggctgaccctgaggcaggatggatgggtcaggatgcttcagcccgatgttattaacattcaagtcattcaaatttcctgatcccatgctcaccaagcaacctcctgattattatctggctctgcacatagacttaattacaggaaagataatacactggccataaggacttgaataatctgaacaccatgacagttatttcatattgtggttgaatagacaggcagttggccacaatatatctccctacatagctgctgtctccaaggggagaatttgctgcttatgtgctgggtctcagggaaaagataatgactgtagcaggtaattgcactgctgcttactacgtggctggcactgtctaaatgccttacatgtactacttcatttaatttttatgaccatcctatgacgtcaataatcaggctgattttacagatggaggaaactcaaacacatagaagctgagtaacttgcccaagatcatctcagtctgttgggaaggaaactggagcccagagtccaggta

SEQ ID NO: 21654 - DNA, 543 bp, Homo sapiens
ccctgccccgccgccacacacacacatgcacacacacacagttttcttctcctacttctctctcgcttggttgaattaccccactgacagagagaaaaacaacattcactggcctccagggaaagtggtgtcgctgcgaatgaagggtggatagaggtggtgaaccagaagacatgctctgtgttggctgcaaaggctctggctctgtcatttccccagaatgtcccctgcagatgcctggcagtggaagatcagcagtgaagggcaggagagaggcagctatgcaccagctcttctttggagatactaccaaaggggaacatttgagatgcattcaggtctttttaaaggcatttttaaaccatatgttaaagaaccaaacaaagtggatatggatcgcttacgaagtaaagccagttcttgccttcgctttagaaaatgcttccctaggctcagagaaaccttttaaagtgcccactctgtggaccctccacttcatgtacaggatgtacaaaagaacagcacagcagagcagggcactga

SEQ ID NO: 21655 - DNA, 440 bp, Homo sapiens
gcttatcaaacgagacacagtgatgatgacatttttgaacacagattaattgtgccaccctctcttatttccttcctcattgagcatacaaatgagagaggtacaatttcaggtaactttgcaaaaaggaaagaaatagaatttctgagccgggcgccgtggctcatgcctgtaatcccagcactttgggaggccgaggtgggtggatcacctgagattgggagttcgagaccagcctgaccaacatggagaaaccccatctctactaaaaatacaaaattagccaggcatggttgtgcacgcctgtaatcctagctacttgggaggctgaggcaggagaattgcttgaacctgggaggcggaggttgtggtgagccgagatcgcaccattgcactccagcctgggcaacagagtgaaactctgtctcaaaaaaaaaaaa

SEQ ID NO: 21656 - DNA, 521 bp, Homo sapiens
aagcaggttgatgatagtaccttggtgggtggggatggtatatcttcatctagggggtaggaacaaagacataaaagtgcttagaggactgtttgagaggtaaagatattgtcaacttcatggaatctactgaagataacatagtttcaggagaacattggcaaatatagggtgacctttaagagagtgatgggagagggaaactgattgcagggggttaaggaactaataaagtaggctgggcgtggtggctcacccctgtaatcctagcaccttgggaggtcgaggtgggcagttcacgaggtcaagaggttgagaccatcctggccaacatgatgaaatcccatctctactaaaaatagaaaaattaactgggcatggtgtcggtcacctgtagtcccagctacttgggaggctgaggcaggagaatcacttgaacccgggaggcggaggtggaggttgcaatgagccaagattgcgccactgcactccagcctggcaacagagcgagactccatctc

SEQ ID NO: 21657 - DNA, 455 bp, Homo sapiens
ttttcaggaagcggtattgagctggaactggaaagttgggagcatcaacatgctgaatgggaggtgcgggtgttccagacacgtgggctgtacaggcagcgctggcggtgagtgaaagcgggtgcctgcctgagacgcccaaatgttaggtgtggccattgctgggattcaggtgggggcagtgagagagagggagagaaggtgactgtgggggacttggacaccagataaggagctcgagcttcatttggtagtaacggcggaagcatggagggcttttgagcagagacacgtgtgattggagctggcggtggtggttgggacagattgaaggaggggatcatggtaggcaggtatgaggtcactgttctaggctgggtgtggtggcttattcctgtaatcccagcactttgggaggctgaggcaggaggattactcgagcccaggagtttgag

SEQ ID NO: 21658 - DNA, 427 bp, Homo sapiens
ttctttgctattgtgaatagtgctgcagtgaacatgtgctgcagtgcatgtatctttataactgaatgatttatattcctctgggtatatacccagtaatgggattcctgggtcaaatggtagttctgcttctaggtttttgaacatcttgcaacctcaatctcttagtggttctatcccctctccctgaagatgtctgtgatgcacttcttaatcctgtgatccctcctggcattttatctgtagtataccctgttacaatcattcaacagctcacgtggaatgtcttctacctaccaaacatattaatagatgtggcttacactctaatgttcctacacaatgggcatctaaacaaataataacaataatgaaaacattctatattgccttttgatgtaaatagttatttatgcagatggctctc

SEQ ID NO: 21659 - DNA, 500 bp, Homo sapiens
gggcattatgggcaggggctatagcaggcaaaaacggcaggcctgtcttatacctatgagagctctgtcccagggaaatgcaatgctgcttctggcccaagttgtcaggctgaggtaggtggctgtgctggaggctcaagccaggaggccctgaccagtgaggagtagaaggggccatgaccaacattaaaaactatatgactgcttttccagaaggcagcttgccctgtgctggaggcccacaacagtcataacactcttcactccctcctgaccttgaaggcagttgggtagtggctggagctgcaatagcagcaaaaacagcagatatgtctattgcatctgggagcttcatcccagagaaatgcagagctgctgccagttgaagaggtcaaatgggtgtttcatggctgttctggagttccaggtcagtgtgccttgcctggagaggttaaccagaggcaaggcatgaagtccctctgctcctcagaaccatgaat

SEQ ID NO: 21660 - DNA, 435 bp, Homo sapiens
tatgacagctacagcattcagggtgtgagtaaagagaccgacatgatggtcaggtttctaatggaagcgcaatgtgaaaagttaaacatgactctttatattgggtagaataagaggatcctggtccttaggcagactccaggagttttaacatcccatctaagaatccaagtactgctgtagcaagcgatggtcttcaggagacccctcccatcctggctccagggcactcactttgcattctctccttagctccctgtcctccaactgtttttagctctatgtggaaaatccaccaaatgatctcgtttttgtttaccactcaacctcagcttttggtgcatccgtggtttgaggtcccctcccctgcctctttcccttcatggtcctctgcccccacagacctccatctcctcatcatgttgctctgtcccc

SEQ ID NO: 21661 - DNA, 593 bp, Homo sapiens
ttgaactcctgaccttgtgatccgcccacctcggcctcccaaagtgctgggattacaggtgtgagccaccgcacccagcctgccaattattacttctaaaattcttcctaaagggtggccaaattagttttcactgacttctgtttaaaaattcaataagactctgaactaaagactttgagtgaagagaaatgatacattgtacatttaaaacctgtgtcttttagacatacagccaaaaagcatatgaaaaagtgctcagtatcactaatcattagagaaatgaaaattggaaccacaatgaaataccatctcacacaagtcagaatggctattatatgaaaaagtcaaaaaacatgctggtgaggttttggagaaaagagaatgcttatacactgctggtgggagtgtaaattagttcagccattgtggaaagcaatgtggcgatttctgaaagaacttgaaacagaattaccattcaacccagcaatcccattattggctgtatacccaaagggatataaattgttctgctctaaagatacatacacacgtatgttcatcacaacactattcacaatagaaaagacata

SEQ ID NO: 21662 - DNA, 605 bp, Homo sapiens
  misc_feature 499: n = A,T,C or G
tacggggcacccttggctgccttctgtctctatcactagatcttttgggccctttgttaaaaggcaattattttaggtactacctatctccacaaactctcaagcagagtttggcaggtattgaaaacgttcagactaaatcttttggttggctaagaaatagttatacagtacagagcctgtagattgcaagggttgatgggtagaatctgaagatctttgaactgggtaggaaaaattatatttttattttcattaacctctaacccaaatgaatcattccttcaattatgcatgtaggtaataaaacaatattaaccacattcatgactatgttatcaatacgaatcacaaatgttgttatattatgttatttattatagctatctctaaaaatcatatttatcaccactttgatatcataatgttcacttggcttgcctctagatcttgttatttcatgcatgagtaaagaagcgtatatattattatgtcacanatctttttttaaaaatattttgaggctgggtgttgtggctcatgcctgtaatccctggactttgggagactgaggcagacagatcacttgaagccaaaagttggag

SEQ ID NO: 21663 - DNA, 110 bp, Homo sapiens
gatggataatacagatgctaataaagataatctgtcttttcagggaagacatattcaggtgggagagaaataactaacctcagatgtgaaatggggatatagcagatgct

SEQ ID NO: 21664 - DNA, 400 bp, Homo sapiens
tgcaggctggtcttaaaattctgacctcaggtgatccaccctcctcggcctctaaaagtgttgggattacaggcatgggccaccatgaccggtctaatttttaagtaataatgtttctctgatataagctcccatatttggctaagtataagactaaatttttttaaagttatctcaaatagattcgaccattttatttcaccccaaaatggcatgtaaaatcctcacaatttacagtttaatagaaaaatatatgtactgtacagattatatctagaaaagcgattatcagtgcctcagtttcatctgtaaaatagagatgctaaaagcacatagcacacagagttatggaaagaattacgttacctatgtaaagtgctttgaagagtgcctgtcacat

SEQ ID NO: 21665 - DNA, 564 bp, Homo sapiens
aaatgatatgttttcttaccctctggactcccactccttcaccccacgtctggttggttttcagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggtaagcgctaccaacatttaccgatagaagttggcttaaacaaataatctctctcctgggaaggtctctaaatctcactttcctcatagaggaaatctgggctcttctagcttcagattattacacaccattaactctgataaaaagctgtcactttactcttgaatttgttcttaacagtaaaggacttggccaggcctggtggctcacacctttaatcctagtgctttggaagactgaggcaggtggatcacctgaggtcaggagtttgagaccaggctggccaacatggcaaaacccagtctctactaaaaatacaaaaattagctgg

SEQ ID NO: 21666 - DNA, 505 bp, Homo sapiens
tctttcttaactccatccctcccagtccttccctcccagtccttccagttcttgggcctcccagaacaggtcggtcttccttctctgctgaagacaggagactgccctcttccctggacagggctgaacaagccccaccccctcttggtcatggccaaggtcactccccacccactgggcctcccgctctgtagtgtggctgtgtgtctctaagagcccagaacagaacagtgttctagtctggcctggccagggtggaaggagggaggaggtggtacagtgatcacctccttcaatataccattgattcctccattaatacagcctgtgcagcaaccagaagctgggggcaaggtgtccctctgtgtctggtacagtgaatcaccttgctctgcagaagcagaggatagctggctgatagaaagcacggtgccaggggagcctgagaggccaaagctaagcaggccagggccgggcgcagtggcttatgcctgtaatcccagca

SEQ ID NO: 21667 - DNA, 162 bp, Homo sapiens
atttggtggtttaataattagaaagtaaattactaaattaataaaagaaactatcttggctggttatatgggcttttgccagtaatcccaacccttttttttttttttgaaaaggaatttttcttttgcacccaaggtggagggcaagggaaaaattttggg

SEQ ID NO: 21668 - DNA, 584 bp, Homo sapiens
gaactcctaacctcaagtgatccgccctccttggcttcccaaaatgccagcattacaggcatgagccaccgcacgcagcctcaaaagtgtgattttttaaagagcaaataaaatacatcaaaattaacttatatctgaaaaaaagaaacttaatagaccagtactttgatatgtgattcaactagagctttcataaaaaactttaggctccctaaaacggctctttattggattagtacaattggctgaatttttgtttaagggtaaaatttgcccaagaatgtagggctttaaaatttatttgccggcggggtgtggaggctcacgcctataatcccaacactttgggaggccgaggtgggcggatcacgaggtcaggagatcgagagcatcctggctatggtgaaaccccgtctctactaaaaatacaaaaaattggccgggcgcggtggtgggcgcctgtagtcccagctactccggacgctgaggcaggagaatgacgtgaacccgggaggcggagcttgcagtgagctgagatctcaccactgtactccagcctgggcgacagagcgagactccgtctc

SEQ ID NO: 21669 - DNA, 572 bp, Homo sapiens
agatgacttctggtaagtagattctagcacttcttgacactttagtggaaaagcttttggaataattatttattattattcatttacatttttagagacaacctcactctattgcacaggatggagtgcagtgatactgtcatagctcactgtagtcacgaactcctggattcaagtgatcctcctgcctcagccttctgagtaactaaaactacgggcatgcaccaccatgcctgactaattttgtaattttttgtagagatgaggtctcactatgttgcccaggctggtctcaaactcctggcctcaagctatcctcccgctgtgtcttcccaatgtgctgggattacaggtgtgagaaaccaggctcgccctggagtaattttattagcatttctcacctgcctatttttgtatgtagataaaagttgcatatatgttgttttgaaagaaaaccagataaaatttaaggatgaacatggctttaaaagtccagggatactataggacttttaacaaaaaaattgactgcccttggttcagtgtttcccactcactccctattccctgga

SEQ ID NO: 21670 - DNA, 598 bp, Homo sapiens
ggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttctgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggtgagggggcatcaatggca

SEQ ID NO: 21671 - DNA, 529 bp, Homo sapiens
gaacatcacacaccggggactgttgtggcgtggggggagcggggagggatagcgttaggagatatacctaatgctaaatgacgagttaatgggtgcagcacaccaacatggcacatgtatacatatgtaacaaacctgcacgttgtgcacatgtaccctaaaacttaaagtataataataataaaatttaaaaaaagaataactttccattttatcaattgaaattaatagaagtaaaagtttaaatagtgttgactacaaatattagtatatagatgtatgtatttgatgtaaaaacatagttttggagattattctcttcaaatgatttagtatatttcagaaagataagaggatgataaatttcaaccaaaaataataacactgagcttttaaaagtatacttgaaaaaaaagtacagttgcatagatttgaagaggaaatatagagcagtatgttatctaaaaagttcagaaaatgggtcgggtgtggtggctcacgcctgtaattccagcactttgggaggctg

SEQ ID NO: 21672 - DNA, 547 bp, Homo sapiens
tggagcccagctgaccctgcacggccacatctgtgcctctgtggacctagcatatgcgttccaagctgtcagctctgtggctttttagcctcatttagatagaaaggattaggggggaagaatataagtgatgatgcccttccccgaagacagctcatcctgggaccagctgcctcgggcatcactccggtggtgccgcctgcagatttgcatgtgctcttcctgtgaaagagagacgggggtgacaaggggaagtggtaaattgctgatgattggtgaattgagtttttctctctggcgggatacagagcatgttgaagaagccctgaacctgtcagaaatgctggattttaatcttgtaggacctcaggcaagccaccaaaccacttcaggcccccatctgatgggggacagtactcatctcatagcagtacccagagggctaagtaacagtgtctgcagcaataccaagcacatagtagggacttcatgtacacgagttgactctaaaacataggcacggtagctcatgcctgtaatctcagca

SEQ ID NO: 21673 - DNA, 615 bp, Homo sapiens
ttgggttagagagcttttggcaacacaaaccatgctacttctgagtctctgaatgttgggattggaagtgtatggaaaacttgagtaagttcctggctctgccactaaatagatgagtgaacttgaacaacttatttaaactctctgagctcctgtttacttatctgtaaaatgaagatatttagagttaaaaacctaggatatttagacttaaatttagacttaaattggctgctgctttggtttcttgaaagaaatactttggtccttggcctccaaagcctctgcttagctgctttaccgattctatgtggtatgtcctcctttttaggttctttgttgctgttttaagagaaaatttccaactaaatgcttgtttctttacagataaaaataaaccgtatgttgactaagatcccacttggccaggcgcagtggctcatgcctgtactcccagcactttgggaggccgaggcagatgaatcacctgaggtcaggagttcgagaccggcctggccaacatggtgaaaccccatctctactaaaaatacaagaattagccaggtgtggtggctgacgcctataaccccagctacttgggaggctgaggcagga

SEQ ID NO: 21674 - DNA, 467 bp, Homo sapiens
gtggaggcctacttttcctgacacgttctttatacccctgggcctgtgggctcttccttacgactaaaatccctggacacctctcttctggagaactgacactcatctttcaagacctagctcactcccccactctctgtaggcctatgcagaggactagcttggatgaagccggtacccagcctcccggcacacatgcacagtgctgctgttttccttccacacctccctccttgcggtacaggacctgcttggttctgcctgcccaggagactctgagctcctttaggacatcttactcatctctctttctctcatgtgttgtacgaacacttgctccatattcagccaggcttcgtgtgtcttgacagagctaaagaccaatgggcaggatgaggtgcagtggctcatgcctgtatgtaatccctgtactttgggagactgagaagggaggattctcttgagcc

SEQ ID NO: 21675 - DNA, 85 bp, Homo sapiens
gaaagcaacgtggcacttctgtgggccccactctggtgactccacagagccgtgtagccctaagggcagagacaggctggaaatg

SEQ ID NO: 21676 - DNA, 533 bp, Homo sapiens
gaaggaggggagagagatggacaaaaggcatgagagagaggaaaacagacacacatggatgcaaagaacctgaaagagacagagatggagagagatcaggcaggctggggtagggaaggggcactagccctctttgggccccgccattccccttgtctgtagagagaatggctgtgctgtaatgcagcagggtgcagactgcattgcagcacggccagactgcaagatcgaagagccccctgtgatctgacgtgattcgccccaggaggggctcaggtgcctgcagtatgaggtcaaaatgaaaaggcctcgaggtcagcactgctccacagaacttcgtgtgtcaatggaaatgttctttatgtgcgctgtccaacacagcagcctttggccatgtgtggcccctggccactggaggtgtagctaacgggactgaggaactgtgttattaatttgatgagtaaattaaatccatctgtgggctgccatgcgtggctgctggtggctgtgccgggcggcaccatttaaggcac

SEQ ID NO: 21677 - DNA, 582 bp, Homo sapiens
gaactttttaaagttactgacgacttggtctcacattcagagattctggttcaatgggtctgggcgggtctgggcattagtatttcttaagagcccgccaggtggttctaatgtgcagctgggttgaaatccgaactttgtagttcttgggacttctttacaacctaaccgagtggccagtcttccggaaccagaggagcgcgtcactccgcagattctcccaagtggatcaacttgggatcacttcagctcctgcatagatgacaagactatgaaagtagaaactaggccttgcgcggtggctcacgcctgtaatcccagcactttgggaggctgaagtgggcggatcacctgaggtcaggagttcgagaccagcctggccaacatggtgaaaccccatctctactaaaaacaaaaattagccgggcgtagtggcgggtgcctgtaattccagctacttgggaggctgaggcaggagaattgcttgaacccaggaggcagaagttgcagtgagccaagattgcactactgcactccagcctgggcaacacagaaagactccatctcaaaaaaaaaaaaaaa

SEQ ID NO: 21678 - DNA, 607 bp, Homo sapiens
cacttttatgggtgacagtttttagcataacctttgataaaatacactcaagtgacttggacttagatgcttatccctacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtc

SEQ ID NO: 21679 - DNA, 566 bp, Homo sapiens
gggaatcacttgaatccagaaggcagaggttgcagtgaactgagattgcactactgcactccagcctgggcaacagagtgagactccatctcaaaaataaataaataaaaggaatttggcataaaatcactaatgttgactgtttcagcctgggtgacagagcgagactctgtctcaaaaacaaaacaaacaaacaaacaaacctgagctccatgtctgtttcacctgttcccctctaagtataaatttcctgagccttctaagttccagccaggtgggccggaggtcaccgagatctctcctcactgggggacggaataggcctctccctgctttgctgctgttctttggccttgtcccctgcctcctttcctggaccacctacaaggacctagagggaacagtactgggggcaggagctgggaaaggcctgctgtggttcactgctagtaagaaatagagactcactcagagaaatttcctgaaacacagcagactcttggcgcagccctttgagcagatgaaggaggacaagaagaagaacatccctcagctccagctgcatg

SEQ ID NO: 21680 - DNA, 531 bp, Homo sapiens
attctcctgcctcggcctcccgagtagctgggattacagacatgcaccaccatgcctggctaattttgtatttttagtagaggcaggttttctccatgttggtcaggctggtctcaaactcccaacctcaggtgatccgcccgcctcagcctcccaaagtgcggggattacaggcgtgagccaccatgcccagctagaactttattcctttttatgactgaataatataaattccaatctttgaggatctggaaaagggagaagaatcaggaaaaggcaagtgacaatcaaagagataaggagaaaatcaggagcaaggaatgccctgaaagcgaattgatgaaatgtttgagaagaatagggtatccaccacatgtcccagtgctgcataaaggtcatacagaatgagaagaaaataaaaagccaccaatttctagaattgaagggtaaccataggtggaaatggctgtgaggtagagtctactctcaagtgcttgataagaagccaaggaatagttggccgggcgccgt

SEQ ID NO: 21681 - DNA, 471 bp, Homo sapiens
tcctcgagcgtctttgtgatcctaggcctggcctcggagtcctcacgcagccctgtgggtctccctttatagaggggactgaagctcaggcaggggcggggatacgtcacctaagtcacacaccgagcaggtggccaagccagagctcctgggtcacactgccccctcctgcctcctggctcactaccagcactccccggcttgggtcccagggaacgtggaggggagagaggaacctgcaggctcctagagcctcagggttttgttgacactgcgattgccaccaacaccacaaaagccagctcagctcagtcacttctgtgtgtgtccacacctccctcgagcccgtctggtgggccaggcactgttagtgttcagtgttctggggccgggggtgcagctgtggtcaatgtcaaccaaactccccaccctcatggggctcagataggatggtagaggcagacggcaaac

SEQ ID NO: 21682 - DNA, 519 bp, Homo sapiens
ctaccactgtgtaagttgagggttgcagagctggtggccacggggaagagccagtgctatagctgaagtttgagggaactggagacccagggagtaccggtgctgctttctagttggagggttgtggagctggaggcttggtggggagccggtgccgcctcccaagtctgagagtcattgagctggagatccacaggggagctggtgctgctgttgtagtttgaggattgtggagctggagacccggggcggagctggtgctgcagttggagtttgagggtcagggagctggggatctggggagcggccagtacagctgtttaagcctgagggtcgtggagctaaacatggagccaaagttggggaagtagagagagagagttacaggatgaccctggaaatggtagacgtagctgtaccccaagcaagctaagcttgggaactcctcaatgctagtgatgaatgcattctttttcctcttacacagtttggatttgttttctgtgtctcatgagacag

SEQ ID NO: 21683 - DNA, 605 bp, Homo sapiens
atgggtatatacacaaaggaaaggaaatcagtacgttgaagagatatacactctcctatgcttattgcagcactattcacaatagccaagatatgaaaccaaactcagtgtccattaagggatgaatggataaagaaaatgtggtatattagtggttactagaggcgaggaagagtaggggtgggatagagagaggttggttaacagatacaaaagtatagctagataggagaaataagttctagtgtgctactgcactgtagggtgactataattaacaacactttattttatattttcaaatagctagaagacaggattttgaatgtttccaacacaaagaaatgataaatgtttgaggtggtggagaaattaattacactgatttgatcattacacactgtacacatgtattgaaacatcacttgtaccccagaaatatgtatcattattgtgtgtcaatttaaaaagtttatatacagaagaagaaaaaagaatgaattgagcctccactgctgataggagttaaaatcaatccaacctggatggcagtttgctaatacagatgaagattccaacagtgcaattttattcttgggaattta

SEQ ID NO: 21684 - DNA, 424 bp, Homo sapiens
cacgcaggcaccttcccaggggcagggttcccttagatactttggttctcattgaagaggctgactcggaaaatcaatgcagtcaccacgcctcattcaggaccatatacaacgggccctgactgtgttatttttattaccttagccataaattgcattttccccttattttattatcaaatttttcaaaggagctcagtaccggttaaattgacggataatttgtgccctccctactgggttactttataatctagaaaatgctcacctagtctgcttttctcagttgttaaatgagatcagtgtgcctactttatctcagcatcttggaaattatttcagaagggtgcttccagggaggcagtaggcaagattaaaatatcattcaggccgggtggggtggctcacacctgtaatcccagca

SEQ ID NO: 21685 - DNA, 467 bp, Homo sapiens
tgttttgggaaacagtttcagtagagtagtgtataatagggagaatatgagatgaaaaagttctgaagaatgagtgtgatgttggaggtgttatgtgctataagatgctcttggagatagactggaaaagtttggaatttaagataggtggagaggagagaaccagacttagcaataccacaatgagttgggaaaggatgagaaggtggaagatggtgtagaatgaggaaaatggtgggaaggttaattttatgtgacaacttgactgggctaagggatacctaggtagctggttaaacattatttctgcgtatgtgtctctgagactgtttctggaagagattagcatttgaatcagtaaatttagtaaagaatatctacccttgggccgggcgcggtggctcacgcctgtaatctcagacctttgggaggccgaggcaggcggatcacgaggtcaggagatcgag

SEQ ID NO: 21686 - DNA, 437 bp, Homo sapiens
  misc_feature 7, 8: n = A,T,C or G
tccggcnngtgactctgttttctgtggtagtggtagtggggagtgctccaagaactccttgagcctcattagtccctcgttcttatctgagaaggttcctattgcttggtgtattagtccgttttcatgctgctataaagatactacctgaattgggtaatttataaagaaaggaggtttgggccaggcatggtggctcatgcctgtaacccagcactttgggaggctgaggtgggtggatcacctgcagtcaggattttgagaccagcctggccaacatggtgaaaccccgtctctactaaaaatacaaaaattagccgggcatggtggcacgtgcctgtagtcccagctatttgggaggctgagacaggagaatcgcttgaacccgggaggcggaggttgcagtgagccaagatcgtgccactgcactctactct

SEQ ID NO: 21687 - DNA, 128 bp, Homo sapiens
tatgtgctaggtcggctcttaagaaatatactttaagcctaacggcctcaaaaaaaaattgtattatcaaacatagagtgtgaaaataacactgaaataattttaaactaaaaggctaggccgggtgc

SEQ ID NO: 21688 - DNA, 548 bp, Homo sapiens
agtaggctgtcatggcccctcacagtcaacattctccccaaatatatatatttgcacatatatatctatgtaacccatatatatatatatatatatccatgtagccatatatatgcacaaaatgaatatatatatttatgtaatccatatatgtatatttatgtaatccatatatatccatgtaattattgatgtattactgttaagcatctcagtaggctgtcatggcccctcacagtcaacattctccccaaatatatatatctgcacatatatatttatgtaatccatatatatatccatgtagccatatatatgtatgcaccaaatttgtaaaattattgagctatacatttacatatgtattttacaccttaatacaaatttaaaaatttgagtcagtggaaattactggaggaactgggaaagcagtcttttcattcctcttgtattttgtgtttttgtgcatatgtgccataataaaatcactgagctctagttgaaaagaactggatttaaaacatagctaagtttactagcagtgagag

SEQ ID NO: 21689 - DNA, 111 bp, Homo sapiens
gccgaactggaaatgtgcttaagctgaaagttaactttcttcctgagattatcacactatccaaagaagtccggaacctcaaatggcttggtttccgcgtcctactggcga

SEQ ID NO: 21690 - DNA, 463 bp, Homo sapiens
actttataaaaaccaatatttccccaatgtaattgctctcagactatgtttaactctgaggaatgcacttgtggatgcctgctttagaaagatgaggaggtaggccgggcgcagtggctcacacctctaatcccagcactctgggaggccgagacaggtggatcacctgaggtcaggagttcaagaacatcctggccaacatggtgaaaccccgtctctactaaaaatacaaaaattagctgggcatagtgacaggcgcctgtaattctggctactcgggaggttgaggcaggagaattgcttgaactcgggaggtggaggttgcggtgagccgagatcataccattgcactccatcctgagcgacagagtgagactctgtctcaaaaaaaaagaaaggaagaaagaaagagagagagagagaaaataaaagaaagaaagacaggcagacagacagaaagaaa

SEQ ID NO: 21691 - DNA, 554 bp, Homo sapiens
acaggaaaactatgacctgaattctttgaatcggccaccttatctgcctggttttgaaacggaaacatctttgatctggagtctgggtttgaatgctatgggtgttaaacataaaaaactgaagtccaaggacagcaagggttatcgtaatatctaggtaggtgggacaggcttaattgctttgtattcgtccataaaaattcctttcctgcttgagagggcattgctggtaaattattctgtctcttcctcacttattctcacattccagtttatttcctaagtcataaaaataatacattaaatcctcacataaaccccaaaaggtagatattatttttgtccccattttagagataaaaaattgaaaacaaggccaggtatggtggctcgtgcccgtaatccagcactttgggagtctgaggcagttggatcacttgagatcaggagtttgagaccagcttggccaacatggtgaaacccaatctctactgaaaaaaaaatacaaaaattagctaggtatggtggcaggtgcctgtaattccagctagtcg

SEQ ID NO: 21692 - DNA, 575 bp, Homo sapiens
gggggggtataattcagtccacagcatagggtctgtttcccagtctcagcctttggggcagtatcttcaatttccaatcacatgatgtgaattgacaaccaagaccacaagttatgacttaaactccacaaagtttccctcttacattccattactagaaacaaggaagcattttaaaaactattaccctagtttttttgcagtcctcttaaaatacttcaccagatagtagatagcagcattcttttgtattttgaagtttctgcagcatggtcttttaaagaaaaagagcttcaggccaggcgcagtggctcatgcctgtaatcccagcactttgggagaccaaggcgggcagatcacctgaggtcaggagttcgagaccagcctggccaatatggtgaaaccccatctctactgaaaatacaaaaaaaaattagcaggtgggccaggtgcggtggctcactcctgtaatcccagcactttaggaggctaaggcaggcagatcatgaggtcaggagtttgagaccagcctggccatcatagtgaaactccatctctactaaaaatacaaaaaa

SEQ ID NO: 21693 - DNA, 594 bp, Homo sapiens
gggcatggtggcttacgcctgcaatcccagcactttgggaggccaaggaaggcagatcacttgaggtcaggagttctagaccagcctggacaacatggtgaaaccccatctctactaaaagaaaaaaaatatataaaaattacctgggcatggtggcatgcacctgtaatcccagctacttgggaggctgaggcaggagaatcacttgaatccaggaggtggatgttgcagtgagccgagattgtgacactgcacttcagcctgggcaacagagtgagactccttctcaaaaaagaaaataaaaattaaaaataaacaagaaaatgatccctgatatttaacgttgaatagaaagagggaccctttatttcaactacctttatacaagctcattcaaaatggataatttttaaaggaaccagcagcctcaaaaacattatgctggccaggcgcggtggctcacgcctgtaatcccagcactttgggaggtcaaggcgggcggatcacgagatcagaagattgagaatcatcctggctaatacggtgaaaccccgtctctactaaaaaatacaaaaaattagccgggcatggtgg

SEQ ID NO: 21694 - DNA, 611 bp, Homo sapiens
cataaccacttaaatacgcatatacacatgcacaacctgtttactcccaaacattcttgtagtcacatgtaattcatcataacttgggacaatttgtaacttatgaaaggcttgccacctgagccttagctcatgtgattatcaaggattgtctgtctcatcatgtgtactttccaaatgatgagatagataatctaattattactatccagttcttaaaggcaatacgactgaactcagtgcaactgagagactcccaaagacacacagtgagtagttggcagtgtccgatttaaatccaattccaaacaaattcttctccactctgccacatatgtacccatgacatgtaaacacttgtatctcctacgcagcaagttgaagttctttagcttcccaaaagaatgcttggaatcagcccatcaggtgggagtagctatgaatgaagctgagagtcaaatagagagtcacccccctccaccttcaagcagacacacacagctgagactcagttcacccttcttaacccccagtctttatctgggacattctttcctcccaggtcaccatctcccgattcctctcccctaaccaaccccaacccacacact

SEQ ID NO: 21695 - DNA, 566 bp, Homo sapiens
tgtggcccaattcttaacaggccacagaccactttaggtccacagcccaggaacttgggacccctgttatatagcacttaggacaatgcctctgagcagtgcttctaacctacaatgtttcccttctgggggatacatttaaatactgtctaaattcaagtcacttctgaaaaggagattattttgagattaaatttaatccctttttcaagcacataaaatttccataaaatgtaatttagctggtaatgagctgccaatctcactggtctgaaaatcttttgccctttaaatacatagaagctttaagatttatttcacatacgtctttataagagtaaaataaactactatttttaagcagtagtatctttcgcattaagcaatgagtgattcaaaaagaactaatttcaactgattatcccaattagtaaattaaacttgtcaaggatcatgaccaatatgtaaaaaagatgatcacattaaattcttatgggtgaatcaccaacacaacttggctggccttattactgagctccaggtaataaagcagactgcagaccaca

SEQ ID NO: 21696 - DNA, 604 bp, Homo sapiens
cttaagagccataacactcaccgcgaaggtctgcagcttcactcctgagccagcgagaccatgaacccaccagaaggaagaaactccgaacacatctgaacatcagaaggggcagactccagacgcgctaccttaagagctgtaacactcactgcaaaggtctgcagcttcactcttgagccagcgagaccacgaacccaccagaaggaagaaactccgaacacatctgaacatcagaagggacagactccagaagcgccaccttaagggctataacactcaccgtgagggtccgcagcttcattcttgaagtcagtgagaccaagaacccaccaattccggacacactatgaactgagctaaataagtactttacatacattatttcagttaatcttcaaatgaaccagatcggagaagtagaatcctccttaaacagctaacaaagctgagcacagagaaattcaatcatttgttaggaggcacacagatagttctttgttggattccaaagccaatgatattaactacaagttatactttttccctatttcaggaaatgaagagaacctaatgaagtcacactaaaacaatctttgatatt

SEQ ID NO: 21697 - DNA, 463 bp, Homo sapiens
aactgcttaactagagcaagaaggaaaattatccaagccccaaacctgggaaacatcaatgcctacgaaatgaactgaagaggaagaaacaatagaggcacaagaggaaggaccaacagaagtaatggaagatacaagtggaagatgacatggatacacacaatgttctactgagtctatggatgacctgttgagcagatcatccatacttctctaggggttctgaaagacactctcctcttgttgggaagacaaaaagccccactctgctactaggtgcctgagtctaggtgcttctcctccctgtcctttcactcccagctctgtcttctctacctgtccctagaaggttcctgtctttgtcacctcagatattcaagattcagctccaagatgccctctgtcttcgaagcatcagagctttgctgaccctcccgcattagttttccctgcctcatcaatg

SEQ ID NO: 21698 - DNA, 616 bp, Homo sapiens
  misc_feature 454: n = A,T,C or G
aaggtggacactcaactagaggtttacatcaggccacatgttgacacctagtcccaggtggacatcaggccccagctagatacctaggcttccagtgaatttcagaacccaggttgacattcaggcccccagtggtcatctggcctcatgcgaacactcagacccaaggtgcaaatgatgtctcaactggataccaaacccccagtttgatacccaaggcccaggtggacaccaggtccaaggctgacactcaagccctaagtgaataccaaactctaggtgaataattcaacccaggtggtcattaggacccagctggataccagtccccaggttaacacaaggcccccagtgggcacctaggcaccagctggacatcaggccctatgtaaacacccgggtctcaggtgaacaccatgccccaggtggacatcaggccctaggtggatacggngccacaggtggacatctagccgctgggcaacatccagccccaggtggacataaccgtttccatggataaaccattcccaggtggatagcaggcctcaagaggatcgcagtcaccaggtagacatcaggcctcagatagacaccaagttcccagatgtacagc

SEQ ID NO: 21699 - DNA, 581 bp, Homo sapiens
aaaattaattagagaagacatgagatctatcaaaaagctgatcagggtggctcacgcctgtaatcccagcactttgggaggccgaggcaggtagatcacctgaggtcagcagttcgagaccagcctgaccaacaaggtgaaatcctgtctctactaaacacatgaaaaaaaagttagccgggcatggtggcagtttcctgtagtcccagctactccagaggctgagacaggagaattgcttgaacctgggaggcggaggttgcagtgagctgagatcgcgccagtgcactccagcttaggtggcggagtgagacttcgtctcaaaaacaaaacaaacaaaaaaaactgatcacctcaggagagcagcagagagaagagtccagatgggagctggtcagtttcaggagagtgcacagagcaggacctcgtgggactggcctagagctcctcaaactaacgtcagttcagcgggtgcaactagcattttaaaacattaatcacagagttgagtagaaaatatcaaaaggtatcagtattattttgtgaaactttatattcatatatatggggggtgtgtgtct

SEQ ID NO: 21700 - DNA, 151 bp, Homo sapiens
aaaaaataaataaaagaaaataaagtaaaataaaaaataaaaatctctctttccctcaaaggaaggagatctgtcctatgtgaaaggacagtaaagattccatctcacctgggcttgataaaaggccacttctgaaatcttgtacagatgt

SEQ ID NO: 21701 - DNA, 455 bp, Homo sapiens
tatatttatggtgtcacatgaagttttgatattaaattcttgttttcattgctagtacttcatgaccatgatcgtttcccttgctgcggttgcttgggtgggacaacaagtccacaacctgcttctcacctacctgataggtaagtctttgaggaaaaactacaggcacatcctggccagtgaaatttaactgtaacttcgtcagtaaacagctgaatacttcctaagttttagacaccgaaaaggaactgtgggaatatggaaagattattatggtctcatagaaagtgaaaacaatgcaataaccaaggtagaaagtaatgtgcaagaggtaaaaataagcaatgattattttctgaggtggaagaggggatgcgagcagaagtttctggggatacatcccagtggaagtaattgatttcatgttgcttcctcccattactgagtttaataat

SEQ ID NO: 21702 - DNA, 607 bp, Homo sapiens
tccacatagtacagcttagtgccaacagaaattgccttgaccactatatccccccataggggaaaagagcaggaggattcctacagtctttgctgctaaagatccccagtctttaccaacacaaatcccagctgacagagatgcctggagcccatgccttacatcccctggagctggagggggccactctggcaccctgcacccggtacggcttcacatgagcccacacctgggagtgatgtcacttgtcttacacctgcaccaggacctggcacccccatgcaccatgacagtgtcacacaatccccaaaaccagtgcccctgcacattcctcacaacttgcactggacccagaactaccacacagcccacccatcatcacacctcaggtgattatttaagaaccaccacacaccccacccatcatcacacctcaggtatcatcacatctcaggtgaaagtcttccccaccaaagccagtctgtaatatctgaaagatgtaactgctccttcaaatgctcagacaccaatgcaaggctacaaggaacatgaaatgtcagggaaacataacaccactaaaggaatatgataatttccagtaatgatc

SEQ ID NO: 21703 - DNA, 487 bp, Homo sapiens
gtttgtccttgggttttgtttttgctgaatctttccttcatattacctgcttcttggtccctgaaggtagatgtctgcccaagatagagccatctgttttaatttctccccttgccttttcctcttcctattacatttgctggcttacgtatcaaatcaggcttgtgttcctagtctctaaatagaagtgcctcctcaaactactctataaatcattattattaataacaaggataataatgataatactaaatagcactcatgtaaaatcttccattacaaaatgctttcagaaatagtacctctgggctgctggtttatataggaaacacaaaaactgattaaaaaagatgacttttctagccaaaatgtgtttgcttttctgggttaaattcatttgtttgattgaaaattttataaagaaggtgtgtattggagaggtctgggattgtggaaagaagcagagtgctgaacccatcaataactc

SEQ ID NO: 21704 - DNA, 496 bp, Homo sapiens
tttcctgcacatcttatctaaaatataactatccactctttcactgtgtatacttaacatggctttattttgcttataccatttatgaatgtgtgtgtgtgtgcatgtgtgtgcgtgcgtgtcatgtgtgagacagagacagaaagaaagaggtagttaattttctgcttctctgtgtaaacaataagggcagagacttatgccttattcaccatgtttatatgaatatttcattaaggctcacaaaaaacaacatgcactattttgttattctcattttacagaggcgaaaacttaagcatagaaaaattaaggaactgtctaggcgcagtggctcacacctgtaattccagtactttgggaggctgaggcaggcagatcacttgaggtcaggagtttgagatcagcctggccaatatggtgaatttccatctctacaaaaaaatacaaaaattagctgggtgtggtggtgcatgcctgtaatcccagctattca

SEQ ID NO: 21705 - DNA, 520 bp, Homo sapiens
gtggtaagtaagaaacaactgactatcagcaatttcataaggttcttaaccttatagaagaaaatgcagagaaaaggtttggcttccttcaaaggttgtaagtacataaaacctggtgccaagtttccccttgtgggaggaacagtgtttagcaaaatacctcgatatttgccttggtttgaaaggtgaggctccatgaaccagagtgaaacagtcatgtgagaaaagtaacaggaagtgggaaaggaggagtgggtggtgagcaggaaatagggagtagatagggaagaatgggagaggagggcacacaatgtcagcatcaaggcagtaggctgggtgctgctggaagtgaggagttccctaagacaggaatgatggaggaattgcagaaaacagtgatgtccaatattggattttaagttcctcaaacctccggtggcaaatctgctacatcaaccctgcgttgtgattgcactttggtggcacaggcatggggtggtgaggatgtgaggtgacacat

SEQ ID NO: 21706 - DNA, 572 bp, Homo sapiens
ggtgctcagaagctctggcaccaagggaagcaccagggttggatgccgacttcccagaaacttcaagcacctgaaacaaacaaataagaatgcacatcaacaaattagtaaagttagtcctttgaaaagtactaggaactggaatcagaaaacctgaactggaattggaaattctcaaccatatacttttgctaactctatgacttcagataagtcacccagttattctggaactcggttaattcatctaaaaaaactggttattataaagataaaagaactggttatttaaccaagagccatttcccccatctttcttcctgagagagccctgattttactcaggtatcaggcaggcagcaaagtgctcggaaaaggcaggtccagcccaagagctgaaccactattggtctaaacccatcatggcaatcccattcccattttccagtgactggtttgctggtgggcaagtaagccagttctagacaacggagcacgagagtatgctggctggggagcttctcagggatgtttttgcaaatcaaaagagcaatgcatgaaagggaatgacc

SEQ ID NO: 21707 - DNA, 372 bp, Homo sapiens
aatggttctccgctaagggcaattgtgcatcacaagggacatttgacagtatctagacacaaacaactagagcatcagagcccctttgctgtacccacagtcttgtatttacagtctatacttccattctttcaggaggtttactcccagaactggtgatataaagaaggaaagtagcagtatgagcactttgagggctaagcaatgggataatatctttctaagggaacagttaaatcaacttcatttggtcttccatggacatgagtttcaagtggctttctggcctttcttctgttggcctctttgctattatgtgaagacttcatttatactcaatctaattcagctaccatgggccatatcaccagt

SEQ ID NO: 21708 - DNA, 457 bp, Homo sapiens
acacttacatatgtcaagaagtgtacatgtaattatatgtatgtagagaaatatatgtagatatagcaactatctacatataaatatatgtagatatagcaaatatatgtagctatatgacagaagtgaagtgaaatttattgattatatcaataaatatactggacttaattagctttataaaaataaataacatttccccagcactttgggaggccgaggtgggtggatcacctgaggtcaagagttctagaccagcctggccaacatggtgaaactctgtctctactgaaaatacaaaaattagccgggcatggtggtgctcgcctataatcccagctactcaggaggctgagtcaggagaatcgcttgaacctgagaggcagaggttgcagtgagttgagatagcgccactgcactccagcctgggtgacagagtgagactctgccgcaaaaa

SEQ ID NO: 21709 - DNA, 586 bp, Homo sapiens
ggagtttgcactttgcataggaaacagaaaggctatcttgctgtaagaggccaaattgcagaagtgggctttggctaaggaatgtggacacactgcagacatcttgcacagaggccaagtcttgcaatgatgtggtcagacgtggtagaggccagctgtttgctccgttgagagaggcttttgccagtccacaggctctctgagggctatgtttaactgaatccaagtatcaaacctgctgagactcactcatcccccagggtgtttggagttgggttcttacagagcacaatattgaaagtaactggtaagagaagttacagataaagacttagctattttaaaaaaaatgtaacatacagtggtgaagtggaatataaatgtattttccctctttcccctataaactattggaatacaggtaaaaacagtttatgctggctgggcacggtggctcacacctttaatcccagcactttgggaggcagaggcgggcggatcacgaggtcaggagttcgagaccagcctggccaatatggtgaaaccccgtctctactaaaaatacaaaaattagctgggtgtagtg

SEQ ID NO: 21710 - DNA, 618 bp, Homo sapiens
ttgggttagagagcttttggcaacacaaaccatgctacttctgagtctctgaatgttgggattggaagtgtatggaaaacttgagtaagttcctggctctgccactaaatagatgagtgaacttgaacaacttatttaaactctctgagctcctgtttacttatctgtaaaatgaagatatttagagttaaaaacctaggatatttagacttaaatttagacttaaattggctgctgctttggtttcttgaaagaaatactttggtccttggcctccaaagcctctgcttagctgctttaccgattctatgtggtatgtcctcctttttaggttctttgttgctgttttaagagaaaatttccaactaaatgcttgtttctttacagataaaaataaaccgtatgttgactaagatcccacttggccaggcgcagtggctcatgcctgtactcccagcactttgggaggccgaggcagatgaatcacctgaggtcaggagttcgagaccggcctggccaacatggtgaaaccccatctctactaaaaatacaagaattagccaggtgtggtggctgacgcctataaccccagctacttgggaggctgaggcaggagaa

SEQ ID NO: 21711 - DNA, 606 bp, Homo sapiens
aggttgcctcagtctctgtgacacaaatgattcctggtttacatttttggtgaataaaagcagtggtcaaattagtgatggaatttgttgataattacatttgtgaagtgaataatgcagcattagttttctgtggaatggtggggttgggggtaggtagaagatataaagtacaaacacatactgctcataataactatgattaacaggagatgttttggtgttaggcacttttttcattcagttcatttctgttctcctgtcatatattgttgaaaatttatcatttctttagtgggaatgagaatagcaaaggtacagaaaaataaaattgttggtccatgatgtcacagcaaatcactgatgaatgagctagaaaatatttagctcaatttttcatctgctgggtgtttgtaagaatttcaaagcagtgccgggcgtggtggctcacacctgtagtcccagcactttgggtggctgaggcgggtggatcgtgaggtcaggagtttgagaccagcctgaccaacatggtgaaaccccgtctctactgaaaatacaaaaaaattagctgggcatggtggtgcgtgcctgtaatcccagctactc

SEQ ID NO: 21712 - DNA, 607 bp, Homo sapiens
acaagtgccacaaataacatacaacattgtaaatcagcacaatttgtagctgggtgaatggaagaaatagttctattcatcacttcctcattttcccttaatctacaatctccagatgtcactactgaattaacagccaacaattccacaactttacctgggagacactggccctttttcttcctcttcctcatcatcactttcattttctgtaaataaattcagagaagcaggtcacattaagcaattcatacttcacataggaacaaatcactgtccagtcatagcacaaggacataactattctcagtgcaagaataaggattctgacaggaatattctagggtgtcctagattaactttggtgagaattagatgaccctgctttccagacccacaggccaaaatctccctctacgtgtagaccataatgacatattccctgcctgagtcaaagttaaacaaaattttttccccaaaaaaatctccaaaaattggtcaaacaattttctaagagtgttgctgcaatacggacttatatcaccaggtaacatggacattaaatgtttagaggcatctatacatgaaacacgactgatagataaat

SEQ ID NO: 21713 - DNA, 606 bp, Homo sapiens
cacccagccacaagtcttatttctaaagagagactttataagaggatttgcagatatcacatgttctcctccaccctagtttgcagacttgaaggctttcctttggaaaaagcaaagagaaacctgagtgccctcagtttaagaacaagagggaatagtcagtcttgaatctcacctacttcccatgagaatgaaaaatccttttaaggccatgccagggctccttacagtcccaaaacactgccacaagttgggaacagataaagtgctgtgggaggttgttctagccaaggctcttggagttacaaggagcagaaaccctctcagattagcccagacaaagcaaggcttactgcagtgaatcagacacctcaggcacaggtcagaacacatcacgtggccgggacttcttgggactggcaccatcacctgaagtccgccctttagaagaccagcggatgctctgtccatctctcaagagccacatgtctctctcacagggtttccactgctccattctctcatccagctttctcatcttgcatgtgattcagccagctcccagctcagctccacattttaacaaccagcaccggcccggcacgg

SEQ ID NO: 21714 - DNA, 585 bp, Homo sapiens
tttgttcatatccttaataatttgcttagtacaaatgcctcaaatggaatcactgggtcaagggcaataattaatgataaagcttctgatattatttgccatattaggcctggtacaatggttcatgccggtgctttgggagcccaaggtgggtgggtcacttgaggccaggagtttaagaccagcccgggcaccacagcaatacctcatttctataaaaaatgttttaaaaattagctgagcttgacggcatgtatctatggtcccagctactcagaggctgaggtggtaggatcacttgagcccaggagtttgagcacttagtgagctatcattgtgccactgcactccagcctgggtgacagggcaagaccgtgtctcaaaaaaaaattaagtaataattataataatttgccatattgctctccagaaatattataacaatagccttcacaccagcagtggataaagcattaggaaatgatcttcatttgaatgttccaagcacagtaaacaaaaacttatcttgaaagagtagagaggccaggagaggtggcttacgcctgtaatcccagcactttggga

SEQ ID NO: 21715 - DNA, 584 bp, Homo sapiens
gaagtacggagttgcattaaaaattcagaatgtctgaatttaaagcttatactcttaactgtttttgattttcattttgagacagagtctcactttgtcacccaagctagagtgcagtggcatcatcacagctcactgcagccttgaccttctgggctcaagtgatcctcccaccccagcctcacaagtagctgggaccaaagtcccgttccaccagacccaactaattttcttcatttgtttgtagaaacaaggtctcactacattgcccaggctggtcttgaatccctggaatcaagtgatcctcctgacttggcctcccaaagtgctgggattacaggtgtgaaccaccatctctggttcttaacggttacttcacaaaagctggactctaaaggcagagacaacaacgtgagaagtactaacaaggccccaaaaatgaagagaaaaaggagagggagtgtgtgtagcatgctacttcctccatactcccatcattgtctctcaccaacaggttctattgttggtgactctgcattgcattgactgctctttaagagtcaatttcactcttcgttcctctc

SEQ ID NO: 21716 - DNA, 502 bp, Homo sapiens
gtactgttaaatttgatgatatttagtaatttggaccatattaaatcttgcttttgctttcttttgcacttccagtactttaaggtcaagtgaatttctactgagttttcagtagttttcactttaatttcatataattaaagcaacagttatatatttatttatttatttatttattttgagacggagtctcactcagtcacccaggatggagtgcagtagtgcagtcttggcttactgcaacctccgcctcctgggttcaagcagttcttctacctcagccctccaagtagctgggattacaggcatgcaccaccatgcctcgctatttttttattttagtagcgatgggatttcaccatgttggctagcctagtgttgagctccggacctcagatggtccacccaccttggcctctcaaagtggtaggattgcaggtgtgagccaacacacccggccacaaaagttatttatttatgagatggagtctcgctctgtcac

SEQ ID NO: 21717 - DNA, 575 bp, Homo sapiens
tatagttctttctgattttttttgcgtatttctcctttttcctgtattttagatatatgtaggtaagtttcttttcaattataactttgatcttctagtctagaaagtaaccactcttcctcccccttttccttgctcctcactggcagacttccctcaactctttctgttctcagcattgcatgagctgtgtgatgacctagaacttgttcttaaaattctgaaagcaatcacagcttgattaatcaaatagacacctggggagactctgtggtctatgaacacctgtcttagtttatctgtaacacagactgactacttgttttgtcttttttttaaaagacagttttccagaatgcaagggtcagatgtcttccaccttaggagaattgccaggactgagcaaaattccactgatgacctgaacagacagctgacacagacattgcttgttttacctgacttgtctccattgctttactttgtgaaggctttgtcaaggaccattgtggattgctcttagctattttcatgtcagatgcacgtgatgtattttaatagccccctcatgaatt

SEQ ID NO: 21718 - DNA, 630 bp, Homo sapiens
catagtttataaaaagctgaaacttggcttttatttgataggtaaatagaaattgattttgcttttgaggtccagacataaaagagaaaaattgactccagaactcaagagaagatcctggattactctgtcttggtttgggttcccccaggaggagattccgagacaaggactctgaatgcaagtagttttctggaaggtcgtgccaggaaacctgccaagaatgggaaagtgagacagggagaggaggaagccaaataggggatgcattgtcaaataagtcatattatgggcagctggtgttcaatctatggagttgtctaggagacagcacaggttcacacttaggttttattccaaccaggaacaagtcaccaatcacatcagtcctgggttgagggctactttttcacattaactccaagcattctggacataggcctggctggttttgacagccagagaaaactctccatcaaagagatgaaagcgcttgcacttgaagctgtagggttgggtctacctgggaataataaatggcaaggggatatagacagagaacacagtgtctgttacaatgtccaaatataaactgtgctgctttgaccttttgtgcaccagtgacttctc

SEQ ID NO: 21719 - DNA, 573 bp, Homo sapiens
catttttcattcatgtgtaaagttatttagtaagactgttgttaatcttccagagtgatagaattttagaagagaccctggacatctagacattttttatgctactacatatggaattatactttactggtgactcatcccaaatagtgtatttttcagagttaaaagatttgttacggctgggcgcggtggctcacacctgtaatcccagcactttgggaggccgaggtgggcagatcatgaggtcaggagttcaagaccaggctggccaacatggtgaaaccctgtctctacaaaaaatacaaaaattagccaggcttggtggcacaaacctgcaatcccagctattcaggaggctgaggcaggagaatcactcgaaatggggaggtggaggttgcagtgagctgggatcgtgccattgcactccagcctgggcgacagagcgagactccatctcaaaaaacaaacaaacaaaattttgtcacaataaagtgattaaacgccctcttcaaaaacaatagaattgtcagcctgccggcagtggctcatgcctgtactcccagcactttggga

SEQ ID NO: 21720 - DNA, 579 bp, Homo sapiens
tcacctctcatttactcctcaatcactactatttgtttcagcttttattatttccatgagactgctccttgctaagataactcttatttgtcagatttcatggtcactctttggaactatcatttgacttttttgaaggattcacctcagatttgacagttctaaaattaaaatcattatctttcctaaaaaccatttcatcttcccatatttctaatcttggttgatgacacccccagggtacttgtcattcacacgagaaacctggaagactttgactttccttcccttttactcagtcatttctttgctcccttataaataactcccaaatccatgtcccttctccatccctacttccagtgccgccttttgttcaggttcccatttttcccctaccttgtatattttcagaggcttcctaattaatcttgccctcctccatttcagtccattttttcctcattgtgctactatagtggattttctaagctatatctaatcttaatggttctccacttaaaaaatattttctggctggacatgtggctcacacctgtaatcccagcactttggtaa

SEQ ID NO: 21721 - DNA, 523 bp, Homo sapiens
aaagtggagaccccctcctgttttatttcttgaaggaggatgttggcgatatgcagagcaaagctctccacttttcttaatagcttacgtaggtgcgtaaacattgtaaactccctttcatagtgatgcctttgagttgtgtgttagaagtagatttaggctatagctaggtacttttataaaatcagattttaaaaagtggacatagtacatccagtctagtagatcataccatctactgtcatgtaatatggcaaactgtatcattgtcacttcagtagctctgtcaaaagtgctggactggaaggcaagagatccatgttcttaacctgagtctgttactaattacacacatgaccccaggcaagtcacttaaccttttatggtgtcagtttcctcatctgttaaatgaagggattagactagattatttccaggactccttccgaaaaagtacaggagagagttgtataactgaaaggcagaaagtggaataattgaggcttggaattcagggtgactt

SEQ ID NO: 21722 - DNA, 527 bp, Homo sapiens
tcttatcttcatctcatcattcaacctccacagttgcttcagcagagaatgagggagcccagagggttgtacacaagctctaaatgcttcagcctgtacttacacagagctcatagccccatgcagaattggccacgtcgttctaccaaactgttagggggctggaaagtgtgtgaaataacatggctttttgatgaacagaaatgcatttccacaagctgttacaaaagaagggtagtgatacaggtaggtaaaacgtgtcccctacagactgggaccctaaacaatgtttaaaatgttgatatataaaatgtagtcaatcggaggagccaagatggccgaataggaacagctccggtctacagctcccagcgtgagcgacgcagaagacaggtgatttctgcatttccatctgaggtaccgggttcatctcactagggagtgccagacagtgggcgcaggtcagtgggtgcacgcaccgtgcacgagccctgcttgggcgaggcattgcctcactcgggaagcgc

SEQ ID NO: 21723 - DNA, 529 bp, Homo sapiens
actacaatttatccttcaaactggtacacttttgaaagtaaacagggaagctgttactaattatactaccacagcacatttaatccaggactgttccagataaacagggatattaggttttcctagtactatgcctcgaaggtccccagtttccacctctgctcatctctgctagatgtgaccacatgttcttaatgttggccaacttgcacatataactttgggtgcattaatcatggtcctatcatttttgggtgactacagaatgatgtactacaagtgtagattataactatctgcactaacagtatggaggtgacttcatataaataatattttacatgtaggttttgagtatgtttgtatttgaatgtagacctgagtgattcttcagaaattaatacagtaaaacattagaaatttaggacagtgatggtggagtgggtcagttagatgtgaaaaattgtaagaaaacatttcttctagacatggaagaataggcattaagattgacaaattatcttgattc

SEQ ID NO: 21724 - DNA, 619 bp, Homo sapiens
gctgaaggcagggattgtatcttcctgacctttgtatctcccatgatgtatgtcacacagaaatgaggaaggcttcaagggaaaggaaccagtttgactgcagctacaacccaagaagagatggaaagactgtaatcagccgagtagctacactgggaaggtgattaaagagctttcattttaaaaggctcgaggtccagagggtttcatgggtgtcctctgtctgacctttaatgaacaggtggctccagtgtatttaaactattccggaccataaagaagacggaaatttctataactcatatcatgaatccaacacaagcttaatagcaaaagatgacataaagaaattattgacgattctcctgaatgaacatagacacaaatactagcaaattgcatgtagcagtgtgtgaataaaacaattaagacttattctaggactataagggtagatgtgtattataaaaatatgtctacataattcattccattgacagaataaaagaggagaaatacattatagcaatagattgcagaaacatcatttagtataattcagcagctattctgtgtttacatagactatgtaaacatattctcctctgatgggaaacat

SEQ ID NO: 21725 - DNA, 603 bp, Homo sapiens
cattcattcattggtcttctatgctgtacaaggccttctgctggggtgagggggaaactagggagcccggggacctctccaacatattctttgctctgtacacttaatcaagataagaaataaagacagcaagactgcaaaaagtctattatgtagacttgcaaaaagtctacataataatataaattcaagccaagtagaagtgattttgcaagtctgtgtatgattaattggctagtgaaatatatggataaaattagttgtagggattaaagcatctgaagtgatctcttgaggctctggtggcaaagcagaaaggggaatttgaatttgaactaggtttaaaagtgtgagtagtagccctttcttttggcaggggaggtgatcctacccattctccttagagcctgtgcaattggtctcagtgtttctcaacatctaagaatgaagctgcattcttaatgctttagtagctgtgcttcaaaacggcaagtttccttttgagagtgattttctctttgttctagcttgtttcactaggcggataagcgtgggcagtaaactgggaggtgtccctttatcagcacctctcagcttcaccca

SEQ ID NO: 21726 - DNA, 556 bp, Homo sapiens
gagaaattgtctagtaattgcctgttctctcttctgaagttgcaccttctagtctggtctctctgcttcccttgtctgtctttttggttcttctctccattttcatttctgccacccacattttagttttcaggatcgaatgcttctgtttttgtttgtttttcaccttattcctgtttcaaagttgcacatcttcttatatttctctgagaaaattatgattttgcttaacacttgatttctgcttcctgctttttatctgtctcctccaagttccttgtttcagtgtgtttgtcatggtctttgtgtctcatgctagaggctttcctcactatctcatgattattggctgtctgttcatatttaaaagagaagcattcaaatttgattggaagttaaggactgtatggagacaaggtatagaaaatattttcattgttttattagtcagggttctgtaggggaacagaataggagatagatatagataatagagatagagacatagacatatagataaaggggagtttattaagtattaacttacacaatcaca

SEQ ID NO: 21727 - DNA, 89 bp, Homo sapiens
atcgtgcagctccagattcgcaagcaggaggagagcctcaaacgccgcagcttccacatcgagaacaagctaaaggatttacttgcgga

SEQ ID NO: 21728 - DNA, 579 bp, Homo sapiens
gaaggaaaccctgatctccccagtcaaggttgagtgcccattctctatgtcttctagcatccagttctctatgtcctgtagcatccaggcctttttaataacatttctcagctgtcttagaactgtttacttgggtgtgttttctctaaattataaggtttttgaggatgggaatttatatccatgtcttttttgttcatcattatgtccccagcattagcatactgtgctgtgttcattacaggaacaagcagctgggtggtctgatccagtctaattgtcctctgattcttcttccaaatccatacctgttttcttacattgctgaacttgaccagaaagaaaattctaatgctacctgatctccttgtcttattgaaagcgattttgaagtagttattctcaaatattactttactctggaagccttttgaaactgcgaatctgtaccagcttaatttttgtgcattcttaatctccatccaggtggttctctgaattttgttttcatccctgtctctggcacacatctctgtctgtatgcgtctggagggttgcagtattgaggaactaagcact

SEQ ID NO: 21729 - DNA, 482 bp, Homo sapiens
ggtgacttggaaaatgagaaagatttagcaaaattccaccgtatcttttgccaggctagaggcagggtggagcgggctgcaaaaatgggaagaccctttaggtacctcgtgaacatcctattctgccaaacgctatggaagtgtgtctcagacatgtcaatcctatgaacagaagttcttaaggtgtgcgtgatgatttagcccatagtggaaaagataatagagctatttaatatggagcagaaagttttgatatggccttcaaaaattaatctctatgattttttttaaataacaaagtaatttttaaaatagacaccctttgccaggcttgaatcagagcaatgaggtgagggtgtcaattgaacatattatctagtattttttatatctgaaacccacagttgttttaaaatcacaaaataggtaggagtgtcaaggtgaccacagcaatcagaataggcattctatgacaggaactc

SEQ ID NO: 21730 - DNA, 525 bp, Homo sapiens
gctgttataaacatttatgtatgagcccatggatatatgttttaatttcttttggatggattttagggggagatcaagaagttgctgaagttttttttattgttgtttattttatcttttttaaagaaatggaggtctcactgtcttacccaggctggcttcaaactcctgggctcaagagatcctcccacctcagcttctcaggtagctaggattacagccacacaccactgtgcccagctaggaagttgcagaggttttgattactcctggcctttagtcttctgaagataggatgttaattcaatttgctaaaatgaagtcaggatggcagtaggggttttgaggcaaggaataatggtttggtttaatatcctatagggaatgggaaggagagctgaccaagggcagattaaaggaattttaggtgccgtggaagtttgtgctgaaattgaggactgttgaatctataagattttcctaaaagtgctcagctgcctggtagaagaagcagagaagagttta

SEQ ID NO: 21731 - DNA, 429 bp, Homo sapiens
aatgaaaaacaaaacccaagctgaacagaaatcatagagggaagaaaaggttataaatatatggatttgtcagagtgattttaagctattaggaatcagttaaatgttttgggattttgtctgagaatgggctaaaggagaatgtcccttttgccttctgaagtttccctgaaaatcactaataggaggcagataaatagtagaaaaggcataaaggtttctgcaatgtgtgtacactggagcccttagaacgaagacccagacacacgatgcgtgcagaagcttatctaccacatgaagtttacagaaagaatggggtcttggatcacaggaaaaaaaaaaaggttatgtgagaaaacaaccctggctagcaacagtggacttattacataggtgaaacctcactgggagcagtcctcagagagaata

SEQ ID NO: 21732 - DNA, 618 bp, Homo sapiens
gtagaagagcagaaacgtaacaagcagctagaagagaaaaaacgtgccatgcaagagacaaagataaaaggggaaaaggtagaacagaaaatagaagggaaatgggtaaatgaaaagaaagcacaagaagataaacttcagacagctgtcctaaagaaacaggtacagtaaacattttgcaccaaatgtgtgatgcctgtgacttgtgagaaatgtaatgcacatctgatttgggactgaggccacatgcatatagctcacatgcttgatcatttggcaagctgttcattttttcaggccatagcgatacacaagcatgcagcaattgattgatggctgaatattcaatcaaccaaatttactgggacagccagtaaatttggctgtccagaagacagagagaaattaattgctctgtgcttgattgttatgaatacccaaaaaaagaattaatccaaagatgataaatgtggtggtggtgtgttggcttctgattctgcgcttgcatctaaactcgttcttttaattatctttcctctatccataggtctgcatgaggcaagaggcccataactccttacctcactcatgggtttgacgttgaattaaaaaaatgat

SEQ ID NO: 21733 - DNA, 578 bp, Homo sapiens
gagcccacgcagaaaccaagctcacctcagtctgggtgtggggcagtcagggaaggcattctggaaaatgtagctgactcgaaataagcacctattgaaaatagtgtgctgagccctggaacattaaaaatgtgttcctatgtggaaatcagaaatgtatgggtcccagaagagaacttgtgggtcagcctgctttccagagagtgccgaggccccttgaatggtgaacactatgcaagcgttcttgtatggccagtggccagcagggaggagggcagagaatgactgtgcctccgggaagccggcgtcaacttcccgacacgcttcaggatcatctctttgtatagaaccatgggatggatcgctgcaggacctactggaaaaaggaggtcatctccaggactctttccatgggtcctttgtgtcttgcagaacttttttcggcaggtgttgtttacatatggttcagagcttaaagaacaactgtgttccaggccagggcagaaagcacaggcctgtctgggaggggcatcatcactcctgcctgcctgcccaaccgacctgtcggtggactgaat

SEQ ID NO: 21734 - DNA, 602 bp, Homo sapiens
tgcgatccatgaaatttgttggaaatttttaccccattaatgctggggtttcttaacctcagtgctagtgacattttgggctcgtaggtcattgttttttgtgtggggtccttccgtgcctttagcatggttcaggtaggaagtttagcagtgtccctgcctcgaccctctagatgccagtagcagctccttctccttgctcctgcacctgtcatggcaaccagaaatgcccagtgtctcatgcgggacaaaattgccctaagttgagaacctctgctttatacagatagattttaagtatttgtcaccaggaaaagcctccaagaagtgatcagctgaattgtttctgtttttatctttcagatgatggatgcaataaaaggaacaatgacagaaatatacaacgatctttctaaaaacactactggaagcacaatagctgaggtcagagatgacacatgaatttcttatttgctaagagtgttttgtgggctgctttaaaggtggtaccatgaagaagcttctctggaaacccctctggggtcctggcttggtcactaagctggctctactgattgtcattatcgatgggggtatttttt

SEQ ID NO: 21735 - DNA, 598 bp, Homo sapiens
ggacaaagttgtgaagaatgctgcatctcagactgcccatgttattgactttttttaaaatcacctggtaatccctttttcctcatatcaaatgcaaacacagcactttctcagactcacttataagagtgcgtttttatccattcttactcttgcttttccttttattctccctctgcccagctataacaaattggattgtgattttgtccacaattattattcctaaaatgacatttatatttggaattgtattttcattacagagaaacaggttaaaaatcaagtcacaattgaaatagggaaagaataccctgaaagatatagtttagcagtaagtgtatttgtacactgataaactgatcttccgaagagactgtttatgattttggcagtgcctcattttttaggtctttgtctttaaggaacccacgtgtggttggggaaagcacctcaatctctgcagttcatatgtagaaactcttataagccttgtgagaggtctgtgttcccttcctgactgtcctacacctactatcttgaacatcagaaacactgatgttcaagaactttgattaccctcatttatctgggagct

SEQ ID NO: 21736 - DNA, 603 bp, Homo sapiens
gatcacaaggtgtgagccactgcaccaggcctgctattactgttaccattacacatccactgctgcccctattactcccctactttgccctctgggtaggcccgtaaaccagggctccaccttctgactggctgcaggtggtcagattgctcttggctacccaggagccagtgggttcttggttctggagaagctggttgaccacaagggaattgtaggttactggggccggcaccatgggtgccctttggaaggttctgctctgacctatccctggaggccccagccagaagagttgtcacttcccttccggccacccactgtgcaagagacaaatcacatgctagtttcgtgccatcttccagtaagatgtgggaggcactggcctgagtgatcccttttcaagcaaagccccatctcgccgtgctcacaggactactgtcataggaacatggatggtttgttcttccatttttgtggagctcggggatggggggatgtgtctgttgtcagggaggtgccatggtaagttgacagggcctgatgttagtgaaactacactgggatagcagcagccatttaaagtaataatggtaagacaca

SEQ ID NO: 21737 - DNA, 582 bp, Homo sapiens
agctatgttgtggtaaaatttctacatttaacttgaagtggtagaaaaaaactctgattgtgaaaagtatgtattttgtaatccccatagtaagggttagtaaaccatattccacaggccaaatccagcccactgcctgtttttgtaaatacaattttgttggactgtagttacacctcattcattgcatatcatgtatggttgcttttgcactacagcatcagatttgggtgttgcaacacacattgtatggctgacaaagctcatcatatttattgtatctggccctttacagaaaaagtttgccggcccagtgtagtgactcttgcctataatcccagcactttgggaggccgaggcgggtggatcacgaggtcaggagttcaagaacagattggccaaaatggtgaaagtccacctccaccaaaactacaaaaattagccaggcgaggtggcaggcgcctgtaatcccagcttttcaggaggccaaggcaggagaattgcctgaacccaggtggcagaggttgcagtgaggcgagatgtcgccaatgcctgtcctagagcgaccactaaagaaaagaa

SEQ ID NO: 21738 - DNA, 440 bp, Homo sapiens
ggaggtccttgttaatatatagtagaacagaaacagtttttacttatttaaaattcatacctgcttctcctcaaaggttttcagcatcttgatagtcagagggaaacattgtagtaagacagtctctatgtttttctgactgtctcttgtggatatgtcattttaacatcttttaacgttgcatccctcatctgttaaatggacatgattataccaattcccacttcaaagttctcgtgaaaatcaatgtaatagcacttcaaacatgggctgttacacattatggaaaattaacttcttaatttcaaaagttagcttgatttttgtttttcagctaacctaaaacaaatgtaaaatattctctgcatattggaatttttactttttatttatttaggcattatagaatccagaactcaaatataggcagtttgctctgt

SEQ ID NO: 21739 - DNA, 590 bp, Homo sapiens
gggaaggattgtgtgtgcccttttgttttgaaagaaattgagggagagaattcttaacttgcttgggctttaaagggttggttttcccttgtgtcttcagctttcatgtgtggaatttatttgcttacacatactacccctcttcctttgcttttctctttaatactttttattttagcaaaggagagagtcgaagttataaacatctggatccagctccttccctcaaaacttaaaaaaaacactttgagcttcttccagccacttaaaaagccaggctcattcagagctaggcaacataccggaaagtaaatggtcatctagaactattgggttctttttttttccccgagtttttactttaaagaaaggacatttcaggatgtgtttaagagatagagaagggctgggcgcggtggctcatgcctgtaatcgcagcactttcggaggccgaggtgggaggattacttgagtccagcctgaacaagatggcgaaaccctgtctctacaaaaaaattcaaaaattagctgggagcgatgttacgcgcctgtactactctggaggctgcggtgggagaactgcttgagcc

SEQ ID NO: 21740 - DNA, 591 bp, Homo sapiens
gggtggtggttttaactgtattttttattataggctgcagtcaagatagtttgaaagctactgtactgggagatgctaggttccttttagcaaaagtgaagaatggttttaaaaaatacactttgaaacaactgaataaacatttattttgaaatgagatccagctgcattgccgactgttacctgcagtgtgatcctctttttgttttgttctggtttggctcagggcctcactatgtctacacccctccaggtagctcctcttgcccacatgtgtctaactgaggacccacaccacccgctccttgatttggcattccttgtctccaagccaaaggtccttctctggtaaaatggttggccttgggcagtggtccagtgacaggaggtgaaggccgaggcgggatagtggcagtggtggtagagaggaggagaggttggggtggatacttgggcattactctttgctaggtttaacatgttgaattcactcgttctctgcaggctttggtatgtccctttaagtgggtacacggtttgcccacagtattaggaggagctttgggattcccagcactttgggaggctgag

SEQ ID NO: 21741 - DNA, 616 bp, Homo sapiens
tctacatatccaggtctctctttatgtaattttattttgcttaatacaaataataaagattctgtttacttataattttcttctggtttctgatgacaatatggtaaacaattttaattattatggtaattaaattaacaaattaatttggaactgtatggagtttatgcatatttctggctaattctggatctgatccttaaggccaggatttaattttggataaagggattcatttaaatttggtattttttttttcctggcaggtgaataatagaactttgtaaacaaatagaaaagtgcattttaaaagataaaagacatggagacgcaactggaaactctttgttccatgaagcattaggctatgacagtgtacaatgtaactgtttgcagttaaatcaatacacctttagagtagcattggaaactatcttttgtccttaccaggttcctcctaaatattttataggttctagcattactttgcatggttccggtacaggatattaaaacgtaaaaaattagatccaacaatatttgcatctcccctcccttttttttctacaaggtgtcaaataactggtttgactgatttccccagctttcactgacc

SEQ ID NO: 21742 - DNA, 534 bp, Homo sapiens
gagtgcggtcacatacttccagaagagcggaccagggctgctgccagcacctgccactcagagcgcctctgtcgctgggacccttcaggtaggacagctcccaacgctgtggggactctcagcaaaacttctccttcctttccacggctctgcttcttctgacctcatcttagttttgctttttcttttcttccttcgctatttttctacgatcctctaagaaccaagtccttgaaacttttggctcaaagtggatacagagacaactttttctagaaagttcagaaaagtgtattttgaggacggagtctggggaaatcaatgggatggggctaaaatcgtgcctggcagtgaccgggttcttgttctaggatgtggagggagcagggactttgaaacaaactgggataggatcctgtttatggaggaaacaccacacaccttggaaatgacatcgggaactggccagatgtttttcacctcctccgttttgattccgattgcttcaggacttgaactgttactccgctcgct

SEQ ID NO: 21743 - DNA, 488 bp, Homo sapiens
gtaaagagaccctgctgatgtctgatcatgaggagctcactattctgtaggaaagaccataccctagttgggcagctctaatcatttcgaattttcacctgatttccgcctctctgtaatttccagcccttggccatatgttgttttctggaattctaatggataagactatttgctctatgagataacccatcacatatttgaagaccactatttgtcctacctaacttttgtttctaaggctcaccccaacaacccacccccagtttggttcattcagcagaactatctggagcactgtgccctaagcattggggctaccaagatgacaatgataacatcaaggagctcacagtataatggggggagagacagatacatacacaggtaaaataagtgctgtagaagagtgatcaacaaagagctatgaaaccagtaagattctaaaaactgactttgtgctgagcaagaggaggcttttcagaaaa

SEQ ID NO: 21744 - DNA, 563 bp, Homo sapiens
gaaggctggaggacattcagaatttctggagaagggagtagcaagatgatgtatatggtaggaggaagagaaagaaagggagtttagggaaatgtcagatagtccagtgttaccagaaaagaagacgcaggagagaagatagtgggagataagaatagagacacagcttgaaaccaaattacagagggcctgagtgccaagataaggccttcaggctgtgttctgtaggcagtaggatggcatgcccagagctttgtgtgtgcacgtgcgtgcatgtttaatcactattgcacctcagcttaggctggtttagaaagagaaggcactacctaaacgaaaaccaaaccggaattcatatatggtgggtgtccatgaagtttccttatttccctttctacatggaagacttgctgaaggcagggattgtatcttcctgacctttgtatctcccatgatgtatgtcacacagaaatgaggaaggcttcaagggaaaggaaccagtttgactgcagctacaacccaagaagagatggaaagactgtaatcagccgagtagctacact

SEQ ID NO: 21745 - DNA, 590 bp, Homo sapiens
gggttctgtatagctcactgtaaccttgacctcatgagcttgagctcaagaccctgggttcaagtgatcctccccactcagcctcccgagtagctggaacatcaggtgcttgctaccacacttagctaatgtttaaattttttgtagagacaggatctcactctgttgcccagactggtcttgaactcctgggctcaagcgatcctcctgccttggcctcccaaagtgctaggattacaggcataagccactgtgcccagcctgtttttgggttttctaggtacacaaattattaagagttcagcaaattttctgtatactaaggtcaatatacaaaaatcagttgcgtttctgttagcaggaattaactattaaaatatagaattttaaaaaaaagatactaaggcaattagaaagtcagttcaataggaaaatggacaaaagacatgaaacaagataagacataaaagagaaagaatagagatttaaaactgatttaattgaaacaactgatgagtactgaaaaagtaaactcagtgtgatttaacactgagtttaaatttaagaaataaatgtggctgggcgccatg

SEQ ID NO: 21746 - DNA, 553 bp, Homo sapiens
caggtgatgaaaaggatccactccttgatggaaaaatactcagaacttttacaagaagatgatcggcaactcatagccagatgccttaagtatttaggatttgatgagttggcaagttctttacatccagcccaggatgcagaaaatgatgtaaaagtgaagaaaaggaataaatattcagttggcattgggccagctcggttccaactgcaatacatgggccattatttgatacgagatgagagaaaagacccagatcccagggtccaggattttattcccgacacatggcagcgagagctccttgatgttgtggataagaatgagtcagcagtgattgttgccccaacgtcctcaggcaaaacctatgcctcctactactgtatggagaaagtgctgaaggagagcgacgacggggtggtcgtgtacgttgcacccacaaaggcccttgttaatcaagtggcagcaactgttcagaatcgttttacgaaaaatctgccaagtggtgaagttctctgtggtgttttcaccagggagtatcgtcatgatgcct

SEQ ID NO: 21747 - DNA, 579 bp, Homo sapiens
ggattaaaaagatggtagtgatctcacaatccagccccaggtgcttctcagaagcagaggcgagggccggctggggacactgcagtagtgggctggatgttgcttacttcactgttctcagccaagggcccagcagtggctcctctggggtctccttaaaaggtggctcgctgcccctggcttgccccaggctatgggtcggacgttcctggagtaaagcctgactttatgtattttatgaaacacaaataattttcatgagcactggtggttaacatcaactctttggagctttttgtgtttgtttatttaaaatggaagctgtctctcattttcatccaaagagatttcttccctggggcggtcaacaagtcttggcaagtgctagatccctggtttagtttttgccatagcttggctattactgcaaagaaaagtcctctcactaagccctgtgagtttgcatgcatgcctgtgtgcttctgtgagtgctgtggaccctgtgtgttccaataatggatcctggggctcagtaaacacagtggctaaaaggacatctatgctgatgaaatcgtctct

SEQ ID NO: 21748 - DNA, 600 bp, Homo sapiens
ggcccactgtgtcattcacaaagtgcatccaaacccatcatcccaggtgaccctcacaataaccccgtgagatttgcaggccaggagcctcctcaaaggaggagtcaggaatgttggggttaacaactcctccaagtcaggaccaggaaatgctatctccagcaccaacctaggttccctatgcttcctcccacaccacagcttatgggcgactgccacctcatggacagagcccttccctgtccaatttccaccaggctccttcctctgatcatcccctcagacaccttgttttctgaggccagtcactctgggaactgttgtccttggcaagtggggacctgggactttgcagaaagcagatgctaaggtcatacttggctgggaccagcattggacagcaaacctcaccttttatttttaaattttatttatgtacttatttgagacacagtctcattcttacccaggctggagtacagtagtgtgatcatggcttgcttcaacttccgcctccccagctcaggtgatcctcccatctcagcctccctagtagctgggactataggcttgtactgccatgcccagctaatttttgta

SEQ ID NO: 21749 - DNA, 431 bp, Homo sapiens
gctcgtgatactcctgctcgctggcttcatacttcccgcgttacttccaggggttaccagcgtttccatccagtcatttcacacacctcattgaacaattttccaagtgttggtttgctctcttccttactacatattaatgaggtgtccaagactgctgttcagcacgtatctaaaatgttgtttaactacatcagaaggtaaatctatagctgctgaagcgaactaaaaagctgtgtcaatctggtgcagtggctcacacctgtaatcccagtgctttgggaggctgaggtgggaggatagtttgaggctaggagtttgagaccagcatgggcaacatggaaagaccccccccccatctctaccaaaaataaataaataaataaaattagctgagtgtagtgccgtgcacctttagtaccagctactcg

SEQ ID NO: 21750 - DNA, 581 bp, Homo sapiens
ggcaagttaagcagcactggaccctttgccaggcattttgaaagaattacaggatttggtcatgtgatattaaatctaatcaaagtagtgttctaggaggcccatcattatgataaaaatgacttgctacttcaaatagggacactagaggaagctgtttttagaggactcagttgtagtaggaaatccgtttggtttaagacaatgcttgaactgaagacactgaataaataatgacttccatgcttattaacaacactaggattaactttgtacctttagtcaggaaggactattggatatattaatcactatgggatattatgtctttaatgttgagttgcaggaattcataaagaaacaagctcaacgtcgggcgcagtggctcacacttgtaaaatcccagcacttaggtaggctgaggagtgtggatcacctgaggtcaggagttcaagacaagcctggtcaatatggcgaaaccccgtctctactaaaaatacaaaattagccaggcatggtggcaggtgcttgtaatcccagctactcgggaggctaaggcaggagaattgcttgaacctgtg

SEQ ID NO: 21751 - DNA, 583 bp, Homo sapiens
gattcagaaccctgagtacaagggtgagtggaagccccggcagatcgacaacccagattacaagggcacttggatccacccagaaagtgacaaccccgagtattctcccgatcccgtctctactaaaaataagaacattagccaggtgtggtggcacatacctgtagtcccagctcctctggaggctgaggcaggagaatcacttaaacccaggaggcggagattgcagtgagccgagaccacggcattggactccaggctgggcaacagagcacgactccatctcaaaaacaaacaaaaaaaaagagtgtcacctggggctacttggccagacacagagagcaaggagacatccctattatctgtcaaaaataattgttggggctgagcacagtggctcatgcctgtaatctcagcactttgggaggtcggggcaggaggacttgaggcctagagtttgagaccagcctgggcaacatagcgagcaccccatctccagaaaaaatttaaaaattggctgggcgcagtggctcatgcctgtaatcccagcactttgggaggccgagggggatggatcatttga

SEQ ID NO: 21752 - DNA, 406 bp, Homo sapiens
tgaacattatgcaagcgttcttgtatggccagtggccagcagggaggagggcagagaatgactgtgcctccgggaagccggcgtcaacttcccgacacgcttcaggatcatctctttgtatagaaccatgggatggatcgctgcaggacctactggaaaaaggaggtcatctccaggactctttccatgggtcctttgtgtcttgcagaacttttttcggcaggtgttgtttacatatggttcagagcttaaagaacagctgtgttccaggccagggcagaaagcacaggcctgtctgggaggggcatcatcactcctgcctgcctgcccaaccgacctgtcggtggactgaatgggccaagtgttcagaagtccttgggaagaggatagtgtcctgaatcataat

SEQ ID NO: 21753 - DNA, 585 bp, Homo sapiens
ggacttaaactttataatttttggttatcatgaataatgctgttataaacatttatgtatgagcccatggatatatgttttaatttcttttggatggattttagggggagatcaagaagttgctgaagtttttttttattgttgtttattttatcttttttaaagaaatggaggtctcactgtcttacccaggctggcttcaaactcctgggctcaagagatcctcccacctcagcttctcaggtagctaggattacagccacacaccactgtgcccagctaggaagttgcagaggttttgattactcctggcctttagttttctgaagataggatgttaattcaatttgctaaaatgaagtcaggatggcagtaggggttttgaggcaaggaataatggtttggtttaatatcctatagggaatgggaaggagagctgaccaagggcagattaaaggaattttaggtgccgtggaagtttgtgctgaaattgaggactgttgaatctataagattttcctaaaagtgctcagctgcctggtagaagaagcagagaagagtttagtcagaatgagggagtgagga

SEQ ID NO: 21754 - DNA, 596 bp, Homo sapiens
ccaaatatataatattttctgtcttttctaattaactgcaatctttctcattttagtaaatggcaaattccactctttcacttactcaggggaaaaaccttgggattacccttgacttctatcttatacctcactctataagcaaattttaccatttctacctgccaaataaatccagactaccactcccatgtaaatcactgtgttacgttgtgatacccacctaaatagtctccttgccaacaccctccaggtagtaatcaatgtggttctgctcaaaacatttctcaagttttttccatttcactcagtaaaactctttacagggccccacaggatctcactatagactcttcctcttgcctaattacatcccacgttgtcccacaacacatcagacacactatattccccctttggagcctgtgcatatgcagtttttggaatattgtgcccccagataacctcatgactcacctcctttaggtgtcactgtgtcaaagagtcctttaccaccccatataaagtaataatacttcacctttggagctcttcagtccctcacctttgcttgaatttttccataaaatttattc

SEQ ID NO: 21755 - DNA, 544 bp, Homo sapiens
ctcttagatggagcggcaaatgtcagtgaactccagcatcatggggatgcaaggtccaaatctcagcaacccctgtgcttctccccaggtccagccaatgcattcagaagccaaaatggtaagtaacagttataatcaccctttcattattctgtgactttttcttttgaattttactctgactccaaaaccttagttcagctaggtagagggctccatctttgttttggtgaatgaaaggcagtgcagagactgcctctctttttgaggatgtttgttacagagccttggtgtcagataatcatgtaacaagcactggattggcaagtggtattaatgaaaggaacatttaggagttttggtagatccatacaagttggggtaggatatgcccaagcgtgtatatatttgctcagcatgtgaaataataaaaataatacaaaactactcattcttcaaggtagttacagtttcaatgccactcttcctgtccccatattcattaagacagaagcttgatgcttaaacacacactggtatgaaa

SEQ ID NO: 21756 - DNA, 536 bp, Homo sapiens
ggagtccctagtatacccagtatacacagcctggcacaaagaatgctcaataaattatatatcatttgcttcatctctctgtatctagaactcattaaaatctgtgtcatcaatatctccatcatcaatatctacctacataaagcctacctggcttagccccaaatcctcaacctgagcaagaagaagctgatttctgctcctgcctttactacttcttggttttctgacactgagaaggtcatttagcttctccagatttttgttttctcatgtgcaagataaaggagttgaacaaagacagtggttttcaaactggattccgaggaaccctagggttccaagaagacatgatggtgagaagagcaaggcaaaagggaaagaagacaattgttaatgagcaggacccccacttctacccagattgctccttcttgctctgttttgtctaccatgcttccacacaatactacacttaatcaaagggttttggcagggcacagtggctcacatctctaatcccaacgctttgggag

SEQ ID NO: 21757 - DNA, 511 bp, Homo sapiens
tgaataaaagaaggacacaccaggcaatcatcatttgggggaacttcagagaaattgctccatgagagtaacacagagcagtgacttctgctggaggggttcacaggtgacattttgagccctgtgcagcctgtgcctccgagacagtcagcgagggagccctggcggtcgtggggctgccttcgccagcttcagaactgtggtttttcccccattaacacacttcttgttaagctgatgtggttgctttctaaactgaatcttcccttggccagaaagaaagaaaaagcttccctgcgtgaagatgaaggtttattggcaatgtcttctttagtctcttagcaagaacagcaaacagagaactcccttctttctgacttaagttacacatattttttttctcttttttactttcaaagctggcagcctcataagagcagcattcaaatagaccgtgccagggatgcagggcaccatgaatggggcatttcttgtccttctggcccccttt

SEQ ID NO: 21758 - DNA, 460 bp, Homo sapiens
caccaacaagaacatgagtgattgtttcagtattgacctaaactttgactcttggggttgagacagttttctcaatgaactgagtttgaaccctggtggcaaggtgggtgccaggtggtgttgatggtaggacaacccagagctgtgatgactccccaagagcacggcctatgaaacctcatggacttggcatgttgttgatggaacatccaaagcattgcatgagattctcaaccataagggatggtcaaaattagtgtcacataagaaggtacaatcaattttcacagtcacttcacttttaaggaggtagagtcagatgtcctggaaaataagagaaaactaaaagaaaatgaaaatgaaagccaaaatggatctctttgtgaaatatgttcagagcattagagagtagagtaaaatggtaattcacagaactcctcacccatgaaatgaatatttt

SEQ ID NO: 21759 - DNA, 602 bp, Homo sapiens
gacctttattttccaaaacttcaagctttgactttcatgtgatcaaattataccacccactgcctgtctttatttcaagcacctgcaaaccttcctgggtcattcacatccttctttgttcacttcattagctcttggctcattgtcactgtctcttatttctgtcataattcttggtgacatcagtatctatgtagagcaatactagtgaagatgtggtctggtaactgttacctgtatgaattaagataaggagttatgccagaatataagtcacctgtgtcactaagtttactgtttagcttactttttttgtagcaagattttgatgaaggacgcaatatgttgatttacagtctggtacaaattttgatgtagaagatgcttccaatatcctggtctcttagttccttgatttcttctccagtgatcttattttctaccctaactcaactacatattcccattgtcatatcctagaatattttgtcttttatctgtaactctgctctcttcccccaatctcatttcaagcatcccactttctaattcctctagtaaatacgtcagttccaacagcccatcaatcccattgggaccta

SEQ ID NO: 21760 - DNA, 603 bp, Homo sapiens
gcagtttgaagggtttcgccgagttaatccaggagagtttagacaatgagaagagcagagggccgagaagcaaagccggcggacacgaggcttggggtgaagagaggaagagggtttaagaagagcgacagctgatccagaggagcctcgtgatggagcaccactgagctccggagaggagggagttcaggaaaaggggatcttcagcatccagtgcagtaaatagaccaaataaacaagggtgggcaggtgtttaaccagcactttgggaggctgaggcgggtggatcatctgagatcaggatttcgagaccagcctgggccaacatggtgaaaccctgtactaaaaatacaaaaattagccgggtgtagtggtatgtgcctgtaatcccagctactcaggaggctgaggcaggaggatctcttgaacctgggacgcagagtaagacttcgtctcaaaaaataaaaataaaataaaattttggagcaaaaaatatgaaaagaaacccagtagaactgttaaaataataagttgagaatctagaaagtagagcaaaaacaaagattgagaagtagttagaggctggacgtggtggctcatgcc

SEQ ID NO: 21761 - DNA, 518 bp, Homo sapiens
tcaaactttcatcaacagaaatatggataaacacactgtggtatatccatataattgaatacttaactcaccaataaaaatgaataaactattgatgcgtgtaacaacgtgaatgaatctcaaaataattacatgcagtagtagatactgtatataaatcttagaaaatatgaattgcagtgacagagaacaaagaggtggttttaaacacacagacatttccagggactacagccccctggatcaatgcagataagcagttaaaaagcacactccccagttaatttctggaaggggtttgtctgtatacttctctagccattgtttgaggattgggctcctctctaggctgcatctagtagccaatgggcaaagaaacagcagaaccctgggatactgactgtgagttccagcgtttcctgagttttttcatctggcttgctccagcaataaagctagagcagattatctctgtagattatccttggaaggagtttattcatggattgatcacagct

SEQ ID NO: 21762 - DNA, 565 bp, Homo sapiens
ctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaa

SEQ ID NO: 21763 - DNA, 577 bp, Homo sapiens
gatatggagaaatctgctgtatatttgtggcccaactcatgaattcagtgtacatggattatagctctgttaaaacgatcttagaaaagctaggactttctctgtacatagactataacattgtcaacatgcatttgaatagattgtctgtataggccacaacagaaatggacctaaaccataaagtagtaaaccatttttttattaattggtgaaattgtgaagtataagtacctgtgatggagatgatcttgtgttctaatgacatagatgtagattatgttcacatttaagtaagaggaacaactatgttactagcatttactatagaaatgatattgtttttgtgaggatgtgtcagaagttattttacttggggataaaatagactaaataatgcttgcagggtttaccatgatgtctagtatgtgtgacgatggcttcatggttttagagaattcttagaatctttatttttttagtttttgcagtgaatgagaaaagaaaaaaattattgagaaactactaaggctgaggcattgtgctgggtgcttggcaaatgccatcttatttaatc

SEQ ID NO: 21764 - DNA, 627 bp, Homo sapiens
gccaggatggtctcgatttcccaacctcatgatctgcccaccttggcctcccaaagtgataggaccacaggcgcactttttttgtttttgtttttgtttttgttttgagatgcagtcttgctctgttgcccaggctggagtgcagcggtacagtcttggctcactgcaacctctgcctcctgggttcaagccattctcctgcctcagcctcctgagtagctgggactacaggtgtgtgccaccacacctggctaatttttttttagtacagacagggttttgccacattggccaggctggtctcaaactcctgacctcagacgatacactcgcctcggcctcccaaaatgctgggattacaggcatgagccaccttacccagcctaatatagtaatttttattatgcataaaaagttataaagtaaatatgcctcatgggacatcattgtttcatttttatatgaaataaagtaactttctatttttacatggaaatcagaattcatatgtctcacgtgtttttggtgttgttatccacaggagaccaatcattttgcaatggcagtccctaatgatctattccctaatcaactggaaatacttccaaatcagttaataaacttctt

SEQ ID NO: 21765 - DNA, 456 bp, Homo sapiens
ggcggaatgaagcttactctttctactgtgtgacgtatcgcagatgtccttcagtgtttatgttgatctgccttcctcttttcttgcttttatagcgtatttccctttatcttccagtttttagaataatgagttggtactctgacctccaaagatgactaatatgtgttttcaaaaataattatgagctcacggattttaacatatttggtgtgtttcaatccaatgtggccattcatctcaatgctcagtagtctcaattttgttcgttgggaccctcaagtatttttggcatgactcaatagtctcttcctcactttcaggtatgacaggatattccaggctattcttttcttcaaattgaaattaaattgtggattaaatcttaattttattgtgtgctgtgttaagaaaaatttatctcactagatttaattagatgtacctgctgtaccc

SEQ ID NO: 21766 - DNA, 489 bp, Homo sapiens
gtcctggaaaataagagaaaactaaaagaaaatgaaaatgaaagccaaaatggatctctttgtgaaatatgttcagagcattagagagtagagtaaaatggtaattcacagaactcctcacccatgaaatgaatattttgtgagcaggttagtctttttccatctattgagtcagaatctgggtgagtcacacacttcaggtgacagatgccaaaacaccctcaaaattaaccaaagggtgctgcttagccttgcaaagcaaatacaaatattcaaacaaacatctctccaaaaggcacctctccactttccgctaactaaccgtctgtgctatgtctttacctagagccccgtgcttgggatgggaacagacgtgttcctgcgcagccctattattttcttgtcagaagcctgatgagagtgatggagaggtttataatgtgtcctgttttcccctgtaaaaaacacatttctcctaaagccatttaa

SEQ ID NO: 21767 - DNA, 502 bp, Homo sapiens
caattcttgagctaaattacaagaaaacacggtgaatttgtatctgtttcctatatttagggggctggcttaaacgttagtgatacatttggggagtagaaaatggatgttggtgtgaagttcttaagttttggacaaggaaccctgtattttcatttttctctgagccccatgaattatgtagacagtcctgcttcgaagttattatttatacaattcattatagagaaagtccttgggaaccttaactttgagtgaggattgcttgagttagtttttcttaccagccactccatgatactctttgttttttccaggttagatgatcgagttttattatgactgaatctgcacctgcaaaattaattctgattaattaatttaataattaaattctgatgatttctctctgatggtttgggtgtgggctcttaaagagggtttttttttgcaagaggatataacaataatcaggttaattaaaaaaataaggctctcaccc

SEQ ID NO: 21768 - DNA, 510 bp, Homo sapiens
gatcgacagagtggagacccggatcaccgctcgccttcgggatcagcttggcacagccaagaatgccaacgagatgtttaggattttctccaggtttaatgcactgtttgtcaggcctcacatccgtggggccattcgcgaataccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcg

SEQ ID NO: 21769 - DNA, 634 bp, Homo sapiens
ggaattcatatatggtgggtgtccatgaagtttccttatttccctttctacatggaagacttgctgaaggcagggattgtatcttcctgacctttgtatctcccatgatgtatgtcacacagaaatgaggaaggcttcaagggaaaggaaccagtttgactgcagctacaacccaagaagagatggaaagactgtaatcagccgagtagctacactgggaaggtgattaaagagctttcattttaaaaggctcgaggtccagagggtttcatgggtgtcctctgtctgacctttaatgaacaggtggctccagtgtatttaaactattccggaccataaagaagacggaaatttctataactcatatcatgaatccaacacaagcttaatagcaaaagatgacataaagaaattattgacgattctcctgaatgaacatagacacaaatactagcaaattgcatgtagcagtgtgtgaataaaacaattaagacttattctaggactataagggtagatgtgtattataaaaatatgtctacataattcattccattgacagaataaaagaggagaaatacattatagcaatagattgcagaaacatcatttagtataattcagcagctattct

SEQ ID NO: 21770 - DNA, 487 bp, Homo sapiens
cgggtgaactgcttgtttattaattcctacatgtgtttatcaaacccaataaaagctttggtcttaagggatttggaactttggagatcctgaaggtcagtgagtgtcttgtggtccgaatcttcctatagctccccataaggataggctggtcaggccaggcgcagtggctcatgcctgtaatcctagcactttgggaggccgagacgggcggatcacttgaggtcaggagttcaagaccagcctggccaacatggcgaaacccaatttctactaaaaatacaaaaattagccgggcgtggtggtgggtgcctgttatcccagctacttgtgaggctgaggctgaataactgcttgaacccaggaggtggaggttgcagtgagccatgctctcaccattgcactccatcccaaaaaaaaaaaaaaaaaaaaaaaaacccctgggggcctttttttcggtaatcccaaccttaaaaaaacccttggg

SEQ ID NO: 21771 - DNA, 607 bp, Homo sapiens
atcattgcggtgaggataggataagcatcctcaaatggaaattgaaaggcttgacaagacataatcttgaataaaatattatcccacttctacaggggatccaggcctaactagatgcagggcaaagaaaaagtttatctaggcaccgataaaggaaaatcaaaagtccttaaatctgtttgctggcttgtaacccatagcaaaaatctgaaacagatgtaagaaagacccagtgttaacaataacgccatctctttaaaaaagcaattttgctttctagtatttccttcaagaaaaaaataattaccaagtttctgtctatagatcaaaatgcgttaatttgaagtagtaataataatgatgcagaggatgacgaggatgatagatgataactatatgtgagacactattctaagtgttttagatttatttacttatgagaccctcactataatcctatgaggtaagcactattattatataatatggacgtacaaagagcttaaatgattttcttaaggaatatagctagtaaacgtcataatcaggattgtgaatcagtctggctccagaacaagtgatcttaaccactgtgctatacagtata

SEQ ID NO: 21772 - DNA, 593 bp, Homo sapiens
cagatcaagaggtagctggaatagattgtcgagggcattattgcatcatttatcagcaactgtggccccagaagaaaacgcaggtctgcgatcttgacttgctcctttcagtttcatttctcttgataatgtattgaattttgtgctcaactaaaacaacatcacagaacacattctagttttgtttactgagtaaaagcatcagatgcaacacaataggaaacaaatgacagcagagacatttgttaaagacaaggaaggcaattaaattaaagacaaggaaagcacaaggtgggtaggccagtggctcagaaaacagccccactgctagcatgactatggcttgagattaagaagctgaggatatgcagttttcttttaaagaaaaaagtgtattcaatatttccatttaagttgttaagtcattgctgtgaaaatatttcttggatactgggggaaatgaattttagctacccgaagaataaaagccatcgactagtttcatcgaagtcactaccactcaatctatctttactcactcaccgccaaagagtgagttggcatttgtggaaacttccagtgtgtgattattt

SEQ ID NO: 21773 - DNA, 567 bp, Homo sapiens
agaaagaagtcattgtagcagatgaaactcttcaggaaactgctggatagagagggtggccacaaaacctgttttacacctgttgcctacaattatcataagcatcattttttattctcagagtccattttgacagcaaattatatggtcacactgtggatagagaaacccaagactttagagcaggagtcatttaaaggagtaatggtagtgtgtgactgtgtacatagttcaaagtcattcttagtttgtataaaccagaaaatgaagctgagaccatattgctgggaagaacaaagctcactacattatcttgtgactaccaaagaaaaagagctaagattccattagcttgaatccacataaagcttaaagccaaattcgggctaattaaagtcaggctctgggaaaacaaaagcataaaagcagtaatcatgtctgagtaagatgaagtaacctgtgggtatgaagaaaacaaagaccaacaacagccagaaggaaggcagaaaaagcactttgggaggataggagtagatacaggcatcatatcaagttgcctggatgagt

SEQ ID NO: 21774 - DNA, 498 bp, Homo sapiens
agaggactaaatataatgggaagaagtgaagaagaggccagctgctggtctggaggatggcatagggggctgcagcctggcattttatttggtttccccctagactggcagcattcatgcccaaagcactagatattgtccatttataagttcagatgaaaattgagttgttcttggtggaaatgttttagtgactggtatcaagggttatgaaatcctgttttcagctcttcatgtccaatctaaactggaacattcaaaaacatgcttagcacacttacagaacttgttgggaacactcaggaaactcagctacaggcagagcacatggtcactgtggtagaacttgcagtgagacctcaattatctagaacctggccaaccacatacttgacctcactagatgtctttgtggcaccaaatgaaaagaacaggctaatgttggaaatggagtttaaataaacaacaacagttttaaaaatctttgaaaatgccagg

SEQ ID NO: 21775 - DNA, 566 bp, Homo sapiens
catcctgttacgagtgaaggcatggagacatgaaaattacatgtcatctttagggactagcagaggctacggtgtcgccgaagcatgcggatgaggttggaaaggcactcttagcacttgatcctcaccttcccctggggctgggaattagaagggaggagtgatctccttaagtgtggatcatctttacagatgtgaagagccattacccacccctccccaactgtgcaactgtgagtgtgtattgggaagatatgtcagggatatttgtggtatatattagaagtgttgaaggcattgtttttatagaaattattttagtaaattcttttttattattgggcacctcctatgtgatttgaagttgcttaggattttctaaaagattacataaaatactgttgaaaagatgattacatacaaaacataatctgttcattgttaaacgtatacgaaatgttgggatacatctgtgaacaagacaaagtctttgctaattgtgttctatttacgctctagtgtggagagacaaatgaagaaagaaatgtcagatagtgataagtgct

SEQ ID NO: 21776 - DNA, 585 bp, Homo sapiens
ttatgttgtttgtatcctagtgaaaattacacagaaacttatacctatcggagagcaaacataattgcaatattttgtgtaagcacgactcaagaatgtttggttagttgccttatagcccttggtttcctcacctgtcagagagagtaatgattttcttatagaattatgagaattaaataaaatatgttacatatattaaatgaaattatcctgtggcagaaattattctgtgtcagatctgtttgacttgaaatataatttatttatcataattctaagagaaaagcatatgtatgtgtatgaacatagatagattgacagttaattggctagttcctggcagttgtaattacataataaactctcttaactaacttgagtcctgcttatataaaacgttgcaattaggccaagtgcagtggctcactcctgtaatcttagtgctttgggagaccgaggcaggaggatcatttgaggccaggatttcgagaccagcctaagcaatataggtacatcctacgtctacaaaaaataaaaacattagccagacacagtggcatgcgcctatagtcccagctactc

SEQ ID NO: 21777 - DNA, 451 bp, Homo sapiens
gatatcttgaagccaggggtggtttaggattagggtatgtcagtgtcagatttggactctcagattccctcccctgggagctgcttcagggggtgccccagaaactcacccaccagcaccagctcagtagtttgtcttccaggtgacagccagaaacagcgtggctctcaacagccaggcattctgtggaattcctttcggcctcaggagtgaaggacaactgtggggttcagggtgttccgcaggcagcagtgaggcttcagtggttttcctcttacctgagcactttgtcacagaaactctccttttctctgtgtgtggggggtgtgctgtgtgcagtgtgatgctgtgtgcacataaacatttgataatctgtgggctgtcagctttgcttagtggtgggctttggaagaggtgaaagctgtgtgtgctgtaataacccgataccctg

SEQ ID NO: 21778 - DNA, 539 bp, Homo sapiens
gagtatgtttatgtgctgaggaaaaggagctaatagaggagcagctggagataattgctgcagaggaatgatgcccctggacaaaggagtcctagaaagcatttgcttgtggcctcaccttttataggaggacagttctcccactgattatgtggaaaaaaggtaaatagaggtgtggatgctaataagtttatggggcagaggaggattgcagaagaagctgggcatgtacttgcctgatggcttctattttgtgtgtgtgtgacctattagagtgctaaggaagtggattggatagggggcttaagaaagtggtgaaattggaagcaggtgttttaggggacccatggaaggatttgtgggcagctgaggttgggtgctgtgactgcgcaggggcactgacctgcatggttgttcattttctccaccagtgcagcagctaggaattcacgtgtctgaggttcacatgtctagggtcagacttctgctgcagagcaggggaaggggtatagctcagtattagaggtcaagagaattga

SEQ ID NO: 21779 - DNA, 546 bp, Homo sapiens
agagcttgagtatgtttatgtgctgaggaaaaggagctaatagaggagcagctggagataattgctgcagaggaatgatgcccctggacaaaggagtcctagaaagcatttgcttgtggcctcaccttttataggaggacagttctcccactgattatgtggaaaaaaggtaaatagaggtgtggatgctaataagtttatggggcagaggaggattgcagaagaagctgggcatgtacttgcctgatggcttctattttgtgtgtgtgtgacctattagagtgctaaggaagtggattggatagggggcttaagaaagtggtgaaattggaagcaggtgttttaggggacccatggaaggatttgtgggcagctgaggttgggtgctgtgactgcgcaggggcactgacctgcatggttgttcattttctccaccagtgcagcagctaggaattcacgtgtctgaggttcacatgtctagggtcagacttctgctgcagagcaggggaaggggtatagctcagtattagaggtcaagagaattga

SEQ ID NO: 21780 - DNA, 585 bp, Homo sapiens
cagcattggcactgttggctttttgggctggacaaccatttattgtgagaggcttctctatgcactgtaggatgtttagcagcatccttggccctactccctagacgccagtagcaaatccaccaccctccctcccctaccccagggttggttgtcagttgtgacaaccaaaaatgtctccagacatcgccaaatgtcccttggggggtaaaatcaccaccaccatacctcttttgactaaaagagtttccagaatagtggcagaatatataggtcaagcataacacattacaatcaagattcagaacatcaaagattcttttttaatcctaaaagaaaaagtttggaaaatctacaaaaagaagtgtgaatttgacaataactatttcactagcaagggtaggcgtaagcagaatacaggtagcatattcaaactgctgtggaaaaacaacatcaaacctagacttctctccccaaactatcattcagagtcgagggcaaaataaatagattttctgacttggaacaagtaggaataatgtacttatagtattcatcttcatacagggatggactataagtgat

SEQ ID NO: 21781 - DNA, 590 bp, Homo sapiens
tgagggagaaacagtagactagccaagcatgcatgaataacacattgaaagctttccttctcagaggtctaattctgcaaagctgcattttcaaagatctgacttgcctttgcatggaaatcagtcattcattcattggtcttctatgctgtacaaggccttctgctggggtgagggggaaactagggagcccggggacctctccaacatattctttgctctgtacacttaatcaagataagaaataaagacagcaagactgcaaaaagtctattatgtagacttgcaaaaagtctacataataatataaattcaagccaagtagaagtgattttgcaagtctgtgtatgattaattggctagtgaaatatatggataaaattagttgtaggaattaaagcatctgaagtgatctcttgaggctctggtggcaaagcagaaaggggaatttgaatttgaactaggtttaaaagtgtgagtagtagccctttcttttggcaggggaggtgatcctacccattctccttagagcctgtgcaattggtctcagtgtttctcaacatctaagaatgaagctgcattcttaatgc

SEQ ID NO: 21782 - DNA, 613 bp, Homo sapiens
ctgatctagtaagaatgtcaaaattgttactatatttgtacccatgctcttcggtttagagggcaggtgcttccgtgtgtacatagaagcagagcttgttggagaagaggagctaaaaaggaattagattagaatccacctctgtacaatggcacgctcccaaaagctcattgttaaactttcgagaattttgagagccagttgtaaaacacagccattataaaaactaaatcatataaacttacaattaaacacattatatgaagagccaagataataaatactcaaaactcttcctaattattttgctatgtttcactattatctattctcttgaggttagttacatctattgtggctatatggtggaaatactgtataaaatgctgtgcaactgagcttctcctcccaattcttcattcagtgatgtcatattcagaacttgaaattgaccatgatggaagtaattacaccacagaaatcagcccatgctacaaagcagactcccctcccctcacccaagaacttgttgctaaacattgactagcacatcactgaccctaagggatgcggtggtaaaattagcctctgcattggagagccaagcggaata

SEQ ID NO: 21783 - DNA, 569 bp, Homo sapiens
gtggtaaatgctaaaaccttccttctcaaggatagttcttttgtttgtttatttgtttgtttgttttcgaggcagaatcttgctctgtcacccaggctggagtgcagtcgtgcgatcttggctcactgcaacctctgcctcccgggttcaagtgattctcctgcctcagcctcccaagtagctgggattacaggcacacgccaccatgccaggctaatttttgtatttttagtggagacggggtttcaccatgtttgccagggtggtctcaaacccctgacctcatgatccacccgcctcggcctcccaaagtgctgggattacagatgtgagccactgcgcccggccaaggatagttctttattataccaatcacatctcccttgtgatttgattaacaggttttttttcccctgcaaactcaccacatagtcttatagtgctaacacctctagaacaatgtagagctccaactaaaggtttttttgtttgtttgttgtttaacttaattgaaactgaatagattactacattaattccctgaggaatttaggatttctatctaaggc

SEQ ID NO: 21784 - DNA, 583 bp, Homo sapiens
gggattacaggtgtgagccaccgagtctggccctgtgatccatcttgaagtaatgtttgtatattgactctatttttgtttgcttttactttaccctcacctgactgataaagttgagagatcctcattattttcttcttgtggggtaatggcagaagactgctctgtaacttttaccaaacaccttaccgagttgctgcagccaattcgtttatatgtcactgaaaactcagacaaatcgagtcatttctctgctttttaaaataattactcctcatcacactttcagggcctccaggggcctggtttgaaagcagaacattcaggaaagccataggaaaacagcatcctggcttaacagctcattgagaacgggccaggatgacaatggcggctttgtggaatagaaaggcgggaaaggtggggaaaagattgagaaatcggatggttgccgtgtctgtgtagaaagaagtagacatgagagactcttcattttgttctgcactaagaaaaattcccctgccttgggatcctgttgatctgtgaccttacccccaaccctgtgctccctgaaacatgtgct

SEQ ID NO: 21785 - DNA, 566 bp, Homo sapiens
gctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccatggaggtgtggtatcgccctactctctcaagagtcggaaataagtatcctggtcctgtcggtgctggaacccggcccctcccctctttgacagctttctgcttgtgtcccctggattctccagctttcactttaataaacccagttttgccctccttgcggagcgattatgagttctagtgatgagaaattttttatttttctaagtagagcgccagcagtgacccatttattttgatctatttatctcgatcttaactcatggtaatgctaggttttaatttttaccccaagctaccgctccgtcttcctgctggaaagtggtagtttagaaaaagtagtgattgaagtcccaaaggtttcactagttgtgttctaattgttatttcatgaaagagaagcacttctcgtgaatg

SEQ ID NO: 21786 - DNA, 566 bp, Homo sapiens
caacccttaaataacaatatccagataatattgttaccagcggtgagtccagctatctggagaaactccagaatggcaactttgtggcaatttcagttctttgtcttctggaaggaaagatttcaaatgagagacacaggcaaggtttaaagcaggagggagaatttattttaagcaaagcgagaatttattagagagagtacacttgaaggagagccatgtgggtgacttgaaaaatcaagtgtgttgtttgcttcagtcacgccccccacatccatgcctgggcagttgtttaaaggtattttgttcctaactgcctcccccattatcttcatgtacctggaatttgtgatacaatgaacaataatatagccaatccatagcttatgttattttaatgtaaattctttgtaaacaacttaggaacagcctcttcctttatctttaaaatcccacttgtaactgctactaattgaagtgtatattcagggcacttgaatctgtgctcccactgagctgttcttaagttttgggctctggtgaactctaaacttagtcatagaata

SEQ ID NO: 21787 - DNA, 198 bp, Homo sapiens
tgagcgtttttcctttggaaattcatactacaccctcgttcccagggaaggaaataaattgatcggtattgcacaagaacgagatctttgattcgtgtcaagattcgtttctaaccaaccagccagagctgaattgtttctcggtggtgagcctggcctaacaaacgtatgagaggagaggtttggattttttttttt

SEQ ID NO: 21788 - DNA, 614 bp, Homo sapiens
ggactcagtggtggaggatggcttgaacagacagattctgtcttaactaataagattggaactgtattaggattcaacgtgggcagaagtgctggtgggagatcgacggtcagggagattaaccgagatgcttgtcattttcctggttttccagtccttcagtcattccttcctaaacacactaatgtccctgccctctattttctcctcatggccttgtttctgcagcagccagttagtgagctgcctgagaacctgcaggtcagtgtgcctgtcatcagctgccggagtaagcagggttgccagtttgatttggattccatttggacattcatctttggagttcctgcctccagcggaactgtggtctcttctatccataacgtatgcacagaagctgtttttttattattgggaatgctccgcagcatgctgacttcaccttggcaatcagaagaagagggatcttggctccgagaatatcctgtgaccctgatgcagttcttcagatatttgtatcacaacgtgccagaccttgcctccatgtggatgagccctgacttcctgtgcgcattagcagccaccgtcttccccttcaatattcgcccttactc

SEQ ID NO: 21789 - DNA, 459 bp, Homo sapiens
gtgtatgatgacaactcggtgatgctgcatactcccgagtgcgcggtggggtaggcctgagagccgaggaaaactgagcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatctt

SEQ ID NO: 21790 - DNA, 78 bp, Homo sapiens
agtgttacttagagtatcctcactttccctttttcttatagaatgttgttataatgattcatttaattatttaatatt

SEQ ID NO: 21791 - DNA, 595 bp, Homo sapiens
gggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaaggaaggcagcggcatgcacaggatacggctgaaggagatgatgtcacctacatgctagagaaggaaagagagaggctgactcaacag

SEQ ID NO: 21792 - DNA, 552 bp, Homo sapiens
gagccttttttttggggttgtggggtgtatacctaagtagtcatatgttttcacatggtcagagttttgataataatactctacctagcttctgaacagtttaataatagatttaatccgtgagaggaaataccctcgaaagttactatagaaataacaccttactatctggtggcatttacttagttcttagaactgactaattagtttatcggttaaagtaatttgctattatattgtaaaatagtacatttgaggctcacttataaaaattggaaaacatcgaaatataagaggtccaagagggtgtttgaaacacattttgctaagttgacaggaaattaatagactttttatgggccattaactaataatacactcaaaaaaaaggtacagttaaataaaggttttaaatagtctataccgtatactaaaactaaattaatatttaggactgaaataacatatcgattaagtaccagctatgtacccaaaaaatgctgggcacagaagttagagtaagatgttttacttaaagggcctttgagtgag

SEQ ID NO: 21793 - DNA, 619 bp, Homo sapiens
caacgtgggcagaagggctggggggagatcgacggtcagggagattaaccgagatgcttgtcattttcctggttttccagtccttcagtcattccttcctaaacacactaatgtccctgccctctattttctcctcatggccttgtttctgcagcagccagttagtgagctgcctgagaacctgcaggtcagtgtgcctgtcatcagctgccggagtaagcagggttgccagtttgatttggattccatttggacattcatctttggagttcctgcctccagcggaactgtggtctcttctatccataacgtatgcacagaagctgtttttttattattgggaatgctccgcagcatgctgacttcaccttggcaatcagaagaagagggatcttggctccgagaatatcctgtgaccctgatgcagttcttcagatatttgtatcacaacgtgccagaccttgcctccatgtggatgagccctgacttcctgtgtgcattagcagccaccgtcttccccttcaatattcgcccttactcagagatggtgactgaccttgatgatgaagttggatctccagcagaagagtttaaagcgtttgcagcagacacagggatg

SEQ ID NO: 21794 - DNA, 286 bp, Homo sapiens
tccccttcaacatctgtgaagctgtgagttaaggatagatggcaacctaaaaacgaatgtacggcacgtcagtcatgtttcagagcaaactggatattggtgaattcataccagtgtggaaatccattgacaccacaaaggcaagcttttctcttacttagccatgaccaatggtcacagcatctcactaatctgtgatataaattatgtggcaaatatctaaagcaacaaagttgccaggatatacagcaaaaacagtgttccatagaaacatggaaatggtatg

SEQ ID NO: 21795 - DNA, 505 bp, Homo sapiens
aggacataatccatgggcctgtgtccaagcctgttatgtttatcataataagaatccagggctaaaagatagcatgaggaagccaattgcaggtcaatcgtggatcagacccctgggactgatcagaccagagggttccctggacatcagcatccccagaatctccccctagggcaagagaggcgaggacgggtaactcagaaacctcagtgaccacagcttagcaggaatcttttggcgctgagctgtgtatacagatttgccctgccagtgggtaccaaggtgccacttcaatagcctaaatctcattctttgcaattgaagcaagcattttgattctgttcctgaaaacaattctgctcactggggaatgcggttatgcctgttactgcccttctgagtacactttaaaatcttctccgcaaacccaatccaatatgttcacagcaaaccaattaacttagggaagccttgctttgggttagaaaacacttctgggttctac

SEQ ID NO: 21796 - DNA, 425 bp, Homo sapiens
gttaaaacagaaaggaagacaatgtgctaaaacgaaaaggaggacttaggaatgaatcctatctactttttacatgactaagaccattttaaatagtactggggaataacttcaaggcaagaaagtgaatgaaaagctctatgtatggtgaaactatgagagacctataatcccaaacctcaatctaatgtgaaagttaatatcaaattgagatgcaaagctggcagaccattattcgttgaaataagtgcatatgctgatgaatatcaagaggacaaaagctctcatttgatcccagggagataagttatagacttatggtagcagtttcctgggcccagataagcatatagaaagaatgaagaggggaaggcagaatgagtcacacagatgagccatgtatgtgcaggaggaaggtattgagt

SEQ ID NO: 21797 - DNA, 445 bp, Homo sapiens
gtagagtaaaatgggggttgggggaactcctcacccatgaaatgaatatcttgtgagcgggttagtctttttccatctattgagtcagaatctgggtgagtcacacacttcaggtgacagatgccaaaacaccctcaaaattaaccaaagggtgctgcttagccttgcagagcaaatacaaatattcaaacaaacatctctccaaaaggcacctctccactttccgctaactaaccgtctgtgctatgtctttacctagagccccgtgcttgggatgggaacagacgtgttcctgcacagccctattattttcttgtcagaagcctgattagagtgatggagaggtttataatgtgtcctgttttcccctgtaaaaaacacatttctcctaaagccatttaatatttcattgccagaatatccagtgatataaaaattctgaaac

SEQ ID NO: 21798 - DNA, 194 bp, Homo sapiens
ttttcctttggaaattcatactacaccctcgttcccagggaaggaaataaattgatcggtattgcacaagaacgagatctttgattcgtgtcaagattcgtttctaaccaaccagccagagctgaattgtttcgggggggggagcctggcctaacaaacgtatgagaggagaggtttggatttttttttttttg

SEQ ID NO: 21799 - DNA, 559 bp, Homo sapiens
cagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtaaaaccactgcgaaaatttccccaaagcataggtggctttgtgtgtgtg

SEQ ID NO: 21800 - DNA, 657 bp, Homo sapiens
acggtcagggagattaaccgagatgcttgtcattttcctggttttccagtccttcagtcattccttcctaaacacactaatgtccctgccctctattttctcctcatggccttgtttctgcagcagccagttagtgagctacctgagaacctgcaggtcagtgtgcctgtcatcagctgccggagtaagcagggttgccagtttgatttggattccatttggacattcatctttggagttcctgcctccagcggaactgtggtctcttctatccataacgtatgcacagaagctgtttttttattattgggaatgctccgcagcatgctgacttcaccttggcaatcagaagaagagggatcttggctccgagaatatcctgtgaccctgatgcagttcttcagatatttgtatcacaacgtgccagaccttgcctccatgtggatgagccctgacttcctgtgtgcattagcagccaccgtcttccccttcaatattcgcccttactcagagatggtgactgaccttgatgatgaggttggatctccagcagaagagtttaaagcgtttgcagcagacacagggatgaacaggagccaatcagagtactgcaatgtgggcaccaagacatatctgaccaatcacccggctaaaaag

SEQ ID NO: 21801 - DNA, 623 bp, Homo sapiens
ttccttaaaatgtcaaaatgaaatattatctattaaaacagaagaattaaaataaacaagagaagttaggtattggtcatctgatggttgtaacctccagctttcccaggaaacttggttggacccttttcttgtgttcagctgtcagaagctaaatgttcccttcctctctctctttgcagtctgttcgtgacatttggtattcctaatatgcccacttggaggaaattgccagcttaggccaaccagggtgaaatgcatgcgcttataaactcataagcccaataataattttcagaaggaggcactcattcacttcggcttataaacttacaaatctgtagattcattagtctatcacttacatggaaagacaaaatttatatttaattgttgagacttgacttgaaaattttcaagaatatcaacatttgtttttgttgtgcacctctctgtcaaaagataaatacgtagtacagaatcattatttatttattaataatatactctgcatggtcttacatttcatagttcatgcattgtttattcattaatataacctgttaacgttaatatgcaccacattaccaagagcccttgtcaactcctcagaagccactaac

SEQ ID NO: 21802 - DNA, 468 bp, Homo sapiens
tagcctcccgagtagctgggattacagtcatgtgccaccacacctagctaatttttgtatttttagtagagacagagtttcaccatgttggccaggctgttctctaactcctgaccttgtgatccacctgcctcagcctcccaaagtgctgggattgcaggcctgacccactgcgcccagccaagaccttcttttctatcactgatatatgtctgttttcttaactctttcctagaaatccaaatattttgctacattagaaagtagagcagaacaaactattgaataagtgcatcttcaccacaacttaaacattatgacttttcactccaccctctactgtgtagatatatcacaacacattcaaaattgtgaacagataatgttagtagctgcagtatgaccctaagttattttagtgataaactactaataaaaaatttcaggccaggcacggtggctcatgcc

SEQ ID NO: 21803 - DNA, 571 bp, Homo sapiens
aacattgtaatacagagcatccccaattagtattcacaaagtttattctaattcagttgtatattccctcaatcaccctaaatcacagaagcagtctttctcagaaatggaaggcatttcagcccagcttcctatcccaataggagtcccttttacaagcatccaggtggcttatcatttagcctttgcttggatgctttcttcaatgggaaacccacacctttctgaggcagctcattgggatttttttccaaggtcagtggggaaaaaaacccaggtatttggggcatatagtgtaactggtgattgttactgatttactattttgcccacatcttgtcttttgttcgtgatagttctgtgggaattgcctattcctggtataccaggaactctcttgttcttcctttgaccctcatccctaagttacaacaataacttaatctcccactataatttgtttccccagaaacagaaaataaggtttttgggatgagggtgaaatgagacagagtcattactagtaaatttgactcctggagcatgactttgccattaaatcaacttttgg

SEQ ID NO: 21804 - DNA, 594 bp, Homo sapiens
tacacggttttaaaatatgaatggggccataatatgtctattattctaaaatttgattttaaatactcaatttttttagagcagttttaggttctctgcaaaattgggaagaaggtacagagagtttccatatatacactccccgctcccccactgaagtagctgtggagtgacttgtaaagaaattgtggaaaacattccctatcagcacataaatgaaccaattatttaaaaaggtggatgaaaagccatgttgtggttataatcaacatctatttaatcagtccatatttatggacttaaagatgtttctggccaggcgtggtggctcacgtctgtaatcccagcactttgggaggccgaggcaggcggatcacaaggtcaggagatagagaccatcctgtctaacacggtgaaaccctgtctctactaaaaatataacaaattagccaggcgtggtggtgggtacctgtagtcccagctactcggaaggctgaggcaggagaatggcatgaacctgggaggcggaggttgcagtgagccgagatcgcaccactgcactccagcctgggcgacagagtgagactccatctc

SEQ ID NO: 21805 - DNA, 496 bp, Homo sapiens
gctagccaagtgtccgttcgaggtgatccagttgcctttcttcttccaattgctgagctggattcttttaaaacaaacattttttgagctccttccacaagcaagctaagtgcaggtcataaaatggtgtttttggctggacaagatagctcacacgtgtaatcccagcatgttgagaggctgaggtgggaggatcgcttgagcccaggagcttgagaccaggctggacaacatagtgggaccttgtctccacaaaaacatttacaaaagttagccaggcatggtggcgcatgcctgtattctcagctacttggaaggctgaggcaggaggattgcttgggcccaggaggctgaggctgcagtgagctgtgattgtgacactgcactccagcctgggtgacagagtaaaaccctgtccttaaacaatgaataaattaaaataaaatggtattcttgtccctcaccttccctgacaccatagaacctataggatgct

SEQ ID NO: 21806 - DNA, 641 bp, Homo sapiens
attgcatagtttcagatagctagaaggagtttattaaatgttcccaatacaaagaaatgataaatgtgtgtgatgatggagatactaattaccctgatctgattatcatacattatatgtattaaaacatcactatgtacctcatgaatatgtataattattatctgtcaattaaaaaataaattttaaaagaagaagaatacatttgactaaataaaaataaattttgcatggccaaaaatacaagcaatttaaatggaaatctagcaactgagagaaaatatttacaacataaagggctagtaatatttctaatataaaaagtcaaaaactgagggaattaaaaaacaacaaccaatgggaaaaaatgacaaaagattttaacagataagtcacacaaacacaaacacacacacacacacacacacacacacacaatacagaagtggtccttaaacatagaaaaagatgttcaacttcatttacaataaaataagataaatgcaaatgaaaaatacactgagttaatatttgtgatcctgtcacctggcaaaactaaggagcatttgctgctgaattctaccaaacatttacacaaaaattagtatcaattgtactcaaactatttcacacaactgaag

SEQ ID NO: 21807 - DNA, 657 bp, Homo sapiens
ggaaagctgcttctgccccattcctgttttagcaagtcctcattgttctggtgtctgagccctgcctctgaagcagagtcccaccttctacctcattttgtcacaaggtctcaagtgcacatcccatattatttctaatacggtaatgtttatgaatcaatgactgtagttccacaaccaaacttccatgtgattaaataataaaagctgaacacttccatgtgactccatgtttcagcacagagaagacttaaactttaatcaaagaaccaaaaaaactgggagttgcttttcttcctttggtgaaagggcaacaatttttttcccctttaggtctcagagtgctcacatttttctggcccccatcatccctcataaccactcttcagtgcaatctgatgatgtaccaaataatcttgaggatttttcctttagattctacaacacctacaaatattttagaatgatttaaaaagtgattagaaatacataaaccagggctgggtgcagtggcttacgcctgtaatcccagcaccttgggaggccaaggtgggaggatcataaggtcaggagtttgagaccagcctggccaatatggtgaaaccccgtctctaataaaaatacaaaaattagctgggcatggtggcacgtgcctgt

SEQ ID NO: 21808 - DNA, 412 bp, Homo sapiens
gtcctctcctggagagggtaaacccgcccctgaagtggtcaccccagtacccagccttctcagtctcctcccccactccttttgcattaccgccgtcctttactgtgccggagccttaggatctacaatatggctcatttcagaaaagcttattttgaccaagggattggcacaaattctatggcagcagacacagatgagaaacaaacggttcactgtgctaaacggggtgggggtgagaaaaaaacaatccagagtgctctcttctactggccttagctccgtatagatccgtccttgctgggctctgtcttaagaacgatacaatttaaagtcaaagaggaatcgctagagttagctctagagtaaacctcgttttgcctattttgttccctttttagagatgtgaata

SEQ ID NO: 21809 - DNA, 459 bp, Homo sapiens
tgagaatccacgtgctagcattctaaaccacgcaccaccccgagaggaattcccggtaagcagtggggccgactgaaacccacaatgctgtctttctaaagtacaggctcccacacagacctgctttgctttaaactgtcattacaatgaaccatcacttgaaaacctccatgatcttgacaaaattggaacagtgatataaaaataaaaggtcagaaaaaccatgtatgatagagctgagctggcctggtatagatttcttcaaagacctcctttgctcactactaaagccaagacgatgtgtcaaagttgtttaagagaggaatcatttttaatcaatgtgacctcagctttccaaggtgcttaggtctgggaacacttaaagtacatctgttattattttggttgtgctgaatttcttattttatatggtttcatttcaagaggggctatttgagg

SEQ ID NO: 21810 - DNA, 368 bp, Homo sapiens
agataagccagtttaggtgaaatgaaattctgacctaaatataaaacaaaagtttcatttctgcctctttgctagaaaggttccttattcaaaataagaactcctaagacatttaaaagaagagctgttcctcggctgggcgcgggatcacgaggtcaggagattgagaccatcctggctaacacggtgaaatcccgtctctactaaaaatacaaaaaattagccaggcgtggtgataggtgcctgtagtcccagctactcgggaggctaaggcaggggaatggcatgaacccaagaggcagagcttgcagtgagccgagattcaaccactgcactccagcctgggagacagagtaagactctgtcta

SEQ ID NO: 21811 - DNA, 574 bp, Homo sapiens
acctaatagactgcagaaaaagaaaaagctaagtaccattcaagattttttagccactgggttcagtgtgactgcaaaattaggctccagacaagtttttctgattgcaatgctgctctgagcaggccatccacacctaccagtgaatcgaattgctctcgcgggcaagcaaacaggcgtccattaatggtgagcgtcgtaaatactgaaacatcattaggtttgagcaccaccttttctgtgaacataaaaagcatgagattgcctattaaatacatctgagatttgctgcactgccctaatcacaccaacaaattgccagcttggtgaattaccggaacacgcagagtgactgcataaaatagagtactgaagggatccacggaataaaaaagacggcattcatgcagccctgcgccactcaggatgccttcagaaatggccacaaaaaggaatagagatgccagagggtcaattcacccagttttgtgctgcaaccataattactgagcacataaaacccgcacttgctatttatctcacaagttatgtttccagatggtaatcacaccca

SEQ ID NO: 21812 - DNA, 304 bp, Homo sapiens
tcctttccttttagtctttatctcattgttatatgtgattataatgttgtcatttatgcagttgtatgttctattttaaaccttaaaatttgttacttaccaactttttgaatatgcctgactgaaatgattcatactgtagcatgtgtgactcagggtagtgaaagggggtttgttttgaatagcaagatgagcatcagactagtcttccaccagaaaacattccatgcaacttgagacacagatgaaacagcaaattttcttcttggcttggggttggataaagggtggattgacttatgta

SEQ ID NO: 21813 - DNA, 484 bp, Homo sapiens
cccccatcaacaaatattagtctgtattttttcattttgtttaagatatattttctcatagctgagtttttaattggtagttactttagctatgtattccagatgatatattttgattctttcagctattcttaaaaaataaaaccagtgattttacatttgctacaaagtgaagttttaaatgatagcaaatatcaagaatcaacatttgttaaactacaaaacaaaaagacctggaggaaactagtaaaatgttctgctttaagaaagccaatagggccgggcgtggtggctcacgtctgtaatccagcactttgggaggttgaggcgggtggatcacctgaggtcgggagttcaagaccagcctgaccaacatggagaaacccccatctctactaaaaatacaaaattagccgagcgtggtgatgcatgcctgtaatctcggctactcaggaggctgaggcaggagaatcgcttgaacccg

SEQ ID NO: 21814 - DNA, 308 bp, Homo sapiens
aacacccggaagagtgcctggcacatggtaggctctcaataaatgtttactggacaagctaattcatgcaatcaatccttccttcacttgccatgtatttctggagagtctacccagtgtcaggccctgtgccaggtgcctggattccagctgtgatgaaaatgcaggcctggtctaaggatgaaaagtcataattaaagaatagggagagggggacgtgatagtttcagaaacaggatcttactacattttacaaaaacctcaggaggcaggtattgttcttattttacagatgagggacgtgaaga

SEQ ID NO: 21815 - DNA, 366 bp, Homo sapiens
tgtggggtacattgtcaagccacaaacataacctgctctgtaataataccctcctacattggtatcttgctttggcacagtatgattcaagtcttaatcttaacactaaaattaagtggtttcactctattaaaggcatcatcctcaactgaaactcactaaagcatatacacgtcacgtggaacagctgaacacaaagctcttaatctgaagttgacctatttagtaaacctatagctcagaatttgacctcatcacctcagaaaatcagggataaaatctgtctttatattgtttcaggtacttgggtatcagagacattatttgtttatcaagacctaacaaaacactttcttattttttaaa

SEQ ID NO: 21816 - DNA, 580 bp, Homo sapiens
gggttcaatatcaaagaaattatctcacccagactgatctggatattggcactattaagtgccccaactgttaacctcaaagaccattaaagttgctcctaacttgtttccaagatccaaactccttaaagtagggcatgaagtgaaagtgtgacctaaactgtctatgataatttgggtgttacctaagttagcaaattataaaattgggcttgtgcatcagcatttcactgaaacctggagagaaagtgtatgaagacaaagaaagactgaaagaaactagcacacaaacagaaagcttagacatccagaggaattgttcccactgctttccttcccctccttcacaccatgctctgcctacatggggagttttccatgaccacttgatggtgaaggagaaaacatccagtacaccgtatgtcaacagtacatggaagtggagaacttctgtctcatagccccattcaggcaagacctaaagattatagtaaagggactaggtgcagtggctcatgcctgtaatcccagcatttggggaggccaaggtggaccaatctcttgaggtcaggagttcgag

SEQ ID NO: 21817 - DNA, 581 bp, Homo sapiens
gcaattatatttaaattacacctgctcctattccattaactagcatattgtatggtgaaacccaacttcacagacgcagaggaggacacttttccttatcatggggcaaggaaatattcatatttgtgagcaataatacaaactactacagttcttatatgtattctgttaaattcttggtcctatgctcccccgaaagagggttgagcacctattattgcagtaaccacatggaaagggaagagagtaagagaaaagcacctttaattaattcaaaaggataaggtgcagaaaattaaaaaaactgagccatttgagataaggaattttaatgtcttcacacagtattcaattctaggaatagactaaggtgaaacaaattactgtgaacatgcttctcattgcaaagatttagaaatacaaaaatactttatatgtacattatttagtagggaagaaatgtagctccttggcattggacaagaattgggagttgaaagccaatgtggtagacttgagaaggtgatactgtggcagtcctgtacatttagagaatcgagaaataggccctttgtgttaag

SEQ ID NO: 21818 - DNA, 602 bp, Homo sapiens
atggaaacttgccacatattaagacacaaaggaaacttcagtaattccacaaagcagagagaatctaaacatattctctaatcacagtacagtaaaactagaaattaaagactcaaaaattccctactggaaatgttactaactctatttaatttgttcaaaatggtaacaccttgtatcagaatccatgatgcaattaaagcaatgaggcaaagaaaattacatccaaaatgaaaaagaaacatcaaatgcaaaattaggaaaagattaaagtaaacaaaggagaaacagttgcaaaataacaagcaaggctgggtgtggcagctaatgcctgtaatctcaccactttgagaggctgaggcaggcacactgctttgagaccaggagtccgagaccagcttggccaacatggtgaaaccccatctctgctaaaactacaaaaattagccgggcatggtggctcacacctgtgatcccagctacttgggaagctgaggcaggagaatcgattgaacctgggaggtggaggttgcagtgagctgagatagcaccactgcacttcagcctgggagacagagtgagactcctccaaaaaaaaaaaa

SEQ ID NO: 21819 - DNA, 377 bp, Homo sapiens
catacttttcaaaaatgttcctgcctattgtaagttccttgtgagcagtgactgtttcatggtattgtcacctgcacagttcctggcatttattcatgccttgataatgttaatgaagtgaatgaattaatatttggatgtctgtatccttcacaataattgtactgaacaacggcggtatatatatccatcgaataattcctgctcatagtagcaagcctccagtgtttcacctccaaaaatgtccagaataacaacagctatccttagtcaacattttccattaccaaacatttggctaaggaattcacactattgcttcatctgtttgcttcaacaatcccatgagcttagatagagcaacttgctcaaggcta

SEQ ID NO: 21820 - DNA, 590 bp, Homo sapiens
ccatgggaatttttcctgccaaagagaccacctcttcttaacacaggtcagtctccagttggtagatgcctttcactctcccaatggcaggcatttcaggagaaacaaactttttgtcagcactccttaaaatataccttggaggtgactgcatgttctgactaagcctaacactagctgtgttaggtactttggatttgcacactgagttccctctggtgctaattagtattaataaaatggaatttgttatagcattttcattaccaaaatatagtaagtaccaacatttataaaagattttgagcctcactaaaaaatgaggtgaggtagcaactttttatcaccatatgaaatgttttctgtaaaatacaaaaaattaaatctttaattactagaatcaaataaaaaattcacttgtcaaggagtttctttaaaagatactagaaataaagtctacaatattgcatcttctcatctctcttttgaaaactaatttcaagaaaaatataagcttattattattctaatttatatcataacaacttcactctatagatacatgtttattcaatacattagacatcttt

SEQ ID NO: 21821 - DNA, 417 bp, Homo sapiens
  misc_feature 90: n = A,T,C or G
aaggagaaatccggttgttgcggatcttacgtggatgctgatgtatcctttcctgggtttttaatatctttagtcaaaggaatttatttnaaccgatttcttcactatcacccaagagaatcctgtatctagttttcctgacccttagaaatccattgtggtatgtgtcaactcagctaggcaaaaagaaaaagcaaagaatccattgtgggatggatgtgctggttaggtgcagatgcctatagagataggagcattagaaatctagtaatagaaaatattagcaaagactgattaaaacctcctttttctttgacgttgcctagaatatatcatttcattgtagttataatgatgaacttggcttgtgactggtagtcattctaagtatttgatcaacgaagcctaggaaaaaaa

SEQ ID NO: 21822 - DNA, 577 bp, Homo sapiens
cagaaggggattcctgactgggaaggttgcttgacaagtcaggattgtgcctccagtcagaaggaccatgaagagagagaagagggcagagccgtgcatggggctgctccccaggacctgagcaggaacctggagttttcaggtgagtggctcacctgtgagcaggatacctgcctgctcgcctattggtctccagattgactagttacctagctaacatctttcctagtacctgtttactttctttccttcctttcttccttggcgacttctttcccttctccctccttcctttccttccttccctcccaactatctgctttctcagctgcctaattttcttcctccttaactaaccaacttacatcctcacttccttcccactgacttcattttttccttttctagctttctattgtcttcctgaaattccaggccgtgggctttgcagtcagatggcctgggttcaaatcctggttatgtcatttattaactgtcttgatcatgtcacttccctgtccttgcctcagttttctcctccttgaaacagggacgatgatagttcctaacccgtggg

SEQ ID NO: 21823 - DNA, 390 bp, Homo sapiens
aggttattttaagcaataaaaatgctttccaaaccacgaagttgttaaatgtacactaaaagggggtgtaacggaattattttcattctgtgtttgaaaatgacattgtatcttgagagtgaccatacaaactctttgctaaatttcattaattgaaactcatgtatgttcagacaatttttattttcataaaagagcatgccaggctgggcgcggtgatcacgaggtcaggagatcgagaccatcctggctaacacagtgaaaccccgtctctattaaaaatacaaaaaattagctgggcgtggtggcgggcgcctgtggtcccagctactcgggaggctgaggcaggagaatggcgtgaacccgggaggtggagtttgcagtgagccg

SEQ ID NO: 21824 - DNA, 567 bp, Homo sapiens
ggatacaaagtgataaaaagcggtttccattctcaaagatctcacaacctacttggaacctcagaacatacacatgaaaaaatagaccaccttatgaaaaagctatgcaaactgtctacacaagtggagagaaaccttcaaacagagctgggctacagtcgctgtttccctgatcaaaccaggcgcacctggcaaaggagagggccaaggaaggacacctgtcctcatgagaggcagggggcatgggctcctgctctcggaaagatgctgaactcttctgactggacaactctccaaggggcacccttgttagcatgccttgcaaatgagatcgctgctgtattctgccaaatgaactaaggaaaaatacgatcaaaaagaaggaagttctactgctatgtatcttactgactgtaattaagaaaaataaaatgaaaaagaagaaatctcaatgtgggactctcaagggtatttccccaaaatttaagaatgaagctataatcgcaagggcctcaggctagttagtgactctgactcacctaaatcttcatcgagcttcgtctttgg

SEQ ID NO: 21825 - DNA, 601 bp, Homo sapiens
tttggatttttaagcttgttttccttaccaaataaattattgtcttagtttaattatttgcatttgagactaacccttggccaataatgatgtacagaagtccttcactcctggaaagctgaggcttacaacaataacattaggttttcccctcctaaaataaaagtaatcatagttcatatcagggcagaaattcaatccaaattctaaaagatgtgtcttcagaactctgtgcttcttaatcaaccaatagtgtgtttgagacaggctagaaagccaactatttttcttttattgggaatattgttgttactatgaaccttaagtggctcaagaaacttagatttaacctttaaaaggatacctttgattttagtattcccttgagactaaactaagtaatgcacaaagaaagatagtcaagtaagatgacagtctgaaaagagaagctcctttcattccagacagaaacttgctgactccagagattagggcacatcctggctccaatataagcggcaaacaggccagggtacaaatgacaaatactgaaagatatgagaggaaaaaattgaaacatggcgaataattctttcattga

SEQ ID NO: 21826 - DNA, 580 bp, Homo sapiens
aatcatgtgtgcaaaacatgggggaaaacatactttaaactaaaatatagttttaagagacaaatgtatatgatagtttcaagactggcaactagtgctgataatttatttttttgctaaactaattatgcctatttttactactgtcattctggctatcagatatctttctgttagatatcaaattcccagagagccatgttctacccagaggtgtttctttgctctgtttctgaatcggaaaggaaaacaaagagcagtaaaattattttcaagagattaatcataatgtcaagaacaaagctgagatttgattattgacttagaattctgtccactagattatacccttactaattatctatttttcttcactgtgaatctgtcaggctgaggtcacacagtaactgggaaacttgctactccctgctatcttttagccttgaattaggcctgtccaacccttgggactttcataagggaaataaatattttgtgagggcaagaagggcagcttttagaaataaattctattcttttccttattatttatagctctgaatgatatttaatttaaagc

SEQ ID NO: 21827 - DNA, 450 bp, Homo sapiens
gtatcttaacagtctggcagggggtgaagtctcctattgataagcagggcctacatctgctactctactgcagaggtgggtatctaacaactgcttccaaagagtcagtttctcccagggcttgggaactcctttgggagctacactaacttctaaaacatcagggaaccactgaacaaattatcatttcagtgcactcagtgatatcctaacggcctggaaacacagtcctaacctacctctagggtcttagagaacagttcacacagaaggaaatttgctcaataataataacaatgtcaagatactaacatatcaaatagtcttagagggaggctcttgagctacacttctccaggtgaattagcatcttcccttaactttccttcccagcaatgaaaaatgctcaacatgcagtaagaagagttttttgtttgtttttttgctttt

SEQ ID NO: 21828 - DNA, 585 bp, Homo sapiens
ataagccgattaaaaaattgtggcacataaatgaggtcaaagtcaagaagacttacaccaaagcagggatttgcttattttagatccaagccctatctgccatcttactcaaaaatttacagaactaccagcaaccagctcttccctcaattggaaagagaagaatgggctgttttctggctttttgggaagatgcttaagggagtagtctctgtctagcctgactcagaacactgattggaaaggcagcataggatagatgccaggttaggagctgcaaagaaaaaattattgtgtgaattacagtccaagggagactgaagtagtacatacagatacaatgaaaagtaagagagtataggctcttgagaagaaaacagtcaagcctctgtcacaggaaaattacacatgcaaggccagagatgatgcatctccagggaagggctgagaaactaagctagcctgattggtgtaagtgctctcctgtacaaacccatttcagaagactggaaagaggttttttttcatatacttaaataccaagagaagattacatggtatacaaaaaaaaaaaaaaaaaaaaaa

SEQ ID NO: 21829 - DNA, 423 bp, Homo sapiens
acaattaggaagtggatagcattctttcttccatttcatagataaaggagacaagacagagttctaatggaggcattgctttactacagaagaaacaatttttgatatctttgtaagaaagctatgctcatataacataccttattgattccttaaataaaatacattatgtaacagctctcaacggagtaaagatgggatgtggctgagcttttaagttgttttcttaaacatgattgcagttctatgtttaaaaatgagtcaagaacatctgcttctttctagggagatattccatggcttcttaacaactgctctaacttttgtggcagctgtctgaaagttagctgtctcttgaggcagtgatgtctttatcactagggggttttcactaaaatcttagtgatgacttgcagatgtcat

SEQ ID NO: 21830 - DNA, 624 bp, Homo sapiens
tgcatatagtttttgtcttagtgaggtgggatgagtcttaaggtaatttattgagaacagagaagggaggataggttgacaaacaaacattttcaagtgttgtattttggaaactttattaaatgcctactcaatatcagtatgtgaattttacccacacaaatgaacctattcaatagaaattttcttaattactcaacgtaatacacatgcacatgcgcacatgcacgcacacacacacacacgcacatacacacaaacataacccagcctccactacttaagatgagagtatagtctagttaaccaggaggttatgagagttcagataaagtttgtcttttggcgtggtgacagaagcacaaacttcatactgaagacagtctttggcctgagcctagaaaaacagggaagatctgtctcctctgaaaacaggactgtaacagaatcccctttgagtgccaaaatttgtatttgtttacaatgaagagaaaacaattaaaataacatatatgcaatatttcgtgaacagtaatgtgccatataataagtgtcagtcccaccattactgttgttaatgtgtgcattatgattccttcaatccatgcactcttgctgttaaac

SEQ ID NO: 21831 - DNA, 621 bp, Homo sapiens
caatggcatggaaatgacttagaggaattttgcactccctaggaccttctcttcctccttaatgtatttattaatactacacgtttaggattttttaaactgttttaaaatattaagctgaaaagattggtctgtcaattaactgaaaacttgaagagcaggcaatttttattcccatgtttatatcactgtttcttttatgcaactttagccctaggcaaagtagtggagtcagtaagatttccctttcatacccatctaacctttttcagtgcctgtctcttccattttgtgtcttctaggattcttactattatttagtactccaagggcttggtctgtgtgcactgtcaagtcataattttgttagatctatctaataggggcccaatgtactcctcttcctaaggtctacactttgttattgtagacttttaaaaattcctctcctatacaacgtttccaagcaccagtgaaatgaatctgtagtagtgaaatttcacgcggtggctcacgcctataatcctagcactttgggaggctgtggcgggcggatctcgaggtcagcagatcgagaccatcatggctgacacagtgaaaccccgtctctactaaaaatac

SEQ ID NO: 21832 - DNA, 458 bp, Homo sapiens
attgatcaaccgatatctttttgatgactcctagatgcaagggaggttaagaagctgattattttttatctaagttaaaaaagagagagagagaaagaaaaactcagggcaagaagtggagaataactgggtaggcaagtggtggcatcatccacaccaggtgttctgaggctacatcatttatgttttacatcccaccaaattgctcaccatacacacatggaggtgtctatccttgattggactgccctttatgttaatcactgaggtctctttggatatgtgaattgaacccaggatcaatgtgaagtcaccttcaatttaatggaagccggtagcaaaggaaggataaatttgctgggcattactttttcttttctgactcctgatgggctaagtagagaaacttttcattttaagctgatggaagcagcaaaaaatgaaaataaggatgaggt

SEQ ID NO: 21833 - DNA, 515 bp, Homo sapiens
gtactaactggagaagcagttacagttgtacctagcatgcatttctgttggagctcatttcaagtaaatgacttatactttatgtccacagcaaagaggcccacatttgtggcaatcttggtcagtacagtcaggaaggaagtggagctgaagatcactgaggaaccagagaaattagtgtatatctggatttaatgatcaatttgcttatgttaaaaatacatttgaatatgatttactgcccttcagttaatgctagttccttgcttgcagcaggaccaatcaaaaggagctaaaccttaaaacccagatggagatgttgaaggattctagctaaagtttatgcaattaattaggcatcccctattcagaatacactttctatttgtgcttagaattgaaagatatcgtactcccaggtgaccttatccttaattcattccacacatactcagttaagtggcttaaataagtgatagagattttaatttaaatgcgagaatataagtgggcaa

SEQ ID NO: 21834 - DNA, 327 bp, Homo sapiens
  misc_feature 202, 212: n = A,T,C or G
agaaaccctcctggcaacagaaaacaaaaataaaaaacattgaacatagaaactacatgaagaagccacaatttgattggattggtttgtagaggaatttatgtccaggacgttgttgataataatagagcaatcccagattgttaatggagtttaataactgtgtgtgtgtagggaacatgggaagagagccttataagtnccagtgcggncatggcataccctaaactgctcccccctagattttactaaactaaagtaatccagccagtcactaaagaaataaacaagcggccgggtacagtggctcactcctgtaatcccagc

SEQ ID NO: 21835 - DNA, 656 bp, Homo sapiens
atgtttcattcaatggagtgggggttctgaattttccgtcttctttattcttggctcctgttatgttttgaagaatggtgaagaaaattataaaactaagtgacatgattataacaacacactttccaagctcagtgaagcactcaaagctactcaacaatatttttactgagctcttctcaactctctttctcaattcctatagcagctgttctaaaatgtctaccaattttctcaagatctccaggcactcttctcaatcccatcaattaatgtcctgattgataaaacagaggtctctacattcttcctctctatttccaaacttattaccacctacaccttctctacctgcacctttcttagaacagaaaggcttctccaatttgtaagcttaatgtccccatatcagttattgatttttcccgtatcccacacctcaaccctattctattactgataggtcaccccttcttcttagacagatctttcttccttttcacaaatgcataatgtgatatatgcatttgtgtaagaaactcacattcctcaaggtcctaaaaaacagtaaggtttttggataaataacattagtaagaatcttatgcaattctgtaataatcatgataacaccaccaacaatcacaatagatcat

SEQ ID NO: 21836 - DNA, 569 bp, Homo sapiens
aaatgtgtggttcctacctgcttctgtgtgatgctgtggtgctgctgctgtggagagcaggaacatttgagaactgtatgtctggggctgtgactggcaaccttgcatacaaccaccaccaataccaatgtgcagtgctcaggacccagagagtcatcccaccactgctactggcttcactgataccacgttgacttctcggggacatgggaacccatttacccacccagcccactgcagccactacaggctcaagaattggcctactttatcccactaacacaagtgccagcatctgctatgcttgggcccaagagtaagcatgctcagcccactgcttccaccaatggggaccagatatggacccacctgccatccctgcccccagaaaaacttcaccatagcctccactaataattagagcctaaaccacctaggaaaccacagatgttactcatactgtttacagccaaagaaaccatatagaggctacattgccatatgcacccagaatcaaagctaaagggtcctataaaaccaacaccattaatacatctccaggagaaagt

SEQ ID NO: 21837 - DNA, 600 bp, Homo sapiens
gaactgcccatataagagttaataacaatatttggctaggcgcggtagctcacgcctgtaatgccaacactttggaaggccgagatgggaggatcacttgaagtcaggagtttcaaaccagcctggccaacatggtgaaaccacatctctactaaaaatacaaaaaattagccgggcatggtagggcatccctataaccccagatatttgggaggctaaggcacgagactcacttacacctaggaggcagaggttgcagtgaactgagattgtgccactgcactccagcctgggtgacggagcgatactccatctcagaaaaaaaagacttaataacgatattgaaattagactaataaccttacaatgggaattttgcaatgaataaaaaagaggaagaaaatagttataattagattgttttctgaagtgacattaaatggccttcaaggctcaccaaaatgtttcctgaattctaagagcttaaacaatgtgttggccaggtgcagtggcccatgcgtgtaatcccaggcctttgggaggccaaggtaggcggatcacttgaggtcaggagtttgagaccagactggcctacatagt

SEQ ID NO: 21838 - DNA, 445 bp, Homo sapiens
agcctctgacaaacccgagcccggtatgtctttcctctgcagaaagcccatcaatggcttcctgtacattgagaagaatactacattctttatcataacctacaaggccccttcataggcaggttctgtccacatttctgcatttgcctcatttactttctccttcatttgcgtctggcttttttacggttttttgaaaattcccatttcttttgctgcaaaggaagcttcttcagggaagagactgtgactgtcttcttcattgctgaagcatcactgtctatcccagttccttgagcacaataagtattctatgcgtgttttttaacaagtagatgaatttatgacctagtgaggatgatcaaaataagtgcataatctttaaaaatgcaaagtcaaatgtggtaagtttcttaagagagacttgatttaagtagtctgggaa

SEQ ID NO: 21839 - DNA, 211 bp, Homo sapiens
gttttggctgctcaattttaacactccccagagagctctcagacatttatgtgatttaatggcctactattattaagtcagaaatattttattttacattgagattgtattcccttcctaggacttgcttattgatgatgcaggataaatgtaatagtaacaataagtcatcaaacattctggcagacctgtcaggaagaggagatggggg

SEQ ID NO: 21840 - DNA, 406 bp, Homo sapiens
agtttctgctgtttgtagaaaaaaatcaacaaacccacttataggttacatttaggttactaatatatgtggtagcacagctaagtaaactggagattatgctgatgctatgtgcttattattgcagtgtgggttttaatgtgaattttgcacaaatccatgaatgatatgcccatttgcctttttaattttcttgctgttaaaaaattagcttattttgtagccattgaaatatatataaagaaaaaaattaacttctacctgttttttttcttttaaaaatatttttatgtgatctaaccagtctgaaatagttggctgtaaatggatgtggggagtgtcatttcaaaccttttacaatttgggatttcttctggggggagtgggtatcagagctttagttctt

SEQ ID NO: 21841 - DNA, 627 bp, Homo sapiens
atatttgtttatacttagcagtcaacaaagtaactcatgggtaaaaattggtttacaaatcttcactttaaaatgaccgtcttatgaattatcattggatttgtaaaagttactgactttaagataagatgataatgctgtgagaatgatggaaaaactatttgtgactcatgttgtattttagcagtttagataaaaataaaataaatcattcttagatgcagtcctcctatacttggaaaagcatatatttgaataagtatataaaactgaaggcttgagtgtttcagttgggtttcccagaaagcaaattctaagctaaaaaataatatataagaagtattctagtcttctttggatcaaaacctgttgtagcaataaaaggaaaaagattggctagagagagaaaatgaacatctgctgaccccactgggagtgctgaagctaggatggttgtttagagtcacattcttttgctgtgatggggctgggcttttatactcccagggcaaccaatcatcaggtgagactcatccagaagacagtcttgtctttggaaaaggcagctctttttagctgaaacaattcccaaagaggagtgaatactaaagagctggaagcataaat

SEQ ID NO: 21842 - DNA, 597 bp, Homo sapiens
gacagaagggcagctctgccacttatttgtcacaagcctgggtaacttgctgaacctcattttccattttaaacatctgtgacaagggtaatgagagcgcactcattgaacatctagtgcctgtgccaggaactgtgctcagcactttatatgaattctctcatttaatccccaagactgtcattacccccattttatctgaacccacatctgtctggctttattatcctggcagcactcgctggtggaggctgcaggaggatgttttgcaaagcacccacattcaagctttcccatctgtcaccagaaatattctgcaagcatgctgaggccaaacagccttcccccttcctccttccctgccggcaggcagccccgcctttaccaatctggcagagtaggcccctgggacaagaatcccagccccatctcactcacggctcttagaaaagacagtggctggccaggcgtggtggctcacacctataatcccagcactttgggaggccaagcaggtggatcgcctgaggtcagaagctcgagaccagcctgtctaacatagtgaaacgccatctctactaaaaacacaaaaattag

SEQ ID NO: 21843 - DNA, 515 bp, Homo sapiens
ctcccaaagtgctggaattacatgcatacaccaccacacctggccattggaccataatctaaattgaaaatagatcatataacattgtgcagttcaaacagaatattcaaatggaaagggtagaatcaagtcaatatataatggtagttacagtggagaaaacagcatttgacagcacgtagaaagaaccatgaacttagttcttgaacttcatgtgtttattctaaaaacaaacaattttgtttcattttttagtcttctaaaattttgatttgaggattcattgtggtggtgtagtaactacatagcatgtcttcataaaacaagaaaaactatggccttccttaaaagaaacctaatctttgctgtccctgctatgctctcttttctaaagtgttatatttgatctgtcttctgaactctagtcctttgactatataactatgaagaaaaaatatgctacttcttagggaaaatatgatgtaaaataatcttgattttgtgattattggtct

SEQ ID NO: 21844 - DNA, 619 bp, Homo sapiens
gggcttctgtccccagagagcagattcgcacaaacccggaagcgggtcgcgtggagtgacggtcccaccgcggggatatctcttccaaatgcatgatgaaggagttctcatccacagcgcaaggcaatacagaagtgatccacacagggacattgcaaagacatgaaagtcatcacattagagatttttgcttccaggaaattgagaaagatattcataactttgagtttcagtggcaagaagaggaaaggaatggtcacgaagcacccatgacagaaatcaaagagttgactggtagtacagaccgacatgatcaaaggcatgctggaaacaagcctattaaagatcagcttggatccagctttcattcgcatctgcctgaactccacatatttcagcctgaatggaaaattggtaatcaagttgagaagtctatcatcaatgcctccttaattttgacatcccaaagaatttcttgtagtcccaaaacccgtatttctaataactatgggaataattccctccattcttcattacccatacaaaaattgggaagtacacatgagagaaaaatctttccaatgtaatgagagtggcaaatcctttaattatagctaac

SEQ ID NO: 21845 - DNA, 646 bp, Homo sapiens
gaaattaggtgcttcctctatattcattactcatgcgtgtttattaaaatttagttatataaatgagaacttgacacattaacaagtagttatatggctgttaactcaatttctctttaaagacttgagaaaataagggaaaaatgaaagttaaaaagaagaccctatttattgaactacagccatttcattctcatgaaaatggtatgttcatggccaatgcagttaatttactggtgaacaaaagtagtccaaactagttcattgaaataatatagtgcaaatccactgacctcagaaataacctcagaaacttatatctaagcttaaaaggggccgttgtctgggcgcggtggctcatgcctgtaatcccagcactttgggaggccaaggcgggtggatcgcctgaggtcaggtgtttgagactagcctggccaacatagtgaaaccctatctctactaaaaatacaaagaaacttgctgggcgtggtggtgggcacctataatcccagctactcgggaggctgaggcaggagaatcgcctgaacctgggaggcagaggttgcagtgagccgagattgtaccattccactccagcctgggcaacaagagtgaaactccgtcccaaaaaaaaaaaaaaaaaaaa

SEQ ID NO: 21846 - DNA, 501 bp, Homo sapiens
gtcgcggtggagctatgtcaactctcggcattgacagcagaacttgcagacgcacgtgcatcggagggcaagggcgcctttatcatctcccccacggggcaggaagccccccagcctcccagcgagaagaaagaaaagctgcttcagttcctcacccagcctcatccatgtctccccagatcatcaagcagagcatcgtggagctcaagctgcaggcggaggacagcttcgtgctgaaggtggtgcagctggaggagctgctgcaggtccgccactccgtgttcatcgtcgggaatgcgggcagcggcaaatctcaggtgtgtcacccgctccagggaccttgcagggatctggcatggtgggggagggctggggcgaagggtcggccctccatcactccccgccaccccggagaccccaacccagtacatcctgggagccctccggcctgagtcatgggccagggaggaagctgggggccgaggaggagggggaggagct

SEQ ID NO: 21847 - DNA, 463 bp, Homo sapiens
attgatcaaccgatatctttttgatgactcctagatgcaagggaggttaagaagctgattattttttatctaagttaaaaaagagagagagagaaagaaaaactcagggcaagaagtggagaataactgggtaggcaagtggtggcatcatccacaccaggtgttctgatgctacatcatttatgttttacatcccaccaaattgctcaccatacacacatggaggtgtctatccttgattggactgccctttatgttaatcactgaggtctctttggatatgtgaattgaacccaggatcaatgtgaagtcaccttcaatttaatggaagccggtagcaaaggaaggataaatttgctgggcattactttttcttttctgactcctgatgggctaagtagagaaacttttcattttaagctgatggaagcagcaaaaaatgaaaataaggatgaggtgtgag

SEQ ID NO: 21848 - DNA, 206 bp, Homo sapiens
atttttttttctttaaggctagacagcctaatatgccaaacaaatgtatactgtcaggccatttacctggcgatgccggagccctctgggcacatgcatatatttatatcagtacatgagatacatgctgaaatgttattgcctacacgctttaactctttactctcaaaattcagttcttgaatgtaaaataaaaagaccttaca

SEQ ID NO: 21849 - DNA, 467 bp, Homo sapiens
cataatgatcttatgcttccagaatcttacatatagaaaaataatgacttataatcctggggtcatataagtaaaaccacttgattattttaattcaccaaaacatgataataaatcttaacttttcttatgtatgttagcatggagtataaaaaatctgaagaccactacagagctttgcttatttaattttacataaaaatattttcctttctgttaaattgatttattttaggtgagcacgttattattattttgacccagagcttcaagagaaaaagagcacttgcagttagaatgcattctggatggacagtgtggcatattcagaagcaatgagtaacatgtacaagctgtgaggtaggtagatcttgaaacaagtcattgagaaaaacaagtttaaaatacaaacacaaaattcctattacacaagaacacaagcaaataaaaggattatatgtatgtgt

SEQ ID NO: 21850 - DNA, 431 bp, Homo sapiens
ttgaagcgattctcctgcctcagcctcctgggtagctgggattacaggcgtgcgccaccatgcctggctaatttttgtatttttactagaggcagagtttcaccatgttggccaggctggtctcaaatggacctcaggtgatctgcctgcctcagactcccaaaatgctgggattacaggcgtgagccaccgcgcccagccacccatgccctctactaaacagctcttggagatggtagaattacggtgctggaaaggaccttggttcaactttgtcattttagcaataaggaaatgggggactagaggtggtaggatcagccctcattatataatcgcccatacatcgtaatctttactgtttaaatgagtaaaggcaaatataaagaaagtaattttttttttttttttttaaaaaggagtctcgtttt

SEQ ID NO: 21851 - DNA, 558 bp, Homo sapiens
gtggcaggagctagtgaggggaggtgaggaatccacactgcagacagatactcactttggaaaagactgaggacacatgaaggccatcaaacagggaaactagaaactatatttcttgagggcaagggggcactgaactcagaagtctaagaggctttggcgcagcctatttacatgatttcagagattaccttatcttgttgacctttctatctttcatccttttccccactttggtccactatctctctatcatcaccatgaccactagtgctaccacctcttaattcatggtttacttcccttttgcctcaccccctactcttttctgccaggcctcttgtataacccctcccaacacctttgggggtatctctgaatcactttcttggtgctcgaatttattgccatccttcttcagtgaaattatgagacggcataaaatgaggacagggaaggccttgttgaattcaaacacatagatccacatcccagcttccagaactagagaagtttctcttttccagctcttcccgtgggcatcaaatctcagctgca

SEQ ID NO: 21852 - DNA, 331 bp, Homo sapiens
taccttttgaaggtacctcactcacccagctttaagtgaccagagattccacggcttcatttcagtagctaaaacatccagaagcctctattaagatgcaaatacttttcacaggctcctttgaagatggaagataaataaatacataaataaataaaaataaattttttaaaagatgcaaatacctcctgggaaaggtaacaagccatatcatgtaattgtgctcaattctctgtaagagaaactcttcagtttcagatactcttaggtcttaggaattgaaagctaagatccagaggataaaaggaggaaggaaaatttgatcaagagg

SEQ ID NO: 21853 - DNA, 173 bp, Homo sapiens
tcattattaccctcactgtcaacccaacacaggcatgctcataaggaaaggttaaaaaaagtaaaaggaactcggcaaatcttaccccgcctgtttaccaaaaaaaaaaaaaaaaaaaaaaaaaaggggggccttttttttcgtaaaccccaacttgaaaaaaacctttgggg

SEQ ID NO: 21854 - DNA, 603 bp, Homo sapiens
tgtttcctctttttcattacctcaggatatgaagatgaagtgtgtgtttcgtttttgttttgaaagagggaactctcataggtgtatcaacaaagctctaagaaattttggaatcttgctgattgaagaagtaacagacttgattcttcaaataaaatgggaattcattacttcacatatatgtatgtgtgtgtatatatatatatgtatgtttgtatgtatgcgaaaaaataatattctttttatcctagctcttgagaaaggtaatgggaaacgaatggtatttccctagtaaaccatggagaatgaatagacaaatggtaacacgctgtttcatcccaaaccgtaaactgggccatgtaactttacataaagtggatgcagctgtttcttccctgtccaactagtctgctttttctgtggaatttttgctttcttttcttgtactcccttaagactcaactgtaaaagaaaacaaatctttgtccaattagagcattagatgggaattttgaaggaattatctgaagcccagcgataaaatatcagaagctctgaaactcaaaattggtataatataatgggtaaaaactctgcctctgg

SEQ ID NO: 21855 - DNA, 583 bp, Homo sapiens
gattcacctggcctggcagagacagaaggtttcccataggagccagtacttgagggaaaaacaggcatcacacacacatttggaacagggagtggaagtggaatggaaagagaaggccttcgaagcagagggaagaatacatgcaaatgtacagaggcgcagatgagtgtgtggttagaaagcaggttggggcgggggctggtgggagatcagctgaagaagcaggcagaggaggcagaaactgaatcattcaagctttcgtcagcagactggtatggaatgtgggctctgtgccaagcaatgggttgtggtagatactcgtttttctcccacctcactggcgatgcgttcccagtctccttttctgtctcccccacttgtatctcttttccatctactttttcttcttagctatctctttcagtctcatagatttaaatatcctgatggctcttaatctgatttttcaatattgacctctcctcagagatcccaaattgaatgaatatctaattgcctaccgatactgctacttgggtgtctaatattcattgtgtacttaacatatctaaaagcgagctct

SEQ ID NO: 21856 - DNA, 556 bp, Homo sapiens
agcagtgacgagagaaccactgggctaagtgtactcatgtatcaaggtactccctcccccaaatacaaaatcttttgagtcagtcttcacttaggaccctaaatctgaattgtttagctgctcccactagttattgctatgtaccacagggaaatactcacagcacttgaggtttacagaatcaggtcttagaaataacacttccctttaggaaagagcttcttaatcttttttgagatcacagatcactttgagaatctgattttaaaatatatttatttactcaacattttcatataatctcaaggagtttgactttctgaagccaatccatagacctctaggtgaccatggacctcaaattaagaacttctttattaggtgctaacagtggatatatttaagttcataaagtttagtagtttactcagaatgattcctaataatttttttaatgatgataggctgtgcagcactataaatgctaaataaacatgacctctaaagtaatactaataaatacagtttagaagaagtgaatattatagcaagtctc

SEQ ID NO: 21857 - DNA, 551 bp, Homo sapiens
aacaacagacactggggcctactacagggtgcagggtaggggaagggtgagaattgagaaactacctatccgatactatgcttattacttggatgacgaaataatttgtacaccaaaccctgcagcacacaatttacacacatagcaaatctgcacacgtacccctgaacctaaaagttaaaaaaagaattataaaaagtacctaaacatattaatatgtgaagaaatttaattgtaaatactccctgaaatagcatatttgctataataaataatttcaacagcaacaaaaaagaaaggtagctggaaaattctaaaatattggagattaaacaacctacttctaaacaatacaagaaagggtcaaagaaggaaacacaagaaaaattttaaaataatagaactaaatgaaaatgaaacattaacttatcaaaattttggggaaaccgcaaaagcagtacttagaggacaatttgtagcattaaatacacatattagaaaagaagaaaaatctgattaaatccaaatcatgaagaataaaatagataata

SEQ ID NO: 21858 - DNA, 524 bp, Homo sapiens
atctgtttaggagggaaacagaggatagcagaacctgctaagtgacaccgccaacatgcagtttgccaaattcaaactatagaacaaatgacccagtttctttaacagataaataacaagagaaaagggccagtggcagaagacttgttagagagattttaaaaaccttaccaggcaaatgcaatgtgtggatcttgtttgaaccataattagcacaataatggttctaatacaaagttcagctgctaaaagatatttttaaaggcatttgagggaatttgaatttgaaacagatactagatgatattttaaaattctttcctgagaaatggtctatgaagaaaaattattgtttattttgttaggtatgatattgtgagagattttgttagaaatacaaactgatgtattttgggatgaaatgatatgatacagaaggaacatagatttaataagattggcaaaatgttgataatttggttgatgttgaaattgggtggtgagtacatgaatgtcattatgct

SEQ ID NO: 21859 - DNA, 608 bp, Homo sapiens
gtttatgtaacaggttcttagatagcatttactgtattccaggtgttctaagctgttcatgaatattaactctgtaatcctttataacaatcctgttcagtattgctacctccatttttttccaggtggagaaacaaataggccactcagctaggtagtgctttagccactgaggtatactgctttttcatgttctttttttctgacccaactgtttctctaactttaaacattaatttttccccagctcaccattcagcattcgtaatctcttatctagcgcttccacaaaaaggattacctagctggcatgcatttctttgtctgatgtctctttgggtactacattatcatttctggccaggtgcagtggctcacacctgtaatcccagcaccttgggaggccgaggtgggtggatcacctgaggtcaggagctcaagaccagcctggccaacatggtgaaaccccatctttactgaaaatacaaaaattagccaggcatggtagtgcacgcgggtaatcccagcaacttgggaggctgaggctggagaatcacttgaacctgggaggtacaggttgcagtgagccaagatcatgccattgcact

SEQ ID NO: 21860 - DNA, 433 bp, Homo sapiens
tcccaccaaaaagcaatccttggcacaagaacaagaacaaagcagagagactggcaaacgataattcatgtctgtttcctactctcctcctacatccacagcccagacatctctaaaaaaaaatatgggcacttggctgggcgcggtggctcatgcctgtaatcccagcactttgggaggccaaggcaggcagatcacgaagtcaggagatcgagaccatcctggctaacatggtgaaaccctgtgtctactaaaaatacaaaaaattagtcgggcgtggtggcaggtgcctgaagtcccagctgctcgggaggccgaggcaggagaatggcatgaacccgggaggcagagcttgcagtgagccgagatcacgccactgcactccagcctgggtaacagagcaagactctgtctcaaaaaaaaaaaaaaaaaa

SEQ ID NO: 21861 - DNA, 576 bp, Homo sapiens
gccgggattacagatgcctgccaccatgcctggctaaatttttacttttagtagagacggggtttcactatgttggtcagtctggtctcaaattcctgacctcaggagatccgcccgccttggcctcccaaaatgctgggattagaggcgtgagccactgtgcccgcccaggactccaccattttacaataaaaaataacattaccatatcatcaaataatatgtgattatttgatacttaaaaatagtacagtatgcagattactggaatagtgaaaattgataacgcaatccctagtagaaagaaaatccgaaagagttctgtataccggctttcagtacatttaaatatatatatgtttgaacaattcatctttatccctaatacaataacttttcaaaagctaatttataaatgtcagtttgtacagatacaaactgtataatatccaatataatcagatattctcagaatatacagattaaatatacagaaataaatgtatggttattgcctgatcataattccttagggaaggcaataattcacaatttatgtacccacagtggcagtgt

SEQ ID NO: 21862 - DNA, 608 bp, Homo sapiens
aactgaaatggttcttccaagaggatttggggacatttattaattcttatttcaaaatgttaaatgtttggcccactatcttaagctattaattccaaacagcacaataaactgaagacactaaacgttaaaaagggaaacatatcagttatatattttcctaagtattgtttatattatagatgattgaaagttttagttaaattagcctgtaaacaccttcaacttgatagtcacccttatcatttaaaattgttttataaaaaatgcattaggagttattcagaaaaaccccaaagcacgtcagacttattactctattttatggattagaaaatttaccaaaagctggaaaatgagttgccttaagttacatattggttcaatggcagaataagctactaaactcaaaccctcagggattgcttatttcattattcaacaaaatctccttttgcttacagttttcatggaataaatttaaatagtgtaacctattagatacatattagtttaaggaaatattcactgtcagaataaacactaatttatttaaagaatgaataaataaatcactgcattgaaatagttatcaaggaataggattc

SEQ ID NO: 21863 - DNA, 599 bp, Homo sapiens
gagatgtagaaacatcatgggtttagattaacgtattcttggcattgtttcctttttcaaagaaaaagaagggatgtcagtggtatctgatatcaaataatttaaccagaagggtagctaagctaaagcaaagtgagtccaggctcatttttcaacaggctaaaatgaagaaaaggaaagctttagatatcattcattttgatccaaagcatgttgaccaaacacctattaagtactttgaaatgttcctgttataatatgggctgcaaatacatgggtattgaatgactttattagtgaaggcattgtgttgtagacaaatatgaatgaaggctggtatttgcctttaagagtttaattgggcttttgtattgggggtgcaggcaggcacgtgcaaaatatttgggctactagctccagcttaaggcagaacatgatatagtggaggcagagggtactatgaagttacaacaggcagaaaaatgtgttttgatcaagaggtttgataatgaaggaacaggcttttgatgtccaaattgaatttcattaaagcttcagataaatattctcctggaatagtttgagggtcattctgacat

SEQ ID NO: 21864 - DNA, 605 bp, Homo sapiens
tggggaggaagaccatctgccagcagaaaattactgtgaactggactcttaagaccaaataccccacttcccacttccctggggtaattcctgtgtaaatgaaggaaacactctaggcttcttgagggctgtgtttcaaatctcttttggaaaacagtggatcatatgtaaatagagtgaatctaaaaattgaaccaatcaagcattaaaagggttcccccaatggatagttctatagaaagaatttaatatgtacagataaagtgttggaaaagatgacaatgcaaagcgggagcaatgaggcaaccctactgatagtcacagcagaaatctcccactgccctaaggtttgaggaaaaatggaaggatttgtgtgagcctgggagcagcactggctggcagaagctaaacttgcggtgggactgccaggtgagtgcagaagacagaaaagcagcggccttgctgagcatgaaaagccactgctggaaaagagagggagtcggggagaaattcacattgtccttccttcttcaatctcccattctcctaggagacacattgaccaaaactagccagaagtcaggaagcctggaaaatgtagtttg

SEQ ID NO: 21865 - DNA, 580 bp, Homo sapiens
tacatccagttttacaatgcttctcatatataaccaatgtggtttctgcactatcgaccatggagacacatatgtgtcctgtactgctggatttgccaagaagtgtttttgatgaatgtgtggaatgccctttttccaaagtcaaacatctggttttggcaccaattatcaggccagctctatgctcagcacaaaaatggaatgtactggatttgcttgggtagaagttgctcacacaatccacatttccaaatgccaaggcttttgcaaaattcatttgagttgattttaggtgtgaggtgaaatcaagaacaatactgcttcttgcctagcctagatttttgctagttctgccattccatattaatcattatgttgcaagtttctgtgttacaagggaaggccttattgaccagtggcatcaaatagagactaatcagtaatttccacatcaataatcaaggagggtacctgcagatttttaaaattgcagcagaagctgagtttaacagtttttattattactaacctatgttcagatgtcaaaatggaaaaggcaattttgagttttttttcttat

SEQ ID NO: 21866 - DNA, 496 bp, Homo sapiens
aaggacaccaatcatgaacagcatatgaaaaatcgatgacagttgtgccaaagggcctaatgagagcgcctactgggaggacctggggaaagtttctgaggcaggggaggcttgggatgtaaggattgttctaggtggggaccctaacgcaggccagcataggtgggaagacgaggaaggggaacagagcatgagatgaggctgaggtgtgttcaggatcagacagtgctggtcttgagaagctgtgggaagaagtgtgactttatcctgagtgcaggggttgatgggtgttgtagaaagctgatgctggcctcatagagaatggtgaggaggaaggcaagtcgagaggcagggagcagtgtggagctattggcctcggccagggagagccgatggttgcttggactagggctgaggcaccagggattgagagaggtgagagatccacaggatgtatagcaggaggggtctgcaaaattctgtgattaattgcacg

SEQ ID NO: 21867 - DNA, 429 bp, Homo sapiens
gcattatattttgtcttattttacaggtctctccacctcttttgtcctaagtttccctcccacaaaaatatcagctcattttttttagtgttactattgactgataagtgacagaaaaatagtaggtgtgaaatttttgcttcagcaaattatctgttacatttgcacagcagcctagtgagcacgatggagaaatattggctgaatcaaagtatagctcgttggtttgcactttggttgaacgagggaacatgtgtcagagagcagattgttggttccattagtatcaccttagaacctgctgcggaagcactcattcattggcccagccctgaataactcatacatcactggcttgtacccgagtatgataatacaagtctcagatttggagctgacaagatgctaagaggtaaagcatacgtatga

SEQ ID NO: 21868 - DNA, 599 bp, Homo sapiens
gatctgtgatctattcctgctcctgtgtatgtgcacgacgtacgaatgagtcatagttttcaagaatgaatgtgggtgtcatcaacagtgatctgtggtctatcatttcataaatagattgttccaaaagtactttaggcacaactgagcacagatagtctttggatggctttaatccaagcccatttcaatatgcctctttttattgtccacacttctttctactaccactaacttaaataattcatataatcagctagaagagttttcaatgaaaactcatctttgaacacaagaaataaggactgagaagtggtgaacaacttgcaactgaggtattctgaaaatagtcctaacataatgtcccccaggtgtagccatatatggtaatttggtaaatcaacaatgaagtcttatgcaacagtgagaatctaagtatcaagcactagatgaggtactgggcaagagaaatacaaaagagaacactgctttaccccatcctcaaggagatctcagggacagaaatgtcagcatctacctcaatacaatgacagctgagtgactatctcaagtgagaactgaagaacgtatcacaggag

SEQ ID NO: 21869 - DNA, 566 bp, Homo sapiens
ctttgccacccaggctgtagtgcagtggcacaatctcggctcacagcaacctccacctcctgggttcaagcgattctcttgcctcagcctcctgagtagctaggattactggtgcacaccaccatgcccagataatttgtatgtttttagtagagatgggggcttcaccatgttggtcaagctggtctcgaactcctgacctcaagtgatcaacctgcctcagcctcccaaagtgatgggattacaggcatgagccaccttgcccagccttcttcttaaatgttttaaagctgtcttaggatctatcccctgttatgaaaaatggagaaaataatactacttagtttttttagaatccttttgaggattaaatgacatatgtgttataattagaatgaatttcattttcacaaagggaaaatgcaatataattataagaaaaattccctgtaaaaatattttattgattattggtcaaaaacaataaaggctcaatgtagaaaaagaaaagcatgggaaaatataactaagcaatatattcatttgtaacacataacatagtattt

SEQ ID NO: 21870 - DNA, 539 bp, Homo sapiens
actagtaagaagcaacactaagactggtttagttccattcttaaccatgaaactgtggtggtttgtagagtggaatcttggcattcatgaggaatacgccaaaatgaaaccaaaatacctactaagaaaacaaacttacctccctcttaaaattttgtaaaactgcaggaaaagatattttgaaaaaaataataaaccaattaacatgagaggcattgggtacattgggtaaatacccagacaccagagtcagactacctaggttcaaatctcagctctctaccatctaccagctatgtgaccttagcaaactgtttaaacctctgagcctcagtgtcttcattttcaaaatgggttgttttggccgggcgtgttggctcacacctgtaatcccagcactttgggaggctgaggcaggcggatcacttgaggtcaggagatcgtgaccagcctggccaatatggtgaaaccccatctgtactaaaaatacaaaaattagctgggcgtggtggcacacacctgtataatcccagctactt

SEQ ID NO: 21871 - DNA, 590 bp, Homo sapiens
aagaatttcctcagagctgggatttacttcaaactctctcctaagccaaaccttactgaccaaagggacaagtccccaggccagctctctacccttctttgttcagagctagagccagagatcaatatgggcttccccactccctgccccttctaccttacccaaaactaaaaggaagaatcaacactgtgtgtctctctgagaagtctccctcaggagataaaagacccaaagggctgacccctaagctaacagcttacatttaaggaagaaaaacaatctgcctgcacttttcttagaatttagggaaaaaaaggagaatttaaaattcaatttcatgtatcagagttctccagaatacagccaagtggaaagaacttagtcccaaatgaaaaagttgagcagaaattcttctctcactcgttttgccggcttggaggtcagactggaggtgtcctgaactagaaccagagcataggttctgacccaagaaggacactgtctacttcccaggcatccctccttggctgggaggagaggggaggatgagtccattggaagctgagaattgtggaagctggggatgggag

SEQ ID NO: 21872 - DNA, 608 bp, Homo sapiens
ctgggatggctggcagcaacctgtgcacccctcaggccgctgcaggaccccagtccctctgagggtcaaggcctgtgtcacagtggtcactggaagccaggcccgccttcctgggctgatctgtgggggaggccaccctcctggacaggatggcaaactggcaacagacccccgaggagtgagcacagctgcaggccctcgccccagaaggacaatgctgatccccgcgcatgctccggtgctgcgtgtcccgagttctggtatcgcgcattatgtggtgaagacagaggtgcagtccctccaggaagagagaaataaataagcagatgttgtttccaacagcctccaattgggagacagatgcccagtggccagagcacaggagactgtcagggccgacctgatggtgtaatttatttaaaatgctacaaaaatacagccaggtgcagtggctcatgcctgtaatcccagcactttgggaggccgaggcgaatgaatcacaaggtcagttccagaccagcctggccaagatggtgaaaccccatctctattaaaaatacagaaattagcccgggcgtggtggcgggcgcctgtaatcccagctactc

SEQ ID NO: 21873 - DNA, 606 bp, Homo sapiens
aatacaaagaatgaggagtccaggggagaccacaggtgaaatatattccgacgaagaatgagaaatctatagcataatttgaattgttgaaaacaaggaaagaaatatcaaaggatgccatttataggataagaataggaggtaattgaaaattcgattttattagggcagaggctaacagtttgaaaccagtataaagcactgggtgtctgggagaaaaggaaaaggaaaggaagttgggaaggacctcaggcctaagaatgcacaaatgtcatttatgtggaaattgcaccttcaattttaataccaactgatatctgatgtttcacagatatattattattaattagagatgttacaaaattctgcctaagcaaacccatctctccagatcaggtgtatatttctagccaaattctactcctatgtgaaaggatacaaagcaaaataaaataaaatcaagaaatacgaatacccatgtcaagtctcatattctttatctttggccatttcgtctacattttccacaattttttaacctctctgttcatgatctatttttaaaagtataaaattcttcaatgcccagtttgttgacacatgtaa

SEQ ID NO: 21874 - DNA, 599 bp, Homo sapiens
caattcccaatgtgatgatattcagaggtgcggccaactgaggggtaattaggtcatgagaatagatcgcttacaaatgggagtagtgcccttataagaagagacacaagaggaatgatctatttctctgccatgtaggacacagccagaaggcagcttacagccagaaaaagaggtctcaccaagtgcccaaccatgctggctcccagatgtcagacttctaacctccatatctgtgagaaataaatgttggctttttgtccttcccattctacagtatatttgaacccttagttaacataaccctctctcttagttcaaagtacccaggagatacatgtcgtaacaccaagtaagccatggagtcaaaggaggaaaggggattttagcatagatagtgtaaacaaggagttgattattgccagttttggtactaatatcatgtgcagcaatgggtctgaagtttgtcccattaacctctcctaagtgtttcctcaaggagagaaacctacgggagccttggaggagctggctgtaaaaatgccctcttcagatctccttcagcagagggaagaggatgaagtttctatgaaattcat

SEQ ID NO: 21875 - DNA, 524 bp, Homo sapiens
aggagtgatcagtgtccattagcatgaagtccctagacttgacctaactgctgctttgaccttagagcctggaggcaaggagagttctgatgagccttaggaatgctaccaaaataagtaacatattggaactctctctctctgagcactctctgatactttccaagttgaagagtggtaccaacccacatttggcattaaccattttatattatcaactctttaaaacctcagcatatatgtacaatgataacacacacatgttcatgccatatatttttatatttattagattatatatgcaaatatactctaagaatattcacttagagacaaaatgcctgtgtataaaaatgtcagtctaacctgaggattaagtaattttttattgttaaaaatgtatatatttttattatacatgtatgagagagaaaaagagagatagagaacatggaggagggaagaaaggagaggaaaagagagagagcttatgtgctgactacatttatgcaaatacaatcaaa

SEQ ID NO: 21876 - DNA, 528 bp, Homo sapiens
ttgttttgtttttgttgttgttgttttactctgaaactcgtctacagacctagtgctcatattgtcttctcatatacagggtgagctgtgggcatactcagtgatgctatgtacctgcaggtgtatacagtggggccagattatgcccatgctgaagctagaaaatctccagctttggatgggaaggttgaacgagacagtgaggggaaatagattcgatatccagtcatgctgactgccatggaaaagctggtggccaggaaagtctgcgtagctttcaaggtagaggagggcccagggaggttgtgaaatgagggagaaaggaaggaacaggggtccgggaagagtaactgtcttgttctcatctttcttcttttccttgcagcaaacagtttgtggatttgaccttcttcgtgccaatggtcattcctttgtgtgtgatgtcaatggctttagttttgtcaagaactctatgaaatactacgatgactgtgccaagattctggggtaagagatatcacaaatatg

SEQ ID NO: 21877 - DNA, 607 bp, Homo sapiens
gggtggcacacctccccctgtgtccctgtgggagaactttcttcacagcaggggtttataaaatcaatttcatgggaaacagcatttaaaaagatgcaatagaaaatatcacaatacattgcaagtattaaagttttgtcagactgttttatttatgtgtgtgtgcctgtgtgtgtgcatggacacctggagcacattgcaacacaacgtgtgtttctttctctgtatcacactgctcatttagaagcccaagcccagtggaagggtagatgtgctgggctgttgggtgtacacacttgtagctttgttagatattgccaaattgctctccaaagtggctgcacagtttcttcagcctcacttttcatgaaatggttgacaatattagactggaattttttccagtctaatagtgaatgatcttagtttcatttgcattctgctcttttgcaacgtattggacgtttgggctgcttctccctgatttgcctatccatctcctttgctgagctttttactgggttgctgtgttttcctgaaagtacttttaagagatactaatcttaaaaatcttaatcttaggccgggcgcggtggctcacgcctgt

SEQ ID NO: 21878 - DNA, 578 bp, Homo sapiens
ccctatctccaaagaaggtcacatcctgagattctggttaggacttcagtcttggaattttgggtaacacaattcagctggtgacactgacacagcctggggctgcccagttttcccagaaggggcagcaggaatgggtcaaaaacccatcactcatcaagaaaaaccagttcatgtgttgaggaaccgtcttgtctgccgtccttcagaatgagtgcgcagttgttttgctgttttcttgggaaccagctgtggaacactgcgcttccctttcctttcttttcaagaaccttggtgcccacctggcctcctggaggacacctttgtgcagaggctgccagagatggaacatagagatgggggaggggagcaggtgatgctggcccctgttgaaagaaagtgggcaagagcacgggtagttatttctcctcttacagaaagggcttgctgagttaggcttcatgtggcattgtgttcttctgaacgtcacttaaggcatacatgaagcgtgtgcacatgacacagcccagtggagccagggagtgactcagcctgctgcccaacacccactgcaagtt

SEQ ID NO: 21879 - DNA, 475 bp, Homo sapiens
atcttggtggctaaagaaagaagtgatggctgtaatcgtgagctttccttactctctatttgtcatgaaaaaagacacagaaaaaagtgaaagtcagcctagaaatgaagagacacgtcattctacagactgatgggaaaaatagggctggggaaagatggaagtcaagagactccaacccctttccatatacttctttgccttctttaataggaaatactgtttcataatttcaaaagtaataccagctcaatgtgggaaatttgagagataaagagaactatgaagaaaaaatttagccagatgctgtggctcacacctgtaatcccagcactttgggaggacgaggtgggtggatcacttgagcccagcagttcaagaccagcctaggtaacatgataaaaccctatctgtataaaaatacaaaaattagccaggcattggtggtacatgcctataatcccagctactcggg

SEQ ID NO: 21880 - DNA, 605 bp, Homo sapiens
catcctaacctgggaaacgagtttctctcacccactttacaacccattgtaatcacattagaaacccaagcgtagaagttttcaaacttagagtcgtgtgccattacactgagcatatgggtgatgttatttgtattttattttatttttacaagtcaaacacaatccttttttttttaagtagggattctataatcagtaaaccaggcacatctttatttgaaaaatgaattggtttttaagacaaatcctccttcatttgatacagcatgcagaaaaaaaataccgataaaaaaaccatgttattttaaagtctattatcatcctggagacaagaaaaactattttctgctttcagactttgtttcttgttttcaaaagagttttcacgcttatcagtgggtgcgctcatattaccacagtaccttaagttcctttgataacttagttttctctccgaaagcaacaacaaaatacgtaattttgttctgtccatagaaagcaatgacatgacacactcctctcacctagcctccccaaaaagaaaaacatccagtcattttggatgtcttgagtggaaaggtttgggtttaaatttggagccg

SEQ ID NO: 21881 - DNA, 606 bp, Homo sapiens
tcctttatatcacagctaaaatgccattcctggccaggcacagtggctcatgcctataatcccagcactttgggaggccaaggcaggtggatcacctgaggtcaggagtttgagacctgcctggccaacatgccaaaaccccatctctactaaaaatacaaaaattagccaggcatggtggtgcatgcctttaatcctagctactcaggaggatgaagtaggagaatcacttgaacctgggaggcagaagttgtagttagccgagatcatacctctatactccacccgggcaacagagagagactccttctcaaaaaataaaataaaatgaaatgtcattaccttagggaagccttcactgtatcctacacaggtaaggttcctagttatggccccattacatgttctgatagattcccaaacacctccttccaaaccatgtaacacaattgtaattcattgtttgtgtagctgtctatttaggaactatcatgctagacaattagctcttgaaaccaaagattaaatctgtcattgtcacttctgtatttatattaggacagtttctggcacatactgagatcctaataaatttatggaatgaat

SEQ ID NO: 21882 - DNA, 606 bp, Homo sapiens
cttagatttatgcactgcctaagcctgttgcttatcacctctcagcctggagtctagcccactcttcgcctccgcctcataggaaagggccagtgcctgcagggagagctgtttcttgacctttgcctttatgtaattttgttattaaaatcaaagcaagcaaacaaacaaaaaaaaccctgcccctgtcccatagcccctgagccgttgaagtcagtgttcttattcagagttctgtgatcccctctcatgtgcctagtcttcaagggccttttaatctaaaagcgaaggttagatgctagctaattaatcaaaagataaactctttagaaaagtttagctatcactgccatgtctgggggaaaaacaaaactaaacaaaactttaaatctagcatatgatatggggctgctctgttaagaagtcctcaccagcaggccgggcactgtgattcacgcctataatcccagcactttgggaggccgaggtgggtggatcacctgaggtcaagagctcgagaccagcgtggccaacatggtgaaaccccgtctctactaaaaatacaaaaattagccaggcatggtggcatgtgcctgtaatcccagc

SEQ ID NO: 21883 - DNA, 555 bp, Homo sapiens
gaaattactgtcttttcttacaataataaatttatgacattttttcttaaatcgtgtttgtatttttttacattttgatacctaaagtatcactgaacattcctcgggtgcaaaaatatttgcataattttttttatagttatgactatagatttttcattaagtttttgttttgtttggtgaggtttttttgttttgttttttattttatatttttttagaaaagttgttttacacagcaaatgaagtgccaatgcagacaaatgtaaccaacatgaagctggccaatagaattcaacaaactgctaaggtcattaatataatttgttttggcactgctacgtttcctagtgctactctgagtagtttgctgggcgcatcaatttgttttcagctattgtgaaatcggatatcttggctttcatccaaaacaccctctccatttgcatatctttgttatcatttcaggttctcagaacatactgtggactatcacaccatctgcaccaagatcctcacatccaaacacaaattaaaaatgaaactgtaaaattt

SEQ ID NO: 21884 - DNA, 560 bp, Homo sapiens
actcacacacacatagacacacacctttgctcatactcaaacattcacacgcagaaacatacttacgctccccaaaataagaacacatgcaccccttttccgaacacttgctgtgccaaactttcaactctggattgagttttggggtgattaaacacatgaaactgaaactatccaaataaactcttttggcagttattgaaagtcttttgaagtaaaccagaatgcttctacagtcaatgtttccatactgaatcagtccctgtcacagtgatattatgtttatttttatgctggaatgtagattttttctttctttgcaccagctctgcaaagataaaaataagaggtaatgaagcagaatgctatgggtttgaggacctcttccctggagaatgtgtaggctctaattctttttacaatctctttataataagattggcctgctacttcatagcagtaattgcagccttcttctattcgtcagaaagagaaactattttctcgcctctgtgaatcagtaatccttcttaatacttagtgactccctcagtcctctt

SEQ ID NO: 21885 - DNA, 581 bp, Homo sapiens
acacacctgggtacatgtgaaatgataaaataacttttttcagcaaacattaagacatctggtttcagtttggaattatatgttggcaaacattgtttaaaaaatggattttttaaagtttaaaaaaagaactttcagtttctagaaagtttttataatgtggaatttgtatggcaaagaatttgtataaaaagctgaatgggaaggattgctaaaggtaagctcatgcagcaggcactcttcacctactttctcttctacctaactcaacaatttgatgggaaaactgccaattcagtttgtacttctaacttttttgttctttgaatttagaaagtgacagaatgtaaaaatttagtatatagggcctgctactatatatttagctatttttccaatattttgcaatcatgttattctccttacattataccaaagtatttctatcacaaatcttttttatcagtgtctcagaatggactagagaaatgactcatggcataataaaaaatctcttttcaaaagcataaatgatgatgcctatttagtaacacaaaatcgttcttacagattgaaatatt

SEQ ID NO: 21886 - DNA, 561 bp, Homo sapiens
gggggccagtaaagtatttccttggtggtcgggactaaggaaaaagccacaggactgtaaagcattccttggttaggacataccaaggagagagaaaccacaggggcggtaagcattccttagttgggactagggaaagaaagccgcagcagggccgtgaagtattccttagtcgggatgtcttgcaggttaaaaagaggtgagaaatacccatgggggtggggcttgaacctcagaaagaggtgagaaatccccatgggggggctgaacttcagaaacaggtgagaaatccccatgaggtgggcaggatgggggagttaaacctcagaaaaaagtgagaaatccccatggtggggggcgctgaacctcagaaacaggtgaggaatcccaatgtggggggttgaacctcagaaagaggtgagaaagccacgtggaggggttgaacctcagaaagaggtgagaaatccccatgagggggggttgaacctcagaaagaggtgagaaatccccatgaggggggatggaacctcagaaagaggtgagaagtccccatgagggggg

SEQ ID NO: 21887 - DNA, 495 bp, Homo sapiens
aaggacaccaatcatgaacagcatatgaaaaatcgatgacagttgtgccaaagggcctaatgagagcgcctactgggaggacctggggaaagtttctgaggcaggggaggcttgggatgtaaggattgttctaggtggggaccctaacgcaggccagcataggtgggaagacgaggaaggggaacagagcatgagatgaggctgaggtgtgttcaggatcagacagtgctggtcttgagaagctgtgggaagaagtgtgactttatcctgagtgcaggggttgatgggtgttgtagaaagctgatgctggcctcatagagaatggtgaggaggaaggcaagtcgagaggcagggagcagtgtggagctattggcctcggccagggagagccgatggttgcttggactagggctgaggcaccagggattgagagaggtgagagatccacaggatgtatagcaggaggggtctgcaaaattctgtgattaattgcac

SEQ ID NO: 21888 - DNA, 590 bp, Homo sapiens
gaaaaacccagcccagctttggtggttttttttagtccaacttagagtataagccatacctcagaatttgagaatttgttccctactcagcaaatgggcaggttgtttgtgctcttacgccaattgttcctttaggagatccttgggaagagaagggcccagaagcagtagtgttaacctctgggcacttcccattttcctccataccaaaggccagtcttcagaggcaaagcaggcagatgttgggggagggccacacagaacttgtaaaagggaccttaaaagatctggaaaggcaccatgagtgttcagtgcttgtttctctagtctgaaaagtggaagccattttctaaaaccatgaaagaataatttttgctagggctctgtttccaatccaaaagaatcatgttttccaatcgctgatgtcaggattagacaaaaggtttgttgcctagaccctgatcaattcatacttaatactactgaatccttattatggtttaggtacaattttaaggctacaatatatattatctcttttaatcccatttaatttactcatcagtccagtatgatacgcattagtatgt

SEQ ID NO: 21889 - DNA, 602 bp, Homo sapiens
gactttcaggacggtcttagtgagataggagctgggccagggtagggaagtgttctgggtgacaacaaggtcccccacgaggaactctgggagagagagagacacgggagggtgagtcttggagattcagggatcaggaaaccaggtagagacttcatgggcagctgtcaaagccaccacttccctgcccggaccttctggctgtcagagctaggcagggagaggggacacccccctacaactccccaaagacccctgaacacagaggcatctgcaccctccccctgctgcatgaacactgctgaacaccggaggactctgtcacattcactgttttctctcctgtcccctctcacaaggaccctgaactttctggcacaaaagatgcccaaggtcagaaggaaatgcatggctgggtgcggtggctcacacctgtaatcccagcactttgggaggccgaggttggtggatcacaaggtcaagagttcaagaccagcctggccaagatggtgaaaccccgtcactactaaaaacacaaaaattagccaggtgtggtggcacacacctgtagtcacagctatttgggaggctgagggaggaga

SEQ ID NO: 21890 - DNA, 581 bp, Homo sapiens
gcgacaccttaaccctgcttacctctcctctcccaaaagaaacatattggctcacaaaatgtacaagtgttggggctctagactctatgggatccatgcaactaagcaatattatcaggatttaggctccctctgtatctccactcttatcatcatcatattaccacccctataggccagaacctcttcatgtaatggcctccagatgttctaggcaaacatcattttaaatctgtcaaagggagagattcttatcaatagtactggcacaaatctaggatttgagccgcattcatcttgatttggttacatgatgagtcctgaagtagttactgggttcatgtctggttaccagcccacccctagagcaagaggtaaaatcagcaccacttgagatatcttaaactgagaatttagaaggggttgttcctcagaaactattggaatgcccttactaggataggaactgaattctggtgagacaaaatccacagatgtcccttaggcctctttttatgtcagtcctacggcatattgtgagatggatgtattggcggaagaaatcatgctactttgacagc

SEQ ID NO: 21891 - DNA, 539 bp, Homo sapiens
tgtatgccagattctgttctaggtacttaatatatggtacattaacccattttaacttcataaactgtggcacaaagaagctaagtcacttggtttagacaaggtcacacagttagtaagtggcaaaatcaagattcaaacctagtcttctggctactctctctcaagctccatagctagatataggaaatatgggatcctactagggagggaaaaggagggcgtgaatcctaggtgttacagaatgaatattactgtccccctctcaaattcatatgttgaaaccctaacacccagtgtggctgtgtttggagatgaggcctctaaggaagtaattaaagttaaatgaggtcataagggtggagccctgatcagataggactagtatgcttttaagaagagacaccaggctgggcagtggctcacgcctatattcccaacactttgggaggccaaggcagaaggattgcttgagcccaagagttcaaaaccagcctgggaaacatagtgagacctcatctctaaaaaataaaaaatta

SEQ ID NO: 21892 - DNA, 584 bp, Homo sapiens
gtcagatacattcaagaaaaagaacgacagatactgacatttggaggagtactccatcccagcgtaaatgcaggtacactgtctcatcgccctctgctgaaagcccatcaactagctagccctttcccatacccagaattgccagtgagctttttagggtaaaactgttaaataggaactgtcattcaaaagacatttgaggaacgtgtctgatttaaaaggcagtgatggtaacaaaatatacaaataggaaagccaatcttggaggaaacagatgatactgcataagaaaatttcccaaatgcccaagtctataattaatattgtcagagaggaaagtaatcccatgtctgaaatgaaagcaggatattattgaaaggaatattgagagaacagaaaagaactcttagaaattaaaaaatatgatagcagaaattaaaataattaaatgcaaaaatgagaatattaagttgaataaatgtctctgaaagttcaaccaaaagacaatgagattgataataagagaaaagattaattagaaatgtctaacctctgtctagtggtcggtcccattaaaagagagc

SEQ ID NO: 21893 - DNA, 538 bp, Homo sapiens
agatgttattttcatcactgtgccaaggggtaactgaataatcatttggtctagccactacttgtaggttagcgaacttctgaaagaaacatgcacttattagaccatgctgaaagatataaatactccttaattattagcaaagcttgtgttccaatcctggcagaaaggtctctgttaataaactcagtgtgtgttttaactccagaatgctgaaaaaaatagacatttttggtcagtctgaactcaaaccaaatatcttgccacctgtaggcagacccaagaaaaaagaaatctcattgctgagaaaataaaattttacattaaagattttttaatgaatataaatgtttaaatattattacatttgaagattacatagcacaaaaaagttgtgaaactttacatataaacaggaaagcgtgaggaagaaagaagggcaggggaaaaacaccgtaacacaccatgaccaaccctacaaaagtgtggtcagatcaaggtcatagaatgagatcaatctgattagcaattcctcctc

SEQ ID NO: 21894 - DNA, 561 bp, Homo sapiens
attgaacaaaactagtggcttcaaactttggcaatccaacacacatgcacacacacatacgcacacaactgaaaagtgtcatgaaacaacatttatccttagtcatgaactctgatattttctataactttttaaatgctggttgtggctcactaatttgctttcatgatttagtaaaaggtctcaacctgcagtttgaaaagctgtggaataaaccacatggccaccaaaggcagaactagaacagtcttcaaaccactcagctccttcttcatgggttattattaaatcagaaagggcctaagtttcacttcttgctgtaaaagaaactgtacattccgtatcctcctcctttgccctccacagttcacgtgagcactagaaattcagagaacacccaggaaccagtgggcacttcctatgtatgcaactcatgtcactgttgcccaatctaaggtgctgccattcaacatcagggagagtcctgtggcctgttctcttagtttcgtcttccttattttgaggcccagcaaccgtcatcattcactgtacctttggagc

SEQ ID NO: 21895 - DNA, 528 bp, Homo sapiens
aataaatggagtctaagtaagaccttgagcctttagtgggttagttgtcagcttttggacagatccctttaccttcttacccttagctttctcccctatgaaacagggccatgatcttgtaaaaggatgaaaatgacatgagtaattgcaaataattataaacatcagggaaaattcaatctacatctactacgccttccattccttttcaactatgttatacatttcttttaactttagctattcatggtgcaagggatcttccagatatctagaaagctaattcaaagactgacattagaaaactttacagaaaaaaaagattaaagagttgcaggcatgggtgcaaagagcaacatagctgctaaaggaagcttgaaatctttgtctagtcctggggacccagctggagttgtcaggaatcagcagagcaggtgttcagctgaggtttggaagaattcttagcccattgaaatactttatgggccgggcatgatggctcacacctgtaatcccagcactttggga

SEQ ID NO: 21896 - DNA, 549 bp, Homo sapiens
cagaagggttctctcaggcaggaatgctcacgggtcaaagaaagcacaaggtcacttttatttctgaggcaccaggaacaataagaacaaaagagtctacatgttgtctttcctagtagacaatgagttccaggtgggcaaaggtgcagtaaaacacctagcacttttgtagatactcaaataatgtttgccgaccaaatggatgaatagaattaaaaaagtaagaagatcaaattatcaaaacacagtgatgcactgccaggtttgatcaaatacatgtgagaaaacttgtgaaatacagattcacagtggcatcttttaaaaacaattgttctgattctctaacctgagttgttatcattagtttgatgccataattttaccacaaacctgctgtggataactcaagtaatgcatattttaataatggtttacttcagccagctgtggataactcaagtaatgcatattttaataattgtttacttcagccagctgtgcccagtttatagcctagaatggtcttcattctgacaaaatctgatgaca

SEQ ID NO: 21897 - DNA, 634 bp, Homo sapiens
atctttatagggtaaagtagtggttttgttggccatggaaaagaaggaaaagaaaacaattgaagaaaatggattattttgttttatttttaattttctaaccgaataagtaaataaatgtgttctcccttaggagaaaagcagtaatttctcccttttctctgggagtcagttaaacctcattttacgttaaaaaaaatagtattttttatgttacaccatatgttttctgaagtaattccacatatctgattttatgcttatagcaaaaatttgtatttatgcatatgtaaatttagctgctaagtgttgtgtttagcatgtgacatacacaggtgataaaacacggcttcagtcttcaaagacaatggaaagaaaataggtacacaaataatttctctatgagacactatgtaatcaggccagaatagtctctatttgatagacagacgttaaagaatttgaactcaaatcatgggctttgttaaaactaacactgtagtttactaactcctagctcaggactctagggattacactatataatcatatcatgatagtaaagactgcccaacatgtcatataaacagggaatgaaagctgagtgtagtggctcatgcctataatcccagca

SEQ ID NO: 21898 - DNA, 514 bp, Homo sapiens
ggttattaaaaatttaattttaaagaaggcatccaggaaaaaaaaagtatataaatgctacttagaacccagattgcccaatttaataagctcatcagtatgtcaacagatggctggcactgctcgttaccatcatctattttcaactggaggcacatgcactgcagtggctcagctggtgtcttctgcctccctcatttaacagagggaatagcacaatctagaagaagcatcagacacaggatatactgaattgggagaatcccccaaactccagatctcttgattgtatttgtaattattgtaagagcaagtatctaaaccatggtataaatggccaacacttcaaggactggtatgattagaagagtttcagcttcctctcattctgtgatatggacatgatattagcaccttcattaaacaggcagtgtgtcattaggttgctttttgtaccccaatttcctcatctgtaaatagggatacaacagtacttacctcacttacatcacat

SEQ ID NO: 21899 - DNA, 579 bp, Homo sapiens
ggactgtataagcatgtgtgtgtttagtattacggttctttgttttccatattttctgcattgattagtattacttttataaacaacttttttaaaactaatttaaaaattgaggctgggtacagtagctcaggcctataatccccaaagaaaaaaaagaaaaaggagaaggagaaggaaaaagagctggaatggtgatgcagtttcatggaactgtgtgggctccagctgttttgccctctagaagggggctttgagaggcctaggcaggaggatcacttgaagccaggagttcaaaaacagcctgagcaacacagtgagaccacaactccacacacacacacgcacacacacacacacacacacacacaaattttaattggccagttttagtggcatgcacccatagttcttgctactcaggaggctgaggtgggaggatttcttgagccctcttttgaggtttcaatgagctatcattgtacgactgcactccaacttgagcgacagagggagaccctatctctaaataaaatacaataacaataaaaaagtatacttaatacctatccagtcttg

SEQ ID NO: 21900 - DNA, 400 bp, Homo sapiens
ataataataatttaaaaattaaaacaaacaaaacaaatcaaaatatgttaggaatcccagtcaatggggtgaaaggaaacaactaaaaacatatatattagaaaaaaaactaaatgtacatgaaccagaggctcattaaattatgggagtacacacgaagcatttctcaggtatttgaaagaggtaaagttatatcactaaaacacatagtacttttaacttgaagagttaaggatgtacatacatgtgtatgactatttctggggagaatacacgtgagactagaaatggtgcttgcttctagagagcagagccgggaatgtggtgaagagaatgattttgactttcattttatgtttcctcgatattttcccatgtgcatatgctatttataaaactt

SEQ ID NO: 21901 - DNA, 581 bp, Homo sapiens
ttgaccagtgacgatgagctttttttcttgtgtttgttggccgcataaatgtcttcttttaagaagtgtctgttcatatgcttcacccactttttgatgaggttgtttttttttcttgtaaatttgtttgtttcttgtagattctggatattaaccctttgtcagatagatagattgcaaaaattttctctcattctgtaggttgactgtttactctgatgacagaaactgttttttctacaaaacctagcttatttctctgtcaagttcccctattcatttccctacaccagcatcaccaacaataacaacttaagagctacccctaagaacatggatatcaagactgcatgaagatttatgaattctaaagagcatttcttgacactgaagccagctaaactaactttgcagaaatgctcaaaatgttcgtaaattttaatttataccaaaatttcagtttcaaaatgccacctaatcttcttgaatgagttatgtgttatacaactttattccaatttccatgtgactctgcatcttgttcatttctaattcatacatttgtgatatatggcttcata

SEQ ID NO: 21902 - DNA, 635 bp, Homo sapiens
agatttactggggatacacacagtaataagagaagctactattactgaacggcacaactaaatatgcttgaaaattctttgaaataaatcaggcctgcccaaacttagtgcttttcaaacccgaccatgattcagaattggccatggtgctttttaaaaatgtagatgcctggattccaccccaaatgtactaaatcagaatcttacagggggctacccagtgactgtacatttaacaagtcacctcaaatccccaaattattctgacgcacatgcaggctttagaaccactattataagtcccgtcagtgtcatggtgtgaattctcagcaatgtaattcctataaaatgaatttgtttaaattaagaaataccaagacattttgattggtgataataaaaccatcttcatgttgtataggtattaaagcacctttcaacatccaagaaaatgaactgtcattcttagaaatttggggattaaaccatgtgctctgaagccttctttataaacatgacactatgatgcagtatctccctgtaatggttctatacttgtaacagataagaaaattccctggctcactcgtaatagctagctgctgtctgacaactgtcaaattttctcattgctg

SEQ ID NO: 21903 - DNA, 616 bp, Homo sapiens
gaggttgtaacccttcaggatgtggaagtctgcctcagttccaagtcttcaccattcgcagaccctcatttcctggtttccactagcctttagaaaatgaatttttaggctacagagactggtagatgcccccaagggcaagcacagagtcagctttaatttactaccttttcaaattctttccttttttaacctctgaaatttctataattactattgttaagattagccttgcaaataagggtaaataaaataattcctgagaatatagaaatgagggtaaatcataaatggcagacagcattctgtttccatctctccagataagggttcttaggggctgctgttttagacaggggtaccaaacatccaaatccatggggaatatatcacacttgcttgtcaattttttttaattgacagtaattgtatctattatacggggtatactgtgatgttttcatatagttttactttgtggaatgattaagtcatgctaattaaaaaatctagcacctcacatacttatattttgttgcggtgaaaatatttaatatctaatcttttaacagttttgaaatatacaggccaggcccagtggctcacacctgtacta

SEQ ID NO: 21904 - DNA, 650 bp, Homo sapiens
caaagcctgccaagcagggtagaggacacgccatccataaccttcaatgcaacaacttgcaactcagtataaccacctaacatccggccttctcagcatttttcacaccatgacatacacagcgcatgaaatctgtacagcaaactgagataaaccactaaggctgctctcagcaggaggagactgccctgagggttccaggtgccccaggccccaccagcctccagggaaattacagagttccacctagacacccgccccaatgcttccagcaagcctggggcctggaatagcatagtggccaggatgctcagtcgaacttgttgcaaaaatgagccaactgtgactcctgaacataaaatccaagatcctggtacaatctatttctacactactggcaccatctcaatctatttgcccagtcacttaataaagataaccagtaggtggataagtgccttcagttcagggcctagaaggggtgggcatggctggctagctgggaaatgcaggttgcacaaaaatcagtaaagatactcacactactttatagctgtattaatgctttatggtttataaaaagcttttattgcattatacatcaattgataataagatataatctggaacaggcagagcaaaaaaaaaaa

SEQ ID NO: 21905 - DNA, 577 bp, Homo sapiens
tgcattgtgaagaatctgaaagcacaaacaggggcatagagcaaggcttctttcagtcaacgaattttgaggaaggcaaaatgcacagagtattgcagaggaactccaggaagatgctgtttttcaaattcaaaggggagaagatggtgtctattggtggtgagaacttaagttccaccacagaagactaaactctgttaaagaatcaatgagtaacaactcctgggtttctgaacatagggctgaattgatagaagtggtgttgcagaattattctaaccataacatgatagattcagctgtaagccaggagattctctgtttgcatatttgacctgaggtaatgagaacatggattaagcttgtggcaataaaaccagaaaggaaggagcagagggatctgagacatgctaccaagaatcagagctagagattcaaatttggctaaatatatgccaagtggtaggtgaaaccatgtaagagacactcttcaaggaaatgggtgttgagagagaatagctgaggactgagtctttggggattccaacagttaatgggaggaggaaagaaggggagc

SEQ ID NO: 21906 - DNA, 523 bp, Homo sapiens
cctttgatgatgattttattcataaatgtttgttttcttctccaccagtactgggacagaaatttgcatataattggcactccattaaaattgcttgcattatttcagcctagggtaaatacatggtagctgtaataaaacctctcaaccacaacataatccgaatagaaccaaccttcagagatagaggaagatgatcccaattgtctagtgattgcaaaattatattaaccttaggtaaagtccattgtgtataaattatggtagaagcttagtgcaggagaatgaacaatagttttagtgtcagaaaatgtgagttaaattcccagcttaccttattactggacctatgacttgaggaagttttgtgggttttctctcttttgtttgggaaaatgtgagggggatgcataatcacatttgggaaactgtggatattcttagaacagaaaaaaatagattagtgaggttttgaatctttccacttatcttggtaaggattatatgccaaagactagttatt

SEQ ID NO: 21907 - DNA, 710 bp, Homo sapiens
tttattctttgaaataaataaattatgacttccaatggcctcatcaaactgccaaagtgaaattgtggttacaagaaaataatggaagcttgtttaaaattaaacattgtgtattttttagatctggagagcctcaataggttccctatcctttgtaccacaatataacacacaggcattttctaaatcaaagcttttactatgtaagtggtaaaataaatcaagcaatttaccaatatagcaaaagttattaaatctttgttgaagaaaacgtcacatcaattagaaacttcctttgtaaacatggcaccatcagggcaacaatttactaacaccaaataaagattttcgggagtgttgagtggatttacaaatagtgttcctccaaaagaaaatatcactttctgagcctgacaacactcagccaagtggcagctgttctataaccctagtcatatgaaaataatagaattgagatgatgagctatctaaggtagaaatagtattaatgtgacatttttataaagagagatacaacaaactatcagaataaagagaacaggcaacaacaaatcaaattcttctgtcttgactgtaagatgaatgttggtgaatcaatctttttaaactgtcttttgaaaagaattacattatcagatgcatttgttacactacattgtgttacactgatgaactattaatatagcata

SEQ ID NO: 21908 - DNA, 603 bp, Homo sapiens
gaaggaccctctcaggagcgcccacccatgaccaccatcacaaccccaaacctgtctcctttccctgctttctcaagtcatttttggaccaactgtgtagacaccctgctctccccataaacctcattacatgagtaagaatccatttcacacaatcttggaggtgtggcattagcattagcagtctcaacactgaaccaaattgtatgcaaactgacccctacaatgggcattgtgagcaggattatccagatgttggctgccaccttcagggaattgctgttttagctttgctttgctcactggctctgtgccccatgacaagcctgaactttcagctcagctgctttgtgctgcttttattgagttcggctgaggctctttgagagatttctctgacctaggtcagtaatttagataatattttggtatttaagaacaggaatatggactcagatcccttttaatgtctccctgagtcatgcatctcagtccagacatattgctgtgtcttttataatttaaaaaaccaaattctgtgtgtatactttcactgatatgtttacagaaaagttatttatctattgaaacttcttcacaagc

SEQ ID NO: 21909 - DNA, 588 bp, Homo sapiens
atgttctgtgaggcatgtcccacgctctctcaccacctgcgggccacgggtcacagctcccatttcacagaggagcaaacaggatcacagaggacggaatgagcccaggcgctggctgtggccctggcaggagactgggtctgacgctggcctccacccccagaagataatgagaaggccccaaaaccatctacccctgagagggaacctcctttcctgggaactggaaagcgagtctttccagactggccacgtgccatgtgctgtggcacactgggctgaagcgtagatatcatttctcacactcagcccggcacctctggcgtcacctggataacagccactgctctccagagctgacaacagggtgcccacgacccctggccacgtcaagtcactgtcaaatccagccaactcatatccagggaagatagggagatgcagaggcagccttcgattcaatgacatgtcactgtcctggataaaacgtgttaaatttcatcaaaaatgtcaaactaggctgggcatggtggctcacatctgtaatctcagcactttgggaggccgaggtgggcggaccacgaactc

SEQ ID NO: 21910 - DNA, 451 bp, Homo sapiens
cttgtatacagagagggcttaattcttgccttgggtcatggctcgtgggacagcatgatcagactgacttctgggagtcctggggccagaaggaagtgctccaaactcctaggggctggttttgaacaacctctgcttggccagcagatgttgggtagggaaggaagtgggtttcctggcttgtttctgacagaaagaagcaggttctgctttgaggagacaaacagtagtctcactttctaggttcccgtgacctctgacctcagcctaccttctacaccacactgacctgatgaggctgtatcctggcctcaggggataaaattgtcccctgagagaagcttggagccagagacaactttgcagactgcctgttccaaatacatttgtgtctcatctgaggaactcagagagtggaaagtgatcaggaggtcacagggcccgatggtca

SEQ ID NO: 21911 - DNA, 457 bp, Homo sapiens
gcctgagcccaaggtctgttgaggcctatccctctctccagggtgtgtgctcaccatgcccttcctggtgtccctgggatccaagaaggtcatggacaggtatatgggccactgcccaagagtttgagagtgaagtgtatatgtaagttactaagaacacgctcagcttctggcacaaatccactcattcactcatcaaacactcggcgcctgctccacgctcagcccttctgcactcctgactttgctgattctcgtacaacccaaccataactccatgtgactgtgagtggggcttccagagcctgggaggtttgccaagtcctcctgctaagtggctgagctaggatttgaactgagatctgtctcaccacaaggcatgtggtgatggctccagagtctctgtcttcctggagtctggcatcttgtgagggatgtttgagccttatggaaactc

SEQ ID NO: 21912 - DNA, 588 bp, Homo sapiens
atctgtttaggagggaaacagaggatagcagaacctgctaagtgacaccgccaacatgcagtttgccaaattcaaactatagaacaaatgacccagtttctttaacagataaataacaagagaaaagggccagtggcagaagacttgttagagagattttaaaaaccttaccaggcaaatgcaatgtgtggatcttgtttgaaccataattagcacaataatggttctaatacaaagttcagctgctaaaagatatttttaaaggcatttgagggaatttgaatttgaaacagatactagatgatattttaaaattctttcctgagaaatggtctatgaagaaaaattattgtttattttgttaggtatgatattgtgagagattttgttagaaatacaaactgatgtattttgggatgaaatgatatgatacagaaggaacatagatttaataagattggcaaaatgttgataatttggttgatgttgaaattgggtggtgagtacatgaatgtcattatgctgttgtttgtattttcatgtatgttctaaaatgaccataataaaagcttttttaatttatagtag

SEQ ID NO: 21913 - DNA, 437 bp, Homo sapiens
aagcaatcaaggtcattgaatgctgctggatgagtacaagatgctgtggaaacttagaagcaggtctcacctggtctgagtgattgagctgagccagtgacatgtagtaaacctgcaggagaagcaggggtatgccaagtaagagaaggcagaggggccgggcgtggtggcttacgcctgtaatcccagcactttgggaggctgaggcaggcggatcatgaggttaggagatcgagaccatcctggctaacatggtgaaaccccatctctactaaaaatacaaaaaaattagcctggtgtagtggcgggtgcctggagtcccagctactcgggaggctgaggcaggagaatggcgtgaagctgggagacagagcttgcagtgagccaagatcgtgccactgcactccagcctggacggctgagcgagactctgtctc

SEQ ID NO: 21914 - DNA, 578 bp, Homo sapiens
tttaaaattaaaattaggtggtttcattctattgcttatgatcaaataaaacatttctctggctttttcttgcacatagacataatccaagtattttttcacatgacctacaaatctctgaatgatttggtcttttccacttctccagcatcatcgtctacaatcattactacatccctttctctctgcactgacagcttcttccaagcttttttctgcctccagccctttgaattttctcttttcttttcttgatcttgacatagctgagtctttttctttattaaaattgtagacacagcagcatttcctcaaagaagtctttcttcactgcatgaatttgcaacctttccctcctccatgctactgatacacactctgtttctttttaattctgttttatttactgaacaacatagccacaatccaactctgtatgtaggtaattgtgtaggaataatttatataccaaatttagcaaagttagctctcagaagaggtgtgcgattatgaagggatttttgttatttttttaaaaatctatatgcttttgaacggcaatagagcataatcttcta

SEQ ID NO: 21915 - DNA, 591 bp, Homo sapiens
gtgggtgaatgaatccttctacatgcccattttttttctgaacatttgaggtctctctttccttatttctctttcccttctttctttcctgcatctctctctttctctcccttcttctttctttctctttattttctccccttccttccctctcttcttccttttttcttttctttccttctttgtttcattccatcctttcttccttccttcttttttttccctttttttctttttcttattacagcagttttacaataagcattcttatagctgtcttgatacttgacagagagaaagcatagaatgcattccatgggagtgaaattgttggatcacagctgatgcaaatattcaggctcaaagaataatgacaggttatttctactcatatttatacttcctccagcaatttgttgactcatctcctctctgattgttggatttgtctggttttgtaattgttgtgggattatcatcagtgggaataaaatcaggccaatagtttttaaatgctaatttgtatttcccttagaactaataaagttaaacatcttttcatgagcttgtttgcaacatgtttcctcttct

SEQ ID NO: 21916 - DNA, 604 bp, Homo sapiens
cttcaacaatgtaactgctgaaaatttcttacagacacacacacacacacacacacacacacacacacatcacacatatatattaatttacatatcatttgttcacaaatatttggctttaaaaaattctaatgagcaaagtttttatttgtgatgtaacaaaaacactgaagctgaggaagagttacttctcttgactaagcacatgctgactgatgtaatacaagcacagtttaaagtggaggaattcaggtatggcaagttttaagtttcaaggaatgagtccagatgagttgtttgtcttggtagcattttttttctcatatttgaagcttagttctagatgagttaaatgtttttgcaaaggaagcaaattgatttggatcacacagataagctggtttgtcaatgggatcaatcaatggttttcaaaaacagaagagaaaaatacaattagggtaataaaaggagcactcatttgccaaatcaaaagagaaattagtttcagctgaatgttagtttttagctctctgggaattactgtcagtgaggggcaccgagtactcttcggtagcacagctaaactgcttgatgttaataaacc

SEQ ID NO: 21917 - DNA, 614 bp, Homo sapiens
ggacagggagagtgtctggggttgtccagtgggctcaatatagtcacagtcagggaatgttctctggccggaggcaggagagacatggcagaagactagaggctgagactgcccaacccaccattgctggagggggccacttggaaagcatgagaaggaagggggacccagtcctacagctgcaaggaataattgagccaactgtgcataagcttgaaggcctccagggtgaacccagcacctcagacactggccccatgagactgagcagaggacccagctgggcctggctgaactcaggcatctgacttagagaattgtgagataatcagtggtatttaaactgccaagcctgtggtgatttgttgtcatggaagcaatagaaaactaatacaacagggctgggagcgcctgtaatcctagcactttgggaggtgggcggatcaccttatgtcaggagttcaagatcagcctggccaacatggtgaaacctagtctctactaaaaatacaaaattacaaaatacaaaaattagctgggcgtggtggcaggtgcctataatcccagctactcgggaggctgaggcaggagaatcacttgaacctgggcagcag

SEQ ID NO: 21918 - DNA, 524 bp, Homo sapiens
tgagacacttgttgattcctccagagcctttccctcctcctttgctagctgagtcctgattttgtttatgtttcaggttgagctcctttggtctcagggaaggtgggtccatgtctgatctagatcaaggaatgtgacccagctctgaccaaaaagatgtaatagggagtgagcaagtggaaaaggcctttcctatctgatcagaggaatgttcatgatgagaaactctaggctctttgcagccctttccctctagcttctgaatgcctgtgtgatgacagggactgtggcagatttcttaagaccttggagggaagaccaaaaacgtctagagattccaacccagatccctgacatcactagccttccagcaccagcaaccacccactccagccttcttgatgtgtgagagaagtaacctccaattgtttaaggcactgtattacttgctgcaaatagcattcatgacttattgcaagtttgtggaattgcaagggatgatgctgagacgtcaagcaggtgcc

SEQ ID NO: 21919 - DNA, 416 bp, Homo sapiens
catggatcccatgtttatctcatactctctctagggtcctgaaaagctgaagaaagtgaatgctgacattttaggagagtttagtagatggtgcaccagcaacagctgactgccactggctatactgtgggaccactctttgatttcttcatgcttcagtgtgctcatttgtaacatggtatggtttggtcagactatgaggctctttcctgctctatgattctgggattctaacatatcctcctttgcttctgtaacctgaatttcaccagattgcaacaaaatgtgggtatgaaaagaacacaatatcatttttggagtattctggcaaaaagtgtttaacctggatctaatcatgaggaaataatcaggcaaattccaattgggagagtctataaccaactggcctgcactct

SEQ ID NO: 21920 - DNA, 609 bp, Homo sapiens
gtgtgtgtgtatgtgtaaaacagacatcaaaggtttcaggaattattggtcctgtcaaaattctgagtagctcagctcatatttactcatgcaccttactcttccagctcgtctgcacttcttccttctggttcttatgttggcaggtgtattagtaagggttccctggagggacataactaataggatattatatatataaaggggagtttattaagtattaactaacatgatcataaggtcccataataggctatttgcaagcttgaggatcaaggagggccagtcccagtctcaaaactgaagaacttggagtccagtgtttgatggcaggaagcatccagcacgggagaaagatgtaggctgggaggctaggccagtcttgccttttcacgtttttctgtctgcttagccagacagaaaattagccagcagctgattagattgtgaccaccagattaagggtgggtctgccttccccagtccactgactcaaatgttaatctcctttggcaacaccctcgtagacacacccaggatcaatactttgcattcttcaatccaatcaagttgacattcagtattaaccatcacagcagggcaagagaa

SEQ ID NO: 21921 - DNA, 609 bp, Homo sapiens
tgggtggggatgagatgatgacagcagattcaaggagaaaagtgacaagagcctgtgttctggcagcagcagaggtgatggagggattgttaggaaccggtcaccccatctgctggggtgaggggagagtgtgttggagcaggaggaagctaggatgatgccagagactggacacaaggcacagtgagaagtgactagcctttcatgggacgaaggcactggaggaggaagaacgtgagggtggtgtgtggtgggtggtgataatggtgtgggcaaaacaagcccggtctttcaagcattgagtctgtggcttctgggagacatctgggtagagctctgcaggaagtcatttcatatattctccctccctccctccatttccttctttccttcatccatctttctttccttccttctttcagtgaagatttattaaggcttaacatatactaaacatatgctaaaattcaaacgtaccctgataaaaaagtgagatgttgtttctgcgtaatattcaatgttggatctcaggagaaaagtaaagatcagaaatatacatttggaggtcctcagtgtgtctgcatgtgtgtctgtatagatatatacaca

SEQ ID NO: 21922 - DNA, 603 bp, Homo sapiens
gggcactggatttgggcagccccgcgtttgaatgccgcctctcccatttcccagtcgggtaatgctgggcaagttaacttcctgtctgatccttcatttcttcacttgcagaatggagagcatatgcctcaccttgagggctgttggaggaatggaggtttgggtgctcagtatttattagcccttatactacattaatttggtgttaggcaaacagaggaaagccttcttaaaaaacagctttaccaagataaaattcatatactataaaatttgccccggtgaaattaaaaccacaatgatatagataccaccttacttctgcaagaatggccataattaaaaagtcaaaaaacaataaatgttggcttggatgtggtgaaaaggggacactttcccactgctagcgggaatgtaagttagtacagccactatggaaaacagtattgagattccttaaagaactaaaaggagaactaccattccatccagcaatcccactgcttggtatctacccaaaggaaaagaagtcattatacgaaaaagacacatgcacacacatgtttatagcagcacagcttacaactgcaaggatatggaacc

SEQ ID NO: 21923 - DNA, 601 bp, Homo sapiens
ttgatctgcagtgggacctggaattttatacattgagcatagtgccaggcaatgcttatgatcagatgatactaattaacccctggcatcatatgatcttcactgtgattggagttagaagatttagcttcatatcctgccttctcctatcaacacacacacatacacatatacacacacacgtgcacaggcatgccaaattggctgttacttatctcacttgtattatttatatctttttactcataaaaagactttgggctgggtgtggtggctcatgcctgtaatcccagcactttgggaggctgaggcgggtggatcatgaggtcaggagatcgagatcatcctggctaacatggtgaaactctgtctctactaaaaatacaaaaaattagttgggcgtggttgtgggtgcctgttgtcccagctactcgggaggctgaggcaggagaatggcgtgaacccgggaggcagagcttgcagtaagccgagatcgtgctactgcactccagcctgggtgacagagcgagactccgtccaaacaaacaaaaaagactttgaagttgatctggcttctacatttgtcatttttctaaaactc

SEQ ID NO: 21924 - DNA, 468 bp, Homo sapiens
gaagtgcaactcgaacttggtcggggcgcggatcccgagagggaaagtcataacaaccgcacgagggagttcgactggcgaactggaaggccacgcctcctcccgcctgccccctcagccctgtggctgggggcagagctcagatttattatctaggatagatttggatgaactaatgaaaaaagatgaaccgcctcttgattttcctgataccctggaaggatttgaatatgcttttaatgaaaatcatcacgaagtatgtatatgagctcctggaaaaggattgtaatttgaaaaaaagtatctattccagtagatgccactgagagtgaaccaaagagttttatctttatgagtgaggatgctttgacaaatccacagaaactgatggttttaattcatggtagtggtgttgtcagggcagggcagtgggctagaagacttattataaatgaagatctggacagt

SEQ ID NO: 21925 - DNA, 591 bp, Homo sapiens
taccatttgattttaagacttactctaaagctacaataaagaaaaccacatgctattgttgtaaggatttatagaccaatcaaactgaagtccagaaataaacccaaatatacatggtcaattgattttcaataaagatgccaaggtaattcagtgggaacatgatagtttttcaatgtattctgctagaactattggatatccatttgcaaagtaaacccttacttcatactgcatacaaaaattagcagagcacagatctgcatttaagcaaaaaccataaaactaatagaagaaaacacaggacctgtgttaaacaaagcttccttaggaaagaaaatgaaatttattaaattggattgtagaaaaattaagaacttgcttttcagaagacactgttaattagatgaaaattcattctacagactgggagaaaacatctgacaaatgtcttgcaatgctcatgtttgcaatatttctctgcctggtttctgttatttcctttacctggtgtgcccttttccctggtcttggcatgaagagctcttatttctcttggagaatggataaacttggatattagatcatttt

SEQ ID NO: 21926 - DNA, 596 bp, Homo sapiens
tggcgtgaaaccaggacctaatctacctcccgccattgtttcctaagtggtccccagtgacagttcaccttttcaatcacaagtcacaaaggaagggtgggtcagacaaatacaggttgcacggaaaatgtgggtgaaaaaacagtatgggagcccattgggaatgcatttttttgtagagtatttccacaagagcaggactcaaggataaatgttccctacagaaatattactgcagcattcctgttcatgtttccccaccacataggatgagcatctaacttgcacaaaacccattcaggggattcattgctcatcaccgaaccagggcaatgctgggttgaccatgtaaagagtcttcgttccagctgggcgcggtggctcacgtctgtaatcccagcactttgggaggccgaggcaggtggattacctgaggtcaggagtccgaaaccggcctggccaaaatggtgaaaccccatctctactaaaaataaaaaaattagccgggcatggtggcacacgcctgtaatcccagctactcgggaggctgaggcaggagaattgcttgaacccgggaagcaaagatagcagtgagc

SEQ ID NO: 21927 - DNA, 549 bp, Homo sapiens
agtctgcaggggataccaaagacctcagttgggcttaacccaagatgtggatacaacagtcatagaggaagacaagtgaaccttaatccttactgcctacttgactacttcaccctcttgttatcatgggagccaaggagcctcctgggaatacttcataccagcctgaaactgaacttcagacatacaccacctggcatgtcacatggcctgggcagagttaggtaaacaggtcctcaaaagtctgttagaaaaagtcggggttgggccaggcacggtggctcgtgcctgtaatcctagcactttgggaggtcaaggcgggtggatcatctgaggtcaggagtttgagaccagcctggccaacatggtgaaaccccgtctctactaaaaatacaaaaaattagttgggcatcgtggtagtcacctgtaatcccagctactcgggaggccaaggcagaagaatcgcttgaagccgggaggtggaggttgcaatgagctgagatcacgccattgcacttcaacctgggcaacaagagtgaaactttgtct

SEQ ID NO: 21928 - DNA, 504 bp, Homo sapiens
tataccttataacaaatgttgaaactaaatttcactacttgtaatctcttctgccaaattaggaggtaccaaattgaatttagttatagaaaaaatataattattgtctaaagagctctttcaattatttctcaggttatcttgattaaaataatttttcataaaatgtctgcacgaaaccctaaaccacacttactcctttgggactaccgatcccttgaagatagctataaatgctattttaaacacatatgcacatgcataaacacacagacacacactcatacaattgcacgcacaatttcatatagttttacagagttaattttatatgttcatagttccagttatgaacctcccctaggaaattcgctatgaactcttatgaaccatggattccaggttaaggaatgtatacctgaccttaatatataccttcatagaaaaataatatcagctcatcagtatagacaattaggttattttaaaaaaaccagttgcttg

SEQ ID NO: 21929 - DNA, 552 bp, Homo sapiens
gagtatctgggaaggacacaacccatctcagctgagtccaaacttctgatccactagatactgcaacatagcaaatgatatcttacatttatcttgctactaaatctgcaatatcctattgtaatgcagcaaacaatgctaatgcaacttttacctgcatgggtaaaatactgaacattactataatctttattcataattcaattgaaaaatgttaacgactttcattctttactcagattattctatttcttaaaacaataattatttcaaaactaaattagtatgcattcttaaaactatttttctcaagtcagagaaaagaatccaagaaaaaaaataactataccactcttgtgtcagtgcatatgttccatgaaatagcagaagttattacaaatatactattatttaattctcataatatcactgccaggtaggtcttataagggccactaggtggctatgtcatcattatgtaaaattccacctgttttcagaatgcaagtttgtaaccattcaattataaagttcatcctctacaccaagagg

SEQ ID NO: 21930 - DNA, 525 bp, Homo sapiens
tcagatgtaaagtgcttgtgtactctcgtttttaattatgtccctcaaataaaaaacagtaacacaaaggtatgcacttaaggcttgctgtttgactaacatgtctacaaatggcacaagaaagctattagcctgaaggtttgctccaaaaattgccacagtaaatatgaagtaaaaaaacctcaagatttctaaattaattatgaatcaattaaggtcttttttatctttaaaaaaagtgttttggacaggcgtggtggctcatacctgtaatccagcactttgggaggctgaggtgggtggatcgcctgaggtcaggagttcgagaccagcctggccaacaaagtgaaaccctgtctctactaaaaatacaaaaaaattagccaggtgtggtggcgggcatctgtaaatccagctactcaggaggctgaggcagcagaattgcttgaacccaggaagcggaggttgcagtgagccgagatcgtgccattgcactccagcctgagtaacaagaacaaaactcca

SEQ ID NO: 21931 - DNA, 548 bp, Homo sapiens
caggaagtcaccctggaggtgaggcccagctccaggtcccagagatgaggccagagtgaagaacgaaagggtccgtgagtcggccctgggtcagagagaagcagagcaggccaagggcctgaaaacacagcagagttcatatggagggttgggcccaggctgaggcatccacctgggaggccaggtctctgtgtgtcccctcagagtgtttgtttgccagactcacggtcactaaggttttctccatgaaaatgcaagctacggctgggcacggtggcttatgcctgtaatcccagcactttgggaggccggggcgggtggatcatgaggtcaggagatcgagaccatcctggctaacacggtgaaaccccatctctactaaaaatacgaaaaattagctgggcgtggtggcgggcacctgtagtcccagctactcgggaggctgaggcaggagaatggcgcgaacccgggaggtagagcttgcagtgagccgagatcatgccactgcactccagtctgggtgacagagtgagactctgtcaaaaaaa

SEQ ID NO: 21932 - DNA, 589 bp, Homo sapiens
ccagaatcctggggtgtcactactcaggacctctccccacacagccctcatgatgcgctgccctaaggatgagggtcactgcccctctgcctcctctcaccacatcacacctccctctccatgtgtgtcctcacacagggtgggaatgcctggtgccgatgactgtctttcttgcttcactgtgagcactgaaagtgtgagatccccccaacatatccccagcatgggacacaaagactgcgtgcagtaagtacacaaatgtgtgtaaggagtgaatgaataaatgactttggagggcttgtctgcttatctcctgattttacttatggggatatagagctacaaataagagagttcacacaataggtggggcgtggcatggtgagccacctttgactttcacaactaatgccacactaaagctccatcaccctgaacaagtcatgtagctcctctagttctccttttcctcatcatagagcggtctaaaatgcaacttgtccctgtgtgcagttcattcgagaacacctacctaaggatcttctaactcccagtcttaaaaaaaacaacagcaacaataatagtaaga

SEQ ID NO: 21933 - DNA, 592 bp, Homo sapiens
gtcttagagaatccttatatgtccaagaatggctaatcataattttcgcagaagtaagacttgctttatcaaaatagactggcaatcaaaataagccttgaacaaagaaacacaaaaagaacttgggccctaaccagcacaaggctccccacaccccacttaaaaattaaaaagcgaaaaacaaggtaaagcaccaagggattaaaacaacaaatgtacttgggaagggctataaatggggttaaataagcttgacttttcagtaaagtgtagaatgcaactagttattcaataaatgtaaaatatacatagccatacttcaatttcatactaactgaaaagaggcaataaaagaggccggcttatatgtggacaatttcatttttaaaaagcggggtggggaagaagatacccaaactattagaaagatagcatcatggctgggcgcggtggctcacgcctgtaatcccagcactttgggaggccgaggtgggtggatcacgaggtcagaagttcgagaccagcctgaccaacatggtgaaaccccgtctctactaaaaatacaaaaattagccggacatggtggcgcatg

SEQ ID NO: 21934 - DNA, 97 bp, Homo sapiens
ggggaaagtcgttcttttagtaataacttgatggattgctatgtaagattacagacagttccatgaacaggatgaagtctttgatttgtgtatgtgt

SEQ ID NO: 21935 - DNA, 578 bp, Homo sapiens
ctggctaatcttttgcatttttagtagagacgggatttcaccgtgttagcctggatggtctcgatctcctgacctcgtgatccacccgcctcggcctccccaagtgctgggattacaggcgtgagccacggcgcctggccaatttaaaaatttcttaaggcgaggaaggcaaacaaaggagactttagattttacttataatgttcttgggcctgctgggaagtgactgtttttattcactcactataaggctgggaattcttgaagccaggcatttcatgtacatttttaagacatttcagtcaaagccttggtagtaaaaccagtgttccaattgtatcctccttatatagagagcagatttttattgaacttatttaaataaaaataagaatacagctgggtgcagtggctcacacctgtaatcccagaactttgggaggccaaggagggcagatcgcctgaggttgggagtttgagacagcctggcctacattgtgaaacctgtctctactaaaaatacaaaaattagccaggcatggtggcgcatgtatataataccggctacttggtaggct

SEQ ID NO: 21936 - DNA, 557 bp, Homo sapiens
ttctttgccttctctcacctgacccatgccatccccctgtcagaatgaatttggcatgtagtaaattcctttgctttttgaccctcctaacagctctggactctggctcaatggattggatcaactctctctgtcctcataccactagtggtttgaaataatatcaggaagcacattttatgccagcccttgagctgagcccaatatgctgcacaatacaacaagcttcatttctttttcccaactctgaagtcccagtaagagcccagtgctctctgtactgggtttccaggtaagtgagaaagaaccaagcgtagagctgagcaaaagcttaaacaacctgtaggccatggaggttttggctgggaacacagtgtgccagaaaatccggcaggtagataaaagtttgattagtcagaaagtcagacaaaacgacattactcaggcaaattatagagtccacaaaggtaggtctggattggcatccagaagtcaaaaggcagggatgactgatacacagaatcattcgtgacatccaacaactcctagtgaagtac

SEQ ID NO: 21937 - DNA, 587 bp, Homo sapiens
ctgttcagggcttccctcccaccccttcttaaacatttatcagtgtaatggctctttcttgcactgctataaagaactacctgaagactgggtaatttataaagaaaagatatttaattggctcactgttctgaggtctatgcagggcttcttcttctggggaggcctcaggaaacttacaatcatggtgaaaaatgaagaggaaggaggcacatcttacatggctagaacaggaggaagtgagtgaagggcaacgtgctacccactttcaaacaaccaggtctcacaagaactcactcacaagacagcactagggggatggcgctaaaccattaaaaaccacccccatgatccaagcaccttccaccagcaccttccccaccttcaacactgagattacaatttgacatgagatttgggtggggacacagaaccaaaccaaatcaatcagcacttcagtgaggcagaaaatgcacccaagaaatctcaactcattcattctggatgctgtgggggctcttctgagctccccagcaagcatgatcttctcttctgaaaattcctccaggcttcaccattttctctga

SEQ ID NO: 21938 - DNA, 585 bp, Homo sapiens
gcattcaacctttaccatcaagccacatcgacattccataggtatgaaggtgtacttaagatttttctttaaatcaaatctaaatcattcacttttttcttatcctgaccctaaacaatgacagccttgaaatcttggcttctgtgtgctaattcttaatgctctaattcatattcaaaaaaaacataattattaagatgtatgacatttggccgggcgcggtggctcacgcctgtaatcccaacactttgggaggccaaggtgcgtggatcacctgaggtcgggagttcaagaccagtctgaccaacatggagaaaccccatctctactaaaaatacaaaactagccaggcatggtggcgcatgcctgtaatcccagctcctcgggaggctgaggcaagagaattgcttgaacctgggaggcggaggttgtggcgagcagagatcatgccattgcaatccagcctgggcaacagagtgaaactccatctcaaaataaaaaaaaggcctggcgcggtggctcatgcctgtaatcccagcactttgggaggccgaggagggcagatcacctgaggtcaggagttcg

SEQ ID NO: 21939 - DNA, 587 bp, Homo sapiens
aaaggaatgcttcgatatagaaaatgttttcttccttcaataggtagtacataagcttttccccctagttgcagcgccctgtggtttatgaagaaaacagtgttgtaaaaatgaagttattgtcatgactagtttttggatcagactgtcctggaatgttttccgcccatggccaaaaacagaaactgaagaaatttaatgacatttttcttacataactaaagaaagccatgtgtaaaattgtttttaatgatgaaaggaactcctcgaatgcacaatcttcttgatccctttttcatttctgtaccctgagtattctgcatatgctcatggatctcagataatgaaattttaaaacaattttgttgtaatttagaaataattatagaagggaaaatactggttctgaatagataacatttcttgaattcttgtgaaacattaacctaaaacagcaggtgattcctgttaaaatttatatactgaattcatctgcagagtcacactgcagatatgagaaggaaattgacaaattaaagactattctcccaactcagaagatgattaatgtggtaaaaaaaaaaaat

SEQ ID NO: 21940 - DNA, 585 bp, Homo sapiens
gcaactttcagagtccagttagaagtggaaaaataaaaatgggaaaaaacctgattcatttttaaaatttttaatttgtttttaattgttgctgtgcagaagcaaatgtactggaaatgaattgtactcagttaattacaatttaccgtattattccatccttaactcattctgtgattgaacactgaatatcaaaattttaaatattaccttcacggctaggtgcaatggctcatgcctgtaatcccagcactttgggaggccgagatgggtggatcacttgaggccaggagttcaagaccagcctggccaacaatggtgaaaccccgtctctactaaaaatacaaaaattagccatgtgtggtggtgggcacctgtaatcccggcacctgtaatcccagctactcgggaggctcaggcaggagaattgcttgaacccaggagacggatattgcatgagccgagatcataccactcactccaacctgggagacagagcaagactccatctcaaaaataaaaatacaaataaatgttaccttcagcaatatttttcctttagatgacctcatgttttcccatgtg

SEQ ID NO: 21941 - DNA, 551 bp, Homo sapiens
ctcctggtgctccacccccaccccacagggtgctgactgcaaccaaagcgccccatggaaagaacagcccatggatggagcccaagaggcgctatgtcctgaacgggccgtgctgggtctagggtgatatttcccaatcacagagtctctaactttgcgacccactggccctgtgcttccgcttcccttggtggcccagggtaacaatcccactctgaaggctggaggacccacagaggcaccacccccagttaaatggctgcattgtgaaaggggatgcacaagagacatttcctgccttgggtctcttgcctcaggactgatgtgcatcaggccacggccaggccagcctgctggagagggctgcgttccctgtgctctgtgtggggaatggtgttcacagttctgggtcactaccgttgactcccccaagacacgggggcagatgtgctccattatataagccttgggtcaatcccagagaatgagcatcaaattcactcctgtctgaagctggctgccccaaggcatttgggttttggggtgagata

SEQ ID NO: 21942 - DNA, 302 bp, Homo sapiens
gcattggtaagtggtcagtgctttcgactttgtatgtccaaaggtgtctgtgttttgccctcactcctgtatagtattttagctgcctgtgaaattctccacagataggtgttcttccttggcaattttataatgttaccttattgccatccgatactcatcgttagtgggagtctgccaaaagtctaggtgtgatttttctttatgaacatttcgatctgagggctcatgtgtcttcggttcgaatttcaatgagatttcgggtaatatctcatcagactttgctgtgtgtgtgtgtgtgt

SEQ ID NO: 21943 - DNA, 273 bp, Homo sapiens
actctagaaactcaaatccctgggctccaacctcctcaccatggcttaccagcaagatcttccctgtcttccaggtttacatctttttttttttttttgaaagggaattttgggggggggcccccccgggaaaaccggggggggaaatgggctttttgaaaaatccccccccgggggtaaagggattcccccgcccaaccccccaaaggagggaggattaacgggctgcccccccccccccaagtaatttttggttttaaaaaaaaagggggt

SEQ ID NO: 21944 - DNA, 317 bp, Homo sapiens
gacatcgagtacctggtgttagtggctttcataatgtaacaggtgtttagagacaccatgaagggatagctcaatgtttttaataaattttttaagttaacttgaatcaattttgtcagagccattctagccttctgagccataaacaggagttctgcattagaaacttgaaggccactacctgttctgttgaagctgatattagaacaagtggtctttattccaacacctgttcgtctctcaattctaagagccatgcacctgctaggtaagtgcttctgggaagagtgtgaatggtgggagaagactgaaaaatg

SEQ ID NO: 21945 - DNA, 535 bp, Homo sapiens
acttctctgaaaaaggaatgggaagggatcagaagcccttctaaccctcactagagctgaggctacaaaagtcctttttatagcaacagaagaactttatcatccaagctttcctgacaaaacactaactccaagtagttttgaatccacctaagctttaatctagacattcaggcaggtcttcaaagcactcagctaaagtttagtttttctaatgatgcaaagatcattagaaatgatccctgctaggccgggcacagtggctcatgcctctaatcccagcactttgggaggcccaggcgggtggatcacctgaggtgaggagttcgagaccagcctggccaacatggatggtgaaaccacgtttctactaaaaatataaaaaagtagctgggcgtggcgacgggcacctgtaatcgcagctactcaggaggctgaggcacaagaatcacttgaacccgggaggcggaggttgcagtgagccaagaccgcaccactgcactccagcctgggcaacaacagcaaaactccatcg

SEQ ID NO: 21946 - DNA, 409 bp, Homo sapiens
ttgtgagtaaagcagaaattacctgtattctatggcaagtcgaagtttaagctatcttaaatgaaaactatctttgattccttataaaaaatatttgaacgaatctgatttaaatttattttattccatctttgatttgtgtgcaagccttatttgataagctttatcactgggctgtgtataacatacaacctgcttatttaatgaaaatagtagagcttaaaaggtattttttagacattaatgtttgtctactactgtatctttcaaaagaagcattatagggcttatgattcctctgttggtgctggtaagaattgcaaagaggcatatttccatcacttttttagaactttcctattcatagaaatttatttcttttaggtaaatcttatgtaggtatatatat

SEQ ID NO: 21947 - DNA, 418 bp, Homo sapiens
ggtaggcattacagattatttttattttctttatatggttctatatttttcaaattccacaaaattagatgcattgtgatcaagaaaataaaacaaaattctattttttaaaggccacaatttgccccttcttcatttctcaaaaactatataacccagagggaacaaagatcagaactcagccacataaataacaaataagcactgaagtcagttgtataaactaaaccccgtggtttacaaaaagagggaggaggctggccctgaagagtcctgaggaaaagggtggcacagtaagaggtctggaggccagggatgtgacatcaacaagacatcatcacaagggaagaagcttcacatgaggagggtctgagctagagccacagagcggcatggagaagaggaaagatgtttatga

SEQ ID NO: 21948 - DNA, 549 bp, Homo sapiens
agcacagggtgtcaagggaactgccgccaatatttcaagaacaaataattcttattttttagaagtattctggtgtacacaaattattggaaaacttccaaactcatttcatggtcttagcagatcacctaagacagaaagtgcaaaataaagtaaaagatgagatttaactacagtaaacacacacactcacacacacacacacacacacacacagattgcaatgcactcacagtcacacgcgaaaaagaatatttataataagtgaaaccataagcaagttaaaatccacatacatgcaggctgggtgaaaatcttgagaagactgcagactcgaaaataatatggattcattataaagagcaaaataaaaacattgcaaagaaaagtaaaagaagtcaaggagatgcacaggaatttaaaaatacaaacgggaataatttaggcaaaggtgctcaatcagagtattaagcagagtaatgaaaattaaaacaataatgatcatatcagcaaaaattttaaagactgataatatccatgttatcaaag

SEQ ID NO: 21949 - DNA, 558 bp, Homo sapiens
aggggtggacctgctgggcccagggcagccttgagtgcattggtggagagggctgccctgagttgtcctgtgggaggaccacctggagtttccaggaaggaaagaatagttgtgacttttctttttcttgtttccttgatttttatcaggatggtttgcgaagactatcagggaatgaatatgttctttcaacaaaaagtaagtttttcctttttaatttcttagatcactgtctataatactgcagtctagcttaagtgatgaaaataatttttcacctcattaaaaagtttcttggtatgtcataaagcctcagaaacaaagcagctgtccctgaggcggtactgtcctccctaagaaacagttaatcctggccgggagcggtggctcacaccgccgagatgggcagatcacaaggtcaggagttcaagaccagcctggccaacatggcaaaatcctgtctctactgaaaatacaaaaaattagccaggcatggtggcaggtgcttgtaatcccactactcaggaggctgaggcaggagaatcacttgaacccggg

SEQ ID NO: 21950 - DNA, 448 bp, Homo sapiens
gatattatctgttcaaatcttttgttaatttctaccagatcaccttgtcatattttcttattgacttgtagaagttctttatatattctggattaacatcttttgttgaatacatgcattgcaaatattgtgtcttttctgtggtttgtgttttaacgccttttatgggaccttttgataaacagaagtttgtaatattaacatagtccaattttttcaattagctctgtttttaaaaaagttttattattgtacctttcatatatcaatttgcaattcacttggaattgatattcgtgttaggctcaaattatatatatacatacatgtgtatatataaatgtagagagagagaaagcacataataaaaaggccattctttactgccctgcaaagccacttttgtcatagatcaggtaaccatgtatatgtgtaaatagaatttaat

SEQ ID NO: 21951 - DNA, 157 bp, Homo sapiens
cacgtggtcatatttgatatgcaatccctcatttacttacattaatgttttaactagtatttctagtcagatgtcagatgtcattaaaaccaccaacagaagggttaatatataagcagattgaaatataaatattgtaaaagaggaataaaaatga

SEQ ID NO: 21952 - DNA, 527 bp, Homo sapiens
cacatctgaggtttggctagacctggcattagctttgttacaatagtataaactctctcttttaaaaatggaaatacattctgttcctctaattctttactatcctccccctgtcccctccctccctgtctgttttttaactgtgggttttagacattaaaaatatatcaatttctccatttctctggggttcaggatttatgcagttgagtcttttaacttcctgtgatttttgagattctattttactcttgtcttctctgcacatccaagtatgtctatttcttagcgagtgatacctacaaaatatgactagtttcagaactatttccaacttctttgttttttcttgtatttctattgtggcactaattactagcaatatgattaatgcactacttactggtggctttgttcccttggtttttctgataatgctaattaatccaattttgaaaaaaatactttcagttctgctcatacatgtcagattgcaggtgccttggaaatcatttttctcccctttg

SEQ ID NO: 21953 - DNA, 591 bp, Homo sapiens
tgaatctagatacatcacaatcaaactgctgaaaactgaagataaaatatattgaagtcagtgacaaaaaaggaaacattacgtgcagagggataatacatatcacacaatgatacaaatcaaaaattatgtaaggcataagacaaggtactgacatctttaaaataccaagagaaaaaacctgacaactcagaattttatgtctggtaaaaatacctttaaaaaatgaaggtaaaataaagaccttcagacaaacaaaagctgagaatttattgcccataaacctgtgttacaagaaatataaaggaagttcttcaggcagaaggaagatatcaagtggaaattaggatacacacatacaaaaataaagaagctggaaatgaaataataaaggtaaatattaaattatatttcttactttaatcacttttacataggatataggatatgcatacttttttaaaaagctagcttgatacataaaaaactttagaaaaatatacagcaaaattttaactgatcttttttctaagtggaaggattacaaattatttcattttaatcttgatgctgatttgcatttaaaaattt

SEQ ID NO: 21954 - DNA, 577 bp, Homo sapiens
gaactcttcctgaagtatatttttaaaagtgaacacacaattaaaagttatgcattatatcagcacaatgtgaaagaaatgagtaatctaaactcctaggatctttctacataaaagcaaaataataattaagaaggggttaataggaaccaagtcatagaagctactagtagcaaattgaaaagcagagagttaccagtataaaacatttgttctggaaatatcaaaaatatttacacataaacaaatttatataaaaagtacatttgtataaatatttcagttatcatagagaaatatttatgttaacttcatacatcatagagacagtgctatttagtatgatcagcactgtaagagacattaatccagctgggcatggtggctcacacctgtaatcccagcactttgggaggcccaagtgggtggatcacctgaggtcaggagttcgagacaagcctggtcaacatggtgaaaccctgtctctactaaaaatacaaaaattagccgggcatggtggcatgcacctgtaatcccagctattcaggagtctgaggcaggagaatcacttgaaccc

SEQ ID NO: 21955 - DNA, 508 bp, Homo sapiens
ctgaagattgatgagccccgtgcttccctggagtgcaaactagcccagcacaccaccttcacagtagcagtgttagtggccagtaattcccataatgcttctgagtgcagaccagccagggccttgctcctatgggagcaccaaccaagctgaggcaccagctcaccagaccctcacttccccagagtgtgaaccagcctctgaaccagtgtctgagccgagcctcaggccaaccatctctaggcttcttccccagagagcaatctagccatgcactccataaccatagaacacagccagagcaagtttgctagccaatcagctctgtgcttccttggagcagggttcagcctggtgtcttgctcccaaggggagcagagctcaagtaggtggaccagtgacacaaatctctgcagtataagccactgaggcacttgcaggaattgctggcttggtaataactgaagaaactgcagagactacaccattgcacacacccagaacaaaa

SEQ ID NO: 21956 - DNA, 91 bp, Homo sapiens
ggattatgaagaaattggacctagcatttgtcgtcacaatccagtgtttggagtcatgtcgtaaaattggcttcatagttattggggtagg

SEQ ID NO: 21957 - DNA, 589 bp, Homo sapiens
tgctcggtgctgcttgttattatttttcattttcagcatgtatctgatgatcatgccagcctgattgcaccagttagagtgtggctgcccttgacctgattggatccatgtggcattcctttaaggagccttagagttgaccttcctcattctcctggctataatacatcatttccaccctctgttttggggcatctcctactgtggagaggctggcaggagggagtacctactaaccactatggagaccaaatgggtgggatatcctctcctctttggaacagtcagtggtaattatgacataccttgtttaccacctgcacttttctgaaactttcaagtagaggctgctccaggagtggcaagcagaccagtttgctcttgccatataaacttttctgtgattcctactttcttggggctccattcctcccaccagttccccaagactggccttctagccttccattaatgctgttatctttccaataaattttcttatggattaaggtagccagagcctgtttcttttgtttttgatctatagccctgactgatacatgatcttaaccataatgtgttctgagat

SEQ ID NO: 21958 - DNA, 568 bp, Homo sapiens
gggttgggtgctgaaacttcagtgatgaataaaacagaatccctgcatgagcctgaactggccacatcctctgctatcctctggaaaaatgaaagagactttggcagagctaaaaagtaacaactcatcagagaacataaactgaggttcttcagcataccttcagaagcagatgatccatgggaattgactattaacccaagattctcagaacaaagagttgactacacaaagcagacagattccacccatgaccattagaacaaactttttctatgtcacactctcctttccattcctgtctttacggattatctctcttgtacaattcctggctctttcttcctatgtaggaattagtttctttaatgccaatccaggaaaagattaattgttctgcagagttattaagccaattcaaggatatgactccccagtacccttggatggattatgtctcattagagtcctttctgggaaaacaataactagtggaacaaatgcctaaaaatatcaaccccatcgacaggacagtcaattggacaatttgaactgacaattcaaaatt

SEQ ID NO: 21959 - DNA, 585 bp, Homo sapiens
caaaattgtttactttactatcccacaaatattagagtcagaggtttcaagattttgctaagtcagttcctactacattcacaatatgttaatatgagatggataagacagtttggtcggctgtcaagtcatgagttgtataaacactagtacgcaacaaaatgactgtaaaagtcatgtggttcctattggtcatattaaattatacttgaagacttttgcttttctagctgcaaataactgggaaaagagtgtacttgagagcaagactcaaatttaaataaactgtaaatttctcaacatcttggaaacttcagttcagcctctttttatgtgcaagactaaacccagtacagtttataacttgaaatccaaacatatcactagcatactgggttctaatctcagctctgatccacacagcactattaacagtatggcccaaaatatttcacttccctctaaatgaaaaacacaatgatatgtaccagtcttaccagacaaaaaaagattaaatgagataaatattaacaacagcagttgtaactgttaataaataacacaggaaagtatcatttacttgaa

SEQ ID NO: 21960 - DNA, 588 bp, Homo sapiens
atgataaggatgagggcagaaaacagttcccaggaaaatgacagcaggaacgcctgtgggctggcctctgattaaaggttaactgacccacgcagacaggcagattcatgcatcacacatgtgtgtacatgctccaagctctccagtacagtaagtccattgggcaggggcactgctgttcatcattattctctacagccaatgcagcactgagtccaatgctgtcacgtgctcagaaaataatggttgagctatattaggcttctgtttcagttttggagaatgtcctctggctctttcaaattaacttcctctttcaagagaacagagagagacacctacaaaaagatgaacagcaaagcatagaaaggtagaaagtgggccagatgtggtggctcacgcctgtaatcccaaaactttgggaagctgaggcgggcagatcacgaggtcaggagtttgagactagcctgaccaacatggtgaaaccccatctctaccaaaactacaaaaattagtcaggcgtggtggcacatgcctgtagtcccagctactcaggaggctgaggcaggagaattgcttgaacccggg

SEQ ID NO: 21961 - DNA, 538 bp, Homo sapiens
cctcccagacacccatgtaagtataaaacaatatatggtcacagagctcataaaactagaccaaagctgacacagtcaaagttgccctagcatatacatgctcatttaggcagtgggaggatggcaaggcctccaaagctcaagcttctgttttgttccagtcccatggcatcactctctacagcatagaactgaacacaggcaacatattagctgtgtattaaaggggtgagtttagctgggcacagtggctcaagcctgtaatctcagcattttgggaggctgtggcaagctgatcacttgagtccagaagtgtgagaccagcctgggcaacatgtaaaaccccgtctctacggaaaaattcataaattaccgggcatggtggtgcatgcttgtagtgccagctactcaggaggctgaggtgggagcatcacttgagcccaggaggtagaggctgcagtgagctgagatcccaccattgcacttcatcctgggagacagagcaagaccttgtctaaataaaaaaaaaaaaaaaaaa

SEQ ID NO: 21962 - DNA, 482 bp, Homo sapiens
taccccttaatacgcattgtatttgtcctattaagaaaccaaacatcttcccatatagcaacttaagaaaattttttaaataataaaggtattaaaagtatgtgcctgaacaggtatgtaaaactgattctgggtttgcatatgatccatagctgcacaaggtttgtgttgaagtttagatgaagatcgttctgattttattccatcttgtaaatagccctcctgttccacttttcttcgcatagtagaattccaatgatttttgatagaattatcagtcctaagaaaggaaaggtatgatttaaaaagaaaaaaggattccacagatttcaacactgtgttaacttgtacaaagtgcttaaaacaaatttttacactgatgaaattagatacttttttcttaatttttcttttggagtttctactcaggaagataggtattttttaaaaattcaaaagataaactgtatgtgcatatgtca

SEQ ID NO: 21963 - DNA, 416 bp, Homo sapiens
atacacaagagggataacatctcactcccaatagtttagaaaaggaggcagaagaggtgtaagattatgaacatatctccctgaaatcataaactccaaggcaacccagtgacttcttaaaacatcttaccactttcatacattcgtccctgctactcagatttgtgcctagaaatattttgctattgttcctatcctgaagtagattctggaaaattaaattatcatcatcaaatcaagtaaaaaaactgtcatatattctacttttaatctaatataacatcttaaacattactaattagctaaaatatgactttttaccttcctctcagttttataattttcactatcctaatgtaatgacatggtttaaaaatgaatagaataggtcaagagaaaggtatatattataaagt

SEQ ID NO: 21964 - DNA, 552 bp, Homo sapiens
cattacaatccacctcaatgcccaaaaatatcccgctgaacatgcagaatttcaaggaaaacagtatgttttgcttatttgcaggaaagaaatgaatgttcaagagagggaaggggctgtggtttaaaatctccaacttgcaaaggaaagcatatgtcaaccaaagaatcatctttgaccctgcagattttggagctggtcctgtcggggcaggcagaggatccacacacagtatggaggggaaggcactgtgtttggggacagactgaaaggatttgcaatcctattgtttgggaacaatagctgacactgaacccttctttataacaggtatcatgccaagaatttgccaaatatatattttttatttagtaagataaagtaaattgcccaaggtcacatggctagaaaattgcaaagtaggacacacaatcctggcttgactgcttgctggatgatcttaacctttctgtgcctcttcttccagattgttaaaaatggagcatgataaggattctatctgtgctccgcaaacttgcctttccaattctc

SEQ ID NO: 21965 - DNA, 582 bp, Homo sapiens
gaggcatctcctgcactcacaggtgctgttctcagatggacaagaagttaggtcattcaccaggtgaggaggagggcggctgggcaactggccccttcctcacttcactctcttgccgtcattcattcatgcagcatgtattcacttatgattccagaatctttcccttcctcaaactcagctcaagcatcaggtcttggaagcccacagttgcctttccctcccatcctcatatttcccggcactcagctacagaataattaacaatgctcctcctcaggccatagccccttaagggcagtgatttgccttagctttcagtgccggctgggcatggtggctcacacctgtaatcctagcgctttgggaggccgaggtgggcggatcacttgaggtcaggagttcgagaacagcctggccaacatggtgaaaccctgtctctactaaaaatacaaaaattagctgggcatggtggcatgtgctcgtgattccagctgctcaggaggctgaggcaggagaatcacttgaacccaggaggcagaggttgcagtgagctgagatcacaccactgcactccagcct

SEQ ID NO: 21966 - DNA, 414 bp, Homo sapiens
ttggcaaggttaggggaggggagcagcagtaactataagaaaggcacaaagctctgcttgggtccagatcctctctctcccttacacagcaatgacttcatcaccaggaaaagagtagcaccctttgcatctgacagagcaatttaagacagaacaaaactctaacatggaaggagaaagaagacatcattagcccagaccatgaaagattcccttccattgagcaaagaaaaagttcagtgggaagactttacctccaagacccagggacacagcacctatgaagactgaggctgaatcagaaaaacagaaaaccctccatctctaccatgaggttagcaggttttgagtagtaactaacaacagtatactgtagggagaggatcaagaagattggtggagatcttctctgag

SEQ ID NO: 21967 - DNA, 383 bp, Homo sapiens
gggccctgcctctcagagtgtttctttttatcatcccatggtttcccacacagacaaactgttttaaactagacctgaggttgacaaactttgatccacaatagaatctggcccacccccaagatgactttgcatttttatatgtttaaggggataaaaactcaagagaggtttaatattttatataattttcaggtgtcacaaaacattatataattatgtccaaattacatagttacagtgcagactgtatgacctgcaaagctgaaatatttaccatctttcctcttatagaaagactttgctgagcgaaaccccatctctgcaaaaaaatacaaaatttaggcatggtggcgtgctcctgtagtcccagctactgatgg

SEQ ID NO: 21968 - DNA, 471 bp, Homo sapiens
gtaccaaattagatgcaaatattcttaacaaaacagtaccaaattaggttaacatatgtatcaagtagggtggtaatccaggaacacaaagttgaacaacctcagtatctattcattgaaaaactttcagtaaactaggactggaaagaaacttcttcagcttgataatggatacctatgaaaaactatcaatatatttaatggtgaaataccggacattttcaccccaatactggaaataaggctattatacattttaaccacttctatccaaggttggaaaggaagaattaaaactgctcctatttatcaataagattccatagaaaatcctaaggaatcaacaaaaatactattggaggtactaagttgagtttcacaaggtgtcagaatataagatctatatatgaaaaccaatcaattccatttctatagaactggcaattccaattccatagaactggaaaataa

SEQ ID NO: 21969 - DNA, 221 bp, Homo sapiens
atgttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagggtctcagggcagaagatctgccggaggagagggagaagagggttctgaggggaggaag

SEQ ID NO: 21970 - DNA, 588 bp, Homo sapiens
aaaagctttcttaagcagtcttcttaccaaatgcagatttgtttgagcattcttttggtagtcatccctccaaatgtgtgcacatgttttccccctgcacctagaatgctctttctccttgaagttcatgctgaactctcatctttccttcaggctcaccctaggtcttggcatatcaggaagtcttcagtggcatccctggaggcagcaggatgaaatgtacaaagcctggacctcagactttggtgttcatcctgtttctgataattacttatgacagccaggacacagcaattcatatttcctagcctaagtttctgcataagcacatacctgccacaagtttgttgttagtgcctgttctcttttcttcagtcatgcaagaaccttgcctgctacttctgtatcgtggcaataattgcagaactttacacttttcagatgtttcggtgtgagctctgaagctgctgctactgttgatcacacagtggcggtcacctactccttcagctcccactgcagcattgctccatatttaaaagggataacccaagaattgacgacgttgcagtaactcaaaggatgata

SEQ ID NO: 21971 - DNA, 579 bp, Homo sapiens
aggaaatctcaagtataacctagaagatgaagtatttctatctccatatgactagttctcattagtaatgtctttttttaaattaaaaaactatcaaggctgggtgcagtggctcacgtctgtaatctcagcactttgggaggccgaggcaggcggatcacgaggtcaggagttcgagaccagcctggccaacatggtgaaacaccttctctactgaagatacaaaacattagctgggcatcgtaccgtgtgcctgtaatcccagctatttgggatactgaagcaggagaattgcttgaacctaggaagtagaggttgcagtgagcggagattgtgccattatatcccagcctgggtgacagggggagactccgtctcaaaaaataaaataaaataaaaatagataaaactatcgcgcttggtcgggcccggtggctcacacctgtaatcccagcattttgggaggtcaaggcaggtagattgcctgagggcaggagtttgagaccagcctgatcaacatggtgaaaccccgactctactaaaaatacaaaaattagccgagcctagtggagggtgcct

SEQ ID NO: 21972 - DNA, 588 bp, Homo sapiens
ataatcagcagaacattacaacattgtaattgtatatatatgtgtgtaccttttaaacacccaaagtcataaatcagattacctggagtattgagtggtccagacgtactatattcagacgagcttgcgacacctattttaatacaaattatcaggctattttatgtgtataattttacttggtaaagtgatttttaaagactatctgacggatagaccataggtcctagtccagcaatgctaatgctagcagactaagactgtgtaaagctgtacaagaaaaaaaatatcaactcaaaaatttgctggggtaagaaaattaaatgccttgcctctaaattaactgacaccaaatcaatttttttctagatcatttgtcttaaaacttgtcaagggtaacagaaaagagttcagtacacagggttctaggtctcctatcccagtgtcaaccaaactgtttcccattctgaattgttttacttttaggaaacctgggtactatttcaagaggtcaattaaacaaaagattctgcactcacggaaaccagaaatatgaaaaccactaatctaaatgaactgacaccttca

SEQ ID NO: 21973 - DNA, 591 bp, Homo sapiens
cttgcaagagactcaacagggtgaagggtggaaaaatgtcagtgaacattgtggttgtaataccaccttacttcacatttcccagtgactttttatgcttcatatagaaatgttcaaaacatatctcattgcatttcatttctagattgcagcgtggttgtattgtttttccccctgtactttaaagactaagtacactttcatcccagatattaccaaaatcatacagatgattcagcacttagacaaaactgcctgataattttccatctttatcatttttcattcttgacctgaatcttttggtattgtgtaagtgctgcctaaatgaaaagtttttctttttagttttaagaaatgtgtgttataggccgggcgcagtggcttacacctgtaatcccagcactttgggaggccgaggcaggcggatcacaaggtcaggagatcgagaccatcctggctaacacggtgaaaccccgtctctactaaaaatacaaaaaaattagccgggtgtggtggcgggtgcctgtagttccagctactcgggagactgaggcaggagaatggtgtgaacccgggaggcggagcttg

SEQ ID NO: 21974 - DNA, 581 bp, Homo sapiens
ttcagaggggacgtgacttgtctgaggtcacagagccactgaacagcgtgccaggggataggaactcaacccagggttaccccaaggcccacgctgggtccatgccctcatgcccaggcagtacagaagccaccactaatggctgctgagattcggcattgcttccccgagtccactgggcctcgcccttccagtaaggccccccgagtgtccctcctgccaccataagcaaccccacacgctgctgtggcacaacaccacgccttggaacgaacccgatctctgccactgagtggtgtggggccttggacgagtcacacccctttaccaggcctcagttctcctcatctgtaaagtgggtcttaggacacggggattttgtgagatgggatacaagaacacagggggccgggtgcagtggctcaagcctataatccctgcactttgggaggccaaggtgggtagatcgcttaaggtcaggagttcaagaccagcctggccaacatggtgaagccctgtctctattaaaactacaaaaattagccgggtatggtggcaggtgcctgtaatcccagctactc

SEQ ID NO: 21975 - DNA, 394 bp, Homo sapiens
gcagttccatgacgtagttcagaaagcacagggcttagagtaagtcccacaaaataaaacagaccctcgctctggccttgggcaagacactagagctctgtaagttttactttctccatttaatataatggtgaggggagggtacctttatgaaaatcagccacatctacaaaaataaatgctgtttttcagctatactggtaacacaggcattctctagtatgagttaggtgatggattgcagtacatgggagtggcctacagaatcactcccagtccacacatgggggactggcacagaaacagcaataaggagtgcttctgaggtcaaaccgaggcaggaattaggagaagaaagtgaccaagtgcaggtagagaatggggaggagctgag

SEQ ID NO: 21976 - DNA, 581 bp, Homo sapiens
ggtggcggtggatttttccctccagggaacatttggcaatgtcaggatggtttgattgtcacacaggaggtggggcttactggcatctagtggacagaggccagggatgctgctaaacatcctccagctcacagcaccccgaaatgaagatgtatctggccccagcagtgccaaagttgtggaacaatgaattagaactcaaagggggaaaataggatactgagtaggatagggaaatatcaaattgtgaaggatattggtccaatttaacaaacacttactgaacatcaactttgtaccagggcctgtgctcagcaccagggactaaaaaggtgatcaaggcatgatctctttaaaatcatataacctggccaggacaggtgcggtggctcatgcctgtaatcccagcactttgggaggccaaggcgggtggatcacctgaggtcaggagtttgagaccagcctggccaacatggtgaaaactcatctctactaaaaatacaaaaattagctggacgtgatgacttgtgccctgtaattccagctacttgggaggctgaggcaggagaatcgcttgaacc

SEQ ID NO: 21977 - DNA, 547 bp, Homo sapiens
tggaggcaacatagtcaaagaccttggtacagtgctttaatatgaaatagacatctctcccacctccccattaggcatcttttatgcttatatgcatacttgtacaaggaaccaatggcttagatctgtaagggtctaaagtatatcagacgagtgagaatttcatcaaacttgtaattttgacacagcacatacatatttttcacatgggatacatattgttaacaggagaatttggtaacaagtgattgaacttctagagctggtgatttttttagcagaactttagatatttaagaaaaattatctgcatataacagtcaaatttttcccttcatacaccccctgtctctaacctacatgtgctgctctatgaccaggtctaaattccagatgttccaagtagctcttcatttagtcttgtcttctgatggcacctaaacaaatatatcaaaacttgtacaacatttagaaagtggaacttgaagattttctttctgttagacaaatagacgccatctggaaaaaataaccccaggcgcttgga

SEQ ID NO: 21978 - DNA, 572 bp, Homo sapiens
gcaggtttagctaacaaccgctccgatctcctcttgggctcttccttggcggcccctttgtcagagctgaccttcctcttgggcatcctggcagcggggagggcatgtgccaggatcctgcggacgggggcgcacctagagccttcgcgaagctgggctgcagttcctcccgccgcccgagctgctgagacccactgccttaactacattttgaaaacttgaaccaacatttcaaaatcaggacatttcatatacaagtctggatgtcagtcttcccttgaacaaccagggcctgcatttgcgtagatcagctcaacaaaggaggcagagaagggtatgtgatgttcaccacagctctgacaactccccagtgagactctgcctctctcaattgtcctgccaccgtttttatctccaaataaatacgttttataccttcatgtctataaagaattgaaaagcaaaagatagaccaataaagtatcacattttaagaaaaagggaaaaatatattttcccttttaaatttcaactaccttctttaatttaaattaaatatccaaagactttct

SEQ ID NO: 21979 - DNA, 585 bp, Homo sapiens
gtgcccggcccttatccttaaattttaaacaaactagccatttatttgtttaactactaggctgcgagatactaataagtcaaactgttggaattttaaaagtcttgaacttcacactagggaaaccagtaggggaaaggctgtggctgactggtgaaggttttggaagcttattcctgggagatcaagggataccaagccactgtcaggagccaacaagacttcagggaatgagacatcacaagaagtcaggagttggtgacaagggggctaaacaggaatctgatatgaggccacaaactgggctgggcgctgcttataatctctacagatccaggctgtatttgacccctcagcccaccccaagtgactcaggaataccaggaattaaagagtcagtagagagggccaggcgcggtggctcacgcctgtaatcccagcactttgggaggccgaggtgggtggatcacgaggtcaggagatcgagaccatcctggctaacacggtgaaaccccgtctctactaaaaaaatacaaaaattagccaggcgtgatggtgggtgcctgtagtcccagctacttggga

SEQ ID NO: 21980 - DNA, 591 bp, Homo sapiens
gtgcaatgctgtgtgcattcacagcaaacacctgagggaggaaaagtcaatggtcactcatctcttcttggccttaaggccatgatcaaacaggaagtaaaagctaaggttatcttgtaaactgatgccaaaaaataaaaagtgggagacatataggaaactcatttaaagaaatcttctggcccataattgaccacgaggttataatcatcaagggcttactctcagaaagccaagcttaaaaataaagacaaaaacatttattaagaagctagtagagaactaagtagacacacacagcaggacaggcagaatgtacagaatgactccatgaaagtcacaagcaaataagaagcaaaaagaaaacctaaaatgacaacataaaaataggaacacaatacatctttgtgagacagaaatattgtcacaatacattaatgaccagaactcaaaaaatatatattaacatgcaaacaaatggtaaagtaagccacatgcacaaagaaaaagcagcaaacaccacatttcatatggaaactttaagcatgaacgtagtttacaaagacattaaatcaactattatcaatatat

SEQ ID NO: 21981 - DNA, 594 bp, Homo sapiens
gtactaccttaaaaaaaataaccctttcctggcctttcatatagttgaacattttcataatgactaaaaaggtaaaaataaattaacaaccataattaaattagaattctactttttaaatcagatgaaatactgtataaaatgtccagaaaatctagtgttaatgaggctgtgcatcctggacatttgatgtctcatctgtgggaatgtgaactaacccaaccattgtgaataactattggctctgtgtgttaacagtctagagtcctgaaacaaggatcttaattctaaaataaaatcctattctaagaatataccaagggttgataatgaaggaagtttcaaagttatagagaagaaccttcatcctagcattatatatgtaatcatccatataaaccagatagtgttgaatgaaactgcagaaaaacaaagagcctacagaatatgtttctctttgtgtacaactgtaaatgtacacatctatccacgtaaaattttacatctcaggaggataagtactgacatgctaacatgctataagataagaaattttacttttctacaatttcatacacacacacactccctcac

SEQ ID NO: 21982 - DNA, 589 bp, Homo sapiens
ccaggcatttttctgtatatttatttctaatttctgtttctttcttatgaattgtctggttaagtcctttctcattatctcaaggtgttttagtatgagatttaagaatattagatatataagcccttgagctatcatattagttagaagtagttccccttttttggtcttttcatttttattactatatgtacaaaagtttaacatcctatggagtaccttgttcatggataggaagagtgaatattttaaggacagctctactctccaattggtttatagatgcaatgcaattctaatcaaagtctaaaaaggttctatgtaaaaccttacaggtttactctaaaatttatatggaagaggaaaaggctaaaagcatccaaaatacacttaacgaaaaagagcaaaacagggaggtttgtctcccagaaattaagatttattggaccgggcgcagtggctcagggccgggtgcggtggctcacacctgtaatcccagcactttgggaggccaaggtgggcggatcacctgaggtcaggagctcaagaccagcctgaccaacatggagaaactccatctctactaaaa

SEQ ID NO: 21983 - DNA, 587 bp, Homo sapiens
tgcccaggctagagtgcaatggcacgatcttggctcactgcaacctctgcctcctgggttcaagcgattctcctgcctcagcctcccaagtagctgggattacaggcatgcaccaccacacccagctaattttgtatttttagtacaaacagggtttcatcatgttggtcagtctggtctcgaactcctgacctcgagtgatccacccgcctcggcctcctaaaagtgctgggattacagatgtaagccaccgtgcccagcctgaagtatttagaattggtttctgggaaaaccaaacactgcaaatttactacatcaattagcaggcaacagttaatatttaatattcaatgactaaaacttcctaaagaaatgtatatgtccctaagagtaaaacattctgaatagtttataaattattgattatatcaacaataataccaatttgtttagctaacatttctctaatgaatgtatcatataatgtcagttaactatgtattttgcttctacttaaattttagattcccaggttattttttcccataaaagcaatctagccattttgatatgttaagtcctatcga

SEQ ID NO: 21984 - DNA, 582 bp, Homo sapiens
acatagtagtaaatactttgttttttattaaattagtaatctaaattattacctctggaacaatgtttcttcaactatattccaaagaataattaccttaccagaagcactgtaccccaacagattccaccattatctatgttcaagaaaagttataaaactgtgaattaaatgttcattattcaataaatgaattgaactttacctaatccttatttgacagtatatttttgtggcaaacattaacatttgacaaattagaattttagggatgcagttttgaaagcttccccccaaaaagggaggtttcctctgggtgatacaaacttacttgattctcttctatcaataatcccaagattccagatgccaatgtcaggcactcctgctctaaatgggtcactaaggaagtggctctaaattaaaagagattggcttcaaataaactttgattgcttattattaaatcatccatgaggtttatcctattaccagacaataggattttatctcagttattagaaattcagtataaaaggccaggcaagggtggttcatgcctgtaatcccagcactttggga

SEQ ID NO: 21985 - DNA, 536 bp, Homo sapiens
gttactcccattttataggcaaggatattgagacacagtgaccacacaaatagcaagtggcaagccaaggtttgaatcccagtttgaggtcaccactgtgctctgtgaacaggacttatgatggccaagtactaatattacaatattggaatttatactctctggagttacgattcagggagagatgatttggaagtataaagtcagatattttcatattaaatctaggtcaaatgttctcaaccagaggttatttgcatcactctcccaccaccctgaccaggagacatttggtaatgcccagagacatgtttggttgtcacaactggggactgctactggcacctagtgggtacaggctaggggtgccgtgaaaaattccataatgcacaagatgcaccacccccccccgccaaagaattgcctactccaaaatgtccacagtgctgtgatccagacaccagctctaggggtttggtttagttgccatattttcctctcccctacccattcttctctttggattttaattctct

SEQ ID NO: 21986 - DNA, 586 bp, Homo sapiens
gaacaaacaatgcttttacccatttaaatgagtttttaacagtgggagttttaggcaagttttaggcaagtattttgccttaacagaagactctgcctatttataattttttaaaaacagattcattgactcttagagttgaatggcttcttgtctcatccaacccactatgtaatgtagttatccctgtattgcatccatgacagatcatcctccggcatttaccaactgccagggacggtttcacctcaccagcaagctgttgaataaattctcatgtgaatccacaatctgcccactgatctagagagttgttttctcctttacctgacagctcttcacatgtttgttagtttctcagactacctgtctctaggaggtttagttattgtctgaatgagatagtttccagacttctcactatcctggtcattctcctctcagtgctttctagttggcaaatgtccctcttgaaaatgttgcctaggccgggtgcagtggctcacgcctataatcccagcactttgggaggtcgggataggtggatcccttgagctcaggagttcaagaccagcctgggcaacgt

SEQ ID NO: 21987 - DNA, 323 bp, Homo sapiens
atgagtaagacataatccatgactctaaatagctgaagtaatgactataatgcaaattatttgcacacaagataaaaagtattatagctgctgggctagaagtacttgcaagatagaagtgggagcaaagaagagaatgcttaattttgccactgggcacatgaaaagaaaggattcacagagggggtgacactttaaagaagagaatacttaattttgtcgctgggcatatgaaaaggaaagattcaccgaggaggtgacactttagttggaatttttttaacgtattgatgttcaccaaagtggagagattggataaagag

SEQ ID NO: 21988 - DNA, 272 bp, Homo sapiens
  misc_feature 96, 97: n = A,T,C or G
aacagagcaagactctgtctcaaaaaaacaaaacaaaacaaaaaccagtaaaaacccataaaacttggaattagttttagagaggaactggggctnnaacagagcaagactctgtctcaaaaaacaaaacaaaacaaaaaccagtaaaaacccataaaacttggaattagttttagagaggaactggggctttgaggagtaaattttctatattttgctggaaacctggtaatttttttttttttaaactattattttaagttagggggtac

SEQ ID NO: 21989 - DNA, 558 bp, Homo sapiens
gcacatcaacaaattagtaaagttagtcctttgaaaagtactaggaactggaatcagaaaacctgaactggaattggaaattctcaaccatatacttttgctaactctatgacttcagataagtcacccagttattctggaacttggttaattcatctaaaaaaactggttattataaagataaaagaactgtttatttaaccaacagccatttcccccatctttcttcctgagagagccctgattttactcaggtatcaggcaggcagcaaagtgctcggaaaaggcaggtccagcccaagagctgaaccactattggtctaaacccatcatggcaaccccattcccattttccagtgactggtttgctggtacgcaagtaagccagttctagacaatggagcacgagagtatgctggctggggagcttctcagggatgtttttgcaaatcaaaagagcaatgcatgaaagggaatgacccttcctttctgtcttgagatattatcttatgaggcagccatcttacaaccatgagaagaaagccggccgggtgcggt

SEQ ID NO: 21990 - DNA, 89 bp, Homo sapiens
gggtctggttttactcatctctgagtctagcctctaacccactgcttgacgcagaaaaggtacctggtgaaaatctattaaaatcaatg

SEQ ID NO: 21991 - DNA, 528 bp, Homo sapiens
gttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcccattacaagtttt

SEQ ID NO: 21992 - DNA, 581 bp, Homo sapiens
accatacacttttacaatttatgcagtagctagaagttagtcatttccatctttagcatttctacttgagacaacttacctggtgagattttgccaccgcatcaaaaaacaaggaaagtggtaatgatggctgaaacattaaggagaggtacagaggtatgagttctatatttgtggataatattcaggttttctaaaaaaactttccacaaagcaatcacatttctctagtttttctacaaagaatgtaaatgctgcccactgaatgatgactcaattccaaaatgatgattccatttcttgagaattacatttgacagtacattactgatgatggtgttcaagttttttaaaaaagcacttattgtggaaaatggtaagatgaaaatcaccactttatgattttcttgtgtccacgtaggagcccagaactatcccaatacatattaactttctttatttagtcctccatttgtcacttatggtgtcaaaatatcacattaatttcattgctgtaccatagaagaatggcaattatagaaatactaagcactatataaaaatactcacagtgtgctaca

SEQ ID NO: 21993 - DNA, 389 bp, Homo sapiens
tggtatttggatgtacaacataactacattctttactgctgttcttggaaatgccataacctaaacaaattcttgtttccattactaaattcaaaaattttgagtcagtgcagtggtagatatgggtaaacatttatagcatttaaaaaaaattgtaaaatcttaaaaaaggatcaagatttggcagtgctgagttaatagcagtcaatcaaattgaatttgaccattgggactgagatttggccccttaaccatatgttattgctttgctccagaaaatattttagtagtattatcagaaatacttccatttatttttttcctttttttaatttttatttttggcagagcatagcatttggtaattcttggggtcattactagggttt

SEQ ID NO: 21994 - DNA, 586 bp, Homo sapiens
tgatagttaagatcaattaaccaattagttacccattttcatttttcctgtatattctttgtagatcacttactaaaatgattttctaagaccttcactttcttaagtaaagaaaaacaatttgactgagacttggccatttagctaaaatctaaaagacctatttaatttaaagtataagtcaagcagagatcttatcttctgtccataaataataagaatgattgtttttcgctaagtggaaaaagtgagatgaggcaagaagttgaagaatgcctagccaggtagcatatgaagcctacaagtttccagccgtgggtctgatgaaaaataatgagacatctgatggaacttaggatcttatttgaaaaataagccatcaagtactttaactttctggtatttcaaaagtaaaaacatatactaatcacttgtttttatttcacttatttgacactacacatctgtcttagtacaaactcatgtttatgcaatgagatttattagactgatagttcatatcttagccccttttcatagagaatcattgaaaaaaaaactgttcactgtgagaaaactctctccc

SEQ ID NO: 21995 - DNA, 461 bp, Homo sapiens
tggtggatgagatgtatgaagatctaaatgcctgcagatagtgagctgtctgcaactaccacaaagcaaaatcatgggcgataactccccagggtaggatctggcctgagcatccccactgggagatgggaggtgatgggctctgtagtgcttagttgaatagagttatctatgtcagtattccctctatgcaaagatagttgagagttcacaagttgtaggctttcaagttgagctatgttagatatatgctcccctgatggaagacagacatgtctccagggttttgagggtcaaatgacagaatgtatataaagtgttttgaacattataaattgcctccttagaggcaagggaacatcaaatttggttgttttcttgcatcagagacttctagctcagatttctttgtcggccatttttaagggcatttccaatgagtttttaagtgtaatgagttt

SEQ ID NO: 21996 - DNA, 581 bp, Homo sapiens
ggttccagggaggagttcgggagtatctaagatgactgaggggtccaggagagtggggcctgtcttcagggttctgagccaagggctactgtggctaaacaggagcagaatattctgtattagatttcaccttgccccagggaagatcattttgaagatggaggggctgcttaggctgcaggaaattgcccttccctgaaggccttcagggtacctgggggccactcagtgggaacactagaagtgaataattaaagtgtccaattctgggctgcagcgggtagccctttgcagttcctccattttttagttttggtgacatgacacctctcccttcctttcacaatttgcaagtatactagtttgggtagatcggatctccgtcctttagtctggagggcccccatctgtcctcagagttcagatgccccaggacccacttggatgcagtggggagtcccggagttgaggctgtctgcccagaaggggattgcacctctgggagacctgccttcctgtgctgatgggcccagaggcaccgggagaagctggccttgtatctattataagcccaggagaag

SEQ ID NO: 21997 - DNA, 585 bp, Homo sapiens
gaacatttatgcatgatatttgactaactcaatttcctaaacctccccattaaacctttaatgccttatatttactaattctgaagctagcttttggattaagaagctttaacctaaacagttaaaaacactgcaaaaacaaaatgttgattaacaactcacagatttatactctagcgtctaagccagtcaaatatatggatgggtagatagattagatagataggtagataatacatatatgagaaattagagagtgagagaaatggaaagatacaggtaaatataaatgcagatatagatacgagagagagaaagatttatttctggctaagatggatgaaggacactccactccaaccaactctttcactgaatgtagctataaaacaatgtacctagaaagaatgtggatgaagcagatgactctgaaaagaaaataggggcgggtgaaagatttatacgatctgaagagaaactgctaaagaaaatgcggtacatatacaccttggaatattatgcagccataacaaagaattagctcatgtcctttgcagggacatggatggagctggaggtcattat

SEQ ID NO: 21998 - DNA, 588 bp, Homo sapiens
gaactctaaggtttaccatatgcacaggaagccccatgagaggttccttaggagtcactataaatttgcagtctaactgatatatgtatcaccagataggtcccaataattataaataataactaaatactaaagacaccatgtataccccagttattatacttcttgtgggaaggcctgacattggcctgcttcccttatgaaaacatggtgacttgccccataggggatggttataagaaacctttaagtgcttaagaaaatgccaccagtagaccttgtagtcttcagaaagctgtaaagatctctccaaaatgatgctaactgtagttattcaggaagcttttcagaaggatacataactcattatttacatgtatttttaaatattattattgatatagtcatacccccatattttgggggtgcatgtaatatttttcttacatgtatacaatgtgttattattaaatcagggtaattggcatatctatcacctaaagtatttatcttttctttgtgctgggaacattacaatttgatgctttttcttacagaagtgacttagttagaaaaagtggtatgaaa

SEQ ID NO: 21999 - DNA, 575 bp, Homo sapiens
aattcacagagacagagtgcaagggtagttgccagggactcgggggagagaacagggagataccacttaatgaatatagagttctagtgaaggaagacaaaaaacttctggagatagatattggtgaaagttgtacgacgatgtgaatatacttaatgccactaaattgtacacttaaaaacagttaaaatggtggattttatgttacaaatatttttccataatataaaaaatctttattaactgcatctatccttcactgtcctttatatttttgttaaggcataatagcatttttataatgctttagtaatcatttcatatcatctggttgtgaatctttatctttaaatatagcatttatttatcataataaaattggaactagatccaaaacaaaacatcaagctctctagtaaatgagaatatgcattgggaaagagtgaagagctctcatctgggtcaatgaatttaggcaaggtctagaatcactcatttttaatttttaatttgttctctccatctggaaagccatagtcacatggtaaacatgcgcctaagacaatgtgcctttc

SEQ ID NO: 22000 - DNA, 556 bp, Homo sapiens
agcagcagaatgcagggggacaaataaccacctcaacctttactgtctcttttcacaaaatggtcatggctgaatgaggctttgggacagtgtgagtggactctgctcatagataagttaccttgaggaacaagactgaaatagatgtttcataaaagtgtctttttttcctttttcctcattcagattataaattcattaagtgcagaaactttttctttttttttgagacagagtcttactcattgcccgggctggagtacagtggtacaatctcggctcactactacctctgcctcctgggttcaagcaattctcctgcctcagcctcccaagtagctgggactacaggcacgtgctaccatgcccagctaatttttgtatttttagtagagacgagatttcaccatgttgcccaggctggtcttgaactccagacctcaagtgatcctcttgcctcggcttcccaaagtgctggaattgtagatgtgagccactgtgccagtccaggaattaatgtttttacatatgtttatctttttaaggtttttttggt

SEQ ID NO: 22001 - DNA, 560 bp, Homo sapiens
  misc_feature 312, 443, 457, 459, 546: n = A,T,C or G
gggataacagcattatgtgtaataattaaaaggaatgaaggagggagccaaatgcccatctagcatacagtgaataaatgaagtgtatgctgtggaattctctagagtggtcaaggcatcataccactgcgggcttcaacatggatgcatctcagaaatcattgagtgaagtcagaatagagccagcatgggtacctttatgtaaagttcaaaatcagaaaaaactaagtatattgtttagggactcagacacaagtagtaaagctataaaggaaagacagttattaacattcaggaacatagtttcctcangagagggtggtggaggggaatgagaacagaggggagaacggggacttggaagcacttcatatatgaacgtttggaccattctaacatgccagttctctgagttaatgtttattcagtgtaaagccattcanataccacagttttntntatctaaaaactctgggagtttaacagatgaaataggaaatccccttgaagtgaaaaatggaggacttgctgtccaaaaatactttntagtgcattaataa

SEQ ID NO: 22002 - DNA, 820 bp, Homo sapiens
  misc_feature 8, 9, 10, 11, 12, 13, 14, 18, 22, 29, 40, 42, 49, 59, 62,69, 87, 95, 538, 570, 643, 661, 667, 718, 737, 748, 756,762, 805, 817, 818: n = A,T,C or G
tcttgggnnnnnnnaaancttncttgttncttttggccgnancggcctncggctgcganagncgacagnagggacaccaaactgganttgtaagnatggcaacattaatttatactccagtcatctagtgttccaaaatattttacataagagacatttttatttttatcaattaaatgggggtaacattgttcttcaatgtgatttttgcattttcctaatagctaataaaattaatcatctgaggtttttattattttccaatattttcctttttgggaactttttaatcggttggcatattttctcatttaattgatttgtagtttttaaaatgtattattcagagtactgatattacactgggaatttgttgatttttcttgatttttattacaaagatattatttgattcttgtaattttaatgcagtaaaatataacactcttgctctgcatgtttaaatacttttgcatctggcttaagaaacatatccctagattttgtttagaaattgtgctttttggctgggtacggnggctgaagtctgtaatcccagcattttgggangccgaggtgggcagatcatgagtctgagaccagcctgaccaacatggagaagcccatctctactagaactacnaaattagcccggcgtggngggggncatgcctgtaatcccagctactggggaggctgaggcaggagaatctttganctgggaggcaaagttgcangagctgaaacnctcttgcnctccanctggcacaaagcaaacccctctcaaaaaaaaaaaaaaaccccngggccctttctnnaa

SEQ ID NO: 22003 - DNA, 723 bp, Homo sapiens
  misc_feature 412, 530, 564, 567, 607, 653, 674, 697, 704, 709, 710, 711,712, 717, 721: n = A,T,C or G
aggggaaaacagttgccacctttgggcaaagctaattaactacaatacacatgttcagttcaggatttctaaagagaaagaaatgtttgattctggtgtatgttacccaacctgaccacacatatggcaggtttgggccaagaggagggagcaggaggacattagttctgatttcaggtaactgttaactcgttctacttcttggaataatatgataccagagagagagagcttctatgtgaagctttgtggatttgaaaactgctatactgaatattttatgatcttgtcaaggcctccccttatcatgtgacctcaaggcgctaccatggctttcatcttgtgaagtcttgaacatttgtagttgcagaaaaacctcaagagactcagtatttcaaaagccatagtttangttttattttctaggctgggatgtttgtgggttttcttattataaaattagagttgtcatagtgatgttgtgtatttcaaaccagatattctgtggtcgcagcaaagtctcactttangaaatggatttctttatgaatgtgctaccattgngcncagaaagtagcccatacagataacaggcatctttggtagnggggggggttggggtaaattaaatttctgaggattgacaaaactcnttacctaaaactgggccagcnctttgggagcccaggcggcggtnacaggcnggaannnnacctnccgnta

SEQ ID NO: 22004 - DNA, 763 bp, Homo sapiens
  misc_feature 1, 8, 19, 24, 30, 504, 601, 616, 649, 655, 669, 674, 681,735, 740, 746, 747, 748, 752, 753, 754, 755, 756, 760: n = A,T,C or G
ncggcctncggctgcgagnaagangacagnaggggttttgagacagagcaatagattgcctccatatcttttaaacattcaggtctcttgtataagaaaaataaccattgtggggtttttgtgcatcttatactaatatgaaacaaacaaaaccccctggatattttatccttagaaagatagaggaagacaggagaagggaatggtcattgtaaattagatagatatattgagtgttagaagattatttaaataattgttcttttgttatttgtactctttgcaaatttatttaaatgcatattcatgtatatcataagtatatattcacatgcatgtctaaatttagtggcatagatctatctcaggggtattaatctttcattcgtgtactgatttgtgttttattttcatttaaaaaattgtggaaccagtggctgggcatggtggctcatgcctgtaatcccagcactttgggaggctgaggcgggtggatcacctganggtcaggagttcgagaccagcctggccaacatggtgaacccccccgtctctactaaaactacaaaaattagctcgcatggtggtagatgcctgtatnccagctactcgggangctgagacaggagaattgcttgaccctggaggnggaggntgcagtgagccganatgcncattgcnctccacctaggcacagaccaaactctgttaaaaaaaaaaaaaaaaaaaaaaaanggccnttttcnnntccnnnnnaaanttt

SEQ ID NO: 22005 - DNA, 714 bp, Homo sapiens
  misc_feature 1, 2, 10, 12, 647, 673, 687, 689: n = A,T,C or G
nnacgacagnanggcagcagtgcatgactgatggcaatttctttgcaacaatggggattaagtttcatcatgaattttggagaggacatattaaaacagtaccattcaattggaaacctttacttagcaaacatgggtccttgaaatgtatcctcactaatcttactgactgtaagtccatttcatcccctaattgattttatctaacctttgagattctacacagtcagtcttgttgctacctacttggggtgtatttgctgtgtaaggcaaagacctagtaatatttactaaatgctatgaaagatcaggcacagtggctcacacctgtaatcccaacactttgggaggctgaggtgggaggatcacgagtccaggaggtcaaggctacagtctgctgtgattgtgtcaccgcactacagcctgggtgacagagcaagaccctgtctcaaaaaaaaccattttttagtgtgaatggagaaaagtctagttggtggtcttgagttttttctaatgaagcgaggtgggtggtatgtacagctttgggatccctcacacctggatatgaatctctgaataactaccctaagattcacattctagtagtggagagttgcatgtaaacataattatcacattagtcctgngtcttttgcacactgagatcctgcancttggttaatgaangngtcatgaataatatggaggattgcc

SEQ ID NO: 22006 - DNA, 864 bp, Homo sapiens
  misc_feature 10, 11, 12, 13, 15, 18, 29, 40, 42, 49, 60, 63, 71, 84, 87,117, 120, 121, 190, 212, 213, 225, 247, 250, 261, 345, 348,356, 393, 402, 442, 470, 488, 505, 521, 536, 552, 584, 587,599, 616, 624, 658, 668, 672, 678, 680, 695, 731, 739: n = A,T,C or G
  misc_feature 743, 750, 753, 761, 771, 813, 814, 815, 821, 833, 838, 846,848, 859: n = A,T,C or G
tacttggttnnnntnaancttttttgttncttttggccgnancggcctncggctgcgagnagnacgacagnaggggtgagcccnggngccagacagcatgtaaagacaacaaactgnggnnacctaagctctctcacaaggaagataaaactcttctccccaaaggcaagagcttggaaaagatgcctanagaaaggagcagagtataatannaacataacagtntgtctgagacccctttaagganttnactctaagtantaggtaacttatccagggggagattttatcattcctttatgctgccaagaaatccttgggtttcatgcaagattttttatatantanaacagtantattttaacaccacagcttctgctgtcagtaaagtangatctggtnaataaaggtgaataattatcatatgagccaaagagaatanaagtcacaaactgtagtgtgcatagtangtaacttataatcatgtngactttgctgatttggngttaaaatagtagtantagaatataatgttngtatttggctgggcgnggtggctcacgcctgtaatcccaacactttgngangtcgaggcgggnggatcacttgaggtcangagttcangaccaacctggccaacatggcgaaaccccgtctntactaaaatncccnaaaacncncaaaaagaaaattanccaggcattatggcgcacgcctgtaatcccagctcnccggaggncganacatcgnggnaccacctntatccagctnctgggaggtgaaacaggaaatacttgaccagagcaaggtgcnnngaaccnaattggccctgnctccncctggcananacagactcctntaaaa

SEQ ID NO: 22007 - DNA, 491 bp, Homo sapiens
  misc_feature 173, 189, 202, 204, 206, 208, 209, 213, 231, 245, 248, 270,271, 272, 275, 278, 287, 329, 353, 361, 369, 387, 415, 428,443, 445, 450, 452, 456, 472: n = A,T,C or G
gggatcaacagcaatggcagcatctgccttgatatcctgcggtctcagtggtctccagcgttgaccgtgtcaaaagttctcttgtccatctgctcgctgctctgcgacccccaaccccgatgacccccctggtgccagagatagcacacaccttacaagggccgaccggaaangaagttcccacccggnacttagcccaagnanangnngggnccccaaaaaaatttttgnctttttgttaaagnggnccctttggggaggggtttttannntgnaanaaaaccttngtccccaaaaaaaaaaaaaccttgggccaaaaaaaggggttnttcccttttaaaaaaatttttggncctttttnggcttttncccccctttttaaaaaanaccttttttttttttttttaaaaaaaangtggggggccccncccttttttttaaantngaaanantttngggggccccttttttnaaaaaaaaaaagggggttt

SEQ ID NO: 22008 - DNA, 739 bp, Homo sapiens
  misc_feature 2, 15, 18, 23, 35, 46, 48, 55, 68, 75, 81, 99, 377, 378,417, 421, 443, 465, 470, 475, 479, 484, 488, 498, 500, 505,508, 513, 514, 524, 527, 532, 562, 568, 597, 599, 603, 637,642, 663, 670, 677, 684, 686, 693, 698, 718, 726, 733: n = A,T,C or G
  misc_feature 735, 737: n = A,T,C or G
anttacttgggtttncgntaaanctttttttgttncttttggccgnancggcctncggctgcgatagncgacagnaggggnatgatctgaaacttcagnattagagaaaaatttcaaatgtgcagcaatagagatgaaaatacagaatgggaaagatgtgatggaaggagaggtgctccagtatttctctgaaagagtgttaaaagaatacaggaaacaataatcaaaaggaggaatgattaacaaaaacagataaatattttcagatggaatgggaggaatacatgagcccaggagttgaagactaccctgggcaacatagtgagaccatgtatttacgtgtgtgtgtgtgtgtgtgtgtgtgtgtgtgtgtgtgnnaccctgggcaacatacaccctgtatttacgtgtgtgtgngcgngcatgtgtgtgtcagggtctcnctcccattgcccacgctggagngcagnggtgngatnataanttcnctgcagcctngnctttncangctcnngtgattcttncanctcantctcccaagtcctgtgactacaggcatacnccaccntgcccatctaatttttctttgtttaatananacangattttgccatgtcccccagggtggtttaaaacntaaanctctgcccccctcaccctctnaaagttntgggatnacaggcntnaatcccnccccngcctttaaaaaaattaaaantacccagnggggggngngncc

SEQ ID NO: 22009 - DNA, 764 bp, Homo sapiens
  misc_feature 1, 8, 19, 22, 29, 586, 737, 738, 744, 757: n = A,T,C or G
ncggcctncggctgcgagnagncgacagnagggtaagaaatataacacttatatttaatgaattcacttatatttagtgaatattcacttatatttagtgaatagtaggctgggcatggtggcttatgcctgtaatcccagcactttgagtggtcaggagttcaagaccagcctggccaacatggtgaaatcctacctctactaaaaatacaaaaattagctggtatggtggtggacacctgtagtcccagctactcgggaggctgaggcaggagaatcacttgaacccaggaggcggaggtttccgtgagccaagatcgtgccactgcactccagcctcggtgacacagtgagactctatctgaaaataaataaataaataaatgtgaatagtagaaattttggagaataactacatcatagggaccatagaacataatgttcaaatttagtagatctgattacatcagaattaaagatttctgttaaaagaactatacacagagttaaaagtcagatgtcagctttggaacttttaaaacctaaagggaataatacctgtaatatattaagaactcctaaaagntaacagaaacaaagacaatagcttttaaaaaataggtaaaagatactaacagacatttaataaagggtgctaagtgcttacaggtagatgagaagatagacaactcactagtaatcaaaaaaaaaaaaaaaaaaaccctgggcctttttcnnaaccanttaaaacttgagnccccccc

SEQ ID NO: 22010 - DNA, 815 bp, Homo sapiens
  misc_feature 1, 17, 18, 19, 29, 41, 612, 649, 679, 684, 706, 760, 789,810: n = A,T,C or G
ncggcctacggctgcgnnnagacgacagnagggattatagnacacacgtgtgccatggccccttcagactgctcccttcacctttgaaaaaccagacaggatgcttctgttcctggaaacacgaatgcccttcatgtgtttttttctttgactagaaactcaacttcaaccaaaatatagactcccacacaataataatgggagtctttaacatcccactgtgaacattaggcagatcaatgagtcagaaagttaacaaggatatccaggaattgaactcagctctgcaccaagcagacctaatagacatctacagaactctccaccaaaatcaacagaatatacatttttttcagcaccacaccacacctattccaaaactgaccacatagttggaagtaaagcactcctcagcaaatgtaaaagaacagaaattataacaaactgtctctcagaccacagtgcactcaaattagaactcaggattaagaaactcactcaaaaccgctcaactacatggaaaccgaacaacctgctcctcaatgactactgggtacataacgaaacgaagacagaaataaagatgttctttgaaaccatgagaccaagacncacataccagaatctctgggacacatttaagcagtgnggagagggaatttatagcactagatgcccncaganaagcaggaagatctaaattgcnccctacctcccattaaagactagagagcagaccaacccttcaagctgccgaagnagaatagtagatcgagccgactgaggatngagcccaaaaaaaaaaaaaancccgg

SEQ ID NO: 22011 - DNA, 819 bp, Homo sapiens
  misc_feature 3, 7, 8, 14, 25, 27, 34, 44, 47, 55, 57, 589, 619, 635, 700,709, 719, 738, 756, 757, 760, 783: n = A,T,C or G
aancttnnttgttncttttggccgnancggcctncggctgcganagnacgacagnangggctttgccttctggtgtcagatgataattgtttttgcaaaatgctgcagggtgagagagagtgagactgacttactcctttcagcattaaactggagggaaagaattacagtgggagctgaagagtgacctggtatgtgtgggtgatgaatagaagaacactttaccccaattcttctgaagcacagtaaagaggaggagaaatgaaccagtttgcaaaagtgggtctacgttagctgaaaatatgcagcccttgagtttatatggagttctagacagatggacacatgtaggtactgccgctgagtgggcaggtgtattacaccttgctgggagtgaatgatggcttatttgtcagcgatttacaaatcctaagatggagaggtagcacgggagtacaaaggccaatgcagcctcaggttcacgtgcttttgagatgattaagaaatgcaaagttaggctgggcaaggtggctcatgcctatgatcgtagcacttggggagatcaatcctagcactttgggaggcttangctagaggattgcttaagctaaggtgggangatcgcttgagctcangagttcaaaaccagcctgggcaacatggtgaaacctcgtctctattaaaaaaaaaaaaaaggccngggctttanctccccctgnatcccggcctttggagggngggggtggtccttggggnngantcaaacccccggccactgaaaantttttttcccaaaaaaaaaaaaaaccccgggccttt

SEQ ID NO: 22012 - DNA, 713 bp, Homo sapiens
  misc_feature 2, 4, 6, 14, 19, 25, 33, 37, 39, 46, 55, 563, 606, 607, 610,626, 647, 653, 659, 665, 666, 669, 673, 679, 693, 697, 704,705, 706, 711: n = A,T,C or G
gncntncgatacancttgnttgttncttttggnccgnancggcctncggctgcgnggggataaaaagtatagtaacatgagcactttaggcaataacggaccgacacacaaaaagttgtatcgtcacaaatccagctccaaggccctgagagatgagaaatgtaagggaaagcacatggagcgagaacaggtccacaagggatgagtctgggacagcttcttttgaaaaactgagggattccgactacaatctcctaaaagcagaaacaaccttttgggttttacctgtgtttgaagaagagactcgcattttccagaaagacatttgatgtttgtgttttatttctttcaaaatatgccttgtggtatgtatgttgacatgtaagtgcttaaagaaaagaattttaaattgtgggaatacgtctttggagcaaactttaatctcatgttctatgtaaaagacttaaaaagtcatacagttgcacaagtagtttatgcactatttacccacaaggaaaaaattgaaaacattgtgccaaactacaaacaagtgactgtactgnatatatttttacttctatatcacatttgggtgattgggggaanntgnccctgttatttactanaacattccagtgattttgctnttaacncccccncttttnnggnagcncctgtnatctgggggaaaanttgntgggtannnatttncc

SEQ ID NO: 22013 - DNA, 725 bp, Homo sapiens
  misc_feature 1, 13, 35, 39, 510, 555, 567, 582, 601, 648, 663, 668, 669,685, 689, 691, 701, 703, 718, 720, 722: n = A,T,C or G
ngggagtttatcntgtaggaatagtacatcttttntttntaggaacagaattttctaacttctgtgtaacatatgccacaatttttattttatcttaatcatgttgataccagtactcctggttttaaataatcataatttattcaactattcctctttgatggagatttggattgttttcattatttctgctttgttttatttttgttattaaaaacagtatcctcagcaagaccctcttgcataagtctttttgtacttttgctgttttatctttggctagatctctaataatgagatggctgggtcagaaggtatgtacatatataattttgctagatatggctgaattgtcctttgtagggaatttcaaatttccactcgtagtgtatgagagtgctgtttcccacaggcacaccaccagagtgtgttatcaggcttttggatcctttctagtttaatgtgtgagaaatcatatttgtgctttgcctgtaaatgtgtaagtgaggngagtgaacaagttaaaaaatgtgcttatttaaaaagatggagacnacaatactttgncatgtggaatgctgnttatttcttggttaaatanaagattaaatgtgcataattttattttggctgaaatgggataccagngcactgaaatgggangaggnnctgggaattttactgntttnanctactccacntnattactttactgttnananttc

SEQ ID NO: 22014 - DNA, 646 bp, Homo sapiens
  misc_feature 381, 420, 468, 516, 521, 529, 552, 576, 577, 580, 594, 608,615, 617, 624, 629, 631, 633, 640: n = A,T,C or G
tgagttctctggtgaaaacacatctgaaaacatgttaataggaatatagctaatccttagcatttcttatagtagctaaggtcagtgtatgctaggcctggtacctgagcagcagtcttgatgctaagttaacaacaggtagccaacaggagtgttttctagctatttggaaattgaaattcaaccaaaaaagctactgccactctgaatcagttacatcatgataccttagatctaggctaccttttttcctgaataatagaaggttacattgattagaaattatggggaaagtagattccttcatataagaattggttaaagtttgactctgttctctgttaaagtaagcagctttttaaataattgagttctttggangagtttttatattttatatattttttacctatttagccntgataaatagaatcagataagagaccgagtgtgaatattcagcacgancttcaccaggtgttatatttctctctatgttctaaagactcaccatgngtagngccttgantctctttgaaaaggaggatcctnttggatgcctgtacggcagggcannggntctaccttatccancctttgagctagcngagatgntngccgganttaanancngcactanaaaccc

SEQ ID NO: 22015 - DNA, 772 bp, Homo sapiens
  misc_feature 15, 115, 315, 447, 487, 501, 507, 516, 608, 644, 649, 664,677, 700, 756: n = A,T,C or G
ggggaaagaaactanggagactagtgtttggtagcattttagagggaaaaaaggccatagctcaaatattgctctgatttcagttggctgaatttatgtgtaaagggcatgttanggaatagtctgcaaaggtaccagaaactgccattcatggaaggccctgagtgcaaaatgcagcagtcagtagttctgacccatgccattagatggttctggaaggtcctcataggagacgcaacaccaacagtgacactgcttccagctcaggcaggctggagctgttctgagtcttcctgaaggttctgaatggtccancccttggactcccttcagagagtcatggagtacccacatttcctttgcacctgaaacacttctttgtttctgtcttcaccctgactcctcatctattcagagatcccagctgatcctctctttcaaagccangccagtgagctcttacagaagcttacttcagcattccttncaccgtcttctgantagcanggcagacanagacagcaatggagaattccagttgattccccataaaatggccactttgttgtggggcatgagctggtctgtacttggttgtgcctggcagngcacacactaaaaccctgggcaccctgggtgtaatnactanatactatattaatanccaaggttgccantgcagcctggacaaaaaaagggnaaatcagctccaacaacttcccctagaaactttcttgctggatttcaaagaactgngtaatgctcaatacca

SEQ ID NO: 22016 - DNA, 830 bp, Homo sapiens
  misc_feature 2, 3, 9, 10, 11, 12, 13, 14, 15, 19, 31, 42, 44, 51, 61,64, 71, 649, 726, 733, 742, 748, 766, 768, 783, 803, 810: n = A,T,C or G
anncttggnnnnnnntcancttttcttgttncttttggccgnancggcctncggctgcganagnagacagnagggggaactctcaattgttgctggtggaaattcagactggtacagccagtgtggaatgtgatttggcagtttattaaaaagctaaaaacctaaacttacatagcccagcaattgcacccccaggagtctacccaatggaaatgaaaacagtccgtccccacagagacatggacataaatgttcatagcagcattattcagaatagccccaaattgaaaacaatccagatgtccatcaactggtaaatggataagcaaaccatataatggaaaaccattcagcttccaataacttccaagaaactgtagacacatgcagtatcatggttaaacctcaaaaacattatattaagtaaaataggcgaggcatgtattgtatgagtcatatgaaatgtctagaaaaggcaaatttattgagatagaaagcagatcactggttgcttaaggcctagggtaggagtggggattaactgtaaacgggtacaaggtacctgactggggcaatggacatgtggattgtgatgatagttaaattgtacagctctctctattatagttgtacagctctattaattttncacaatcattgaatcatgtctttcagttttatgaggtaatcatagtccatgaagctttttaaaataaaagataggcntgtgtgnggctccctntgtatnccacactttggaggccangngggggatatgaggtnaggagttcaaaccacctgancactggngaaaccttttccaaaaaaaa

SEQ ID NO: 22017 - DNA, 835 bp, Homo sapiens
  misc_feature 2, 3, 10, 12, 15, 19, 20, 24, 31, 42, 44, 51, 61, 64, 72,633, 646, 667, 673, 787, 802, 805, 820, 828, 829: n = A,T,C or G
anncttgggntncgntaanncttncttgttncttttggccgnancggcctncggctgcganagnacgacagnaggggaaaacattttaaaatgtgattataaaatagaccagtatagcttttcaacatttggttgtaagaatcccaagaatgtaagtttatgatcttagtataccacctagaatcgagacaaatacatgaggttatgaatcatgccattttcagttttaaaatctgttacatagtttcttcattgattcttttttgccacagtgtgttatggtcctcattatttggatgaataatttgaataataagtcagcttgtgacttacctaaataaatcttctgattcctagtaaagtgtttttcattatatgaaatgccagctatataagaggagattaaaagtactaagaactataagttccgcatggattatcatatgctaaccatgggccaggcacggtggcacacacctataatcccagcactttgggaagctgaggcgggtggatcacttgaggtcaggggttcaagaccagcctggccaagatggtgaaaccccatctctaccaaaaatacaaaaaaattgccagatgtggtggtgcatactggtaatcccagctactcangaggctgagtcangagaatcgcttgactcgggangtaganattgcagtgagctgaaatgtgccactgcgctccagcctgggtgacaaagataactgcatctgacaaaaagaaaagaaagctagctggactaattctttgaggttaagctgcaanagtgctctcatgaanagnggatctactggcagngaatggannggggtg

SEQ ID NO: 22018 - DNA, 794 bp, Homo sapiens
  misc_feature 2, 13, 14, 15, 19, 22, 25, 26, 33, 44, 46, 53, 63, 73, 85,650, 670, 674, 699, 715, 716, 721, 726, 728, 729, 747, 759,761, 764, 766, 772, 791, 792: n = A,T,C or G
anttacttgggtnnnaaanccnctnntttgttncttttggccgnancggcctncggctgcganagtagacagnagggacactagnatatgaactctacccagtatcagtaaaccaataaaaatgttttgctttataaaatgctgtgttgcttggcagcttcaaagtcagcattgactgttacggatcttggtctaagttaaaagattagtggcttccagtagaaaatgaaaattgctttacaaatacaaatgggttctgttaataatacagagaaaagctaaatgttattttagcatccagtcttcatacttcatttatggtataaaattttttatttattcttttaataactttttaaatagtaatctcattttaaacataaactgaggaccagaatattaagcagtgttcatcaagatcgtacagtttaatagatttgaaccaggtaaagccaagattcaatattaggtctgacaaaaagctttttcaacaaagtaactctgcttcttttctactgttcatttaaaacaaaacagataaacagaccagctatcatttgggatgggagagcagaaaatttgaggaaagtaaactcaaatgtgtaaatactctaatattatgctgaaaatagatcgctttatttttctangtgaatacagagtgagttgntcantatacagatgtttaattgggactanttaggattatgacctnnaaaanaatantnnaatgcctttcaggagccnggcccggggctncnccngnatcccncttttgggaaccaggcggnnat

SEQ ID NO: 22019 - DNA, 840 bp, Homo sapiens
  misc_feature 5, 9, 10, 11, 12, 16, 17, 18, 22, 30, 41, 43, 50, 59, 60,61, 71, 83, 246, 648, 691, 711, 726, 737, 768, 769, 788,799, 806: n = A,T,C or G
tactngggnnnnaaannncttnctttgttncttttggccgnancggcctncggctgcgnnnagacgacagnagggacactagnatatgaactctacccagtatcagtaaaccaataaaaatgttttgctttataaaatgctgtgttgcttggcagcttcaaagtcagcattgactgttacggatcttggtctaagttaaaagattagtggcttccagtagaaaatgaaaattgctttacaaatacnaatgggttctgttaataatacagagaaaagctaaatgttattttagcatccagtcttcatacttcatttatggtataaaattttttatttattcttttaataactttttaaatagtaatctcattttaaacataaactgaggaccagaatattaagcagtgttcatcaagatcgtacagtttaatagatttgaaccaggtaaagccaagattcaatattaggtctgacaaaaagctttttcaacaaagtaactctgcttcttttctactgttcatttaaaacaaaacagataaacagaccagctatcatttgggatgggagagcagaaaatttgaggaaagtaaactcaaatgtgtaaatactctaatattatgctgaaaatagatcgctttatttttctangtgaatacagagtgagttggtcagtatacagatgtattattgngactaattaagattatgacntagaaaagatagtanaatgccttacngagccgggcccggggctcaccctgtatccanntttgggaaccaggcagganatcctttgagncaaacanctgccactgggaacccgctcctaaatgcaaaaac

SEQ ID NO: 22020 - DNA, 769 bp, Homo sapiens
  misc_feature 3, 421, 426, 430, 431, 433, 440, 445, 451, 462, 470, 471,481, 493, 502, 535, 539, 551, 588, 592, 610, 641, 644, 645,656, 669, 677, 680, 682, 692, 696, 700, 715, 726, 753, 758,759, 764, 767: n = A,T,C or G
ggnatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtggtcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaattttttttttttttttttngaaangganncncccaggnggaantgcaanggggcaatctnaatttcanngaatttttcncctcccgggttnaagcgattntccccctaaccctcctgagtagctgggattaanggcncctgccatcacnctgggttaatttttgttttttgacaaaaaggagtttncccntgtgggcaggggattggnctcccctcccccacctttccaaagggtgggnttnngggttaacccnaaccccctccccnccaaatgnaantntaatttgggntttntccngggggttgggggggnaaaaaaccttnaaaaaaaaaaaaaaaaacccggggccnttttnnaaaanaanaa

SEQ ID NO: 22021 - DNA, 474 bp, Homo sapiens
  misc_feature 347, 358, 376, 395, 409, 418, 435, 443, 454, 456, 458, 465: n = A,T,C or G
ggggatgaatgttcagttgaagtaataccaaaactaaaggattagaagcaaagtatttgaatgtatagagctaggcatgagaacccagaacgtacacctaatgacagagcctgtgcgttccctgaattttgtaccaatcaaaacccttcacctgtcctgccatttcccttgctgctgcctcattgggtggaagtggccacctgtagttttccagaaaattcacagagcaccgctggctgagctggtgtcccattaccactccaggcgtatgctggtacatgtaccaaattcacacagaatgtctggggcactcgggggagacactgtgggaacaaaaagaccaacanaagccctcctntttcaaactcgctgtgcnacccaaaaggcacctgtgntttctggtggtgangcagggcanatttacatttaagaagnctactttnagctgatgcgngntnatgctgnatcccacct

SEQ ID NO: 22022 - DNA, 858 bp, Homo sapiens
  misc_feature 2, 15, 16, 17, 21, 22, 23, 24, 28, 36, 47, 50, 57, 66, 68,71, 79, 84, 671, 726, 743, 766, 776, 783, 789, 818, 819,831, 832, 833, 834, 835, 837, 839: n = A,T,C or G
antaacttggggttnnnaaannnncttnttttgttncttttggccgnagncggcctncggctgcgnanagnacgacagnagggnatgaaacttaagtgacaggaacgcatgcacagcattgagtatgaagagaaagcgcccagtgaatgttagctggtttttttaccattattattattatttacaagtgcttactatatgccaaaaaccatgttagatgctcatttaatttttatgaaaatttgcataattttaattttttaacagtctttgggatagatattatatcacttatgattggagaagttaagtaatttgcacaaagccacacagctgttcggtagtgaagctaagatctatatctacactgcctcactctagatttcaattctttcctatccctggcatttgtcgatgctgacataacaaagtcagctactgaagtggaattcattcaataggcaatccacctcaggttgctactggcaaaaatttggataatatgccttaaaaaatacacacacacacacacacacgcagacacacacacaaacgtgcatttgccaatacctgatgaaaaatgctttgaaatgtgagactttaaaataatattcaccacattgtattcttattgtttttaaagaaaattaaatttaacacaatttactggnggcaaacttttggaagcactactacacaagctttaaatacagtttctgtcttcangaataaatctttattgngaagaagactaaaaggagagtanccctgaaaantagggangactangggttactacaaaaaaaaaaaaaaaaccnnggggccttttcnnnnncnantaaaaactggggtgccccc

SEQ ID NO: 22023 - DNA, 770 bp, Homo sapiens
  misc_feature 6, 25, 179, 562, 567, 589, 712, 754, 756, 757, 765, 766: n = A,T,C or G
gacagnaaggcataatccctggatnttttttatgtcgataattaaacttgttctgggtggatggttggatagccagaatagtaataacctctcttccagccactcaaagaaaatgatataaacgtagggttggtttaattgttgagaggtcacgttttttccattcttgctctcaggtnaggaaagagcactgttggttcacgcattcctttttccctcatacactttgttgggcactgatatggtttggctctgtgttcccacccaaatctcatgttgaattgtgaccctgagtgttggaggtggggcctcgcgggagacgactggatcatggggcggattttccccttgctgttctcatgatagtgagttctcatgagatctggttgtttaaaagtgtatagcacttcctgcttcactctctcccactccaccatgtgaagaaggtgcctttgcccttccgccacgactgtgtttcctgaggcctccccagccatgcctcctgtacagcctgcggaactgtcagttaaacctcttttcttcattaattacccactctcangtggntttttatggcagtgtgagaacngactaatacagaaaattggtccagagaagtgggatattgctataaatacctgaaatgtggaagtgactttgaactggtatgggcaaaggtggaacagttggaggctaaaaaaaaaggaaatanggaagttgcagcttctaaaactgtgaaggtgggccaaggctntnngattggcnngaac

SEQ ID NO: 22024 - DNA, 681 bp, Homo sapiens
  misc_feature 5, 7, 18, 24, 27, 39, 50, 52, 59, 69, 71, 81, 83, 87, 254,256, 416, 449, 452, 598, 619, 620, 625, 631, 636, 642, 643,650, 659, 664, 666, 667, 668, 669, 671, 672, 673: n = A,T,C or G
cttantnacttgggtttnaaaaancanctttttttgttncttttggccgnancggcctnacggctgcgnanaatagacagnangggnatttgaatgcactttaaatcttttaaaacaacacacacacacacacacacacacactcacatactcacccacaaaaaacccaccaaaacttctgggttggatctggtgaggtcacaattttggatttggttcccacgtggtccagttttgttattatggagtaaatntntgtttcagaggccaccatatcacatttctcgagtctccttgtagacacctaacttgtccgtgatgatatgaggtaataacaggagataatgattcagcaaagctttgtcccgccactgagaaattgctttgaaacagtggcccatccacagttgcaaagngggggtgattcttcttcagggagcatagcgtancanattttcccctgcgtcctctgtgtttgttcctcagtgtctggaaagtgcttaccctagagagtgagcttgggaccatttttattaaagctattattattattatttgagacaaagtctcactttgtcacccaggctggagtgggggnggggcgatcacacctcactgnnacctncacctnctgcntttaanngattctncttgccccngcctntnnnntnnntgggactg

SEQ ID NO: 22025 - DNA, 362 bp, Homo sapiens
  misc_feature 11, 13, 16, 20, 21, 32, 40, 44, 46, 50, 58, 60, 137, 153,157, 160, 166, 183, 184, 204, 207, 216, 221, 246, 250, 252,255, 273, 303, 306, 313, 315, 318, 319, 321, 322, 339, 345: n = A,T,C or G
attttttgggntncgntaanncttgtttgttncttttggnccgnangggntagccagnanaaaaaagggtggagaaaatttaggacagtgtcttttgagcaaccaccaggcttgaaggctacaagagacgagaaagnattctctttttgaatntagnccnggaggnaaaaaaaagaatggggnnaaaaaaacttaggggaagtnttnttttttttnaaaanaccccttccttttggggggggttcnaaangnganaaggggaaaaattttttntttcccaaattttgggcccccccaaaaccncanggggggngnaanncnnttttttttttggggganaaaaanttttttttttttttttt

SEQ ID NO: 22026 - DNA, 821 bp, Homo sapiens
  misc_feature 2, 4, 10, 13, 16, 20, 21, 33, 44, 46, 47, 212, 301, 432,459, 553, 576, 579, 584, 594, 603, 617, 621, 628, 643, 651,685, 690, 696, 706, 709, 714, 715, 730, 752, 764, 768, 775,777, 801, 804, 810, 816: n = A,T,C or G
antntcttgnctncgntaanncttgtcttgttncttttggccgnannggctgctgtgataagagctcagagtgaactccctctgcctttgggattattacatcacatcttatcagaccccatatatgagttactgacctgaaccagtggacttcaaaatacatgggaaacctaagagtttgacagaccttttgagagcttaggctacagtangttacactgttggctgcttttctaaagacagagtctacagtgtacaaggctgcactctgtcagcctcttctccaagacccacagctcangctgtgtgtgacagggccacaccttattagccttgcctgccaacaccgcaccaccctctaggaggaagaaaggactggcatgaagtggagccaggggttagaatccaactgatgaagctgggaggagtcancttcaagtccaagttcaattggcccanggccatgggatggagccttcatgcatgtgtgtgtatatgtgtgtgtgtgtgtgtgtgtgtgtgtgtgtgtattttatcattgcacttcaatgangctgaggcatgtaggtactatanaangctgnacatccaggngagagcttnctctacttctttcncttnctccctnctttatagagagggngaaccatntgggctacccctgctgcctgccaatgccctgganagttntgggtngcccaggggnctntcctnncttacaaaactgttnagagccaaattttgggagtttntggtgagaaatntttnaccaaanantttactcctgcccccttgactggnacnggaaangaattnttttg

SEQ ID NO: 22027 - DNA, 619 bp, Homo sapiens
  misc_feature 16, 169, 170, 516, 572, 578, 596, 600, 601, 606, 608, 610,611, 613, 616, 617, 618: n = A,T,C or G
gggaaaacagaatggnggagagtccctacttttctcacccgttaaatattttggcaagtaatagctcagatccaatggctcagatggccatttatccgtccatctagtcatcagtaaatatttggtgagcagttactctagtgttatgcacttgcaaggagctaagaanntataggtttctaagctgtcttcaagaagcttgtcatgtgataatggtaggagacctgcaaacaggtctgtattattaggtgttaggagaactgcaacacaatctcagtagttaaataggggcacaaactctcttggcatggttaggaaaggttttcaggcatcacatattctcacttataagtgggaggtacacattggataggtacagacacaaagatggcaacaataaacactgagaattacaaaacagaggagggggacaagtgtttaaaaactacctatctggtattatgttcattacttgggtgacaggatcattagaagcccaacctcagcatcacacantatacccatgtaacaaacctgcatatgtaccctctgatctaaattaaaaagaaaanaaaagntgggggagaaagaatgtntganntcccncncnncnccnnnc

SEQ ID NO: 22028 - DNA, 670 bp, Homo sapiens
  misc_feature 2, 12, 13, 14, 15, 22, 23, 35, 46, 48, 80, 220, 221, 556,563, 589, 602, 616, 625, 630, 636, 637, 638, 641, 646, 652,653, 655, 659, 664, 666: n = A,T,C or G
antacttggggnnnnaaaaccnnctttttttgttncttttggccgnanggggtgggcagtacaggatgtgtatatacagnacatgtacatttttaaagacttggttgtctctgcagtgaagacaatatgttttattttttattccatatacttctctgtattttctatatttgcttcaataagctggtgtaacttttaatttttttaattaaaaaaaatnnagcgtaaaattacacttaaacattagcagctgctgctgggaaaaaatggacaaattgcccaggcagccacattagaagaagaaagtcatttgaatacagttatatacttatttttattgagacacatcttgctgtgtcacccagggttttgctctgttgccacagcttactgcagtcgtgacccaggctcaagtgatccctcccacctcaggcccctctccccgaccagtagccgagactacaggcaggcacagactggcaccaccacactcggctaattttttttttgaggcagggtctcactatattgtccaggctggtcttgaactcctganctcaagngatcctctcaccttggcttcccaagngctgggattacanacaagtcatggcanctggctgantccanttttcnnntancctanaaaacnnanggcncccantncttt

SEQ ID NO: 22029 - DNA, 621 bp, Homo sapiens
  misc_feature 1, 2, 3, 9, 69, 173, 194, 253, 285, 292, 340, 344, 353, 357,371, 386, 395, 432, 458, 470, 483, 510, 536, 549, 564, 574,579, 582, 586, 590, 592, 601, 604, 607, 608, 615, 620: n = A,T,C or G
nnngacagnaaggctcatttgcagttgtgggtgccacgcctggccccgagtgtgttggggaaggtaaanaacctccactttggtcttctcagttcccttcctggcactgtgcagccgtggaggagaaatctgggttgaatctgggtctagtgttcaagaggagggcctggcanaaaccaagagtgaaggggtgnaaccacagctccctgtggactgccccgtcctcagtccccggtgccccagctgcacagangaagtgatgacagccacatgaaggtgcaacantgcccanctctggaaactccacccttgtaaatcaaaggcctgtggtgagcaaaancganaaatataancacncacaggtttctggngacaaaagcctcctngcctggtancacctgggcatgaccccctttgcccagacgacattantcactcatatggctcttgcgtttggntggccaaaggcnggggattgttaantcatcttggggtgatgaggtggaaaanggaagccccacatgtgaaattctgangcctgggactganccccaccctccacanctactttcanattgnctntaancctnanctccttaanacnctnncctttgnggccna

SEQ ID NO: 22030 - DNA, 785 bp, Homo sapiens
  misc_feature 1, 9, 11, 456, 600, 648, 728, 729, 732, 742, 749, 752, 759,761, 769, 776: n = A,T,C or G
nacgacagnangggtggttgattgtgttacttttcgactgtattctgtgctcttccctacaggaggattattcattcctgtttacttgaattcaggcaacatcatgtaacttgatttaaggaaccgatacatgagtggaaattctgtgtggcatttctgagcagaagttttatgaggcagcacatgctcactgtgttacctgttccttctgccatgagactggcagatggacattctctatcagccaggatatcagaatgaagaaatgtagaacatagaccaaaacaccaatgagaaataagcgtttgttgttttagggaaagtgtgttaccacagcataatttaacctatcccaagtgaatacatattcatggagttaatatctatacctgaaaattgaaactcaggttgtctacatctaactatgcctctgtcttttccaaaggtataaagtangagaaacttccccatgatcctactcttccagtgttaactacagttaaaatttagtgtaaaattgtttaatactttttcctatgtgtatgtcaatgttcatttttttaaaactgggaccactttatatgacacatactattttanagcttcttttcctacttagtaatataaaaggaccactgtccagggtangttttcataacagaccctgagtttgaatataaatatttcaggatcatcaccttaaaggaaaatgaaaaatagattggganncanaataaactgngatctgnccnaatgtcntntgggtcgnttgttgnaaatatcct

SEQ ID NO: 22031 - DNA, 739 bp, Homo sapiens
  misc_feature 597, 626, 676, 699, 717: n = A,T,C or G
agggggagaatcatgtagttaatcccattgctcttacaagtgtcagcttacttgtatcagcctccctacgcaaggacctatgcactggagccgtaggagctcttcagttgggccccaaggataaggctactgatttgatactaaatgaatcagcagtggatgtagggatagctgattttaaaacactcggctgggcacagtggctcacacctgtaaacccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccaccgcactccagcctgggcgacagagcgagactctgcctcaaaaaacaaaacaaaacaaaacactcacccatcaacgaatatagactcttctctcatttatcgatgatcctctttttccatttttttaagtacttatgtggaagctagtctcccaaacacaatctttanagaaaaagacatgaacaactccaaatatncatttatcaatcatgtttttgctttggataaaaacttgaacagttttttntaggactgcaatggaccttattngacttgagatgaaaaatntttggaaaaaatgactaattac

SEQ ID NO: 22032 - DNA, 751 bp, Homo sapiens
  misc_feature 531, 568, 628, 638, 650, 654, 665, 687, 703, 716, 720, 721,726, 727, 738, 748, 750: n = A,T,C or G
gggggactatttctaaattttatttaaatgttggtaacagaaatcacatttgtgacttcttgtcaatgactgtatttactgtcagactccagcaatatactttgcctttgaatcggggggcagagttgagcaattgaagttattttagctgataaacctctgtgggaacataagtagcctccagttcgtttgcttgggcttaaagtttgcaataaaactttctctctctaaaacatatagaaggcaacatttcattgatgtgcccatattagattgttcctctagaaatgtgctttcacagtagggccagccacgtgtggctatttaaattagaattttaaattaagtgaaatgaaaaaactagctcctcagtcatactcgctacattttgagtgctcagtagcctcctctggctgctggctaccatgttaggcagcatatgtgtagagcatgtccatcatggcagagagttctctttggcatatgtagagcatgtccatcatggcagagagttctctttggcagtgctgntgtataccacatgggaggtgtgcaagaaagaagtggnctttgattatggtcaagaatcctttcactttcagtcagtacatttgtacaatacctcaanagctaaagcntttccttccagngtgncaagtgaatgnggaacatccattgcacgtggcntctattgcctccgggnttggtgaagatcncaannaaagnnccgctgtcttngggtactgantnc

SEQ ID NO: 22033 - DNA, 858 bp, Homo sapiens
  misc_feature 2, 7, 13, 21, 26, 33, 44, 46, 53, 54, 62, 64, 66, 67, 68,74, 76, 86, 249, 587, 614, 624, 676, 761, 767, 773, 786,789, 790, 791, 798, 821, 829, 832, 843: n = A,T,C or G
antaacngtgttncgataaanctttntttgttncttttggccgnancggcctnnggctgcgnanannngacagnanggtaatgagnagccaagttaaatagcaaatgacttctcaccctttcctagtcctcatgcctgaggaataagggcgacattaatgggagcgggagagtggtggctttggttgagatgcacgttcacagactagaaaagtgcctcacctccatggtgtatatgtgccaccttttnttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcttatttctccacatcctctccagcacctgttgtttcctgactttttaatgattgccattctaactggtgtgagatggtatctcattgngggtttgatttgcatttctctgatggncagtgatggngagcattttttcatgtgtttcttggctgcataaatgtcttcttttgaaaagngtctggtcagtactatgcagccctaaaaatgatgagttcatgtcctttgtagggacatgggtgaaattggaatcatcattctcantaactntctganggcaaaaaccaanccnnntgttctnctcccaggggggattgacatganaccctggnccnggagagaactncctttgggacggggg

SEQ ID NO: 22034 - DNA, 709 bp, Homo sapiens
  misc_feature 2, 9, 12, 15, 16, 17, 20, 23, 27, 35, 46, 48, 57, 233, 470,502, 508, 529, 538, 578, 593, 604, 625, 630, 632, 652, 675,686, 699: n = A,T,C or G
antaacttnggnttnnnaanaancttnttttgttncttttggccgnangacgacagnaggggtctctcttccttctccctcactccacacacacatatagacgtacatatattctacatgtatatgtattttgtatatatatatatatattttaactctagcttttttccaaatctttctctgcctactgatttttagtatgtgtgatctatcattttctaatatagattatnctcatattaacttctcctattatgattggagattgtgaaattctcctaataattttgtccttttttactctttgtattttgaggccatgttgttgagtgtatgcaagtgtatatttgttacaatttcttggtgattgtcccattaattattgggtagttcctttactctgcctgttagtgtgttttgccttattttttttccatcctacagctattaaaatacaggcccggcatggnggcttatgcctgtaatcccagcactttgggangccgangtgggcggatcatctggtcangagtttgangccagcctgggtaacgagcgaaactccatcttaaaaaaanaaaaaagccaggcgngggtgcatgcncctgtatccagctcttggagntgagngngagaacacttgacctggagnaaaggtgcatgagccaaatcacnccctgactcanccggagacaaacnaactcggctc

SEQ ID NO: 22035 - DNA, 820 bp, Homo sapiens
  misc_feature 2, 12, 13, 14, 15, 16, 17, 22, 27, 33, 44, 46, 56, 546, 633,642, 645, 704, 728, 731, 744, 748, 752, 756, 760, 789, 795,808: n = A,T,C or G
antaactttggnnnnnnaaaancttgnttgttncttttggccgnanagacgacagnagggggactagtcacttcatttatattttctcattttctttattccttactatatttctctgaagtgtcattcccatttcatagttgaggaagctgggactcaggaggattaataacttgtccagcgttacaaagtgagtttaggagccacaattcagattcagatttattgactccaaaatttttgcaggttttaccatagcatgttgcttcagaaataaacagacctggctgcaaaccccagacccaattactctgtgcctttaaacgagttacttcacttctttggtttttgtcacctataaattagggataataataataaatacaacatggaacagttacagtgttaaatgattgaggcatgtaatttgccttacgaaatgcctaactcatggggtgcccttaagaaatactactctcccccacctcctttacaaaattgcatgtctaatgcagtgagaaatgccaggcgtggaagatattctangtttgatcatctgtggtttcttggccaaacaagaagtttgagttctacattttattttgagtattaaacattgcatgcatcacaaanctgtattgnggnctgtagagaacatagcatagtattcaagatgcagctttgggccacagctttgactgagnaaattcctacctttctggcctcanttnctatttgaaaggnggtntggngggngggnaatacacttggaggtttatttggttaatnaaaaantttaaactttacnagtttaactaaa

SEQ ID NO: 22036 - DNA, 819 bp, Homo sapiens
  misc_feature 2, 9, 15, 16, 18, 20, 22, 23, 29, 35, 46, 48, 62, 600, 684,691, 712, 784: n = A,T,C or G
antaaactngggttnngntnanncttttnttgttncttttggccgnanggggatagctcaanacatgagtccttagttaagataactgtatgcgagctaccacgatattggaacttgattgtgttagtattactcatcagtcatattgatacagggcaccagggcactgataccttctaagaaacattcttcaaattacaataatagttgaaacaagcttagcattgaggttcctagaaatagttaaacttccatagactgtataaaaactaaaacatagtgtagatgtaacccaacgaggctatatacattttaacaagagggatatgagtgttgatccaaacatgtgagtgagaattgaatcaatattggagaaaactgctactgttgcctggggaagaaatgcagggactgtctcctggggatcaccaggggtcagagtcagccttcatctctgccaaggttctttgtctgttgcagctggtgatgaaacaggtctgaactcttgaataaaatgaattgccaaaaatccaggacttcctcagaataacactttggacttactatggccaaatcccacataggggtattagccattangaaagaaaagggccatttttcttactatggagaaaagcagttgttgaagtggcttaccctgagttagtagcaacagacatagangtctaanaagtgcatccttgtacagcanatctgctggcttagggccatcctacatcagggggggcgactgatgattcaaaatgaggagatcttaaatacnttagggaacaagttagctctggcaggggaacccag

SEQ ID NO: 22037 - DNA, 552 bp, Homo sapiens
  misc_feature 364, 405, 442, 464, 479, 515, 520, 522, 523, 524, 529, 530,534: n = A,T,C or G
ggggttttgttgagtgcctagaaaatctgctgatctcttttgtaaaattttatttgtgggtttagcttatttattcctgtctcattatataaaaggagggcagggtaggggagcaggtctaggactggactcttttcaagtctaaaattcaatgttgatgaataagagcatcttataaatacataaaaatctaggtgtaggccaggtgccgtggctcatgcccgtaattccagaacttttggaggttgaagcaggcaaattgcttgggcccaggagtttgagaccagcctgggcaacatggtgagaccccatctctgcaaaaaaaaaagtaaaagttaaacgagcatagtggcattcacctgtnttctcggctcttgggaggcagggccgggaggattgcttgancccaggaggttgaggctgcagtgagccttgattgtcnctgcattcctgcctggtgacanagcaaaccctgtctntaaaaaaaaaaaaaaaaaaaaaaaaccctggggccnttttncnnnacccnnatanaaactttgtagtgacccc

SEQ ID NO: 22038 - DNA, 790 bp, Homo sapiens
  misc_feature 4, 7, 30, 642, 648, 679, 738, 741, 781, 789: n = A,T,C or G
gggnagnaatctagcagggaggatacaagnaaatgtacgggtaaagggctgaaaataagttcaggagggacctgaagaagctccaggtgaaatgttactgtggtcgtagagacggggaggggacctgagctgacgaagtggacgggtggtagacagaggagctggaggctcttcagttgtagggaggggcaaaaaacagatgcccagagaagccaacaggcccccagtggactctcatggtagaagaaagtggggaggatcaccaccattgaggcaggtccttagggctgtggctccaggaactccattttgtcagggtacccagagccaaacaaattctgcgggatggactatctgttgactgaagatctataagccaggtgcagtgtattcatttgcagaaaggactatgtccttcccacaactggaatgcttgtgtttgccttccagggctcccttgtttctttcctccgattatctcccaccctctccttaagggtcctgacctttcctgtggcttcaatggccacctgtatgcagactccacagtctttatttccagtccccacctcccatgtgagcttcagaaccatatatctgcatgcctgctagacaccttcacgcggctgccccacggatctnccaggntcactctgtccaactgaactatttaaagatntatcagcacagagaggcagtgacagcacagactctccagctgcctaggttcaattctanctntgcacttgttagctggggaccttgggagtactaacttctnttgcttant

SEQ ID NO: 22039 - DNA, 821 bp, Homo sapiens
  misc_feature 2, 4, 9, 17, 18, 19, 30, 41, 43, 50, 60, 70, 88, 104, 248,712, 743, 801, 804, 811: n = A,T,C or G
antnttggntaacaaannncttttttgttncttttggccgnancggcctncggctgcganaatagccagnaggggaccatccatttgngtgattaggaacaagnaattgaataaatgaggagagacagggaaaattttcatttcttaaatttgttctctaaaattaaaagcacttacctgaatcttaattctaaaacctgcccccaggagatcccaaaacgttggtcatgactctgtcttgactgatngggctctccctgattgctgggtttcattttagaaagaatgtacttaatgggagcagaaaatcatttgatattttatcattaagccccttcagagcaactgttcgagtaactataaaccacaaaattacattttatattgtgtccaaaaacgatagaccagtttggaaagcaaaaagttaacttctctcagtccaaagtgaagtgagttgggaactccatgcaggccatagagggaaactgaggctgttcctcgggcttgctgggggagaccttccttgaagccccatgcagcccctggggttggcaggtgccataagttctagcttggattacagcaaaggagaggatatgatttttctcttcctttatgaagacagaaatttgtgtctgttttattcgcttctgtctcccatgcctataacagttctggcttattttaagtgctcagtaaatggttgctttcnataacaatctggtttcattctctatcagggnacatcttttagttctgagttatagttttgaaatccattttggggaatcaatgaactgnttntttatcnaaaactaaaa

SEQ ID NO: 22040 - DNA, 706 bp, Homo sapiens
  misc_feature 1, 8, 28, 48, 214, 480, 512, 523, 554, 657, 666, 691: n = A,T,C or G
ncggcctncggctgcgataatcgacagnaggggtgggacagtgcaagngctttttgagggataatgcctgttggcagggttggtgtgagggttgaggggtggatgtcaacagagatgatgccattttctactttgagctgacagtggtgctcttgactagtttgcaggggaggaaaagatggggtattggatgagggagggggaaggaggtggnagatgtttgtggttgcagacatgtggagtttgaagtgctgtgggcgccaggtggagttgtctgacaggcagttggaaaaggcaggtcttaagctcagacaggagataaatattgggagtcagtggcatataagaggcggttaaagccatgggaggggataagattgctgaagagactgtgagaagagaagcggccaaggacagaataccccagagacaggcttaaccaaaaaggagccagaggagatgatgggtgggaaccatcantgggagccggtggagggaggaagggctggganggagtggggangaattgctagctgtagtgtgacacattgtantgtttgccaggaaaggagccagtcatgccggaaacactgacttctgggaagccacccaggtctcattcctccctgctgttggagcacatctcctcttttacanagggtcatnctttttcttccaattcttcattaanaccattcttgagtga

SEQ ID NO: 22041 - DNA, 538 bp, Homo sapiens
  misc_feature 1, 11, 512: n = A,T,C or G
nagacgacagnaggggaagtaattcaggaatttttccttgtttcttcctttagtgtgtcttttgatgacatttctagttgctattgtcagcctttcagaaaagagaattcagttaaatgtaagagatcatagatcttgatctgcctaaaaatactcttctgccagtttgctgtcatacctgaaatttctatgactgactagtcttttgagttatttccagcaaattagatagttcccaccctcatcttgtctttttccctacttcattttgtgttcatgtgacccttttatagccaatatgtttatttggccttcagctttttgattagtttagtttagtttagtttagtttagtttagtttagttagtttagtttagtttagttttagagatggtgttttgctttattgcccagactggagtgcagtggcatgatcatagctcactgctgccctgaattcctgggcccaagctatcctctgccttagcctcccaagtagctggaactgtangtgctcaccactatgcttgggtaatt

SEQ ID NO: 22042 - DNA, 752 bp, Homo sapiens
  misc_feature 2, 13, 14, 15, 16, 19, 23, 24, 36, 47, 49, 55, 57, 397, 399,400, 407, 411, 413, 415, 416, 418, 421, 422, 424, 429, 437,445, 447, 449, 450, 451, 455, 462, 471, 472, 475, 478, 482,487, 493, 495, 497, 498, 500, 503, 504, 506, 508: n = A,T,C or G
  misc_feature 512, 515, 519, 521, 522, 523, 525, 526, 533, 535, 541, 564,588, 601, 616, 640, 657, 662, 666, 673, 697, 700, 701, 729,730, 732, 736, 746: n = A,T,C or G
anataacttgggnnnncgnaaannctttttttgttncttttggccgnangacagnangggcaaggtgccattatcccttaaacatgtcccattaggagtaaaaggctgagaatggtgtctgtgagttgagcttggtaaacccaggagggccccaaagatatgattttctcaaacattgtctctcaaacatctctggagtgctcctctcagaaattttcctggaattatctgcatgagtttggatctctatcttgttgaggcctcattggtggatcctgaggtgctcttcacctccttcttgttcagaaaatgcatgtaggttcctctctcccaccagcttttcatcgtagtccttgattaaaagggcctcacctatggtcttacttttttttttttncnnggggggngggntntnncnttnngnataancctgcccnaaaaaacncngnnntttntgggtcnccttaggtnnccnccnctcntcctnagaacnantnntntanntntngggnggncaancnnncnnacacacncntttaanttttctttttttaaagtttaacncccttttgggccacaaaaagtttnttccaggcaattnttccccaattggccntggtggccccctaacaaataaacnttaaccttcctttaccnttatntttnccaattnaattcactgacttcctaaaatcgnggnncctaatccaacctcctttcccctttttnnancccntcctgcccancccctt

SEQ ID NO: 22043 - DNA, 843 bp, Homo sapiens
  misc_feature 2, 11, 12, 13, 14, 17, 21, 22, 33, 44, 46, 53, 62, 65, 73,685, 739, 763, 773, 796, 804, 805, 806, 828, 837, 838, 839,840, 842: n = A,T,C or G
antacttgggnnnncgntaanncttgtttgttncttttggccgnancggcctnggctgcganagnacgacagnaggggaatatctgtgggaaaatataattaaagcagttatgaggatgctgcatttttacatgagctaagcctcatcttccaggtctacggggcccttttgcgttgcttctactcatacttaatctgtagaataggaattaaatgcctttgatgaattttgctctgaaagcttcttttttctgacagatcaaagtcaacctgattttctcccttcatgttacttgccatttatctttttgtgtgcctcacatagaagtgagcaaccatttcctttatttgttgtattagaaagataagaaaatgcaatgcttttagaggtgatgttatataagttgtcaaaattcagagaacaggaggatgagtgacttgaatcagattatttgggggcacttatttaatgttgaaggcatttattttatttactggactatatatatataacacacacagtaaaaagcagaggtcaggctgggcatggtggctcatgcctgtaatcccagcactttgggaggccgaggcaggcggatgccctgaggtcaggagttcgagaccagcctggccaccatggtgaaaccccatctctactaaaaatacaaaaatagctgggtgtggnggcaggcacctgtatcccagctactcaggaggctgaggcgggaaatcgattgancccggaggcaaagttgccggaggngaaatccacnttgcctccacctgggggcaaagnggacttcnnncaaaaaaaaaaaaaaaaaaaanggccttttnnnnanc

SEQ ID NO: 22044 - DNA, 765 bp, Homo sapiens
  misc_feature 4, 16, 173, 175, 550, 591, 601, 629, 655, 678, 718, 733,734, 749, 755: n = A,T,C or G
gggnatcctgggcatntatttatcctggccaacttgttagcatatttttgtgtgtgtgtgatttctctcttttcataaaggaaatcagcagtaatgtaagccaaatagaatgcagatggaggaaacttcagtttttccatttccttttccatttgacttttcccccttacttntncaagtaagccagaagttttgtcacaacttcctaccatatgtcttggagtatggtatgtagtatgaccaagaatagtttctttccccaaattgtatgaaacagtgacttcctggcagtgcagaacggtgaccctgaggtagggaaacatgaggggagctcagtgtctggagaagtttcaggttacggggcagggagggcaaacccaggcagagccttgtgctccctggagttaaagagatggagctgggcttgcaggaggccaaggaggtgagaggagcaagctgccagagagagggtgtcagagagcttcagaggagcccttttgagtcttctgctcagtaatgatcagcacatgtgtgtgaggaagccgcccanggctgggcaaggtaccacatgaaagagcaggaataatcctncgagtcatanaagccaggaatagtttatgttcccccanccaagtggaggatttggtagtcacanggcgtcaataaatctcaaaaggngttgcctcacactagggataattgggttacttataagctnaaactctctgacagnnccttactaccgtttnaataangctcctacaa

SEQ ID NO: 22045 - DNA, 716 bp, Homo sapiens
  misc_feature 2, 3, 4, 15, 16, 17, 22, 23, 27, 29, 35, 47, 49, 50, 59,61, 246, 411, 516, 530, 542, 558, 611, 617, 625, 639, 647,652, 674, 679, 680, 684, 685, 691, 694, 700, 707, 708, 709,711: n = A,T,C or G
annnaacttgggttnnnaaaanncttncnttgttncttttggcccgnanntacgacagnangggtactagttttatagttcgaggtcttggctttacatctttaaacaactttgattttacttttgtatttggtgatagatactagtctgttttcattcttctgcatatggatatccagttttttcaataccatttcccaccagtgtatgttcttggcacctttgtcaaaaatgagttcactgtangtacatttgtacgtttgttactgggttctctattctgttccattgatctatgggtctatttttatgccagtaccatactcttttggttgctataattctgtggtataatatgaagtcagaaaatataattcctccagttttatttatttatttatttttgcttangatagtattatttcttatagtgaaagcattctatgttatttattattagtctaattttgtagttttacaatgctatcctcttttacaaagctatgatcaactcantgtgtccagatcangatcatttgtanctatttgcaaaagtancaatattctggctgggcatgggggctcatgcttatattcccacactttgggangccaanacaggcanatcacctgaggcanaaggtcanaccanccgggcacatggggaaccctgncccannaaanncaaaantanccgggntgatggnnnangcctg

SEQ ID NO: 22046 - DNA, 840 bp, Homo sapiens
  misc_feature 2, 11, 13, 16, 20, 21, 32, 43, 45, 52, 64, 65, 73, 79, 88,723, 791, 821, 824: n = A,T,C or G
antacttgggntncgntaanncttgtttgttncttttggccgnancggcctnaggctgcgatannacgacagnaagggnaggcggggntgctgcggctccgcagcgggctgaggcaccttcgggcaacacccaatactcggggctccgctcggcttcttcgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagggtggtaaatctcgtgaaaaggtggtgaagcttttggcttctacaactccagaagagatcttggagaaattaaaaaaggaagccaaaaaaacataaaagcaagaaatgaggccgggcgcagtggctcattcctgtaatcccagcactttgggaggccgtggtgggcggatcacctgaggtcaggagttcgagaccagcctgaccaacatggtgaaaccccatctctccaaaaatacaaattagccagatgtgatggcgcatgcctgtatnccagtactcaggaggctgaggcaggagaatacttgacctgggggcggaggttgcagtagccgaatccnccgttgccttcacctggcacagatgaactnttnccccaaaaaaaaaaaa

SEQ ID NO: 22047 - DNA, 753 bp, Homo sapiens
  misc_feature 4, 11, 668, 697, 701, 714, 728, 735, 738, 740, 741, 744,748, 751, 752: n = A,T,C or G
gggnatccagnataattatttatgaatatagacatgaaaatttgtttttagattgtctacacagtagcttcccctttttttgaacatagagtagaatttgtaatgcttttcttttttctccatcagtactataaggaaaatattattaaacacccctcccctgcccaacctttttttaaaatagagatgaggttttgccatgttgcccaggctggtcttgaactcctgggctcaagcagtccgcctgctgcaacctcgcaaagtgcttgtattacaggtgtgagctaccatgtccggcccaccctttcaaacaaatttggttgtagtttgctataataatatactaaatctatgtttatttgaaaggagcctttaccttttaaagcaaaatgcactttccttaaatataaaagtaatatggtttactttaacatttaaagttcaccttatctggggaggcagaaggaattttcatagtgcttactgtgttaattattatgagagatgaaccatatgtgataggtaaagtacatgtgtaagaaagacaaaaaattttcctctttttataatccatgaaattcgaaacagaaaatattcaaagaataggcaaatgtcatgacagaacttagtgtgagcaagtcattgagaataaaatctacttttcaggncagagagccttgaaaactacaataaagtntaangcctaggattttntttctttttttttnaaagganctngnnttncccnggnng

SEQ ID NO: 22048 - DNA, 664 bp, Homo sapiens
  misc_feature 3, 172, 420, 513, 530, 535, 564, 592, 599, 605, 613, 614,619, 621, 637, 640, 641, 647, 655, 656, 659, 663: n = A,T,C or G
ggnatgtttgatgtgaaacaaactgatgatgcttgaattcctgtttactctgaagttcttttcacatgctggtgagttctgagcaccatgcttacatgcacctctcctttgcagcaaacataagttttgaggtccctgtgagtcctaatggcaccgaggtgctgtctcaggngaccttctcctaatcctgaaaaagtctccatgattggccctggaggagttctcctggttgtctggaatgagttcatactaatagtcagggctctgggcattgtgagaccctggctactttctttctttcccacaatgtatactttctcactatttatttatttatttttttgagacagagtctcgctctgctgcccaggctggagtgcagtggtgtgatcttggctcactgcaacctccacctcccangttcaagcaattctcctgcttcagcctcccgagtagctgggaccacaggcgcccgcaaccacgcccggctaattttttttgtatttttagtanagatggggtttcactgngttanccaggatgggcttgatctcctgaccttgngatcctcctgcctcggcctcatgtctgnatcccangaattnggaggccnnggganangatacttgacccaggngtnnaaacancttggcanntangccnt

SEQ ID NO: 22049 - DNA, 580 bp, Homo sapiens
  misc_feature 82, 461, 464, 486, 491, 528, 552, 559, 562, 574: n = A,T,C or G
cccaaagtgctgggattacaggcatgagccactgcacccagcccaacaggcagattctgttagatcagtcatatcatctgcntaagtgaagagagcattcattacacactgagctactttggcaattgtttgttacaaaccataactcattagatatccctaagctcatcatcggaactgaggcaatatcctaccatgtcacttgattgtccatttggttctgagtcaggcttaacaatcatccacagaacagactagtccaatttctatgggtcccagaagagctgtcaataacaacagtgtcaagtcagatcctgtttgactgtaaacaacagaaaactcagctgatacacatgtgtctcgcccattaaggaatttagatggccttttttcctcttcctctcttgcctttcccagtggcaaagcctcttcttcatgttgcatcatgattccaagatggncgnagccactctaagtttatgtccnccttncagggagaaagaaaaagggcaaatggccatggaatgngctatcaagtccttcctttgaaanatcccantanactccacacttntattgc

SEQ ID NO: 22050 - DNA, 840 bp, Homo sapiens
  misc_feature 2, 9, 12, 15, 19, 20, 31, 42, 44, 45, 62, 65, 73, 78, 710,713, 721, 723, 733, 744, 753, 766, 768, 769, 777, 783, 785,791, 795, 801, 816, 839: n = A,T,C or G
antacttgnctncgntaanncttgcttgttncttttggccgnanncggcctcggctgcgagnagnacgacagnagggnatccatttttcatgttatggaacatcggttttcttttcaccaaaatgattatagagcttgataggactttacaaagattctacagaacagtgttttgtaaatttttgttattattttaagcttttattttgaaataattatagattcacaagaagttacaaggctagaacagggttcccctggtcgacctggtttcccccaatggttacttcttttataactttagtacaatatcgtaaccagaaaattgatattggtatgatgtgtgtgtaaaattctgtgtcaatttatcacacgtgtagatttatgtaaccaccttattcgaggtacagtactatttcatcaccacaaagctcttcatgttgctacccctttattgccacacccacctccttaaatgcccccacacccccaatccataaccactggctaccactaatttgttctctgtctctaccattttgtcatctcaagaatgtgccgtatacccagacttcaccactgtacaatatatgcacgtaagaaatctccacttgcgctccctaaacatataacagtaattttctttaaaggaatgcactagaatgggattatatagatatgaagtttttacatttaaaattataaatagnggngcattttngncgggcgcagnggctccacccntatcccacnctttggaggccangnnggggaatnccaagncnaaaacnaacntccggntaaccactgaacccnttttctaaaaacaaaattgcggng

SEQ ID NO: 22051 - DNA, 871 bp, Homo sapiens
  misc_feature 2, 12, 15, 19, 20, 25, 31, 39, 43, 45, 46, 63, 66, 73, 82,93, 118, 541, 580, 661, 663, 712, 725, 730, 766, 774, 790,793, 810, 836, 839, 840: n = A,T,C or G
antacttgcctncgntaanncttgnttgttncttttggnccgnanncggccttcggctgcganagncgacagnaggggtagnagtgttctagnggtgactaacattttaagctaaagnattgttggcaaatagaagatgaaagaataggaaataattccaagatcttcaactcttctgcattacaatatgtaaccaaatgatcttaattgtctagtcaaccaaagtttacaaaaaataaattctgccataactgtgactcaaatatatgcgaatgcataaaatatgggtaagaaagtgaatttgaggcttgaacacaggtaattaagaggatcttataagaattgccaagacttgatggctaaggactcaggtttagaatataataaggaaaggtcttctgcttctggctatgacagagttgctagaatcagatgaattcatccactgagaataactataaaacttgagaacaactataaaacttggacaaaatacaaagcaaaacaaaacaaaaatctgaaagctctgtagaacaaccanggcagccaggacctcagggaccaagatcctggagagaangaaaacatattgaagtgagtactgctctgagtacagctatttccccttggaatgtttgctgattcaaggcttggggcatanangcataaaaatgacccattcttgaacctgtggcagttgtcctgggctgangaaccaaaatggngtcanagttaataagcagtactactgagggccagatctaanaaagtctntggcagctaaaccatnttnttgggctttttccttangcttttttgattccacggcttactcnganngaccgaaaaaacagtaaaatcctttggaatt

SEQ ID NO: 22052 - DNA, 690 bp, Homo sapiens
  misc_feature 1, 15, 581, 600, 614, 615, 620, 628, 637, 639, 661, 662,673, 678, 682, 685, 689: n = A,T,C or G
ngggttttttcaagnatggagtctcgctctgccacccaggctggagtgcagtggtgcaatctcggctcactgcgacctccgcctcccgggttcacgtgattcccaagtagttggaactataggcgcatgccaccacgcctggctaatttttgtatttttagtagagacggggttttgcagtgttgaccaggctggtcttgaggtcctgacctcaaatgatccaccagcctcggcctcttaaagtgctgggattacaagtgtgatgaccttgggcccctcccctcctttctccatcatggtcgtggtggtggggctattgaccttttaagcaatatttttgaaacaaaaaattatgtctaggatggagttatttggtttctaagcctcagtgagcccttcaccaaaatggcttgtagtgttttggaggatgtagacattatattcctatcatggcccaggcgaggtggctcatgcctataatcccagcactttggcaggctgaggtgggaggattgcttgagaccaggagtttgagaccagcctgggcaacatagtgataccccttctctacaaaaaataanaaagttggctggacatggngcacctgcctgcanncccanatactcangaggctgangngggaggattgcttgaccccggnnggggaggctgnctganctgnatntacnt

SEQ ID NO: 22053 - DNA, 389 bp, Homo sapiens
  misc_feature 254, 342, 348, 349, 353, 358, 365, 374, 375, 377, 378, 379,382, 383, 384, 387, 388: n = A,T,C or G
ggggctgcacagaaaaacctaatagagttggtatttatgtggttactgttccctgttagggtggctttagtgcaaacttttttcattgaagtgaatgataggggagaaagttgaggtagtggtagaaatgctttcttagagtaaaaataggactatctaaaaaagaacctgtcataagtagtggtatttgctaccaatttggatttgtagtttaagcaccaacttatttcttcttatcttttgcaatcaagtancaagtattgatgtttcttgggttaagtttcttggtccccttactatgattctcatcctaggcctatgtactatttttttttttttaanctttgnnttgnaaagntttactntttttttcnnannnttnnnttnna

SEQ ID NO: 22054 - DNA, 721 bp, Homo sapiens
  misc_feature 2, 13, 14, 15, 16, 22, 34, 45, 47, 588, 622, 628, 645, 656,660, 669, 679, 691, 705, 706, 709, 710, 713, 715, 716, 718: n = A,T,C or G
antacttgggttnnnnaaaaanctttttttgttncttttggccgnanggggtgagctatctaggaatggagaagatattagtactgtttacccaaagtactggagtgtgaacataaaggtttgaataagaccaagttggtaatagctattaatgtggaagtatgtttgttctctgtgcaaattggcaaaatttaatttggctttgagaaaaagagaaatgctagtagcaggttacttttgttgccagttgagagaaaaattcaagtagcatttcatgccaggagagtattttactggtgttagagtggaagtggggagtgctcatggatctgcaggtcacaccaccaaaccaggatttactgattaataatggagacaggataatttttggcctcattaggaagaatgaagatgagaaatgtagactatgccttcaggtatgtctgtcctacctcaattttaagtgtacaaggaatcttttagattaaggtttcttcatgcctgcctgcctgcctgccaacataataagctgtaaaaccttgtttagttttccttaaatccagaaatgattctataccaaatccttcnaatcgaatcactcttaagggagtaagtgaaaacntgtgtntctgccttgctggcttntctatttgcanatgnctcattctntttgctaacnaatttcttaacntccttgatgacctnntcnnttngnngnaat

SEQ ID NO: 22055 - DNA, 699 bp, Homo sapiens
  misc_feature 2, 12, 15, 23, 198, 340, 487, 501, 557, 578, 607, 609, 612,637, 649, 657, 658, 667, 689, 690, 694, 696: n = A,T,C or G
tncggctgcganagnacgacagnaggggtatactcagtttccgaatttcttggtaataaagtaatttatatgcaatatgctaatatatttggataaagaggtgtactatggacaaccaatgaaaacacttaacatctataagctattctttttgaaaataattttattctcaaagtgaattctctttatggaactttngatattataaagatacacgaaattggacaatctatataaatccttcataataaattttatttctccaatgtgtataataagacatcaaacagaattccccttttatgaaaaaactattttatacctatgcacattttatggngtgtgttcattttctttttctaagaaatttaactctatgatttaacttatttttaaacgatgcataatacgtgcacatttttatagggtacgtataatataatattttggtacatgcatacgacgtgtaatgatcaagtctgggtgngttcatttcactgncgaactgtcaaacacaagcagtgctttttgggactgtacatttctccttggtgggngggtgggtgaaacaggactgnatgattaaaaccagactgggacccaatgncngantctgatccctgctctgcacaactanctggggtagctntttttgcnnttgggatangggaaaaaaaaaaaaaaaaccnngggncnttt

SEQ ID NO: 22056 - DNA, 815 bp, Homo sapiens
  misc_feature 4, 6, 15, 16, 17, 18, 21, 23, 24, 27, 35, 46, 48, 55, 65,67, 77, 94, 249, 250, 576, 646, 682, 721, 727, 736, 737,740, 746, 747, 755, 756, 761, 773, 775, 777, 782, 806, 810,813: n = A,T,C or G
cttntnacttggttnnnnaanannctnttttgttncttttggccgnancggcctnacggctgcgnanaatagacagnaggggttgtcatctacntgcttttattattttcacttcttgactcatgaatgatatcctagtccattttcactgatttcttgtcatgtatctttataagaatagttctgttttctcaatggattgcttttcagttatcaaaatgacccgttcaaattttgatgttcaatttnnagctaactcatcacttctttctgcctctctctccctcctagtttcagacttggcacttgactctggatcctcttttgaggaagggaagtagttgttgtttcttcattcttctttcttgcattctcccattcattagctgccccttgctcctctagggttcatgtcaggggaaggaataggaaagggaaaaggcaaaagtcctttatgtgcttttaaatgcttttattgtggaacagttttggttctccagaggcttcatatggacctcttatgtaaaatgaaccaatccacctacacatatttctggacataagtatttatatgcntgcacaagcattaaaagctttggagcatacacatcaaatgaaaagtatgattctctctgacaaggcaggngggatggaaaacaaggggatggatatcccaagggtnttttacttcatggaatactggaattcttattacatggancatacnttttttgannttngattanntaacctanngaaanctttttttaaanancngaaanttgccaaaaaaaaaaaaaaaaaancccnggncc

SEQ ID NO: 22057 - DNA, 721 bp, Homo sapiens
  misc_feature 6, 27, 177, 179, 180, 535, 577, 608, 627, 631, 645, 650,654, 660, 662, 673, 677, 680, 691, 695, 701, 707, 710, 714: n = A,T,C or G
gacagnagggataccacctggggcggncagttacagttacctgtttacctggccacctgcctagattaacagcaagctctacaatggcggagacttggcctatgccctgttatatcttaggcatcttatttattgtacttccatgtggaatacaatggatgcctgcataaaagattngnnggatttcgaatcacttaacatggtagcaggccgaggggtggaattggctaccacaggtcttgtgttgcgtaaactggtcgtgccacatgaccagacttgtctcccttcctcccatgcccacagcccctctgctgagaaagacagaaccagtaccaggtaggtcccttgtaacaagccagaggggtgagtggaattatcttctgttttatagaccaagatctggagaagtcacatagctaacatgccagagagtcagcatttgaatgtgggcctgcaggagtccactttttatacccttcacagatcggatatgctggtgcatctgccactgaggacatattcagcgatacaaatncaattaacccgatagcccaagaaacttaactagtctgagganaacttcctgacatttttttgttttgtttaangttgggccaaaagggctanagtngggctttcaactgntatcncatncccagncnaaaatgattangggngancctttttaatnaatnaacagngaaaanacnatgnggacaca

SEQ ID NO: 22058 - DNA, 756 bp, Homo sapiens
  misc_feature 14, 174, 175, 176, 340, 358, 465, 512, 545, 551, 568, 572,591, 616, 667, 670, 684, 693, 703, 715, 716, 723, 732, 733,734, 735, 737, 738, 750, 753, 754: n = A,T,C or G
ggggcccacaaagnagcgatattttccagtgtggacccatcagtggaaccagggatggttaaaggcagcttatgaaggcaaaacgggactagttgcagaaaattatgttgtcttcctctactactatttagtggatggcagtatcttcatggtatccggtaacaaatagtctcnnnacccaaatgcaaaacctaaccagaaagtatgaaaagatgacagcacaactttggtctccggatgattttttaaaatacctaagtaatatattacaaaatcagatgtaaaaatcttcttttatagaagacatttatgcagccaacaaacataagaaaaaaagctnatcattgctggtcattanagaaatgcaaatcaaaaccgcaatgagataccatctcatgcaagttagaatggtgaccattaaaaagtcaggaaaccacagatgctggagaggatgtggagaaatanaaacgtttttacaccgttggtgggagtgtaaattatctcatcattgnggaagacagtatggcaattcctcaaggatctanaaccanaataccatttgacccancatnccattattggcatatcccnaagattataatcattctactacaanaccctgccagtggatgtttttgctgcctgtcccataccaaacttggaaccnccnatttcctcatgatnactggtaanaaatgggccntttcccctggannttttgcnccttaaagnnnntnnttctttgaggantgnnaa

SEQ ID NO: 22059 - DNA, 767 bp, Homo sapiens
  misc_feature 2, 13, 14, 15, 16, 17, 18, 20, 21, 33, 44, 46, 188, 212,219, 223, 234, 262, 272, 342, 373, 383, 385, 466, 525, 541,556, 601, 608, 617, 648, 704, 713, 716, 743, 751, 756: n = A,T,C or G
antacttgggttnnnnnnannctttttttgttncttttggccgnangggatctagttccaaaacattttcatcgcccgaaaggaaagtggtacccactaatcagtttgagaccagcctgggcaacatagcaaaaccctgtctcaaaaaaaaaagaaaaagaaaaaggaaaagaaaaaaaagaaggaangaaagaaaaaaagagagagaaaanggtggangaantagggactaanaacattatatactgtagtctactccagngatttaatanatctaaaaggctcaaaaaactgagccttttggagatggagagaccttcccaaaatcacatcactggctanaacaccttttcctttgtttttattcttccanatgtcaacanantatctctgttcttgtctggccttttcacaagttatctagggtgtagggcatggtttcctaagttacgtattgaaggagganagcataagtcagtccaaactctacactgttccatagacctgccacatggtccacagtanagggagcagtacttanagtcacgtgctgtanttgttgatgaaggaaactgaacattggtttttaagtgtttcgctntaagtanaaaagcatnttatctcaaaattctgctggcaaagattatnccatttttggttccaaaaaaatgcctttgaaaagtcttttgatttgatggatttancaaaacctnaanatttggatttgcatgtcatttacatcnactgtttntattnttatgaagccc

SEQ ID NO: 22060 - DNA, 863 bp, Homo sapiens
  misc_feature 7, 11, 12, 13, 15, 16, 18, 19, 25, 31, 42, 44, 51, 61, 64,71, 100, 134, 622, 655, 658, 677, 686, 715, 733, 735, 771,788, 794, 805, 827, 832, 835, 839, 842, 845, 849, 853, 856,862: n = A,T,C or G
tacttgngttnnnannanncttttnttgttncttttggccgnancggcctncggctgcganagncgacagnaggggccagtgaccggggtgaaaaacagnaaggcatgcatatcatatttgtggacggcaaggnagttagtaggaattgcaacattctcagtgtgcagaatgaggattcaaatagtcaggaatggtaaactccagcttattaaattttattgaattgaaattcaatagtaataagtcagattctgcctttgggttcaaaaagtcaactcttcatagataaagtaggaaagatgtagaatttttagaactagggaggcactctgctgacagcacccttcccctgcatcaagttctgtcttaagtgccaaactttaagggcattatcaacaaatgaatatattcagaggagtgatctggagggtgaagggacctaaaattttgtcatgtagaaacttctgaagaatcagcattaagcccagataataaagactcagggaaaacaaaattatagtctagatatactgtattaatggactgaagggagaaaattagggccagtggatggatactgcttgtattaattcagaatgtagtatccctcaaagatttaangaaagggtggtgtgcactggaaaaaatactggnttncaagtcaggcagaccttgntaattccanactcttgacaaagtttatgtcagtcttanttttctccttaaaattgnantaatatgtattctgcaagtttgaacctatgtaccanggctgtaatcctttgcncacctncctaaaacgcntggtgtttaatgggttctaggnaggtngcncttnttnttntttntttnttnaggaanc

SEQ ID NO: 22061 - DNA, 363 bp, Homo sapiens
  misc_feature 2, 9, 352, 353, 355, 356, 357, 358, 359, 361: n = A,T,C or G
gncgacagnagggggacagctgggaattgctgaattagaactgcagaggttcctctacagcaaggtatctggggtatatggtcacacaaaggcagctgtattgagagacattgacctagcttaggagtctaactcataaaagagaaataaaagggggttaattattgtatgattattaatgatagtatcattaatattaacgagctcattaatcatattaatgagcagagcttccttagatatatctgtttataatgaatgatacacatatagctctgatgccatagggggagagtaagaatgaacaaagaaataaaataatttttaaaaaatgatacaggcccacgtgtanngnnnnntncc

SEQ ID NO: 22062 - DNA, 789 bp, Homo sapiens
  misc_feature 2, 3, 13, 24, 26, 33, 43, 45, 46, 54, 83, 659, 669, 675,701, 719, 724, 736, 741, 747, 751, 753, 754, 760, 761, 765,770, 782: n = A,T,C or G
annttttttgttncttttggccgnancggcctncggctgcganannacgacagnagggggaaatccaagttgaacataacagnaatagctacagcattctttgtgagaaactatttatcttatctagctaccgataaaagtatttatttatggattctgtagaacagtaagtgaaataccgtggaactacaggaggtgtggaatgagctacagggaccaaacaaccatcagaacccactaaaatgacaaaactagaatggcagttatgtgaggcagtgaatcttaggttggggggttctttttgctttttccctctaatcaggaaagtgacgtggaaggatttgagtgtggtttctatgtggcaagatcaaaaattgtttttgataaacattttaggaactaacaagatgatgcttttacttgcttgttatctaaaatttgttttattttgggatcttctcacgtaagacagatttatttgactaacattaattgtgtactcaaaaacttgtgtgaagcataatattgtatagtatgtatgtgtgtatataatagggatttttataatctcatctgcatgaaagatgaaagaaggctgggcgcggtggctcacgcctgtatcccacactttgggaggctgagggggcagatcatgaggncaggagttcnagacancctggcacatggggaaaccctgtctntactaaaatccaaaatanggggnggggggggggcncctgnatcccncttntnngaggcnnggcngaaantgcttgacccgnggggggg

SEQ ID NO: 22063 - DNA, 710 bp, Homo sapiens
  misc_feature 552, 582, 610, 640, 650, 653, 654, 657, 658, 659, 660, 661,676, 679: n = A,T,C or G
ggggaatcaggaaacaaatcaacaatcaactggaattacaaccaaatctatgtacttctgttgtgagatctttttacttgcaatcctttgcaaaacgtgctgtgcacaatgtagtaagtatgcttgtaataaacaattaaaggagcttttcacgtgtagaagtgcacgcttaatttttgttaaatcatctcaataaatacttataagtgaagccaacatgattttcttaagttttttgaaaatgtgtgtacctataactgctgtgctatttgcaagaggcagtatacacacaaatttgatgatttcattctttaccaaatactatatttagcacattaaatactaagaaatagcactaaaatgggccgggcctggtggctcatgcctgtaatcccagcactttgggaggccgtggcagacggatcacttgaggtccagagtttgagaccaacctggccaacatggtgaaaccccgtctctactaaaaatacaaaaattgctggcctgggtggtggatgcctgtaatcccagctactcgagaagcttgggcangagaatcacttgaactcaggaggcggaggntgcagtgagctgaaatgtacactgcctncagcctgggcataaagcgaactcacctcanaaaaaaaaanaannccnnnnnaaaaaaaaaaaaggnggnggaaaaaaaaaaaaaaaaacccccggccctt

SEQ ID NO: 22064 - DNA, 832 bp, Homo sapiens
  misc_feature 2, 8, 14, 17, 19, 21, 22, 28, 34, 45, 47, 54, 65, 68, 76,196, 615, 663, 670, 674, 739, 741, 760, 765, 788, 800, 803,806, 827: n = A,T,C or G
antaactngggttncgntnanncttgtnttgttncttttggccgnancggcctncggctgcgagnagnacgacagnagggggtctgactttagtgagtagcagtagaaatgtagagaaatagacaaatttgggagatacttaagaagtagaaatcttggtgatttactcagttagaatttaaaagtgaaacccagntttcctgtttggtcaatgagtagataaatatgcctgggataagaagcaggggaaggaagtgggagaaggatctgatgagtttgaggtacctgggagaccctaggaatgttgatatatagatatgaaactccataaaagtgtgatcacctcatcacctataaaaagttgatctgggctgactaatcaatatttggaagtcagaggcagtaaaatgacaaataaaggccttgggtgatgatgagctctctcagggaaaatgtttaaactgcaacaagagaagaaccttagggaagtatcgacatttaaggaatcagttggaaaatgggagcctacacagtagactatgaaggaccaaccaaaaagaacaagaactgggtggtatcatggaaacccagggaagagagggcttcaaaaaggangatgtggtcagctgtagtgaatattactgagagattgtgatggctgangcctganaaanactactagttttaacaacagtgttggtggtacattggtcttaatagttctctgaagggggaccananactgcagatgaggagaggngagtncaaaaaaaaaaaaaaaaaacccnggggccgttttnccnaanccaactgaaaacctggggttnccccc

SEQ ID NO: 22065 - DNA, 819 bp, Homo sapiens
  misc_feature 8, 9, 10, 11, 12, 13, 14, 15, 16, 18, 22, 29, 40, 42, 58,61, 68, 73, 590, 635, 704, 740, 742, 744, 751, 753, 755,761, 778, 782, 786, 788, 800, 803, 804, 805, 811, 812: n = A,T,C or G
acttgggnnnnnnnnnancttntttgttncttttggccgnancggcctcggctgcganagncgacagnagggnacagtttcattttctaactaaggcaaaaatgatttttgaaacaattactttttaggataaaagtataaaattatgaagaaataatgtgtaggtttgctaaatgttgtgttcttaaatcttgtgttgaggtctgatgaatttttttatatctttaatagttctaaagtagtgtactgaaagttaggatcatccatgttgctacttaacttgttgtccatagggtctgttgtcctggatgttggtgttataaatgtacagagttaggtagttttctgtgaagagtttgcaggctaatatcactgtttttgacaatgaaaaatatagcatgaaaattaaggttggggtatggagaactttctagagctattgctttttctagctgatgattaaggttgagaggcagaagtacattgtgtcagggaggacctttcccttttatgcatgcacctggcatttatcacctttaacaaagtgtgtgtgtcatgctgtgctgcttgcttaaggggctgtatgcctncagtctgagtcacatggtaactgcatcagcagtcttagcctgtancatttattatttctttcaagttacacttggctaaactaaacatttatattcttacagtaatgaactttnctgaaagatggcctaccttggataaaaaaaaagccnantntttaaantntntcctgnttcctaccggccaagtnaggngggncnaccctaaccggntannncaaaannatcccaa

SEQ ID NO: 22066 - DNA, 768 bp, Homo sapiens
  misc_feature 2, 10, 11, 13, 14, 15, 18, 22, 26, 27, 33, 44, 46, 56, 523,552, 563, 569, 619, 649, 660, 695, 722, 723, 735, 738, 746,747, 749, 766: n = A,T,C or G
antaacttgnntnnncgnaaancttnnttgttncttttggccgnanagacgacagnaggggttgtctactctcctgcagttggtccaagtggttcctctttatcagcagttcatggatgtcagacttcatttgcattattttaatgctggctttaaacatgagctattctttattcaccatgaaaagtcagtttcatgttttggggaggaaaatatataacatttaatataaaatatattttaaaggaagaaaaaatgtgcttttcattaatgaggaaggatgataaaactttatgatactaagatttcaggcccaactaatgatatttatttctcacagatcaatggtcagattttatatggaagaagtcatcagaatgcctcatcaatcattaaatgtgccccttctaaagtgaaaataatttttatcaggtgatcattttcttttgctagtttaccaaatactttttgttagcatttcttctctgagttcttttgaatgaaaagaaaacatttgtagccnggcatgctggctcatgcctgtaatcccancactttgggangctgangcgggcggaacatgaagtcaggagatcgggaccatcctggcttacatggngaaatcccgtctctactaaaaaaatagccnggcgtggggcnccacctgtagtcccactctagggagctgagcaganatccttgacctggaggcggaggtgcanngactgaaactgngcnctacctcnntnggcacaaaaaaacttgncc

SEQ ID NO: 22067 - DNA, 777 bp, Homo sapiens
  misc_feature 1, 9, 14, 20, 634, 641, 669, 683, 702, 724, 770: n = A,T,C or G
nacgacagnagggnacaggntgcttctgttcctggaaacatgaatgcccttcatgtgtttttttctttgactagaaactcaacttcaaccaaaatatagactcccacacaataataatgggagtctttaacatcccactgtgaacattaggcagatcaatgagtcagaaagttaacaaggatatccaggaattgaactcagctctgcaccaagcagacctaatagacatctacagaactctccaccaaaatcaacagaatatacatttttttcagcaccacaccacacctattccaaaactgaccacatagttggaagtaaagcactcctcagcaaatggaaaagaacagaaattataacaaactgtctctcagaccacagtgcaatcaaattagaactcaggattaagaaactcactcaaaaccgctcaactacatggaaaccgaacaacctgctcctcaatgactactgggtacataacgaaacgaagacagaaataaagatgttctttgaaaccaatgagaacaaagacacaacataccggaatctctgggacacatttaaagcagtgtggagagggaaatttatagcactagatgcccacagagaagcaggaaagatctaaattgacccntacatcncattaaagaactagagagcagagcaacncttggaaagctgcngaagcagaatagtagatcnagccgactgaggaatgagaccnaaaacctccaaatcatgatcagaactggtttgaaggcacatttgtnacgtaca

SEQ ID NO: 22068 - DNA, 527 bp, Homo sapiens
  misc_feature 87, 92, 393, 427, 478, 480, 482, 486, 488, 490, 494, 496,498, 500, 506, 511, 513, 516, 517, 525: n = A,T,C or G
ggaaacccaactgtcttcaccatctcgcctttgattagttagaaacttaatgagtcagctgaagggaccatctgcagccgtcatgcntttcnactagcctgtggtgggcaggctggtcagagccagtagcagcatctcacttccccacccaaagccccaaggagagagactggagcgccttctagttgcactggttttcaaccttagctgcaaacaggattcacctggggaacttttaaaatacggagatcaacaaaagaagaatactgacacccaggttcacccccatattctgaggcctggcatgagcatcacaatttttaaaagctccccaggttcccctggggttcccctgtgcagctggtagggaaagccactgtgctggggactccnggcatctagcactgacctctccctccaaagtctncacatgcagggacagagttccgggcttagcccacttcctttttcacacacncncncgcncncncacncncncncacacncacananacnntttttctnga

SEQ ID NO: 22069 - DNA, 734 bp, Homo sapiens
  misc_feature 380, 422, 457, 511, 518, 559, 575, 587, 589, 602, 625, 637,673, 710, 711, 714, 716, 721, 723, 731: n = A,T,C or G
gggaataaatgttttacattttgtttgcaatatggtaagcgatcagagatcctagatgctggttatttactattgatatatttcatttaaaaattcttactttaactgaaaattggctgaaactttttactttggctgaaactctatgcaaaaaagtcagagtaacatggatatttttgaaaaattgatggtcatgtattatgtgggttaatattgtatttaatcagaagtcaagtgttttttttttaggtggttctatgtggacacatcctaatttgatatctcatgaggactattgtggaaaagagcacaaattaaacagtgtaaattgcacatgctcaatgtataacttgttagcattttgttttaccaatacttgngcgtcatctaccagtgaagaaaggaaactcatacacttttgngtaatttataagcaaaaatatcccatttgaaaganaaggtaaagagaataactcattttatgactttctcagattttggctaaaaccanaactttncctccattaaagaaagtaatcgaagaccttttccacaattncttctaggatgacaanagcttgcttggngngggtgcctaaggnccctgttacatttaccccttcangaggggaccagnggcatctccctgggaggctgctcaagtttggattgngtaatacccgttttctgttttcaaacttctttttcannccngngacanangaaacctnctc

SEQ ID NO: 22070 - DNA, 740 bp, Homo sapiens
  misc_feature 3, 10, 437, 483, 498, 507, 510, 531, 565, 581, 590, 596,598, 603, 610, 646, 651, 670, 681, 716, 724, 725, 726, 727,728, 732, 733, 734, 737: n = A,T,C or G
ggnatcttgnttattgtcaatagtgctgcagtgaacatgggggtacaggtgtctctttaatatactaatttcctttcctttggaaaaatactcaggagagggattgctggatcatgtatgtagctctgtttgcggtttttttgaggagcctccatactgttctccatagtggctgccctagtttacactcccacccacattaatagcacttgaaaaacgacaacaacaatgtttttgtaacctaggctgtttgtgaggtctggcatagttctgctggcccaggtttctaaagcaggtgaagcagatgtatcttagtgaattggactgtaggtttgcagctactgtgaaatgttatcctttagtgcagtatctgttcattatttcctatataactatcttttgcttggcttctcttttccatggactgcatgagtcangacataacaggggcccccaaaagaacccattgttgagcattcttanatgttggaagtgaanagtatacanaangtggcccaagtttcaggagcncagggccagaatgattcaaaaatgaagtatgtantgttgatgtgaatctngtaattttnccgcanancccantctgatnggtcccttttacaggcccattaatacctaaatgccncaccnaggtttattttggattttngggattttgtnttttcaccaaaaaaaaaaaaaaaaaaaaaagggcncttttccnnnnncccnnntanaaa

SEQ ID NO: 22071 - DNA, 746 bp, Homo sapiens
  misc_feature 6, 22, 583, 619, 651, 734: n = A,T,C or G
gacagnaaggaggaaacccagnagatgtggtagtaggggttgtgagggggcgctgtggggccatgcctggtggagatccaccacgttaagccttctgctaactgtttgtctctgactccatgatctcttctgcctcttcccattctggattctgctcatctcaggttgctggtcaaagcttcctgtttatatttagagagtgtaagaagagtaagaacccttttattgccactgacccatattcatatttaatgttgcttgtgttagtcggctcctcattggttctctttttggaagcaagcagggacttagagagtccagaggaagctcagagggctggagctttagttcaggttggctgaggtgcttgttcttaattcttctgtgacaccatgtctgtctcagtcactgcatttttaacattgttttgaaaacatttctcggccaggcgcggtggctcacacctgtaatcccagcactttgggaggccgaggcaggcagatcacctgaggtcaggagtttgagaccagcctggctaacatggtgaaaccccgtttctactaaaaatacaaaaaattagctnggtgtggtggcgcacgcctgtagtcccagctactcnggaggctgaggcaggagaatcgcttgacccanaggcggaagttgcagtgagccgaatcgcgccattgcactccagcctagtgacagactgaactgtctcaaaaacaaaaaaacanaaaaaaaaaaac

SEQ ID NO: 22072 - DNA, 729 bp, Homo sapiens
  misc_feature 11, 470, 492, 504, 522, 552, 569, 603, 606, 607, 613, 618,621, 627, 655, 657, 662, 666, 672, 680, 694, 723, 726: n = A,T,C or G
aggggcaaggnacagcttttggtatgctaaagaatttgggaaagatgctgttggtgtaggggcggggagactagaaacaagatctttccatgggcagagctcttcagagcttgataacaaagtttggtctgcagcctttgtcaaataattataaactctccagttgaaacagggaaatgtgggctggcgtggtggctcacacctgtaattccagcactctgggaggctgaggcaggtggatcacttgaggtcaggagttcgagaccagcctggccaatatagtgaaaccccatctctactaaaaatacgaaaattagctgggtgtggtgatatgcacctatagtcccagctactcaggaggctgaggcaggagaattgcttgaacccagaaggtggaggttgcagtgggctgagatcatgccaacacactccagctgatagagtgagactctatttcaaaaaaaaaaaanaaagaaaaacagggaaacgttngcaaagcttccntctccaggttgacttcantcaataatcctattgtcttaaggctggagnggacttccttgaagctntttgcccaaaaaaccttgccaaaactctcctaanatnntaaaanttttntcnagtctnttttcctgattccatcactggaaatgtntnaaaanattntggggncaagtctncttacttttgcttnaacccatcccccaaaaaaaaaaaaaaaanccnggg

SEQ ID NO: 22073 - DNA, 776 bp, Homo sapiens
  misc_feature 1, 618, 666, 671, 676, 683, 690, 695, 703, 710, 711, 728,746, 752, 760, 774: n = A,T,C or G
nggataaaatgggctgggcacggtggcctgtagtcccatcactttgggaggctgaggcaggcgaatcacttgaggtcagaagtatgagaccagcctggccaaaatggtgaaaccccatttctactaaaaatgcaaaataattagccaggcatagaggtgcatgcctgtagtcccagctacttgggaggctgaggcaggataattgcttgaacccaggagacagaggttgcagtgaaccgagattgtgccattgcactccagcctgggcaacgagtgaaacttcatctccagaaaaaaagaaatgatataaaatgttttattcttatgaagcagtttgcttgagtaattttaatggataacggtgaaaattaaatcactctgggtgtttttattctcacagatgccttttaaaaagtgatgtaagcattttattttaaaataccagtatttagattatagttgaaattacctaatcctttgcaactattttgttactttatcaaattaaccagtttataatcaaaattccaggtgacagtctaattggcaaagggtgcatacatttttcaaagtattttatgagataagtgaataaaattggggagcattgctcgaggnctcggaattacctaggattggactgtgagtcatgggatcagtatttanctgcnccagngaggcancctgctntcagngggggccnctggctnnatggaggtgctccttangggggcctgggctggatntacagnggctaggncattactgttaagngg

SEQ ID NO: 22074 - DNA, 653 bp, Homo sapiens
  misc_feature 25, 34, 47, 50, 75, 79, 88, 90, 94, 95, 97, 110, 119, 120,122, 126, 134, 146, 152, 161, 162, 164, 175, 180, 189, 212,234, 235, 236, 238, 261, 270, 271, 280, 453, 480, 496, 525,541, 556, 563, 564, 567, 577, 590, 593, 598, 602, 605: n = A,T,C or G
  misc_feature 607, 611, 615, 639, 640, 647: n = A,T,C or G
aggttcagctgcttccacaacgganggacggggncgacttgcagcgngcntgcgttttggtatctgtgcggagtnctangacccaatncncctnntncactgaggacatngctgtgganntnatantgaaaggnacctctgggaangcgagntcaacaagnnanttaaagaatgnatggngtagatgtntaagcagtctgctaggagacagncaactgcctcatggtacacagnnnancctctccttgctacccactctcncacaacctnngactacatntgtgtcttcactttggaagtggcatgttgacagtcaaggcctcaaatgagtgcatttccctgccctctttgtctggctttaacatggtttgaaacatgatgttaaactacaatattgatgccaaccacagaaggacagtgtgcaagttggcgatacacttcttagtgttctgntccctaagctcattttcataaatgggnttctttcttgattagncatattcacacatgaatgggtatttgctnaatctcaattcttggngtgaaattcaggacnctttaanncangaattgttanggaagctttacanggnttctncctnccncnctgntganttaggggggctgcctttccttgcnngatgttnacggct

SEQ ID NO: 22075 - DNA, 767 bp, Homo sapiens
  misc_feature 609, 626, 677, 685, 695, 715, 716, 721, 722, 723, 736: n = A,T,C or G
ggggagtgcataatcattgcctaacattttatgtgaatcattgtgttacctttcataacaactctgaatggacaatattcttgctctccttttatagtgagggaaataagtgcttggagaggttaaataacaaacaaattggtccaaagcaacactgctggcaagcatcactctgggattaaaactaggcctatttcattccagagcaattttcttccctataaaatcatgattctcagacttagctgcatattaggatcacgtggttttttaaaaaaatcctgatgcccagggcactctccgtaagaaatcggaatgtctgagggtggacccaggcatcagtgtttgaaaaataatctccctcgatgattccagtggggaggcaagtttgagaaccagtactataaactaagctgcctgaatggggctgtttgagagaaactctcaaacgtgtttacacaggttgggaccgaccaagctttctttaatcttttcagaggaatgggtatttttaaagtagcaatagataaatctaactaatcttccaggtgtgaaacttaaggctatatgaaagaaatagtttgggacaaagaatcccttcctaatttncctgcagtccctcatangcatgaccatcgcatctctttatggctgaacttacctgactgctgacccanacttttgnccaggacctntggggaggtacttccttttnnctgcnnnaccctaaaatttncttattgctgctctaggactagggtttttcc

SEQ ID NO: 22076 - DNA, 739 bp, Homo sapiens
  misc_feature 1, 5, 20, 22, 27, 580, 622, 651, 666, 673, 677, 679, 693,720, 728: n = A,T,C or G
ngggnaacatgaacctcagnanaaganatctgggccaataatatagatgtattcatatacttaataagtacagcttgagagactgcaaccatagaagtctcgtggtcaatttttgctctccaatactctcattttgataattaaaatatctggtttcatatggtagttaaatttcaagtttgcattttaagctaagaatctgccctcccaaactttggacatgaaaaagatggaatgagggaggaaaaattgggccatgaaaggtctctcttgactaataccaatgtaatctggtattgggttgatctggttgtttcagatgtttcaaggtgattctttctcttgtgggtactttcatgggctcattgaagaattgcctactgaactatgctaattatagctcccttgatgtcagcagtgtgtatccttaggctggctacttacagccccttcccatccctcccactcaccatgcagttccactttttaatggtccactagtaccaccctaatctaagatatcctttctactttaagttctgctcaggtgctatagcatttatcctgaaacatggactanttgatatttgttcttccagggcttcaaccaaaaccaaagtanaatgaaccccattttatcttctttttcanagatatgtgaattgntcattanaagngnaattgaatgatganatctttttcttccacttcccctccagnagaagctncaaagggcagg

SEQ ID NO: 22077 - DNA, 785 bp, Homo sapiens
  misc_feature 523, 602, 654, 671, 705, 710, 720, 749, 757, 767, 772, 774: n = A,T,C or G
ggggatacaagtaacatcttctttcttcataccttgtggggccatttttattgttattgttatacacccaaatgtaaaattagctatacaggtagcaaaacaatgtatgagaaatttaacacatccataaatgatatcagcagaaccctcagtgacagaagaatcaaacacgaatccaaaataagtgacattccagctagttcaaatcagttccctctctaagaagaaagggattaaacataattcagttcaccacatgtagggggcttctttaccaaggtctgatacttgtgaaggatataattgtcaattctaattcttcattcccctctagtaatattatgtatacatactcttgccatggcctttaggagggagagttatattttcctacctcttcactttcgttttagccctgctactttctttgagcaataatatgtaagcagtcatgctgtgagcatgcaataaattttgtctgcaaagttcagcttggtctttttgttgttttgtctttcattgngataccaatgtacgttggttaaacactggtccagaaaatgagaaagcaacataaactcaattttatctttgagacagancaagctgagtcagcctaacagctgaacctcggccacatgcaaatgaataaanataatgctttggtgggngccctgagattctagtaatggtgttaccaaaggngtctnttggctgganaattggctttggcaactggttctcatacncagtaacngccttttgcngggananaactatttgat

SEQ ID NO: 22078 - DNA, 861 bp, Homo sapiens
  misc_feature 2, 8, 14, 30, 43, 60, 63, 71, 568, 616, 671, 727, 730, 732,748, 755, 767, 780, 820, 833, 843, 844: n = A,T,C or G
tnttttgncctacnaaccccttgtttgttncttttggccgcancggccaacggctgcganagnacgacagnagggctctttaatcttggtccagaggttgtttcttctaatgagcactagatgaagaagttcgtttgagcagacgagctatgttatgagatagacatatacagtcctttaacattagtgagccttgggaagcaaactccatcaagagaatgagcagactccttgacttactctggaccccactcattgggtaaaatgaagggcagagtagcatggccaacaccatttaaacccatataaaacgtgtgcgtgcacaagcgtacatgtgtgcatgcatttaattaagtctgtgtaggttaaacaaatataagttgggactccatcatcttgagtactgctcatgtgcccgaggtatgctaagtgtaaacagaaataggcccgtgcagctgctgcccttgaagcctattctaaaaggtcactaggattatacaacacagcactgcaaaactgatatggttgggcgcagtggctcatgcctataatcccaacgctttgggangccaaggcaggaggatcacttgaggccaggagttcaagatcagcttangcaacacagtgaaattctatctctataaagattttaaaaattagctgggcatggnggcacctaaagtcccactactcaggaggcagaggcaggagaactgcctgagcctangangncaggcttcgtgagccntgatggntactgacttcanctgggtacaagcnaggcttgtctctaaaattttttaagattaaaataaagacntatgtccccgttncggagtccannaggaaacagaaaaattt

SEQ ID NO: 22079 - DNA, 675 bp, Homo sapiens
  misc_feature 4, 21, 23, 42, 360, 362, 447, 517, 532, 542, 551, 579, 586,611, 614, 634, 640, 644, 647, 656, 662, 664, 670: n = A,T,C or G
gggnagcagtaggcaaaaaangnattttaatcaattgcaagnagtcaatttcaggcaggacgcagtggctcatgcctgtaataccagcactttgggaggccgaggcaggtgaatcactggaagtcaggagttcgagaccatcctggccaacatggtgaaagctcttctctactaaaagtacaaaaactagttgctcgtggtggcatgtgcctgtaatcccaggtatttgggaggctgaggccggagaatagcttgaactgggaggcagaggttgcagtgagctgatattgcaccactacactccagcctgagggagagagcgagactctgtctcaaaagaaaaaaaaaaagtcaatttcntntcaccatgaagtattggaattctttaaaattaaagtaacacttgatgtgtttcctgttgactaaccgtttgtgtgatttctgtantaattaaggtgtttggcttagttacctcagttggaactataaagaattgaattttaggtatatactatgngtatgtatatatagntttttttttnacttgttgnaccccaccgatgcttgaaagttaaaaanaatcctnccaaacccccaaataggagtttcancanttttattttttaaacaaatntttgancccnttngttgcttgnttgggntngcccgncttgg

SEQ ID NO: 22080 - DNA, 758 bp, Homo sapiens
  misc_feature 2, 9, 14, 585, 604, 646, 678, 688, 689, 692, 714, 736, 753: n = A,T,C or G
gncgacagnagggnatttgactgacctactaaccgtgaaaatacttcttcaagttaagggttaggatagggaagaagaagcaagttctgtatgcacaagcaaaaggttggccctcaccatcaaagctcctgtcataaagagtgaatagaaggaaggattgttattattatgactttggttttatttaagtataaaagtatcagcactttaatgctcaaagtatagccataagcaagattagaaaatgtacttgctgtatattgttccagcaacactctgggtttgccctacatttgtatatagttggttttctgtattagtgttttatcatagaccgagtatcatttgtatatttttcaaaattacataaataattcattttatcattttatttattaagtccagaaactgattttaggggtagagggatgagttgtgctatttaatcttactctggcggataaataaacatatggattcaaaggtgttgagtgagagaagactcttgatatgttagaagaccactgctctaggatatgtgtagaaacaaaactgacacataggaagtacttaatgaatggttgntgaatgaataaattttcangcctgcctgaaaatctatgtgacatgtgtcgacacatacagnccctctggtactcagtatcatattctgaaaangaaggggtanncangatttctagcactggttacttntaaaatctggatgggggggggnttcccctggaatccacnctttg

SEQ ID NO: 22081 - DNA, 651 bp, Homo sapiens
  misc_feature 571, 604, 619, 625, 643: n = A,T,C or G
tatgtgtgctcagtagggtacttaggatatttgaggagggaaaaggccgtcagaaactgatgtgggagagtggtgcacaggaagaagtactatggtacagtgacaaagataactttgtcataattttgcctaaaaagagaaataagactcgtagtcatgttatataggttaactgtgcgatgaagtaaagggaatgtcatgaactacttgggaaacccagtgtcttgaatcccgaaacttagaactcaaccttttcacgtttgggaattgcttatgttcagaagtcccatgatttaagagataatgtaaaaatggaagttaattcacatttgtacgtgtcctttgtgtgattgtcggattgaaacattttaaacttcttaagaaatgtagcgaagcaaatttggatttgtatgtgaaagtgacctagatgagaagtatggaaggagacggagacagcagcaagtttgctcctcccttggtttcagaggaaaatggtttttaagagctgggccagatgtttctcatagctccttaagggggattccttttttctgggtcttctgttttaagngaatctggttttgagccttgcggaaacctgcanaagccagggaatgancagcanaaatggagtgagaggaanacactggg

SEQ ID NO: 22082 - DNA, 813 bp, Homo sapiens
  misc_feature 11, 15, 20, 21, 32, 45, 52, 62, 65, 73, 92, 98, 613, 659,665, 692, 758, 774, 788, 793, 801, 804: n = A,T,C or G
ttttttgaccntacnatccnncttgcttgttncttttggccgcancggcctncggctgcganagnacgacagnagggcgcttgaacccgggnggcggnggttgcagtgagctgagattgtgtcactgcactatagcttgggagacagagcaaactccgtctcaaaaataaataaataaataaataaacaaaatttaaaaaggtaataatgtaagaaaataaagagcatggagaaagtagaaaaccagataacctcggtcctattttgttaaattttgggaaatttcagtatctgcattgtacagatgacaggcagaatcttgagaagttaacactttaaaagaaagaaagaaaaaaactagatattcactatgtgtcatcttgttgactattctcttctctgaacttcctggcatcttagttagcctatttgagctggaataaaatgtactacgtgtcttcagattctgcaaacatttaccaggcaccagggcgtccactatccagtcccaagcctgccactcaggagttcatgggggagtgagtgcatgtggcaggcattaggcagggtttttgcattctgctctcccacttgatccctgtgacaaccctangagcctgctgccactgatcttcttattccacttgaggaacctaaangcaganacaggatttgaatccaagcctccgctncaaccccagctgaaggagcaagctggacccaagatgctttcatcctgctgctctgacactgaattnttcctggatgctggantttgctgatcattncctcncagggccnctntgaagttaa

SEQ ID NO: 22083 - DNA, 757 bp, Homo sapiens
  misc_feature 8, 11, 13, 248, 255, 266, 267, 271, 274, 275, 276, 278, 282,283, 288, 291, 295, 303, 304, 306, 309, 315, 317, 318, 320,322, 324, 327, 329, 331, 337, 342, 344, 350, 353, 355, 357,360, 368, 370, 382, 391, 415, 416, 420, 428, 429: n = A,T,C or G
  misc_feature 430, 431, 435, 443, 444, 445, 446, 455, 457, 461, 462, 471,474, 477, 480, 491, 492, 494, 499, 502, 508, 514, 515, 535,539, 550, 560, 561, 568, 574, 578, 585, 590, 592, 599, 600,615, 632, 635, 654, 666, 684, 697, 701, 705, 712, 735: n = A,T,C or G
  misc_feature 736, 737, 756: n = A,T,C or G
gggggagnagnanaaatcctgtttagcagttaggtaccctgtgacttctttaccatgtgctagactcaaacatacggtgaagttagaggaattgttttgtatttgttcttaattactctgtaatactacattacaattttaaaaccattttaaaataaaaatgtattcttttcacttgttctgccctcagaattcttcagtaatataaatatttaaataaatcaacaaagcttttttttttttttttnaaaatcnggatttttttnngggnctnnntntgtnncccanttnggancaggggcnnantcncggttnanngnancnttnancnccgttnaaggnancctccngcntnanccnggcttgcntnacaaaccccagntaagttttngattttttttttttttttgggaannaggncattttcnnnntttnccccaggnnnntttaaaccncngggnntaaaccctnccnccnagnggggggaaatnntnggctngancccccncccccnncctaaattgggaattttacncatntttaaagttcntttgattttnnacatgtntgggcnaaanaaaaganaaccngncggggcnngggggctaagggggnaaccccgccctttgggnggntgggggggggggaaccctngggggggagttngaaccccctggccaaatnacaaaaaaacctntttntttnaaaaaanaaaaaattacggggggggggggnnncccttatcccccccccggng

SEQ ID NO: 22084 - DNA, 801 bp, Homo sapiens
  misc_feature 2, 8, 13, 23, 28, 36, 50, 51, 54, 555, 660, 680, 702, 726,735, 736, 748, 769, 783, 784, 785: n = A,T,C or G
antacttngaccnaacaatcccnccttntcttgttncttttggaccgcannggnaggtgacctctttaaactcttcctttactccagcattttgcatcctcatgttagctctttaaacacattccgtgaataattttgttactgcatttgctaaattatactgagttgtatctgcttaggtttctgtttctttcaataatatctgagtgctaaaaaggctaagattactttattcgtttgtttctcagattagcaagggatctgacacacagtaaacattcaatacttgctaactgaacaaatggatacatgacaaaaatacataatagctgaaaaccacaacaatccattgaatgcttactcagtgtgaatggatgagccagtcactgcaggtataaataccaatggggaaggtaattgaagcatttatgtaaaggtttaaatgcttcaataaattttttttatttatttgaaatatgttcccaactgaatgtgaactttggttaatttgtactctattattaactatgcttttttcttagaattgtcatctanggttttctagatgtcattggtaaaaatcacagagacgaaaacattttattatgcgagaaaatccctgcaagcatcaagtctcaagctcattatttatttacttgnggaggatgtaatattttctntaaagaactgccactcattaangaccttaatcattgcttaaaatancctacaacnnggattgggaccngcaggattaaattggcttaanacaacctgggctannncattaaacaaaaaaga

SEQ ID NO: 22085 - DNA, 828 bp, Homo sapiens
  misc_feature 11, 16, 24, 31, 44, 51, 61, 63, 64, 72, 78, 664, 720, 730,731, 736, 751, 781, 804, 805, 816, 821: n = A,T,C or G
atacttgaccnacaancccccttncttgttncttttggccgcancggcctncggctgcganannacgacagnaggggnaaatgttcacgtgtgatgttttcctgagtcattctttggggttatattccaggcctgtgttttaccttgttgacaaacaaatactctgtaataaatatattcaaaacatctgacatggctaacagatttatgtaacaattcataggcaatttgaatattaaatttattgccaactatgtttgtatatttttgttccttttagcagggcagagacaatattctgtagatgccaattcaaagttaaatgaatgtgaatgttggaaaaaataaattgatttacaagtaaatatttttcccaaaaaattgctttaaaaatatttatataaattttaatatcattatgtaacattttacatttgtatataatattttaaaatatctttaaaatgtataaattgcttcaaaatttgtactgtttcagttgaatttaagaaattaatatttgctgatcctttactataagcttggccctgtcttacccctataatccctttccatactcatcccatacccattcctgagttgcatatcattctcagggtacagatgagaactccagctcaggataattaattgatgaatgcanaaaatagttataattacttaaaaatcaatgcttatatataattgaaataaagcagngatatctttnngggtncactaaaacattcantttcaagatctatttgtctgaagggatggnatggcactttgaaatgattgagnnaaatcttctgngcttntgtcctg

SEQ ID NO: 22086 - DNA, 800 bp, Homo sapiens
  misc_feature 4, 8, 9, 13, 21, 29, 32, 36, 50, 55, 58, 60, 700, 706, 720,730, 731, 734, 736, 752, 769, 772, 798: n = A,T,C or G
ttcnactnngggncaaaaaancccccttnttngttncttttggacaccanggggnagnanataccatattcataattgtgtttgttcctcacatgacaacatgaggaaaatcctgtcctgcactgtttataaagggagtcagaacattcagtactgtactataataaatgcataccataataaacacactgaatctgaaggaagaagagatgaagaatcagactacaagttaaatgatttgcctgaagtcacgcatatagatttctgggacctgaaagtcaatctgtgcctaagaaatcccttttttttaaaaaaaaaattacaattactgaatgaattttgaaacagaggccataaagacttaaaggtgtgggccaggcacggtggctcatgcctgtattcacagcactttgggaggctgaggcaggtgggtcacctgaggtcaggatttcgagaccagcctgaccaacatggtgaaacccccatctctactaaaaatacaaaattagccaggtgtggtggagcacgcctgtaatcctagctacttgggaggctgacgcaggagaatcgcttgaacccagaggtggaggttgcagtgagccgagatcgcgccactgtactccagcctggacaacaaagcgagaccctgtctctaaaaaataaaaaagaagtagtgctaattcttggagaaaaagataanaaactntggaggcccctcantattcagcannaanantgtggcttggaaaaancctggttttttaaaaantancactggctggggttcatgcctgaatncc

SEQ ID NO: 22087 - DNA, 570 bp, Homo sapiens
  misc_feature 336, 428, 440, 456, 462, 510, 513, 519, 538, 539: n = A,T,C or G
acaggcagaagaggtagagaatataggcagagtcatggatgttgaaaatatccatgattatagatttgtgtgtactcaatctattcatgtcttagagggcaaaggccagccattttagataaaagcctaggcactcggctttgaactaagaactttgtccatcaacctgccaacatagacaaataagggaatatggccagtgtgcaagaaaacagaaaatagcataaatcacaatccgtacaacttgcatattggcaaactaggtttaggtaaatcaggacttattcaaagatgaataagcaagtaaaaaaaaaaagataaaaaaatcttcaatgncttttctatcttccatacttcataacaaaaggaaatcaaacataatacttagtgtgactgattgggagatacttacttcataggcttattgnaataagataaanaatgtaatttatctanaaagcncttagcacagctcctggcaggtagtaaacatccataagagtaagtttnttnttttgntaacatttgaactaaaganngactcaaaactgctttctggtccagtaatcc

SEQ ID NO: 22088 - DNA, 671 bp, Homo sapiens
  misc_feature 428, 462, 487, 577, 595, 620, 624, 628, 630, 648, 649, 659: n = A,T,C or G
tggactacttctagccttttgcaattataaataatactgtgatgagcaactttattttattttattttattttattttattttttgagacagagtctcactttattggccaggctggagtgtagtggcgcattcttggctcactggagcttccacctcccaggttcaagtgattctccgcttcagcctcccgagtagctaggattacaggcatcctccaccaagcccagctaatttttgtatttttagtagagacggggtttcaccatgatggccaggctggtctcgaacttgtgacctcaagtgatctgccctctttggcctaccaaagtgctgggattacaggtgtgagccaccgcgcctgaccgaacaactttatatataaatatttttatttatttattttttgagacggagtttcactcttgntgcccaggctggagtgcaatggcatgatcttggntcaccacaacctccacctcccgggntcaagcgattctcctgcctcagcctcccaagcagctgggattgcagacgtgcaccaccacacctggctaattttggattttaatagaganggggttctctatgttggncaggctggtctctaactcccacctnaggngaancncctgccttggctccaaanngctggaatanaggggggagcct

SEQ ID NO: 22089 - DNA, 767 bp, Homo sapiens
  misc_feature 544, 557, 635, 678, 682, 701, 716, 717, 727, 750, 752, 753,763, 765: n = A,T,C or G
aggggggcactttccagaagaggggtttctaggcaaacacagttactcctccctaccctcacttgcctgcccagaactctaggtacccagctgacactaaatttttagaagtaaaacaagctgtgttataacaccagaacctggaaggataactgctgggtctcagtcctctcctttctggaaacagacacctgggacaagagagaagcagctagggactcctatgctggctgaaccaaggtagtggtgcaggctgtggaggtgggtgcagaaccatagatcttcagaagtgtcgatttcctcctcccttgtgtgccaggtgggcagtatgcatcgtctccatttttctgatagaggggataatagggtaacggggtttgaggtcacaccaggagaaagaggccagaaagtggaccaggagaaccattcaagccttggactccagtcccaggggcctatactggatctggtaaagagtaacagctaggatagccgggcacggcaaatcacacctgtaatcccagcactctgggaggctgaggcnggtggatcacgangtcaggagatagagaccatcctgaccaacatggtgaaacgccgtctctactaaaagtacaaaatgagccaggcgtggnggcgtgcacctgtagtcccagctactcaggagctgagcagganatcncttgacccggaggcaaagntgcagtgatctccanntgaatccgcnctggctcagccttcagctggcananncagactccgntnaa

SEQ ID NO: 22090 - DNA, 786 bp, Homo sapiens
  misc_feature 590, 657, 661, 685, 695, 707, 710, 723, 739, 742, 744, 757,768, 777, 782: n = A,T,C or G
gggatcctagggctaggcatggtggcttacacctctaatcctagcactttgggaggctgaggtgggaggatccgttgagcccaggagttcaagaccagcctgggctatatagtgagaccccatgtctacaaaaaatacaaaaattgaccaggcatggtggtgcacacttgtagacccaggtactctggaggctgaggtggaaaggattgcttgagcacaggaggttgagactgcagtgagtcaagatcatgtcactgcactccagcctgggagacagagtgagaccttgagactttgcatcagaaacaaaacaaaacaaaacaaataaacaaacaaacacgttctggaagtagtatgaatggtaggttgagagatgagggtaaattcaattgagaaagggatgcaaatgagaacataattattagtaatctaaaagagaaatggtgaggggaaatttttaattaagataaagtaaaataatggtgaaatcatgaatttttttattttgtatttcatttttaaaaatcataaccacatgtacacttcattactttagaattggtacttttgaaagaaaaaatagtcatatncattgactctcaaatattcttatgagttatttatactaaatgaatgaaaaaggcagagaatacactntgtntaaatatgagcccaatttttaganccctttgttnaataggctaaanagncgatgggttaganattttagaaaggatgngananatagaaaaacttngggctgggggnggggctccncctgnttcc

SEQ ID NO: 22091 - DNA, 650 bp, Homo sapiens
  misc_feature 376, 462, 492, 525, 555, 557, 565, 624, 633, 639, 641: n = A,T,C or G
gggtagagggaagatatctccacttaccgttaatatagcaaacatagttcctttattactggactttttgtgctgaagatgtaaaaactggaaggaataaggtagtcttcagaagtgattactttgtaattatacccatcctttaaactggttacattggatacatgtaatttacgaaatgttttcaaagtccacaatattgcaccaatttctctcttatattagttttattctggatccataaaaaatatacagtggaaagtccaattttccaaggtaataatggctgttaaagtgttggaggttctcaaagagggctcatattccctttttgcttttccctacagtgcctggctttcctgaaagccttgaagangttgataatacttgggtattgataatagtagcattggttactcaagagctaaatttaaatccagcctttagatagatcacccagancctcaagggtgggccttgccttgctcatgnttattctgaacctgaagcaaacccttggtaggnggggtagtctattcatggagaaacctgggncntacctggngttgctgctgaacctctgcaaaacctaagggttacattaaacatgctgcctctttgggnagtctttanagtcanantatgaaaaa

SEQ ID NO: 22092 - DNA, 764 bp, Homo sapiens
  misc_feature 545, 637, 720, 753, 760, 763: n = A,T,C or G
agggacaatctgctgggctgaggatcaacacatgttcaaaaagagaggaaagaagtcaagggagatcatgccagatggacttaatttcaatgaagaacagggtcttcctgcctgtaagaaggaggcactctctgcttctgtcatgtgctaagcttcgtcaaacagattatctctctaaaggtagaggcctgtgattgaccgctgtaccaatgactgagcagacataaaagtcagcctggatggctaccaccactaatcagatttgtctgctgatgcaaggcccttcagtcattccagaactggtaaatggagtcaccctgaggacaggccctgctgctgattgatgtccagtgtgggcagctctcttggctgctcaacattcagagaggctctccttgtttcagtgctaaatgattgacagtcagggtgagtatttcaggaggaagagtcccccgcccactccagccatgtggcaaaggtatttgcttccttgggaaggaagtgatttatctgtgggagaacactgtttgggcaaagttgcgtangaacagcgtctgtctctgcagcatgtgtgtatgtgagtgtgggcataaagcagcaagagtggaaggtaaagacaacgtgaacgtcataaaanacacttctttttacaaatgcttgaaacttcgatgctgaaagacttcagacccctaaatgaatttgcacctaattcacatggcntacttcttttttttcaaattaagagcctgcctntcattanttnt

SEQ ID NO: 22093 - DNA, 851 bp, Homo sapiens
  misc_feature 15, 27, 34, 48, 64, 66, 69, 77, 127, 141, 154, 173, 625,630, 642, 671, 713, 760, 763, 787, 801, 805, 810, 813, 814,819, 831, 839, 841, 848, 850: n = A,T,C or G
attacttggacctanaaaccccccttncttgttncttttggaccgcancggcctacggctgcgnanagnacgacagnagggcccccaatgaagtaagtccttttcatgaacttttcaccatctgagnaactcacacagggnaagaaacctcagnaaatatgatcacgtgaggnaaagacttctggcctaactcagtcttatcttgagaggattcatactggaaaagttcttacattgagtattacatctaagagcttctgaaaccatgagaatataattgctgtgggaaaggttttatgcatagctcccttattcagcatcacagaagttgtactagagattacctgagaacatagggctgggaagccttcgggtgtcccagaactcactggcaaggatccctctctgaacacagcattctgggaaccccttcagtaggagtcctcattgttttcagcatcagaggactcatatgggcaaacatcctgtgaatgaaatctgtgcagacaaatgaccagccttaactctcaccttatgtgacagaacgaaaaaaatatacactgaaaagaaccccgttgaataataaaaatgaaatgtctcatcctatttttatatcatgtcgtanagaangcaaaccctacntaaaacactgataagtatataaatgtagncttggctcttctaatttgcttattatctgacctgacatctanaacaaatatttaaatatggatgagaccaggggtcttttacttctggntgnccccttttgctacccatgactgantactaggaactcantccnaacgntgnngaatnatgtctgaaaantgcggaananaattgtntna

SEQ ID NO: 22094 - DNA, 783 bp, Homo sapiens
  misc_feature 1, 505, 601, 666, 672, 673, 681, 685, 687, 717, 719, 726,757, 764, 766, 773: n = A,T,C or G
nggatctgtttcaattttcctttgtcatttatacttgcatttgcctccttttaccctaaccaatttttttctctcatgtgcatatatgtattccctctttcccaacactgtcataattacttcaaataattattcaatcctatcactttcatttttagattttcctttttggggggaggaggattattttctttttaaaaatgttaacaaaatatttcaaacttgcagaatataaccaatatccatgatcctatctctcagaattaattttttaaagaaataaaaacatatatttggagtctcctttgtacttctttccaatcccattcttttccatccaccccaaatccatctactctcctgaaggtggtgcatattattctttttaccatttgtactcttatttatgtgtgctacaaacaatacatttttgtgggttttaacatttgcataaatttgaatatatcctgcatatgattcttcaacttggtttttcctttattgngttttggaaatgtgtctatattgataaatttatatttagctcattgatttaaactacacatggcattacatcacatgattatatcagtatcctttncccaccgatggatgttaatacattactcattttttaccattatgaaaaatttctgtgggcgtggnggctcnncctgtatnccancnctttggagtccaggcggcagatacttgagncnggagtcncctgacacatgggaacccctctttctaagtntaagtancnggggggnggccagcctt

SEQ ID NO: 22095 - DNA, 779 bp, Homo sapiens
  misc_feature 624, 643, 665, 685, 690, 701, 706, 718, 722, 731, 738, 764: n = A,T,C or G
ggggaaagtaacattgtgcggtgaggtagagtgggacatgatgcatccttattcttacctttggagaaaagttgagggagaccaaaaatgactttttgagggaattgtagaagtttcattagaagaaaagtaagtttttaattaaaaagttaatctgaggaacaggtagaataaaagtgtagttgttagtggtagaagagaatggattccatagggcaaaataagaactcaagggaaggttggtggaagaggaagaggattgaattgtttcaagaaagaatagcagttgtcatccttatgaaaagtaaaatttttattttcaaatcaggaaatgtaaaatgtgccttccagaccccttggtggtatacatgggagattggttctaggacacacacagtcccatcccccaccctctgaccccatacaccccctggatactcaaatccactgatgctcaagttccttgcataaaatggtatagtgtttgcatgtgacctatacacaacctcttatgtgtactttaaatcatctctagattacttatattacccagtacaatataaatgttatgtaaatggttggtatagtgtattgtttagggaatatgacaagaacactttcttncatttgcagtcaccattgnttaccccaatatttttgtccanggtggtgaatcggacccaanatcanaggctgacttncttanaataaataactngggnggggggggngctttgnccactctcggaggtgccagaaaagcngaacccgaggggact

SEQ ID NO: 22096 - DNA, 781 bp, Homo sapiens
  misc_feature 9, 528, 673, 675, 680, 720, 725, 731, 737, 753, 766, 769,775: n = A,T,C or G
ggggagaangtggtaccacaataacaaaaataaggaagataatcctggattgagttgctaactgctccctggccttctgtaaccaggctgaatttagaaagataataatgactcatactccttttttagatatgtaaaatttgagcagctggcaggagagctaagtgtatgtcagacgttgggaaatgagaacggaagctcagagggataagtggagttgccactgtggtttacttagactagctcatatttaatcctggctgattctttcctttactttaaactcctgttctaatctttgatgtacaaatccatatattgactttataaaaggttcaaatatataggagaaacaaaagataatctgcaaataggttggtggtctccagattgtttaaaaatcaccagaaatgattccacaatctctaccattttaaaaacataaaacttttctaaagacttgtcacacctaatgtatgagaacaaaagcatgtgcaatgtttagagacttcattataaaaagcttangttgggccaggcacagtggctcacgcctgtaatcccagcactttgggaggccgaggcgggcagagcctttgagtcaggagttcaagaccagctgggccacatggcgaaacaccgtctctctaaaatgccaaaattactggccggngngggcncctgtatcccacttcttcaggctgaggcagaaaatgctcnacccnggtcanaggtgngccagatctgccctgnctccaccaggcanaanggactntgttca

SEQ ID NO: 22097 - DNA, 682 bp, Homo sapiens
  misc_feature 13, 23, 24, 28, 36, 50, 51, 599, 603, 605, 610, 613, 617,618, 624, 630, 633, 640, 655, 658, 663, 665, 669, 672, 675: n = A,T,C or G
atatctttgaccnaacaaacccnncttntcttgttncttttggaccgcanngggggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattatttttttatttttgagacagagtctctctctgtcacccaggctggagtgcagtggtgcgatctcagctcactgcaacctccgcctcccgggttcaagcaattctcctgcctcagcctcctgagtagctgagactacgggcgcccgccaccatgcctggctatttttttgtatttttagtagagatggggtttcacccgagatggtctcaatctcctgacctgatgatccgcctgccttggcctcccaaagtgctgggattacaggcgtgagccaccgcgcctggcctattttttttttttttttaaatnatananggggnctntgcnnccaggntggagngcnggggcancccccaactcctganctnaggcngncctnccncanagcctac

SEQ ID NO: 22098 - DNA, 813 bp, Homo sapiens
  misc_feature 7, 10, 12, 32, 46, 52, 65, 84, 739, 784, 794, 795, 804, 807: n = A,T,C or G
cacttgnccnanaaaacccccttttcttgttncttttggaccgcangacagnaaggcactgaagnacgctgggttatcctcagnaaggcgaagttgctgcagcatcttcctcaatataaactggccaaattaggcagtctaagtctcaaggccagatagggtttcattcaccctttcttagataagtagatttcggtcctgctacctttctttaaaggagagagtacatggaagctcaaagtggaaaacatgaatctgtctagcctacctgtctccttccccacaaggcgcaccccccatccccacctgtgtgtgtagaattactcctttgcactacttgaggtgtacagtataaaagtcactgctctcccttatggattccccaaactgaaaatgctttcacgtattgccctgtgcccgagtgctacggagcattcagagagaatattctatagtgctagtgaccacagtcttaaggaagatgggcaaacacaagaagtgcatggcatgttcgggtctcacaggaagtctttggaagcattcacttctcactgtcctgtcattcttggcttggtccccaagtagaccccttggtgcaggattagatgtcctcatactgcagcccttaaccttagctgaagttggcttaatgaggaacacatgctttgtgcttatttgactggttaccatcactggggccctctgccagcatctgtcgtctgagttatcctggccaaanccgtggaaaggggctgttggcatttccttctgggtcatctgtaanccctgttcannatttgcctnagnccaggg

SEQ ID NO: 22099 - DNA, 750 bp, Homo sapiens
  misc_feature 2, 12, 15, 18, 22, 27, 35, 48, 52, 173, 722, 730: n = A,T,C or G
tnttttggaccnaanaancccnccttntcttgttncttttggccgcangggnacatatgcctttccttaggtgatggtaaatactaataaaatatactttatcaagtggaattattttgggttcatggaagtcaaacagtttttgaataaggactttatctggcaactcaggnaaaaccatttttattgcttcatcgttttttaaaaaaccagtctttacatcacgattattcgaagctgtgacactcccctatgatgaagcacttaaacattttaagggtattcattcacaatatcgagatatcaatttgcactttttggaaggcaaaagttaaacgaagtgcaatcttggaataatttacaatgaatagcaaaagtattgtgaatggactgaaacattcaacaaatatctatttagtactgactatgtatgaggcactgttctatttgtaggggatagtgcaggaaacagggggacaaaaatcaggctctcttacaacttacattgccctagtcatgctgaatattctccacctgctcctctggctccacttctcatacttcagtgagctttgagctctggccactgactcttcagtactgcttcactttctatactctgacttggtattgctttgaccacaaacacaaagagcagatcagaggttggaggagagatcaatctgagtgtgattctcaggatccttcctgctgaggcgtancttgcggngcctgattctgtacttaagc

SEQ ID NO: 22100 - DNA, 500 bp, Homo sapiens
  misc_feature 197, 202, 208, 209, 212, 217, 233, 236, 242, 245, 252, 256,257, 262, 278, 279, 282, 283, 306, 326, 327, 329, 335, 339,346, 347, 359, 372, 376, 378, 380, 383, 393, 413, 430, 443,447, 450, 453, 458, 479, 485, 491, 496: n = A,T,C or G
aggggacagtagggaccagctaaagttgctttggaggaggtgggcagggcttttgtttgtgaggtctagaaaccagtaggtgaggaaggaggtgtccctggaactccccctggctgcagggctcacagcacacaccatgacaccacaggggtgtgtgtgtgtgtgtgtgtgtgtgtgtgtgtgtgtgtgtgtgtgtngaggngagtgnnttngaganccatctatgccaaganatncttggnganagcgtanatanncacanatgttctctgtcaagnntgnnttcacccacaccctttttttctnctaccttgtataactggggnnanggtgcnctgngttgtgnntgctggagagcncagcttctgcacncttntntncgngcctaacacncattctttatcagtctcatngccctggcacatgtggncagtctgcttgcnatcnttncangcaantttcctctcatgtgatgtagnctcttntgtgcntgacnaagg

SEQ ID NO: 22101 - DNA, 780 bp, Homo sapiens
  misc_feature 4, 642, 704, 705, 730, 735, 742, 761, 765, 770, 773, 779: n = A,T,C or G
gggnatagtgagggaaataagtgcttggagaggttaaataacaaacaaattggtccaaagcaacactgctggcaagcatcactctgggattaaaactaggcctatttcattccagagcaattttcttccctataaaatcatgattctcagacttagctgcatattaggatcacgtggttttttaaaaaaaatcctgatgcccagggcactctccgtaagaaatcggaatgtctgagggtggacccaggcatcagtgtttgaaaaataatctccctcgatgattccagtggggaggcaagtttgagaaccagtactataaactaagctgcctgaatggggctgtttgagagaaactctcaaacgtgtttacacaggttgggaccgaccaagctttctttaatcttttcagaggaatgggtatttttaaagtagcaatagataaatctaactaatcttccaggtgtgaaacttaaggctatatgaaagaaatagtttgggacaaagaatcccttcctaatttccctgcagtcccatcataggcatgaccatcgcatctctttatggctgaagcttagcctgactgctggacccagacttttgcccagtgacctctggggtagggtactatcctctttgtcctgncagtacccctagaatttgcttaattgctgcatctaggacttaggatttttccaatgctggtnnaagtcctgggtaaatctctccaccnttttntgtgttntgaagacggagatcatttnattntttcnttnaaatang

SEQ ID NO: 22102 - DNA, 802 bp, Homo sapiens
  misc_feature 3, 15, 32, 45, 61, 63, 64, 71, 77, 94, 722, 793, 798, 799: n = A,T,C or G
ttnttttgacctacnaaccaccttgcttgttncttttggccgcancggcctaggctgcganannagacagnaagggnattctggccttggcggnagttggggatggtgtcgcctagcagccgctgccgctttggcttgctcgggaccatttggctggacccagattccgcgtggaaccgcgatagggatctgtcagggcccgcggccgggtccagcttggtggttgcggtagtgagaggcctccgctggttgccaggcttggtctaggtgggtggatccttgtaagcaggattagcgagtcactccacgctcaggttctttagcctgagggcccgtgtgccacagcatagctaccccgcccttccagtctcgggtccctaatactgccttgcttcggttccagtttccgccgcacaacttcactcattccaaatgttaatttctgcgttttttttcagccccaattctgtttctccaaatcagggatgattgtcggccttccacagaccctcgcgcttgccaggattagggtgttcgcgcgcattgtgggtaggggtgtggaggaagggatccagaaatcttaagtattaacttagattagtgttagcaaggaagccgtcacattttatttagccgggacactcttgacagtttgtgccgactgctattttttgatcaaggctattttgcccacttgtctattttgtggcccaattgtctgntttgctaacatcggaaagtataatgaaataatctgcaaaaaaaaaaaaaaaaaaaaacccttgggcccttnttaannaaa

SEQ ID NO: 22103 - DNA, 756 bp, Homo sapiens
  misc_feature 2, 9, 593, 605, 611, 619, 636, 642, 649, 669, 683, 686, 697,708, 713, 722, 726, 731: n = A,T,C or G
gncgacagnagggaactttttttgcatgtttttaggtagacttttgcaggagttattttttcatttgttcctaaaagtgaaaatacaggtataagcaagcctttgtagaaaattattggctcttagaatatgtgactattttagaaaatgattaagtgccaaagtaagaccctattgtaaggagaggcttggatcaataagttaatataaactatatcctgaatcaaaaataagtgaaatgaatagagggtactgctttgaaagatttagtatctccatagtatttatgattactgtatgtttagtaggcaacatttatgaaagtatgatttatttatactttggcttgttcatgaatctgaaaggatcctagggaagcctgagatatttttcctcacaggctttgcatatgtaaatatccgccagtcagagtgggtttgaggccttgaccttgtttttctgaagctctctgataagaagagctgcctgctctccatgacaaggtctggccctgctgctgcaccatcaccttgggaagggggattaaagccccagtctggaatgacatgacttggcttctgtcccagctcttnctgcttatatangatgancctgcgcngactccgaaccttttgngccttnggggctncccatgaaataagcgatagnggtatctattcccncgngcctctgggtnttcaaatcttntaaanatgcgagcnttgnaagcnttgggaattttgctgttaaggactg

SEQ ID NO: 22104 - DNA, 448 bp, Homo sapiens
  misc_feature 193, 208, 276, 278, 357, 369, 390, 395, 401, 406, 422, 428: n = A,T,C or G
ggggaccttgcagaatggttttgacactggcataaggttcccctgatagtggctgtaaaaatctagctcttctgagaactatgggcatcctgaaaagtagcaatatttaagaacagggagttggcctgtctgcactggaaaaggcatttatgtcttggtagaacccatgtttgggcaagtaaccgggacttgngcggcatgagctccnggctgtgaaccagagtcataccctggcaacagtcataacactgaagaagacctggggccttgcagcanancttgtggctgcggtggccattttagatgatgtcattcactccctgccatgccctgctttccaccccccccattgggggntgcttttttttntttactaaaatcaaccaacangcttntaatancctcnggatcttcaaaaatanacttcncttgaaaaaaaaaaaaaaaa

SEQ ID NO: 22105 - DNA, 563 bp, Homo sapiens
  misc_feature 16, 22, 26, 33, 46, 47: n = A,T,C or G
atatctttgacctacnaacccncttncttgttncttttggccgcanngggcacacagtgcttcctaagcaattgaaaagtgtgaacagtattaaaaggcaaacctttagtctgctaaaaccaatccttttcaaatattatgtctatgtagcatcagccatttaaataattgagactaataaacacttattagtcttttcaggtttgtagtggtctctcagagagttcttcacgataagagtgctattcatacatacttgagagtaattaaacgatccctctggctgggcacagtggctcacacctctaatcccagcactttgggaggctgaggcgggcggatcacctgaggtcaggagtttgagaccagcctggccaacatggtgaaaccctgtctctactaaaaatacaaaaatttgctggtcgtggtggcgggtgcctgtaatcccagctactcaggaggctgaggcaggagaattgtctgaacccggaaggcggaggttgcagtgagcccagatcgcaccactgcactccagcctggccaacagagcaagactctgtctc

SEQ ID NO: 22106 - DNA, 604 bp, Homo sapiens
  misc_feature 427, 467, 497, 523, 552, 557, 563, 572, 598: n = A,T,C or G
cctgatgttatactactatgtgcaacatctctgacatagaccttgtttgtatctgttggtgtggacttccaactttatctagtaaaagtagtcattaaaactaagtgtagttgcatttacttcctgcaaagtttttttttcagactctttgatagaattaaccctttctctcttttttaatacttctgggttctcatatgtgatgttctaatacttcctccaattgatttctactctttctctggacacttttttttgtttttgtgaaatatatcttagtcatatttatctcacatttgtgaaacttcaaaaaaaagctttcattagacagttgaaactatggattattttcatcatttattctagcaactgatgcatttcaaaatggtttgaataggactttataaaactaaaatttattacttcncaaaacttattctggaaaaataataccagtgaaatgaccnagggaagatgattattattatttttgagangagtctcactctgttgccaggctggnctcaactcctaactcaagtgatccccagngggcncctcgnctcctaagngctggatacaggcggagccccggccncccttt

SEQ ID NO: 22107 - DNA, 822 bp, Homo sapiens
  misc_feature 3, 15, 33, 47, 53, 57, 65, 222, 464, 478, 559, 580, 584,599, 608, 639, 696, 727, 731, 745, 772, 785, 796, 805, 807,808, 809, 816: n = A,T,C or G
ttnttttgacctacnaacccccttgtcttgttncttttggaccgcangggagnaagnattacatntggggagaagccacttcccctctctggatctctgtttcactacctatgaggagattaaactagactgtctataagagtccttctctgagttgttctctgatcttggattctaaaggctggcacttgtatgaaaccagctgtcctgctttctggaaanagtccagcgccattgttaagcaggaaaatttctcctgtgtggttctgccaaaacaaaagctcagactattattcagatctggctgggcaagagagatttgtcaactacatgtttattgaatgatgaaacagctgcacacattcctgcacagaaaacacacattgtctaggtgacaaagagtaatgtggacacatcagggccatcttctgacctttgctagtttttttgttagtttgttttgnttttgtttctttgnattttttggttgtttttgggtctgtttttgagacagggtctcattctgtcctccaggctggagtgcagcagcatgatcacngctcactgtagccttgacctnccangctcaagcgatcctnccacctcanactcccaagtagctgggactacagtcatgcnccaccatgcccactaaatttttttaaatttttgcaaaacagggcctccttatgttgnccaggctagtcttgactcctggctcagcganctcnccttggctcccaantttgggatttaggctgactctggcccnctaaaatttattntctttaacttngggggaccngnnnctaaaancccaac

SEQ ID NO: 22108 - DNA, 767 bp, Homo sapiens
  misc_feature 320, 326, 341, 394, 461, 467, 481, 497, 519, 529, 533, 542,561, 573, 590, 598, 610, 613, 614, 625, 626, 634, 643, 658,685, 695, 702, 704, 712, 722, 724, 741, 751, 759, 760, 764: n = A,T,C or G
agggaacatgcccaagttacacagctgataattggttaggctcaggatttgaaaccagccaaactgagtagtaattatgtgtttacctgttatgctcttatttccgaggaatagatgacagttctcactagagatagccaaatttgtgtgtttgtgtatgtgtgtgtatgtgtgtgtatgtgtgtgtgtgtctgtttcttttttttttcccctttgtttttgaaacagggtcttgctctgtggcatgggctggagtgcagtggcactgtcacagctcactacatccttgaccttctgggttcaagtgatcctcctacctntacctnagcctcccaagcagntgggactgcaggtgcatgccaccatgcctggctaattctttaattttctgtanaaacagggtctcattatgttgcccaggctgatctgtaactcctgacctcatgtgatcctcccatctnagcctnccaaactgttggtnttataggcctgaaccnctgggccaggtctgtgtgtttntttaccaganatanatcctaaanaataaaaacttgtttgttnggagtactgggnattttaacaaaaaattntaactggntccaactgccantannccaaatcttanngaactttnaaagggggntccaggactttaccncactttgaatttggattttaggggtcnttaaatcccntttttanancctttaangtttcccccncnagtgggggccttttttncttttttggnacatttanntttnttt

SEQ ID NO: 22109 - DNA, 708 bp, Homo sapiens
  misc_feature 173, 587, 617, 679, 686, 689, 693, 697: n = A,T,C or G
ggggaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcanaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacgagactgggatggagaattatatgaaaatggctcattttattttgctaaaagacatttgatagagatgggttacttgcagggtggaaaaatggcatactacgaaatgcgagctgaacatagtgtggatatagatgtggatattgattggnctattgcagagcaaagagtattaagatatngctattttggcaaaagaagcttaaggaataaacttttgggttgcatattgatggatgtctcnccatggnccntttntgtntcaggagaccg

SEQ ID NO: 22110 - DNA, 644 bp, Homo sapiens
  misc_feature 1, 4, 17, 175, 513, 525, 531, 610, 631, 639, 640: n = A,T,C or G
nggnatggtgtgaaggncttaactccctacattttagttctcacatctgaaaaaatattgagcatgcatatgccatagaattattgtaatgattaaattacacatgtaaattgtataatacacatagtgtctggcacaggatcattcacaataaaatttttattcaatgagtacnattatcgctttctgtaacattctctagtagccctttctaagctctgcttcactttacatcattacttttgtctagtccttgacattccacctgttccggctttgacttgcttccccagatagtgtacatctgtgtctgcttcaaagcctcattctgttatgttctttaagagttatacctagaattgggccaggcacggtggctcacacctgtaatcccagcactttgagaggccgaggtgggcggatcacctgtagtcaggagttcgagaccagcctgtccaacatggtgaaaccccgtctctgctaaaaataccaaaattggccgggtgtggtggngggtgcctgtantcccanctgctcaggaggctgaggcaggagaatcgcttgaacccgggagatggaggttgccgtgagccaagatcacaccattgcnctccagcctggggacaagagngagacttnntctc

SEQ ID NO: 22111 - DNA, 704 bp, Homo sapiens
  misc_feature 536, 561, 599, 633, 663, 665, 676: n = A,T,C or G
aaggattatttagaagttatattactaaatgatttccaaaggctatcattatttagataattttacatcattttctactgcatgaaataactattttacaaatttctcagacagctctaataacatatgatatagccaaatccatggcacttctgcagaattatacttctccacatgttgattctttttttatttttttaccatttaaaaatagaagattgcctttgaagttttccttaaatgggctttgaaatttgtgttggctaaaattcactaataatattaccttggtatatgataaacataaattttgcaggtttcatccacataacttatgagtaaattattttgtttttaagatgggatcttcctctgtcacccaggccggagtacagtggctcaataatagatgatagctcactgcaggcttgaactcctgggctcagcaatcctgctgcctcggttcctgagtagctgggactataggcatgtgccaccatgcctagctaattttttaatttttatttttattgtanaaatgggttttgatatgttgcaaangctgattttgaactcatggcttcaagtgatcctcttgnctcagcttcccaaggtctaggatataagcattanctgctgatctagcttgattgaaattttaananaagggctatanatctgagcttaaaagaaattaaggtatt

SEQ ID NO: 22112 - DNA, 754 bp, Homo sapiens
  misc_feature 1: n = A,T,C or G
nggggactaaaacatgtctatagagctgatgtgacaaacagaagccaaaattcatggacgcaaggaacagtagtgaacaggaaatgcaacacttgtctatgatcagtaactatagttacagtataatcattttcaactcagatttatataaaatggggagatggtaaaactttttctgtcatagttgacgtgtatttttctgataaggattatggtcatagatggctatcggtatgatccatttgcttttataaaaaagttgagattcatatcattgctttgttttcattcagcattactatatagtggcatatgtgtgttagtccttccaaatccttcaaatgaatgtgctactttcagtgctgccagcaagttttataaattttatttaaatttctgattggatgtgaatggtagctcctgaatgacacacatttcaataggtaagactaaaggtttggggttaacaagataacatttatattatatagatgataaacaatttctcttttagatattttacaatataaaaatgttgcagaaaaaatttaaatgcagaaaagcataatgaagaagataaaaatctcctacattcccactacttagaaataactactaatcacatagtagtatatattcttctatacttttttctgggaatacaccacaccacagagagtgtgctgtttcaaatgagtatggaatatttaaaaacaatagacttgcatatgtaaaattaggtttaattctactg

SEQ ID NO: 22113 - DNA, 806 bp, Homo sapiens
  misc_feature 10, 15, 20, 27, 40, 58, 61, 69, 74, 623, 730, 732, 735, 757,763, 767, 796, 800, 805: n = A,T,C or G
ttgacctacnatccnccttncttgttncttttggccgcancggcctcacggctgcganagnacgacagnagggnagcttgaaatacctatgaaccccaaccttaagaagtagatatcagtagatttattcagatactagatttaattcctctatgaagtttaacattttgatatttcaaaatttactgacacttattttatggcacaacataaaggctaaagaggaagttgagatttttacacctgctgtgcagtaatgagtgacctctttctccactgtgttaggagagagtacatgagatcttggacttccattcccacatggaggtaatgagacattcctccgtcttctagctggagtggtgtgagaggaggcttaatgcagcatcaggaatttcaacagtgtccaatagtaacaaagccagacaccctcagtgtcaatataggacacatgggagatggtaaaaaggcattcctctccctcccagccaggtgagtatagtagaggcttagtagacaactgtaactcctacacatttgaggagaaatagggaatttgtactgcttgggtattaatggatgttgactatgggttgtggtcttctaccctacatagcaataangatgcagtaccccacttttttctgatggagtagtgacagagaagtcaaggtaaacctaggttttaataagattgagaaaattatagcctactatgaaaacaagattncntcnaaatacccctctaccagagcanaaagtntgtncttaaagagatgatatagagccctaccanagangggang

SEQ ID NO: 22114 - DNA, 761 bp, Homo sapiens
  misc_feature 1, 4, 29, 568, 572, 664, 676, 678, 709, 730, 740, 743, 756,759: n = A,T,C or G
nggnatattcaaacttactgtgtcacagnataaggaaaatagggcctagagatgaagaatgacttgctaaagccacacagcaggtaagtccagttttctctacatagaaccactttgtccctccctcacacacttccattattggtaacattgctcctaaactatttgtcagcttctgtggcaaagaaataattatctccatccccataggcttttcagttaagaatctatgttcccttggcattgcttacaatgctggtgtcaccactgctgaatcaggatgtccacagatcagctttttatctggcacttctaaagagctcctgctgacttcaatagaatatggatagagctggcctcctataggaactttcaggctctcaaatggatttgggatgtgtcctgggagaaagagaatgaggaaagactttcagaatttgtgtggaagcatgtgttttataaaaacaaaacatgacaaaatgagttataagagagaattgattgggtttatggatgaagttcctgataatgattacttttgacactatattggactatcacataaagntggntctttatgtctaatctatttccacttgctacatttagtaaaaacctaaataagtttagtacattctaggaatataaataagtcatgcaatgngtagccttctananaaaattctgcttctaatttgctcagctgagngaagggacccttttaaatggntaaaacatgntgnttgactcttattnttngg

SEQ ID NO: 22115 - DNA, 715 bp, Homo sapiens
  misc_feature 173, 557, 574, 586, 604, 647, 653, 656, 657, 658, 659, 664,670, 678, 691, 698, 700, 706: n = A,T,C or G
gggagccagttgctgaggaagcacaggtaaaacaacgtagggcttcccattgttattggtgtgggaggcctgtctggcgggactcggccctttggaatctaatgctatgtcccggtagatagcgtcaccattgaattagaagacacacatatgtggagaataatctttctggncatttactgcatgtcatatttacaatatgtaatcaaattctttatcctgaccttatggcacctgggtttaggaccatgatttgaaccaaacgttggtctgtcactttctgagtttgaaactttattttgcctttagcgttttgctattgctttttcgttttcttttgtttcgtttcgtttctaagttctggggtatatgtgcaggatgtgcagatttgttactaaggtaaacgtgtgccatggtggtttgctgcacctgtcaacccgtcacctaggtattaagcccagcgtgcagtagctgtttttcttaacgctctgcctcccgaaaggccccagtgtgtgttgttccccttcctgtgtccatgggatctcacttttcagctnccattataagtgagaangtggcgtttggntttctttccctggattantttgctgacataatgacccccatcaccactgttttttttttanttaaanagnnnnttttnttgaanaaaattgntcccaaaaaatancctaatntncatgangccaaccct

SEQ ID NO: 22116 - DNA, 759 bp, Homo sapiens
  misc_feature 4, 16, 520, 623, 640, 648, 690, 696, 721, 728, 731, 739, 758: n = A,T,C or G
gggnaaaatatgaatngctaggccccacccctaaaatttctgattctgtggttcggggttgggctgaataatttgcatttctaacaagtactcagatgatgctaatgatgctggtcagggaaccaactttgaggactagtttgttagtggatttaacgcctacacattagtatcacctgaggagtcccccatccctacttctttttcacaactggcccttgtccagttaagtaaacgtgtttggaagtcctgctcaaacatggtgttaggattttatggtccttttcaacagatgcagctccataacaagtgtagactttttattttttactccaaatcttcataacacttgtgtgatgaatataaacagcaggattggccagctgtgtggtttggtggttttagttcacataaatctgtattccgtcaatagctcactttttggtcttggccagttcccataagtgcctgctgtagatggcttgttaattgtaaggagtaaatagtaactacacagtanagtaattggctgtcactttgggtgatcaaaattaacatcaccaatgaagggaagatggacatcatgtcttttcagacatctggaaggataacatcacttatcngtagtttgacacattgnttaaacancagttcggtatacttgattggaatctgatctaagggaccacngatccnaatgagaagcttcattttaaaaagnccttttnttntaatacanggcctgaaaataagttgcna

SEQ ID NO: 22117 - DNA, 714 bp, Homo sapiens
  misc_feature 510, 518, 521, 571, 575, 600, 630, 636, 637, 644, 661, 663,696, 699, 703, 705, 706, 707, 710, 713: n = A,T,C or G
ggggggaatcagactgtattaaaaaaacaaataaactcatagacctgaaaaaataaaactgaagttaagaactcattatatgagcctaacagattaaacacaagtgaagtgagacttactgaatgtaaaaatgtcagttggaaatatacagatagaataataaaaagaagaatagaaaatgtagaaaagggtctaagagatatatgggacaacataaaaatgtctaaactgcaatctcataagagtgaagagggataatatagcagaagcaatgtttgaaaagattgtggctgaacagcttatacaatcgttgaaggacattagctacagcttcaaaaagtgttacaaacaccaagcaaaacaaacaaacaaaaatccttccaaaaaaccataaagaaactcatatttaaattcatcacagtaattcctgatgaatgaaagaaaatatgaagggcaccaaaggaaaaaagattgttagcattacgaaagatcctaaagtacagctacttntagaattntanaaccaggagccattgatgccttttcaaatctgaagataaaactccacctnactnttcccagaaatttctcaaatttgcntataaacttttagaatcactgagggatttngcacgnntttgtcntaatctaagagatttgntnaaacatgtccaaaaaaaaaaaaaaaacccgggnttntctncnnnaantang

SEQ ID NO: 22118 - DNA, 508 bp, Homo sapiens
  misc_feature 358, 375, 392, 416, 421, 451, 456, 458, 467, 475, 483, 486,492, 493, 495, 499, 500, 505: n = A,T,C or G
ggggtgacaggacatgtcctcactgaaggcttgtccctgaaggcagagcagagggagaattctaagatcccattaagactttgagcctggagcactgggggagttaggagtcagcagaaagaggtggttaggggaaatgatgaaaatttatcttaattgtgctgaaattggggtgcctgggggtcatccattaggaaatgagatgtagatacttaggagaaggtaaaactgggatggagattgaagagagtcactgctgagtcaagaggagagaactgggagattagaggttaggaaagtgttagcttttcaaggagtagtctgtagatggtggagacattgccccagagaacaccangatgacatggcctgcangagtcgtgggacttgtnttaggaggccaaccttgccgacancatanaggaaaaaaaaaaaaaaaaaccttgggctnttttntnatcccactnaaaatttntttttgcnccncttttnntncccnnctctnttt

SEQ ID NO: 22119 - DNA, 756 bp, Homo sapiens
  misc_feature 674, 677, 681, 748, 750: n = A,T,C or G
gctaactgtatttggcagtcatctgtccagagacagcagttgactaaagaaaagcaaaggcagactcttgggaaattctggcatttaggagacacaaagagtaactgaaaacagagaggcaaccactggaaaaaccaggagagaaccaggatatacagtgctcagaagcatggaaggaacaaggaacaggcaggctggagaaggtctttgaattcaatggttgttggtaccttacaaaaataatagccaggggtggtggtaggcacctctagtctcagctacttgggaagctgaggcaaggggatcacttgagcttaggagttcaaggcagtatcactctacaattgcacctgtgtgaatagccactgcactcctgcctgggcaacatagcaaaatccctatctgtaaaaaaataataataatgtcatagagtatgaagccaaagggttatagagtatgagtcgacagtgaggaagtagagttagtgaatgtaaactatgcttttgagaaatttaacagttaaccttaaggaaacaatgaaaaactccctttgtatgcctggcatcatggcagatagaggaagagtgttagaggagaaactgctgctgagatattggcaggcttgcctcagtttgactctgtattttctttgacccagtctgtacctctgcgtnctntctntttacttcttaaataagatactgttgtgaggataaggatgtagtaaggatctgaaaataagtaagcngnttaaaa

SEQ ID NO: 22120 - DNA, 379 bp, Homo sapiens
  misc_feature 11, 18, 45, 52, 56, 85, 89, 94, 108, 109, 116, 128, 143,161, 162, 193, 274, 275, 276, 333, 336, 342, 344, 350, 351,357, 358, 361, 363, 364, 372, 374, 376: n = A,T,C or G
ggggggagcanggtgtgngagcggtgatgggtgccctgcttccangatatanatgncatcactgcagtcctcttcactatggcancttntatanaatatttctctgcnnacagtangaaacctaaatngggattttcacttantttttattaatccaagcnnaaccaagtttgctttatagagaaatcaacanctgttagacaccctctcccattgcctgcccagactcttcctcgtccaggtgctgatttgtctaccaccaaaaaaaattgtnnnggatggtgtaaatgtcaatttctgggtttcatactatcctataattcggcaggatgnctncattgnangaaatnnggtgannggncnnggaccctntntntct

SEQ ID NO: 22121 - DNA, 711 bp, Homo sapiens
  misc_feature 10, 692: n = A,T,C or G
agacgacagnaagggattttccaggcattgttttagaagctaggcatataacaggaaaaaagacaaaaatctctgtcttcagggataatgcattctaaatagaaaagatcgataataaataaataaggaaaacctctggtatatcaaataataacacgatctgtgaatttaaaaagggcagagaaggtaggtacaataagtggtaagcaggaggtcgtgatgttaaatgggtgggtgtcagaaagggcgttactgcggacatactgtgtgagcaaggacttcatgtggaatggcaccaagacgttatctagcagaataacattccaggaagagggaccagaaatctctaatactggagtatgtcaggattgctcaagaaacagccctaaagctagtgaggctgccctgaaatgagaaaaggaacgataggaagaaatgaggtcagaatgccacatgatgtcagactttgtaagtaattgaaaagtttttatttaaagtgaaatggaaaacagctgaggagctgtgaccatgtgaatgatactgtttggctttggtttcaaaagataactggttggatttggcttgcattgaagccctgggtaggaagaggttggaggcagaagggaagggtggcagaagctgatgacaggaggctactgtcttcgtctaggtgagatatatggtgcttgtanaggatataaggagagtgcc

SEQ ID NO: 22122 - DNA, 715 bp, Homo sapiens
  misc_feature 88, 97, 103, 109, 118, 132, 144, 158, 177, 239, 263, 279,323, 429, 494, 583, 590, 612, 616, 626, 631, 640, 649, 662,664, 671, 693, 698: n = A,T,C or G
aggaacagctgaaaaacactttctccttgctgggaaaacttaaaccttgctaggctttatgcaacttaaaaaaaaaaaaaatcacttntgtgctganaactancatganaaatctcancatgaaaggttggnggattttttttnttcataaaactaancccaattgttggttttaanagtgatgccacaatatacatatgctttgttaggaacaaatataatctaatttcaagggcatnttcaacaaaaattagggggaaaanataaaggctacttaancagtgatccagtgtctgaaagcaaaggttgaaaacatcattgtnccatcaaggtctaaaaatgctgctaaccctgagcgggttgttactgtttgaaaagcctatgggtatttgttttattgttgtctcactcaattcttacttagctganagtatctcacaagggaagtactgctctgtgatggtgtcctggactttgttttctatttgtttcancacttcaataaatggtctgttacctgccattatggcctgtatgcatttgctgagcagtttttcaaaacaaaacaaattatgtggctgtntttctanacgctgagcccttttcaagatngttngattagaacnccctngacccgtcncccattggntgttatcctgacncntttttcnacttttcaggaaataaaaaaanaaatnggtggacatccatttgg

SEQ ID NO: 22123 - DNA, 696 bp, Homo sapiens
  misc_feature 616, 635, 666, 689, 693: n = A,T,C or G
gggcaataaatgggtgcacacaaatgtatacacactttgtttcttgttactaggaagcagccaaacagagaagatggcttttcctaagataatatattggtagtttttcataggtaactgaaaaacttggggcagctcaagtgctattaaggattgaagtaattaatgaataaatcgcagaaactatatcttcttattttgtgcttatagtaaacataaagtctgttggagaaggagaaagcttatggcatttgtacatgtccccagttatctggcagctatttgaattacatacttttttaaaagccaagttaggggaacgggtgagggagagaatcattttacattatgagtaagattcatcatttattcaataaagaactgaactatgctaagtagagagattctactcatgggtaaatggagatgaagatactatcttgctcttgtgggcattttccatgtagtggagagagaccttattacacagtcatactaatgactgtataataaataatggagacagttacttgaagtagaaagcattttataaaagtattaacaaagaaagtagattgatttccttggctgggtgcagtggctcacgcctgtaatnccacactttgggaggctgngcaggccatcacctgagtcgggagtcgagancacctgacacatgaaaaacctcntctntcc

SEQ ID NO: 22124 - DNA, 647 bp, Homo sapiens
  misc_feature 519, 553, 577, 584, 597, 598, 605, 608, 614, 618, 621, 622,627, 635, 637, 643, 644: n = A,T,C or G
gggggagttggaactgttgactctgctgtcctggcttctccaagtcctgccatcattttcttctgccccttcccagagcacctgctgtgggggctggtgggagctccaggttccacagctgagccgtggggagcagaagacagagctttcctgctaataaggatcataaatgccagccctgggctgggcaagcatcctgctgccggttcatatcactggatttagcatcctgtggcggtggtttaattggaagagataattggtgccgtgtcctggggagtatgatctgggagtcggatgataagactgacgcggctgatgtcttggagctcagactcgcagcctgggatgggaagcacccgttctcagcaaacttttggtttctgtttgtattactgacctgctctgtacttttcatcactgctagtttgttgctgttgttgttgtttttgagacagggtctccctctgtcgcccaggctggagtgcaatggcacgatctcagcctcactgcaacctncatctcccgggttcaagcgatattcctgcctcanccacctgagtagctgggattacangcgtggnggcatgcacctgnnatctcanctncttganagtntgnncctgnaatacttnancccggnnggc

SEQ ID NO: 22125 - DNA, 723 bp, Homo sapiens
  misc_feature 448, 490, 508, 551, 588, 609, 626, 631, 640, 643, 645, 646,649, 660, 662, 666, 667, 700, 701, 703, 710, 721: n = A,T,C or G
gggcatgcttcagcttgtcttaacagctatttatagctcgggtgcctccttatttggtagctgactgcactgcagtctgtggcctctctccacagggatgcctgccttcctgacaagcagcccaggctcctgatgcagttctgtctcctacaggctttacgcagaacaggctcacatctgtgtgagctctgtgtgagccttacctattccaaatgccctttaaagccatttacatagccgttacatgtttaattgtgttaaaatacacataacataatcccagcactttgggaggtcaaggcggccagaggatcatttgaggggccaggagcttgacaccagccttggcaacatagcaagacccccatctatacttaaaaaaaaagaagataatggggttgagggtgccctctgtgactggccaggggtttggaggtgatcactctancctatttactctcaccaatccaagacacctgctaacccccanaatctttaaaggaccagnctttccaccctgtgatgcatttgggggcacaatgggtacccgnctctcctctcccacccgttatgggctgaactgggtcntcccaaaattatatgccgaanctcaacttcacacctanaatgnaccatattnganannggnctggaggaggnantaannaaatgaggcctatggggggcttaccactgacanngncctaaanaaaaaatgggnca

SEQ ID NO: 22126 - DNA, 794 bp, Homo sapiens
  misc_feature 550, 564, 583, 596, 597, 598, 638, 640, 642, 643, 662, 694,700, 751, 786, 787, 788, 789, 793: n = A,T,C or G
aagactcttcaccaggggaggatccggtggaatgggttatcctcgtttaggtggagaaggtggaaaaggtggtgatgtctgggttgtagcccataacaaaatgactttaaaacaacttaaagacaggtatcctcggaaacggtttgtggctggagtaggagcaaacagcaaaattagtgcactgaaaggctccaaaggaaaagactgggaaatccctgtgcctgtgggtatttcagtaactgatgaaaatggtaaaattataggagaactcagtaaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaagcctgcaattgcagattacgcattacaacattaaagcctgaacttggaagatatgtcagtgatttcaacagatatcagtagctgatcttcnggttatagaagacncattgaacaaggatggccncaattctcagctnnnaagactaacactcttttgtgtgatattctggattagcttntntnnctcatcagacactttgacntatctgttcaaaattgattgccaaagactcanaaactnctttgcgtataatgctgcaagccaaagtctgatgtaccctcaattaatttnttttaaaaaaaaaacctgccttctacctaatgtgnnnncccnc

SEQ ID NO: 22127 - DNA, 232 bp, Homo sapiens
  misc_feature 1, 9, 163, 165, 174, 176, 182, 188, 192, 193, 197, 204, 208,211, 213, 216, 217, 220, 222, 224: n = A,T,C or G
nacgacagnaaggggtttatgaaattaccaggatattcataaatgtgacaaatgaacagcaggattatgaattatcaaaggaaaaagtatttgctgaggtgaaaaaatctgatgtttgaggaagtttttatttttatttatttgttttgtttttttttttttngnggcaaactntntccccnggcttntccnncctnaccctcncaantancnggnnctncngncttccccc

SEQ ID NO: 22128 - DNA, 623 bp, Homo sapiens
  misc_feature 338, 349, 417, 450, 485, 487, 510, 517, 531, 537, 553, 561,565, 566, 568, 575, 578, 586, 593, 598, 610, 612: n = A,T,C or G
ggggaaacacgaggtataaaatggtagcaaaataatctttaatagtgatcttcaaaattgttggcatcaggactttctcaggtacagaggaacagtgtgacacagcagctgatgacattatttttcgttcctgttaactactcaaggaggtgacagctgtgagtgttgtacctaatagcagaagtgagctcacctcaaattataaataccaagggtaatgtagtgataacttctctcacctaaatattttgccctcttggttaataaggccttctgtttcacctgagagatcatttcttttttgaaattgctgttgtgagcccaaggaagagaaagtntcttggagcanaagagaaaaaagcagtctccccaaacatctattagccctgccctgccctgccttcaacaaactttcancatctgctgaactccgaagtgcgatttgcttantgggatctaaaccctttgctctttaagaggaacanangtagttcctaccccaagatgctnggttaangatattagcttaangctttntacctactgtggccantggaatangacnnanagagaanagnttttaatntttgatnttggnaaattgaacttncntggtccccttg

SEQ ID NO: 22129 - DNA, 776 bp, Homo sapiens
  misc_feature 652, 716, 737, 738, 740, 744, 747, 750, 756, 757, 760, 766,774, 776: n = A,T,C or G
ggggttttatgtttaaataaaatggttttgtttttgttttttaaatacagatggggtctcattatgttgcccaacctggtctcaaactcttgggctcaagagatccgtctgccttggcctccccaaatgctgggataacaggtgtgagccactgcacccaggctaaataaaatgtttagactgtaaacgtattctttcttgtgatttcttactttaactaatttttttcacccttcaactgaagcagtactcatagtgtcaaataagagagctctggagctccttatttcaatgatctctaatgggactcagtctaagaaaggaggggcatcagattttctgctgcacgaggctgttctgaagtcattattctagggtttgaagatacttacttttctggcccttacttgactcctccggccatagctccaaactgtctagccagattaccagggttggcttcagatgaacactttagtattttgatgctaaataccagtgataactataaatatttctcaacttatgatgtgtgttttgttttaataaatccactgtaagttggaatactgtaagttgacatgcatttaatatgcctaacctactgacatcagcttgctagcctaccttaacatctcagacacttacctancctatattggcaaatctctacacaagcctatttatgatcagattgaattctatgcattatgatnctcattgattttttttataannanattnctntgnctcacnnggnaaaaangaactcgntn

SEQ ID NO: 22130 - DNA, 779 bp, Homo sapiens
  misc_feature 619, 651, 653, 670, 674, 706, 748, 751, 773: n = A,T,C or G
gggggaaggatgagtatggcttataaaggagtagtgcaagaagtattgtggtgactagtacaattaagtatcttgattacggtgatagttacttgaagctctgtgttataaaatggcataggactatgcacatacatgcacagatgtgtatgtgtaaaaatggtgaaatctgaataagcagtgtgggtgtaccagtgtcagttccctggtgttgatattgtactctatgcaacttactaacattgggagaggttaggtaaagggtacacagtacttaactgtacatttctttgaagtttaaaaatacgctttttaaaacaagcacttccccttctcaccccaaaccaggacaattattagagacaaacgtctgttcatttggtgtgtccttgtatcttgccatttgattatagcagcacagcagaggataccctcaaaggagaatactccctagtctactcatgttttgggggcagtgtatttttgtttatgaattagttcctactaaagccactatcagttctagaaaacccatttctagttacgctatagctcccatggctaattaaggattcaaatgtatgcatcctcattttcctgtttatggacatactgaatntaaaccttaaagaatcacacaaagaaacattncngcctttaatttcagcanatanattttctattcagtggtggaatatataatgtncttcaataatccaccttcttttattagccactgataattctnaanagaatttgttgctgctttctgngatatc

SEQ ID NO: 22131 - DNA, 568 bp, Homo sapiens
  misc_feature 478, 479, 480, 482, 486, 494, 495, 496, 522, 534, 536, 537,544, 546, 549, 558: n = A,T,C or G
gatctcttgcttggattattagtctctcaactggtctttctgtttccatccttcacaagagtgatcttgttaaaacagattattttatgtcatctcttcacttaagattctctgtgatgagttctttaccccactcagagtaaagtctaattagtgtaatactgtaccaggttctacagggtctggcctctcattccctctcagacttcatcttctatttgctctttctactcagttatggtcacactggcctctttgctgttcttgaccacacctgcacactcctgcacctgcacttttatacttcttgttgcctctgcttggattgctcttcccctgatgtagaactgtatgtgaacttagtctaagtaaaacaaaacaaatcctaacttaccctatttaatcatgcaatcttcctctttgagtctgtaacctgtatacctttttcatgttttattttttctccaaagccaattgnnngnctgntattatgnnnctacttcctgctaggacacgttttgncttgttcttggngnnttactancnctnacacaatgnctgactcata

SEQ ID NO: 22132 - DNA, 679 bp, Homo sapiens
  misc_feature 647, 654: n = A,T,C or G
ggggtacttctttgtccacttgctctgtgactgacagatggggctcagcttgattccagagctggcacttgacccgaggtcttctctgcctggcacagtgatacatggtgtagcgtatccatgtatgttgtctctgtgtgtgtttctcatactttcctagtgggctgaagagctcactaacttcttgtttccacttggcatgagtatagatttgacacctgccagtctcatttttcttctgccagcctagagctcccagtttttgactttgagtctcttgataggaattgcattttttattccacattttttggtgtctctgggactagagtataggagttttttccagaaaaaaactgattaaatctccctactgacattcacctgagctgtatgactctgtctcggtaagacatcagattttgggggttaggatcttttgaatcctgactggaaaatattctagacttgagatctgtcagtgtctcatccaccttaatccttggtcttagtcagtctgccagtccatgtaatcataagcattcaatagatcagaaagtacttgaaagataaatgaagaacatgattgttttactctctgtatgcttgagatacattccttgcttcagtcccattaagaaaatacntattatnaagaaacaataatctctccttcctg

SEQ ID NO: 22133 - DNA, 685 bp, Homo sapiens
  misc_feature 523, 571, 580, 585, 610, 613, 629, 637, 638, 645, 650, 659,678: n = A,T,C or G
attctcccaacatcattccctccgccttgggtgtgcttccgagagggttggaggtgtcacctgccgtaccctaggactggctgagggaaaacacacctgaagatttcctgtaaatgaaaaagtgaatcactaaaagggggagctgtcatcccctggcatttctctgtgcacaggcgacctagtgttgggatggcagcagaacccagacaactgagccaacacgtggagggaagccctcactagcctgcattcaacttgtgtgagagagaagtgaacgtttacgtgcaaagccactgagcttttgttgttgttcctgcagcacagggcattctaacctgcctaatactgaaacgagtactgttaggcttgatctgtgaagaggagaacataaaaggcctgcatattctcttttaggtcctaaaaatgcagtgctctcttcttggccttgctgtgaccaggctgtttaaaatctgtcaccccgccagtcgccactgtattatcttgctttatttttcttcatagnatttattgataatttatgtgcttatatgtctccctgctggaatgaagnttcatgaangccangacttgtgccttaaacaggcctggncanagagcacttatgtgtnttttgaanngaattgnggctnaaattctgntttcaaaaagtaataaggnaaggctt

SEQ ID NO: 22134 - DNA, 900 bp, Homo sapiens
  misc_feature 665, 703, 743, 758, 768, 780, 782, 792, 794, 797, 811, 833,844, 849, 853: n = A,T,C or G
gggggggtttgtagcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggataaatcatacggtgattttagatgatccatttgatgaccctcctgatttattaatccctgatcgatcaccagaacctacaaggaacaattagatagtggtcgaataggagcagatgaagaaattgatgatttcaaggaagatcagctgaggaagtagaagaataangcagaaaagagctaaactcaggctttctttggagaggnggagactactgatgcaatttaacctcaaaatgtctgttgngtgtaatgaccatgnccaatgagantgaatatttctntnattggcatananttngagttccaactganaagaatccttgtcctttgattnaagaaaatggnaactntaangcatgcttaaaaaaactggtttccccgtgagtaagagaagggaacag

SEQ ID NO: 22135 - DNA, 898 bp, Homo sapiens
  misc_feature 586, 637, 646, 659, 729, 759, 771, 779, 787, 793, 800, 811,813, 814, 815, 816, 829, 834, 855, 878, 885, 891, 895: n = A,T,C or G
gggagtgacagcagatgaggcctgtggggtagagaaaaactaacccattaagactagcctgccctgctcacatttctctcataattaaacacaatctatctggaccatccttaatttgcaaagcacagatagatctaaattttccttaattattatttcctctttggtggatttctgaaaagaagtgtgtgtgtgtgtgtatgtgtgtttgtgttcagacatctgcctatctatagctaagcttctgattaaccaagttttaatctatctacctcattgcgctttgctattttctctttctttatcctccaattgctccactaggtggggggtctggagggcaaacacattcattatgttgccagcaaacaagataggaattgcactgcaggggacaaaattaaatttacagctttcccttgtagatgtcataaactattgatttaacacaagaggagaaagctgcaatgatgggggcacaactgcagcgtatagctggactgtgtctggggagaggtcagcaatgactgccaacagccaagtccagacatctgagatcaactcctgccccaggcaaagggtgaangaagctagacttgtatgcttgctataagagcaaatttcacctaaagcgcgnctgctcagnatactatctgtcncctggtgaacattgctgataatatggagagacagattagtgaagttacatcagttcttgatcttgactgngagggcttaaagaacagggagagcagctanaagcaatactgngaaccttnttaatatnaagtantcttctnagagcttgtgncnnnntttagagatcttnccccnccttctgccgattgccggccnctcactagcctaaaaaaaaaccngcccttnacaaanaaantta

SEQ ID NO: 22136 - DNA, 696 bp, Homo sapiens
  misc_feature 534, 595, 627, 666, 669, 677, 678, 682, 688: n = A,T,C or G
agccagccaattttggaataaggagaggtattaaaatagattgctttgatttaagtctcctgaacggtaggttacattgaggctctcgtcggagcactggccagccggctttccccttcattccatgtgttgtaatgtgttaatatgcccagctgacgtttttgtctgtttcttagtttgacatcaacaacaagatcgagttctgacgctctgcaggggcgatacgcagctcctgaattggaggtaagttcatttccttttcctgtcctgcttcatctcagaagatccatttctcaggagggccttttgtgtttgtgtctttatcagtctgcattccgtgatcctgtttttctgctgaggaaagatttttgtatagaaaaataaatgctggccgggtgtggtggctcacgcctgtaatcccagcactttgggagtccgaggcgggtggatcacctgaggtcaggagttcaagaccagcctggccaacatggtgaaccccatctctactaaaatccaaaattagccaggcatggntgctccacctgtagtcccagctcttggaggctgagacccagaatacttgaacctggggcanagttgcagtgagccaagtctacactgcctcanctggcataagtgccttgctcaaaaaaaaaaacccgggcnttncctaaccnntaanacttgngtgccccc

SEQ ID NO: 22137 - DNA, 844 bp, Homo sapiens
  misc_feature 605, 629, 673, 676, 699, 723, 744, 745, 748, 751, 775, 777,781, 788, 793, 802, 806, 815, 818, 819, 830, 842: n = A,T,C or G
tgaaaaactcacatatatctagtcagacttaacttttgcatggtctctcgcttgctcccacaaggaaggcaactctttcctaacctgcttttcctatagttagaattcttatttttcaagattttttcttggctgctgtttcagatttcttcctctcctttccctctccccagtggtgaggtgaggaagggggtgtggaactcaaactttattttattttttagagacagagtcttgctctgtcacccaggctgcagtgctgtggcatgatcatagctcactgcagcctcaaactctggggctcaagcgaccctctggcttcagtgtaatttttcaattttgtggagacagaatcttgctatgttgcccaggtggtcttgaactcctggcctaagcagtttttccaccatggcctcccaaagtgttgggattacatgtgtgaggcaccacacccagccatacactttagtgagtttcagaatcacataaagggcttgttcaaacccagattgctgggctccacccctaagaagtagaggggagctgagaatttgcatttctaaaaaggtccagtgacgctatgctaatatccctggttggtacangctccgtgttttttgtttttttgngacagaggcagggcgtgatctagctccagcgatctcctgcttanctntcagactggatacagacccgccntgccgctattttgttttgaacaanccatctgtaccagctaaggannggncanctgctcggaccttgctcagaaatntnactnggggggngtgangaccaatgncctnctcccgggnaannggaatcttaanaaaaaaaaaccngc

SEQ ID NO: 22138 - DNA, 747 bp, Homo sapiens
  misc_feature 715, 736, 747: n = A,T,C or G
ggggaatggccacatcaagcaaagtccatccttgagaaggcaagaggggatgtgaattggaatgcaagggaggactggtctttgaaaaagggatggtcctttcctccacggcattgaaagagaaggcaggtgcagatggccacagttgcctgcaggtgttttagtggtgagaagacaagacttcatatctaagagcttctcgtatttttaaagaagtcagaggttaagtaactggctgagactataataagagtgtgctctacgggtagaggttgagaaggcagaaaacacttaaaatcattatcttggggagttgggaagagatcttggattgtttggcagttttctgtgcctgtttgagattttgatcatgaattttaaatgaaaccaggcacagttgtatgattttctgcagcaagacttagctgctgaagtgcaggcaggggtacgtgatagggtttagttggtgccaggattttgctaggattgtaaaaaaggaaaaaaggtttgagggagatgatgacattttgacaggaaagtgaccatattaaaggactggtgaaattcggctggatgaagagcaaagtgaagccagcacagatggggagaaagtcataggatctgtgacctcagtaagatcatgatttgtagcagtggagatctttgaccaataaattaggaggtgtatcagagatggcttcaaagtggtcagctntgatgtatggtcaggtgggcntggagtgaaan

SEQ ID NO: 22139 - DNA, 698 bp, Homo sapiens
  misc_feature 559, 572, 608, 657, 665, 668: n = A,T,C or G
gccgctggcctactctggaagttcagtaagtgcagggagcctcgatcccaccatgtgctcctgcagtccccagtgctctgagccagaccctgctctctgggctattgagacctctggaggccctccgtgaggttcctctcttacataacgaggctgtctctcttcccttctcttgtttagctatgagattgacacatcatggggaaagcatttagaatgtacccagtgctttggggtgcttggtgccacccagcactgtgagcacaggttcttctaccttggggccacacccagttacctgtatctcactgcacagcagtggctgttggggaccaggcccacccctccatgtcccacctcctgcaactgcagcctgagccttcccatcagcctggggtggtgcagacccatgtgccattgtggatccttcaagttacctgtgtggcagagaggacgtgtgagtgccgtccaaacccaaacactgagagggtccttcccattgcccccacggaagtaaggtgccccagtgctaattccacttatacttgctggtggcaangacacttctcctncttattaaagtgggggattgctgggtgaggtggctncgcctgtatccagcactttaagaggcaaggaggtggacacctgaggcangagttganacncaacctggcacatgtgaactcatctctact

SEQ ID NO: 22140 - DNA, 699 bp, Homo sapiens
  misc_feature 410, 421, 424, 427, 433, 434, 438, 443, 444, 451, 458, 469,480, 489, 513, 540, 559, 564, 596, 613, 622, 634, 640, 644,655, 661, 665, 666, 674, 678, 684, 685, 688, 690: n = A,T,C or G
gggataccaatttaccaacagtgagggtgtttcccaatgccccaccccacttatttttatatttagaatcttcatacgtatatttttttaaattctgggattttttattcttagaagtttttaatggttcgaggctgggcgcagtggctcacgcctgtaatcccagcactttgggaggctgaggcaggcggataacaaggtcaggagatcgagaccatcctggctaacacagtgaaaccccgtctctactaaaaatacaaaaaattagctgggcatggtggcaggcacctgtagtcccagctactctgggaagcaggagaatggcatgaacctgggaggcggagcttgcagtgagccgagatcgtgccactgcactccagcctgggcgacagagcgagactccgtcccangaaaaaaaaanaangangagaanngaanccttnngtttcanccaggcntgtgaagtaanaactctgctanagaggaaanggctgcttcatcatcatcctcctnagctgggggggtcaggggaagttctgncactggatctggtttcagngtctnaaaccttgccccccccggaagccctttccctnccccaaggacctggaanatgtaaaanaggctctgaaanatcctntgcnatctgttttancttcangggnntccccctnaacnggaaanntgncncagtgctcg

SEQ ID NO: 22141 - DNA, 768 bp, Homo sapiens
  misc_feature 632, 674, 711, 722, 733, 740, 745, 760, 767: n = A,T,C or G
ggggtattctttaatcttacaaaactcactgcatttcaccttttctctaaaaccttcctagtctatcattttcatcccctacctccgagtgaagcatttcttcccttttccctcccagcatgttatattccttctgcataactcctgatggcacagaggtgttcacctggcattctgcccccctagcccgagctccttgagaacagggtggttatcagtcatctcttttcacagcactgacagtgcctggcacacagtgagcgccccactaatgcatcctcagtgaaggagggagtacctctggtttctccacccctctttctattttagccacttcatttttgcttaaaccaggtacttgtctaaaaatggtcttggaatctgtgctttgttatttaaatcctctgatgcttagcttttatttgggccactgctagctacattgtaatctttttacggtcaggaaccatgtggtattgctggctctatccctcatgatacattgcatgtaatatgcactcaagaagtgcctattggccgggcatggtggctcacacccgtaatcccagcactttgggaggcaaggcgggcaggtcacgaggcaggagttcgagacagcctgacaacatggngaactccgtctctactaaaatacaaagtagctggcatggggngatgtctgtaccccgtctcagagctgagcagaaatcnttgaccgaagngaggtcaggancagatgncatgnctcacctgggacagnagatcgnt

SEQ ID NO: 22142 - DNA, 642 bp, Homo sapiens
  misc_feature 476, 558, 580, 606, 611, 612, 626, 637: n = A,T,C or G
gggattgggaggcttaggtatttttgttgttgtttgtttgttttgagatagagacttactctgttgcccaggctggagtgcagtggtgcaatctcagctcactgtaccgtccacctcccgggttcaagcgattctcctgcttcagcctccagagtagctgggattacaggtgcctgccaccatgctgggctgatttttttataattttaataggggtggggtttcacagtgttggccaggctggtcgcaaactcctgacctcaagtgatccacgtgcctcggcctcccaaagtgctgggattacaggtgtgagccaacatgcctggccagaaggttctggtttgttaaccaggtaaggtctgcacatttaaaactgagaaatgctagcttcctagcaagcagaatggaatatatagaattgactgcatggtctcctttacttcctatcggaaaagtctttttactctgctgactanagtgtatgtgtgtgtgtgtgtgtgtgtgtgtgtgtgtgtgtatttcttttgcttcaattcattaaaaaaaaaataaaatganctgggtttggaggctgaggcangaggattgcttgacccctatgatttnaatcnncctgtgcaatacancaagatctatntttgg

SEQ ID NO: 22143 - DNA, 727 bp, Homo sapiens
  misc_feature 519, 532, 538, 546, 553, 554, 576, 618, 619, 622, 624, 645,675, 679, 686, 688, 690, 698, 702, 709, 715, 717, 718, 721: n = A,T,C or G
agggattttcagtctgtctattcaacatcattatgtccattgatacacaagcagttatagtataagatagaagatacttttggctttgaattattgttttgttgtatatttttactttcttgcagaggctacaattacaatagcttgacaactagagagaattcttcggtctgacgccaccagtagagggatttctctctatgtgttatgtgggctgtttccctcagcagctggtttgttctgaccagatgagctccacttccctctttgagaaggccgaggtgggtggatcacaaggtcaggagtttgaaaccagcctgaccaacatagtgaaaccccgtctctactaaaaatacaaaaaaattagccaggtgtggtggcaggtgcctgtaatctcaactacttgggaggctgaggcaggagaatcgcttgaacccaggaggcagatagcaccactgcactccagcctgggcgacagtgtgacactctatctcagaaaaaaaaaaaaaaaaaacttgntaaaggggctaanatggcnttcttgcnggcccanntggatggtcttgttaatgctantaaaattacttgtgactgaagaaacatttggtttttggctannaantnggggcaaagggtgaagacccnaaaaaaaaaaaaaaaccccgggcccttttnctgntcccacngnanatattttngggnggacccnatttanannccnccgcgg

SEQ ID NO: 22144 - DNA, 774 bp, Homo sapiens
  misc_feature 10, 558, 609, 693, 694, 697, 709, 710, 714, 722, 724, 728,730, 732, 734, 742, 748, 749, 759, 771: n = A,T,C or G
agacgacagnaaggggattttccttttatttgtatcagattgtattatcagaagttcctggcctgtgttttgaggccagatatttagaaaatactgagaatcttggaaaataggataaccagtctgagcaaaatacctgttggcttaaatctcaaatatatttctgatttcagtggttattcagtcagaggagaactcagaaaggcaggcatatgagaccaagtgcagaaataaacttacaataaattttattttatattaactcaatatttgtttattagaaagaatcaggcttggctgcagagataatgatgataaatacagccagatatatgatgacggatttagctgagcaatttctggaagaggtctttataagcagagacccaaacaaattcttcaaaattaaatgactgtattttcatcacacacacacatacacacacacacacacacacacacacacaaagggtatggatttataagaataaatgtacacacacacacatatatatatacatacataatgttttttgctttctccttttacataaaagntagcatataatacacatgattttcatttaactatttaggttgttgcagaantattgcagctatattgatttggttaccttgtttatcagttcatcacaaattctttctttcttttttttttttttttgaaagggnnttnttttcccccggnnaaangcgggggngnttcncncntnacctcccntccggnnaggatttttnttggccccaagncgg

SEQ ID NO: 22145 - DNA, 603 bp, Homo sapiens
  misc_feature 417, 442, 477, 491, 529, 535, 539, 546, 553, 555, 556, 562,571, 576, 583, 586, 587, 590, 592, 600: n = A,T,C or G
gggcctgaagataaatgctgtaagaattttttttgctgaatcttcttttctgagaagtttctctcagcaattctctcctatgcttgttgtttcctacaggcagtttatactccattgagctatgagtttatctttgtaattccaaaatttgattgtgttactgttctgctagaaaaatgacaactgtctaatccatgaccagatgagagctaaaacccttagtgtggtgtggaatcttgctattcaggtgtgatcctaaaaccagcagtattaccatcacctgcagtctcctttcagaggcagaatggcaggcccagccatgaccaactgaatcagaatttaaattttaagatcacccagatgatatattttcatttaaaagctgaagccctagttccaaagaccactccagtttanccttatcttgcccctatagcctggnccttccacctcctccttcccctccttctactttgnctccactggctctnccttctctaggctcacaatggacttttcctgcctttanctcttntgtncaaaggncctctgncnnaatttnctttcctgncctanaactctnctnnttntntgacccanacc

SEQ ID NO: 22146 - DNA, 834 bp, Homo sapiens
  misc_feature 705, 711, 751, 773, 774, 776, 778, 782, 784, 785, 789, 793,796, 800, 811, 813, 818, 827: n = A,T,C or G
gtgattcccctaagaaagacatatattttaaaaacttaaaaaggagttgattgcttgtatcatatgattgtatatgtatgttagcttataaatgcctacatatacgcacaaccatatatctatattcagctattaaaaatatgaccaaattctagccaggtttacttgcctttgatttcagtcaaatgttttggtcataatgaccataaatgaaatgtagctgactttttatcacactgacaacaccgaaagtttacacaaatatttatgaacagtatttgcaaaaagaaagatgtagttagctgataagtttggtaattatccttcagcaaatatacatattagcttatcaacctaaattctattatgtacagcttcaaaatattaattgctatatatataaaagtttaaaattaagtagaaagaaattaattgatatcttaaaattgagcatatgtttaatgaattcattttattttataaggctgagtacatatacagatgatcccattttagtttctcagctattttactatatgttaaatattttgatgctgtatttacatattagcatcagcaaccataatttttctgataacttttcaagatcagccaaatcatatccttgccagtccacttttctctgagttttcataaaaccaaataaagtatctgcactggtagcatttacaatctcctcattanattatnatgctttagtgagttttcttttaacgcagggtaaggcagnttggttagttgtatttttcccnngnanggcnanngggngacngangganagatgattctncngctgnggacttgtntagaaaa

SEQ ID NO: 22147 - DNA, 836 bp, Homo sapiens
  misc_feature 641, 684, 704, 709, 713, 729, 740, 742, 767, 769, 778, 780,783, 799, 814, 815, 820, 823, 828, 829: n = A,T,C or G
gggatgttgtttacagtttgttgttacagacagattattacatactaccttatatttcttttaaggacatgaaacatttaaattctattttgttgctgtaatactattatttagatttgaattttacttattttgttgctcagcactgtatcttgtatactacagatttcttagtttgaattttaaatccaattaaactcatttggctggagtgttttgagtaaactttacagaaagagaatgttttagcggactttctaaactttttgtctctgagaacgtcttgtgttgacttcttatattttgactatttagttggtgataacaaatatgttggacaaagaggatttattaggtataatcttaacttaaaaaattttgtcatcaactgccccttttaatttttaatggggaaggttcttccctttcccctagaagaactcttaggcaagtcttcatgtcttggggtattcttgtagagtaagttatcctgtggccaatcaaaataatcagacacagttgcaaattagtaataaaatttttccatactaaataatagtctaatttcaatgaacccctgcatattagaagcccctatgaactgatggctacctagagatagagggatatcactcagtcgnctctcccacctattttctttctgcccacctatttgctttatgngtaaattgaaaaaaaaaganaaganggcntttgctgctgtgaaangcttggctaangnctggcaagtcaacgcttttgaggtntntgcttgaancnggnggtttgctattctgancaaagattaagacgnnttccngcngttanncgtaaag

SEQ ID NO: 22148 - DNA, 595 bp, Homo sapiens
  misc_feature 3, 11, 458, 464, 505, 514, 516, 523, 557, 558, 562, 568,570, 572, 582, 583, 586, 587, 589, 592: n = A,T,C or G
agnacgacagnaagggtttttcctcattgttacctattctccaggatgcgtggccattctgattctaggtatctttagtaccaagtctcacctctatttaaagcctttccttattcctgtccaacaactatctcctcctttttggccacttaatattgtatattttgatatttgatgataatcctttggcaccctcctgagtcatcagagcataatgggaagggtacagactttgaagtgagatttggtttgaggtctagatgtgactttttggaaaagttacataactattctgagcttccatgtcattgcttgtaaataagaaaggataataactggactgttgtgaggaacaagtgaaaacacattataaaatgtagcacattatgaagacttatcagaatattgagacaaaattagcttcttgtgagcagaggtgtctttcttccttttgtagncctgtntaagatgcctaatgaatacttaattatttgaaatataaagntcttgattngntctatcnaaaatatttcttgactgcctctttcaacatgcanngatnctgagngntngtactctganngcnnanccngac

SEQ ID NO: 22149 - DNA, 673 bp, Homo sapiens
  misc_feature 1, 80, 84, 95, 101, 111, 116, 129, 140, 158, 164, 242, 318,341, 581, 584, 599, 632, 639, 648, 656, 667, 668, 669, 670: n = A,T,C or G
nacaaagactttaaaacaactctcataaagatgttcaaagaactaaagaaagatgtgaagaaattcatggaaatgatgtntgancaaaatagaantagcantaaagagatntaaancctaaaaaagaancaaaaaagaanttttggagctgaaaagtncaatancaaatgaaaattggactaaatggattcaaaggcagatttgagcagaaataaaaaagaatcaatgaatgggaagagaanacaatggagattactgagtaaggaatagaaagaaagatgattgaaaaaagtaaacagaacctaagggacatgtganacccatcaaatgggccagtctanccatttggaagtccccgaggaggagagagaaatggatagagagaatatttcaagaaataatgactgaaaattttctaaatttcctgaaagatatgaatataaacatgccagaagaactccaattaaaatgaacggaaggatcttcaagactctttgtaagcatttctgttttggtgcttcaagactcattcatagaaagatccttattagatttgcagatttttttattcaaactttggngcngaccagtagccattnttcaaaaaaaaaaaaaaaaccctgggccgtttntcctaancaactatanaccttgtngttgccccccnnnnaaa

SEQ ID NO: 22150 - DNA, 611 bp, Homo sapiens
  misc_feature 333, 346, 376, 379, 393, 404, 417, 476, 490, 500, 501, 549,561, 562, 563, 566, 567, 568, 571, 573, 574, 576, 594, 599,608: n = A,T,C or G
ggggaaatataatttgcattacagtgtagatggcttgcatatgaaagggctacatgaacttttgggctgatgtaaaagcatgtggtgaacttttctgatagcgttcctgagctgctttaggactccactgtgtcatataattcatcttagccaatattgctgccagatattagctctggaccctagaactgtattcttaccaggttagatgtggacaagatgctgaattcaagtcagcacactccaaaggcccgtgtgtgtgtgtgtgtgtgtgtgtgtgtgtgtgtgtgtgtgtcttcacaaagtttataatgataatttagttgctttggnacacactgggcancctgtaatattctttccagctctcgaattntgngatttttttttttncctagtatttnggcaagcaatggntgtctctaagtaacacaaaaaaagttctttttcaacaaagcctttaaaaagcctcccanctctcaggctttcnaaaaacacanntgtgtgtgtgtgtgtgtgtgtgtgtgtgtgtgtgtgtgtttttttttntttttcctgaannnttnnntgnanntngggtcttttttctggggngctcntgtgccaanacc

SEQ ID NO: 22151 - DNA, 735 bp, Homo sapiens
  misc_feature 663, 704, 720, 724: n = A,T,C or G
gagtactttttacctggcttaatctatttatggttttctgtttaggtagtttttttaaatacgaagtagcttataaataactgatacagcaaggcatggtagctcactccttgtaatcccagcactttggaagactgaggtgggaggatcgctgagcccaggagttcgagagcagcctgggcaacatagtgagactctgcctctaccaaagattaaaaaaaacaaacaaacaaacactagccaggtgtggtggtgtatgcctgtagtcacagtactcctgaggctgaggcaggaagatcacttgagcccaggagttcaaggctgctgtgagctatgatcatgccattgtactccagcctgggcaacggaatgagaccctgtctctaaataataataataataatttataccatttaccgagcatctaatacctagtttcatttagtctccacaccattctctgatgtaggtggtattatccctattttaaaaactgaagaatctgaggttcacgaagatgaagcagcatgactagtttcacacaggtgcttaatggcagcagaactaagattaggtcccgggttgcactgacttcaaagcttactccacactaatcagctgctttttcatccttattgtctctctttgggtggtcactttggnccagaagacaaactttttctatctgattcctggagaactcncgatctgctgttactntganatcctcattgg

SEQ ID NO: 22152 - DNA, 766 bp, Homo sapiens
  misc_feature 226, 409, 598, 651, 669, 682, 695, 703, 705, 728, 735, 738,739, 741, 744, 745, 750, 756, 760: n = A,T,C or G
gggagaaatctcagttacatcttctatcttctgtcacaattgaagcgaaatttaacatggttgtttattttatgctctagttaggttttatcttggcccctaactctctttaatgctgagatttcctactttctgcctttaagaaaaaaaaaaagtctgaatcttaattctgcttcatacctctaccataaccatcatcatgctaaacatgctgatttgtatttanagtccaagttctttaatgtaaagacagcaaggcagactgctagcctattgcattgctcttcttttctcctctaatttctccactgttttctgttttatatgatttgtagtacatagtgccattagctcttttgaaccttcatattaggtccttttctaggcatcttaaacagttattgtttanaattatcttcttgtactgtttttaaaaaataaagaaaataaagataggccgggtgtggtggctcacgcctgtaatcccagcactttgggaggcctaggcgggtggatcacgaggtcaagagatcaagaccatcttggccaacattgtgaaacaccgtctgtactaaaacacaaaaatagctgggtgtgnggcgcgtgccagtagtgccagctctgggaggctgaggcaggaaaatgctcaanccggaggcaaaggtgcantgagccaaatgcncacccggctcaancgagatgngnccaaaaaaaaaaaaaaaacccgnggcgttntcnnanccnntgaanactggngtgncccccc

SEQ ID NO: 22153 - DNA, 781 bp, Homo sapiens
  misc_feature 486, 686, 719, 723, 725, 727, 745, 751, 755, 774: n = A,T,C or G
ttgtgaatagtgttccaacaaacatacgtgtgcatgtgtctttataatagaatgatttatattcttttgggtgtatacctagtagtaggattgctgggtcaaatggtatttctgtctttaggtctttgaggaattgccacactctcttccacaatggctgaagtaatttacactcccacgaagagtgtaaattaaaaagcattcctttttctccacaaccttctcagcatctgttattttttgactttgtaataatagccattctgactggtgttagatggtatctcattgtggtttttgatttgcatttctctaatgagcagtgatgttgagcttcttttcacatgactgttggtcacatgtatgccttcttttgaaaagtgtctttttctaacttttcatctgctccttaagacctgcttttggagaaaagtgtatcagtgccagagagtgtggtaagggggtgttttccttacatgatattgntacatgtctacatgatcttgttacatgtagtaacaagatgttcatgcctaattgaatctaggatgggcatggggctcacgtctgtatcccagtgctttgggaggctgaggcacgtggatcacctgagtcaggagttcgagacaacctggcacatggcgaacccatctttctaaaatcaaaatagctgggatggggctgcncctgaatccactcttggagctgagcaaaaatgntgancngnggcgaggttcaggatcanactgcnctgnctcacctgagaaaagaacntgctcac

SEQ ID NO: 22154 - DNA, 766 bp, Homo sapiens
  misc_feature 1, 9, 23, 683, 704, 705, 712, 736, 737, 747, 762: n = A,T,C or G
nacgacagnaagggggtccaggnaacttttgggtgaagacagttgacttccaggctgtgggttggcaagttgactgtaattcagctcattcattctctaccctgacctcacacatcctgaggtcatctgaaaaatcaagcctagtccatggaaagtactcagtaccccaaagaggcatttattcatgtgggcaaagaaacaacctgtcagaatctgactaggcctgaaagaggccatttctcttagtatcgaaaccaccctccaaacactaggagcaagtcaactcttttctttaaatatcctattctattagctattttaaagtccccccttccaaatatacatatgtatgtattagctatttcagaggcccccttccaaatatacatatgtacatgacacccgtttcacaggttggagagccaaaaggcacaaagctcagggcacaaagctggtgaggagagagccacatctctaattccaggccccacaatcgataacagtgcagccacacagagagaggagagaaggaggcagccatcgaaacaggagagatggtgagaggccagaggagagacaggaaatggggatacacagacaaaatgatgagtgatgagaataggagcaaaatcctagcagtcagagaactgctatggagtgtgcttatcatgagacagtctaangagttttaggagcaagatgannaagctgngatataaatctttgaaaaaatgcnncttgaaatancaagcttctatccanaagg

SEQ ID NO: 22155 - DNA, 818 bp, Homo sapiens
  misc_feature 10, 13, 21, 38, 679, 720, 725, 780, 786, 787, 792, 793, 797,803, 804, 807: n = A,T,C or G
cgctgcgagnaanacgacagnaaggggagagagacagnaaaccaaggagaaagaaaccgggaagacaagcaaagagacaggtagaaatagacggagaatttcttctgcttcctcctggcagattgcacttggggggcaacctggctgtcccaggccaccagggaagcccacatggcctgttgggttggctttgtcccgaattgcctggaagttcatcttctgtctagccttagatcttgttgctaaataatttgggggacaaggacgtgagaatcccctcagccaggagtcagtctatatgcagtggcaggggtctagacagagtccccagagccaggggtgttgggagaagccccgagaggcagcccctctccactctgaacccgggactcattaggcaagccagtttcagccaaggtcgggggccctcgtgtggcacccccacagaatagcagcggtgatactgaaccctagagcccctgactgtgggctccacccaggcaagagccaatggaactggaggtagggggtgcatggggaggagtggacatcttcacttccctaaagcagtgtgtaggtcaacacgcacgccactgcatgatgtgttgctgtttaggtcagagttatatgcatgccattatgcgcatgcgtgtgtatagtatgcatctatagaataganttatctatttctgttatgtgagggccattggtgttatatgngtgtntttatgtgtctatgagtccatataaacgtacaaaccaaaaaaaaaaaaaaaaacnctggcnntttcnnatcnactaannctngagtgcccccc

SEQ ID NO: 22156 - DNA, 765 bp, Homo sapiens
  misc_feature 563, 624, 627, 659, 684, 701, 703, 708, 720, 722, 723, 727,742, 748, 756, 764: n = A,T,C or G
aaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaattcaggaactctcagagcccctagaagtcttctgtagacactcaaatctggagagtcgttaaatctgtcttgaggatttttaaaagtatatnctcgtccagtcaatcttggattttgctttgtggttagtaacggtaaacctcttgtctaaanccnaggaggctctttcgtttttggaaatttttagnctagtttgacaagacagattaacgngaggatttatgattggncnttgcngctccgaactcnannaatngttgatgaattgggngtcttnacgggaanaaaatacng

SEQ ID NO: 22157 - DNA, 716 bp, Homo sapiens
  misc_feature 430, 614, 621, 677, 683, 704: n = A,T,C or G
acctgtggtataataaaaaatatatttggtctttgtcctggttcttggcacagtgttaaaactcttggaatttcctgagtgataggggtgtcaagtacagatggcccctgggacttgcaactggtatctcaagttggggcagtcttgtgggactaacctgcggactctgcattaactctaggtgttagagtcagaattgaattaaatcgttggacacatggttggtatcagagaatgggtggttgatgtggaaaaaactctatacatttgttgttggaagtgccattggaaaaaagacaccacagtacccatatctgagtacccacaaatcatggagataaagatacaacttccatttctcccattgaattcttactagttggatagaattggagagtggtagtgggctcttttatagacttggtccaangcagctacaagagtgcaactttcgccaggcgcggtggctcacgcctataatcccagcactttgggaggccgaggtgggcagatcacgaggtcaggagttcaagaccagcctgaccaacatggtgaaactccatctctactaaaaatctaaaaagtagctgggcatggtggagcttacctgtatnccagctnttcagagcttgagataagagaatacttgacccggaggggaggtacagtgagcaganatggcnctgcctcagcctggtgacaancagactccgctc

SEQ ID NO: 22158 - DNA, 856 bp, Homo sapiens
  misc_feature 673, 684, 718, 735, 762, 768, 771, 818, 819, 820, 822, 830,835, 842, 844, 846, 848, 849, 850: n = A,T,C or G
ggggcagtggcctgatcagtactatgttttaggagggtactggctttacttgggatgtctagttgcttccttccttaattgagtatgagaaactcaataattcctttttcctcagtggtagaaatggaggcatattctctgtcattgtctgagataatggtttgaatcagtccctttggcctaattaggaaaagtaaggaggttaggacccagtccacatatggtaacactccacttaatccagaggttaaaccagctgtggaatgtaaggagcccaaaaactgcttgaaattgctatcaaagccatgtcccctcctctccctggtcccccgacgccccggggggtatttttgcatagcatttctgatccttttttggacttccattaagtctccttatgtttactagctttgttatcttaaagcagatgagactagggagggaaaagaaatgggattctgaggcatgtaagttgacgtcaggaaagttagcaatttatagcctgacatgaaggtaggagttagaaattttaagaaaaccccaaagaactgtgataggatattgaatatttgctagttgaaagtagatatgttcgtatattgtttaaggaatcatgggtgtagaataattccaatgatgtaatgactgagctatggacagataacctgtttantcgattgctcnctgatcattaacataacaatcctttactcccttntgctttttctgtctaanaaaaagtgttctcttttactttaggcncaggtntcntaaaatctacatgtctaatgtcaaaaactacctctcaaatcaaattnnnantcaaaaanaatcnaggcaananangnnnattttt

SEQ ID NO: 22159 - DNA, 870 bp, Homo sapiens
  misc_feature 511, 685, 696, 697, 732, 750, 794, 802, 807, 830, 848, 854,865, 866, 867, 868, 869: n = A,T,C or G
gggaccatctatcctacagttattagctggaataattcattaaagagaaacttccccatatctactattagattactcaatggtacagttcatataggaaaggaaggatgaatgcttgattctccctctttatttaccaatttttaaaataatgaattggtttcctggcatcctcctaggataatcaattaattttttttcatttttaatatcattatgaacaaggcctagaattttttagtatcattttaacatatttactatatcaatccattgaagttattatccttaattagtattcaaattactctgtttttggcctgtgggaggcctgtcaagtagacttcttgatccatttgacatgagcctagtatttgatagcttacttgctatctgctatgtccaaatattccagattcatttctatattttttgttttagacctggaatcagctatttctccaatagctttacttttagtaggaaaaagtatttggagaacacaatctangatctagggtgctcactgctaccaggttggtgattgtttctaggcttttatagtggacagagcttgcggattttttaagcataaaatatttcatcacttcctattctaatctggctaaaaggttaaactaacctctctacatctctactctttgctccccgtcagatgaagaantccattgctanngaaaactggagcagagctgatattatcttaatgcnaccaggtcaattgttctntgcttaagcggctaagctcttaaaattggtacccactcttggancagagagnggtgnccggtcaaccctgactgaacctntcaccacaaaaaaaaaangccttnacaaaaatggnnnnnc

SEQ ID NO: 22160 - DNA, 533 bp, Homo sapiens
  misc_feature 193, 350, 372, 466, 471, 472, 482, 483, 491, 498, 500, 501,502, 508, 514, 517, 524, 525, 526, 527, 531: n = A,T,C or G
ggggggagcagggtgtgtgagcggtgatgggtgccctgcttccaggatataaatgtcatcactgcagtcctcttcactatggcagcttctataaaatatttctctgcagacagtaagaaacctaaattgggattttcacttaatttttattaatccaagcagaaccaagtttgctttatagagaaatcaacanctgtaagacaccctctcccattgcctgcccagactcttcctcgtccaggtgctgatttgtctaccaccaaaaaaaattgtaaaggatggtgtaaatgtcaatttctgggtttcatactatcctatattcggcaggatgtctccattggaggaaatanggtgaagggtacagggaccctntcttactattttttgcacttcctgtgaatgttatttatttcaaattaaagcagggttaaaatggtaattgtatgtacaatgttgttttatcacngtttnnagcccccttnnattttttntttaatnannnaaaaancctttnggngtttttnnnncccncc

SEQ ID NO: 22161 - DNA, 777 bp, Homo sapiens
  misc_feature 623, 673, 674, 698, 702, 713, 737, 741, 745, 748, 749, 759,766, 771: n = A,T,C or G
aggggacagagaggattcaggtgaacagattagctcatctgtcttccatcagcacacctgttgcccccaacagagggcagaaccatttctctttcaagcatgggctactgataaattcagctaggcgagctagttcagccttctcattaagggaagttaagagagaagtgatgaaatcttaaaaattaggagtaactggacatttcgttaagggagatgcattacttcttacagcactaggtatgagttgaagtcaatgcattttaaacatggttttcctaaattgaagtctttaaaaaataaaactttaagaaagtatcctaaatacatatggtaaaaattttcacaaatactgctctttggccattcaagaaatcttcaaatgaaatatgatgttggaattttttctgcagcagttattctgatgtaatatacatctgccttattttttccatcactaatttttttcagtttgggtaataaaacttgttcatgaagcgtggtatatagaccatttttaaatggccctactccagtggacttcaagtccaaaatgcaatgaggagttttcctaatggcaatgtgcatcttttacatttttgtacatggaggggaggcagtanaagactgtgatgatttagctctgctctcagcagagacatcatggaatgtnncaactgcttaggagctctctgacntgcncgtcctccttnttctgaaaaaaaaaaaaaccctgngcgntttnccnnatccactaanaacttgnagtgncccccc

SEQ ID NO: 22162 - DNA, 403 bp, Homo sapiens
  misc_feature 299, 368, 369, 370, 371, 372, 373, 374, 375, 378, 379, 380,385, 386, 392, 393, 401, 402: n = A,T,C or G
gggggtgtagtatctttataattccctttctgtccatcagagaaaagctgtttttatggccagatgcagatctgggcagcagagcactgctccctgctgtgtagaacctgaaagttgatcaaacaggtagtccttgagttagcagtctcagggaagggattggattttttgtttgtttttggagaggggtcttgctgtattgcccaggctggtctggaactcctgtgctcaagcgatctacctgcctcagctactcagaaggccgaggcaggagaatggcttgaacctgggaggcagangttgcagtgagctgagattgcaccgttgcactccagcctggcagcagagcgaactctgtctcaaaaaannnnnnnnttnnngaaannaaaaannaaaaaaanna

SEQ ID NO: 22163 - DNA, 601 bp, Homo sapiens
  misc_feature 590, 591, 592, 593, 594, 595, 596, 597, 598: n = A,T,C or G
gggatctatttgctgaattctttccaacatacaaacttagactgtagctaccgctgacctaatgaacctggttatttatatgctgtctttttgttcatttgtctggtcaaaagggcccactcaccttcctgtgggcatagctggcgggagcaagtctggtatttcagctgacttctccttttggctttctcttctccttctccttttgctatcttttctcttcaattcattgaaaaatgtctatatataaattacataaatgcaatctgcattgcaaaatatcccaatgaaaagtatatatgaaataatttttggcaaactgagtcatgttcttagtggatatgggttcctgtgatttcaaggaatgctgtcctgaacttttaatttaaaaacattcaacctcctaattattttgccagtccgtagttttatgtttaagattgcccaaaaaagacctgttctgtcagtgaatggataatctaatgtgcttctagtaggcacagggctcccaggccaggcctcattctcctctggcctctaatagtcaatgattgtgtagccatgcctatcagtaaaagatttttgagccnnnnnnnnngga

SEQ ID NO: 22164 - DNA, 665 bp, Homo sapiens
  misc_feature 282, 294, 313, 321, 327, 363, 405, 407, 409, 418, 421, 444,509, 526, 530, 532, 541, 549, 554, 559, 601, 612, 618, 643,652, 654: n = A,T,C or G
atagcacctgcagaaaatctactgcagtaatagttcatagtatctgtaataacattgaactagtttcttgcttaagttaagggacatttatttcttgttttgaactgcttagctttctaggtttgatgaattttaaagtatctattttatgacagtaaagaagtacattaactaggtctctgtgctctagaattcaccaatgtgtaaagcattggttttcaggaaaggtaaatcaaagtacatgacaataacaaacatttgtatttttttttttttttaaanggagtttcactnttgttgcccaggctaaagngcaggggngccatnttggctcactgcaacctccgcctcctgggttcaagngattctcctgcctcaggctcctgagtagctgggatttcgggngngncccaccatnccnggctaattttttgtaattttagnagggacagggtttcatcatgttggccagtctggtcccgaactcctgacctcaggtgatctgtccnccttggcctcctaaagngcananattacaggngtgagccnctgcncccancccatttgtattctaccatggatttggacctgggctaaaagnccttgcatgcntatttntttgattttccataccccttaaaanacccaatcntnggaccttctcc

SEQ ID NO: 22165 - DNA, 761 bp, Homo sapiens
  misc_feature 630, 664, 682, 683, 685, 705, 722, 736, 746, 747, 750, 756,757, 758, 759: n = A,T,C or G
ggggtaagccaagttaagaacattcaagatgaaagaacatgaggaggttgacagttcagatggacctccctggcagccgagtctgtggagtgaagggagggaagttaaaaacattcgagatgaaagaatgtgaggaagtttgcagttcagatggacctccgtggcatctgagtctgtggagtgaagggagggcacgcttggaggcggggccttcaggccttcctgcgcttgtgtctgtgagataaaggcctgaactaaggtaacagggaaggagaaaatgaaactgaaggaggtaaactggaatttggagactgacgaggagagaaaggaaagcattccagggaaaccccagttttttgcttggctactttgggtaggtgatggtgtcattaaccagaatcaaaaatgtcagtggtagattagatttgagtgggggaaataaaaagttctctttgagatacaccaaatttgaggtacttgtggatttcccagaggcatcctacataggcacttaggaagagagccaggggattcagggcgattgtgtaggtagcaggtagccaaggcgtagaggagactcaaggaaaaagttgtgtgaagagagacagaacctaggacagaaagcctganacaaatatcttgtggctgggaagggaactgctantgtctggagggatggctnnantccatcagaaaaaaaaaaanaaacccctgggcgtttntcctaatccactgnaaaccttgtnntgncccccnnnnaa

SEQ ID NO: 22166 - DNA, 807 bp, Homo sapiens
  misc_feature 701, 725, 750, 789, 799: n = A,T,C or G
gggattcataagaggccaaatcttgatattcaatagagtttgtgcaacacagcaaacaaggaagtggaacaatgcaaagaaaacaaattcatcactcccctgcctcccttgccccacaccttggagtcactgaatactttttctttgaagtctagaaaaatctcttcttgcatgatttgattggtgccttccctagatattttgcatttactttccctgcattcagttgaatattttcatgaaaaatagagccttgttcaaaaacatttgtttttgcaactgtgaaagatctagcaaaagcactggtaattttagtgattttctaaaatcacacagcagagtttttgtcattggaaatacactattggaaatacaaagttttcttaagtcatgtaggaacatcaaaaggaccaagctgatgcaatattcacataacaattgtttgatgaaagcaagggaatttccagtcaaccatttctagccacacttcacctggctaacattagggctatttgactttttaattctatttgcattaagaaaggcaagccaagagagaatcaagagtcaatttgtttcataactttccttgcatgatgctggtctttttctctgttctcactctagcttcctcttgtgacggtcatctacataggctgttatatggagaaaaatatcttcagataaggcagatgccaagnggtggcaactttggagattctggnttctaaccatgccatcttttctttnccttaaacgaaaaaaaaaaaaaacctggcgtttctaccntgaaactgtntgcccccc

SEQ ID NO: 22167 - DNA, 867 bp, Homo sapiens
  misc_feature 587, 603, 606, 608, 610, 663, 680, 689, 693, 695, 714, 736,746, 751, 772, 774, 784, 785, 786, 794, 810, 827, 832, 833,839, 853, 855, 864, 865: n = A,T,C or G
aattttagcagttaaagattatttttgtgggaggccgtttggctgtctggggttcaaatttgcatttaggtggggttagtttcaccgctgtttgaaacagtggcatacatttcaatcagtttagatgcattttttttttatttctactacctgtcttcacccccaccatctagtctgtcacaaaatcttggttatgtagcttttatatatttaggaatctctcttttttggtatttcttctgccactcccttgggtcatgccaccattgcttttacttgatttctgcagtggcctccaatgtgtcctctccctcctgtcccgtgcccctcaaatccatgttatgtagcatcaagagaaatctagttaataggagattctcatgttactccttttcttaaaactctgtgtcacctcattatctacagaggtggaacttactgtgctgtaaaaggccctcattgctctagggtggaatgaatgggccaaaatgtattttgaggaattctgagcttcttcactgggctttggttgttgttgattttcaaaagggcattgctttcaacaaatatattatatacatacatcncacgtgtgttgggtgnggngngnggggggaacttatatatatttggaaaggagtctgctagttgccaggctggagnctgggctttccaggcanggcataggncctnancccgactctggagcaggantctgctacctccatactatcgngggccccccnattgncaagaatttttaaaaaaagcnanttgaatggtnnnttgccganccccctagagggatgngaggggtcaaatgaccnggaanngacttnaaaaaaaccggctncnacaaaaatnnag

SEQ ID NO: 22168 - DNA, 832 bp, Homo sapiens
  misc_feature 7, 8, 14, 17, 21, 30, 35, 37, 132, 133, 149, 150, 156, 157,168, 176, 196, 199, 200, 212, 213, 214, 227, 232, 246, 249,280, 290, 301, 304, 318, 331, 334, 350, 366, 400, 402, 403,408, 411, 412, 415, 417, 428, 430, 436, 437, 445, 463: n = A,T,C or G
  misc_feature 479, 481, 484, 485, 488, 489, 490, 495, 500, 547, 553, 554,558, 561, 589, 598, 606, 611, 622, 644, 645, 646, 656, 664,667, 670, 673, 684, 711, 726, 733, 742, 743, 757, 773, 775,793, 803, 810, 816, 826, 829: n = A,T,C or G
tgcctcnngacgancgnacgntgccgcttncatancnccactcacgggttcaggatgctcaaactacggacaaaatggtgcgcgttgcttgaatacgacattaacaggttctggctctggatataacgacannttcggtggcaggcctnntatatnncctcatgattngtcccctntgcttagaacgacgactggnacnntacaggctgctnnnaagactcacagtnatggnacacgctagggcanaantacgactttaagggtaccagctcgctgaganggacttaccnaacgggtacgnccngcgagaaagtactncgataagggtgcngcnctagagaagacttacnctaaggggaccccatnatttaacatatggaccttgttcctttgaagcatntnncttgnganngtntntgacctttttntntgaccnngtcattcnccgataggagtctctatntttactctgatactantncanncannnatgangtccntatttctatcgtacaatagttatattttaatgacctcatacctaagntccttnntcgntantgtagctttcatttctgttatcgctgtntgaataatntgattaantaganggttcgtgccngtaaacattatgtactaaatcnnncttaaaatcnttggtctntanttntangagttgctgtngctctaattcttgggctctctattgantgattcactttgtgngaacagncatgaactnncggaatgaagtcanttggaggatctgatgnanctttatatatactgcaanagggcccttnccaattnaattcntttgttagantanaaa

SEQ ID NO: 22169 - DNA, 700 bp, Homo sapiens
  misc_feature 1, 9, 663: n = A,T,C or G
nacgacagnaaggggtttatattgacaggttacatgctcatttagataatttggataatgaagaaaaatgaagtttaaaaatcaactcaaatcccaccatctggaaaaaaaactaacaaacatgaattgagcttcatttcagagatgacagtgtctcactttttttacctctctctttctgtttctttggtttcatcgaatttggagcctctcttgagctttgatgtcttttaagatgcccactctgtttgctcttatagatcattcgttctttctatttgagtccctaaagtattattgggatttctgaagcttaaccaaaatatgtctcagtattatgcatttcctgaaacatggagtgttctttcagtctgcgtatcagtttgttctagctcagggaatttttttttaaaaaagattaagtttggctgggagcagtggctcactcctgtaatcccggcactttgggaggctgaggcgggtggatcacctgaggtcaggagttcaagaccagcctggccaacacggtgaaaccccatctctactaaaaatacaaaaattagccgggcatggtggtgggcgcctgtatccccactgctcaggaggctgaggcaggagaattgcttgaacccaggaggtggaggttgcatgagccgagacacncattgcactccagcctggcacaagatgaactccgctg

SEQ ID NO: 22170 - DNA, 666 bp, Homo sapiens
  misc_feature 511, 547, 609, 630, 642, 648, 657, 661, 663, 666: n = A,T,C or G
ggggagcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttanctgttgagataaaagagcttcaaggacaactagcanactacaacatgttggtagataaacttataccacccctgaatggagaagtatgatgattcatntgcttaagctcaaatgatcanaacacaagttgntgtctntttctgaanacancnaan

SEQ ID NO: 22171 - DNA, 716 bp, Homo sapiens
  misc_feature 525, 529, 536, 555, 578, 609, 610, 629, 639, 674, 679, 681,683, 688, 695, 703, 705, 706, 707, 710, 712, 713: n = A,T,C or G
gggtggcttgatcacagctcactacagccttgatctcccagtctcaatcaatcctcccacctcagcctcctgggtagctgggattgcaggcgcatacctccatgcttggctttttttttctttttgtagagacaaggttttgtaccatgttgcccaggctggtctcaaactcctggaccgaagcaatccttccacctcagcctcccgaagtgctgggattacaggcgtgagccactgcactcggcctctactttttgtttacatcttgtacttaatgctatttataagctgcttgtggtcatttgagttcactgctcctgccctgtgactgactctctccaaccttttccaccgagcaaacaacctttcccacactaaagcatccagtcacctttcctttatacttgctgactgactgcatttcaactaggttgttacttcaagcaaaaacatgcattttttactttatctctggtagtgaaatgaaaggttcattctctgattataggaatctcaatttgttanccangaagcanggggaaactgaggatgaantgtggaggaagagaggaatccanaacgcatgctcaacatgatttactgctttcnngtgacttgggatgaagganttggaaatanaaggcctttaccttctttgaaggaaagcaaggttncctcngngntatanaaggcanttgaattntnnnaancnnggg

SEQ ID NO: 22172 - DNA, 686 bp, Homo sapiens
  misc_feature 6, 33, 34, 38, 96, 110, 113, 128, 134, 135, 140, 142, 157,158, 167, 177, 181, 201, 259, 270, 280, 333, 340, 341, 346,427, 430, 438, 459, 467, 488, 503, 507, 514, 528, 586, 604,626, 628, 650, 658, 669, 674, 683, 686: n = A,T,C or G
gtactnctttgtccacttgctctgtgactgacnnatgnggctcagcttgattccagagctggcacttgacccgaggtcttctctgcctggcacagngatacatggtgtancgnatccatgtatgttgnctctgnntgtgntnctcatactttcctanngggctgaanagctcactancttnttggttccacttggcatgantatagatttgacacctgccagactcatttttcttctgccagcctagagctcccagttnttgactttgantctcttgatnggaattgcattttttattccacattttttggtgtctctgggactagagtatangagtttnntccanaaaaaaactgattaaatctccctactgacattcacctgagctgtatgactctgtctcggtaagacatcagattttgggggntangatctttngaatcctgactggaaaatatnctagactngagatctgtcagtgtctcatncaccttaatccttgntctnagtcagnctgccagaccatgnaatcataagcattctatagatcacaaaggtacttgaaagataaatgaagaacaacgantgttttcactctctggangcttgagatacattccttgctncngtccaattaagaaaatactatntttaaganacgataatctntcttnctgaaaaanaan

SEQ ID NO: 22173 - DNA, 605 bp, Homo sapiens
  misc_feature 431, 474, 493, 498, 503, 505, 510, 513, 519, 520, 540, 550,561, 584, 595, 596, 598, 599, 602: n = A,T,C or G
caaagttgtccacagcctactcccgagaacctgtgaacatgttaagttacatggtgtattagtccatttcacactgctgataaggacatctcctagactgggcaatttacaaaggaaagaagtttaatgacttacagtttcatgtggttggggaggcctcacaatcatggcagaaggcaaggaggagcaagtcacatcttacatggatggcagcaggcaaaaaaaggttgtgcagggaaactcctccttataaaaccatcagatcttgtgagacttgttcactgtcatgagaacagcatggcaaagacccgcccccatgattcaattgcctcccacagggtcccttcacaacatgtgagaattcaagatgagatttggctgtgtctcacccaaatctcaccttgaatgtagctccatatttccatgggtgngggaggacccagtggagatattgaatctggagcggttccctanctgtctatggtatgacagnctccnaattnanatttntangggttnnctttacttgctctatttttnctgcccatgnaaaatccttgntttctcttctgcctatggggctnccacttggganngnnctngcc

SEQ ID NO: 22174 - DNA, 441 bp, Homo sapiens
  misc_feature 1, 9, 46, 156, 190, 247, 257, 281, 286, 289, 323, 341, 358,361, 370, 371, 376, 380, 402, 403, 406, 420, 421, 427: n = A,T,C or G
nacgacagnaagggaccctcatggggtgaaggcagtcaccaagggnaaagaggtgtgctgtggctctgtgattcaccttggacccactttatagagaattggagcgaatacaggctgatgaagtgattgcaattctggatcaagaacagcaagggnaagcatgaaactggaatattcaaccccttaaagnatgagctataaaaatgagaaagaatgttcctatcaaatatttattttaaaaattggntaatcctttntgaaaaacctttttttttttttgncccanaancccttgggttttaaaatttaaccagggtttaatntccagttcattaaaaaantttccccttttcttttnccnaaaaggaannctttngggngggcccccaaatttttaaaaannttntttttttttttttnnggtttngggggggggggggg

SEQ ID NO: 22175 - DNA, 787 bp, Homo sapiens
  misc_feature 625, 731, 758, 760, 769, 778, 782, 785: n = A,T,C or G
gggctgcactgcctttgaaatactatttcagatctgccaaaataaatggcaaactcattaacaagaaagcagggtggggggtgcattcatccctgccttcctgagtagtctattcacccaaagacaaaaggatgaccagcttccatcagggatattcaaagacacagtcaccctgccatgcagccagaggctggcaaaggtccaatcccctttttaagaagcttgttggatgagctctttaaacatacaaccacaaaggaaaggcacagccagtgtgagggaggctgataagatgggcattttgtttgcttcaaggttagaatgcaacttgtctatcaaaatgtggttatctgacctccacaatgctgcagtccagttaaatactgcaaatattcatccaccatttactatggataaaacaataatgtgctgtggggaatccaattacacagacacacacacacccaagaaagtgcacacacacgtgggcacacacactgctcctgctgcctcagagcttccaggccggcaaggagtaagtgcaaacattagtaggtaagtctgctaccaggaagatatgataagtagatccacagggtacaacgcagtatgatagaagcaacanggtgagatgagtctgactcctttcctataaactgatatggatagttatgaagactcgctgatgaatctatatttccagtgtttctttccaggatggactttttctnttcatgtcaaaaaaaaaaaaaaaaccngngcctttttngaaccaatnaaanttnaa

SEQ ID NO: 22176 - DNA, 882 bp, Homo sapiens
  misc_feature 510, 587, 614, 665, 695, 720, 761, 762, 768, 779, 786, 789,790, 800, 805, 809, 810, 826, 828, 838, 839, 846, 855: n = A,T,C or G
gggacatgtggtatggagggtgagacagcacttaccagaatatgtgtggagtcctgtatgacaggcatagttttgggtattcataagtcaaggatgaataagacaacagaccttggcttgaagtgccttgcagcctggaagaagggagattgtcaacagctggattgagcatcgtccaaggaaaagagtgtgtacacagtatgaatctaaggaaagtatattcagctttgtgaaacggagggggagtaataggagagggagtactcttgggtcagtttttgaagtagtagtgaggactccctggacaaagaagagagcatttagacagaatgaacatctgtctacaaaggtgtgaacttgtgaaacaacctaaactgccttgggagtggcccattatttggtttcgctggaagttggggtgctgaggggttggcagcagtggtgaggttgaagtctttcttgtcacatgtgcagtgtgtgtcttcctcctctcccttgacccctaccctncagaggaaggggcagtatttcactgccacctgccaccagggtttaacaggggagtagcagggagctttagggaggangggattgagggattttactaagcagangcaggtgatagattgagatttcaaagtcagacttgagccagtgaggaatanattacatgtagagcgttgtaggcgacccanacttccagggatgctagtcccaatngaccccttactggttcctttatggaggtccaaaggttcacnngaaatntaaggctgagngaattgnaanncagcctctgnataangaannccattgaaactgaacntnttttgggacnnggaggtnacttctttnaaagtaaccaaaggggacaaaaaaacc

SEQ ID NO: 22177 - DNA, 888 bp, Homo sapiens
  misc_feature 1, 9, 720, 722, 751, 756, 773, 776, 791, 796, 815, 828, 842,848, 867, 870, 881: n = A,T,C or G
nacgacagnaagggagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaccattatctgatcaatttggatttttaagtgtctaaaactcactgagtcagcatggagctctgcttgtatctcccctttggaggcaagatggaggaggcttgagttagcgtncnacagcctggcacatagtagactctgcttnaaagnttttaaaatactggccntgnccccgtgtcactctngagcngagtactgaccaggttggntggggactggtcncccctcacggacanggcctntaaaaaaaccggccttctntcnttaaatgtggnccccccc

SEQ ID NO: 22178 - DNA, 742 bp, Homo sapiens
  misc_feature 1, 9, 651, 683, 684, 708, 710, 731: n = A,T,C or G
nacgacagnaagggggaacaggcactccatcaattatgccacatgctttcgcccaaagcaagtctcaaggtcaagccagttttcccccgatttagcagtagggaaatagaaggagctacagtcatgttgcaaaaggatgtggatacagggaaggtgaagaattgtggccacttttgcaatcaatctaccccactttccttctgagaagctggttgtttccagtgaaatcaaagccagctgaaacctggacaatcaagtagccaaaaaccttccctgttagacttcagcatattgaatttggcttgtaccaatttacagagccagttgttaaacacagctattaaactacataaacttcaatctaaatacattatattgaaaaaagatgatcatgttaatactgtcacttcctactttttattattatccatgttctcaaagttatttataatcattatatccaaatggtaggaatgctatataatgatgctactgacatctctgcccaaatctgtgctcagtgacaccatgttgatagattgaaattggccatgagagtatttacacaagataaattgacaaacactactaattagggcttttttcttcctttttttttttgatagctgcttgtaacattaccacccatcntgcctgttgtgtgatggagattgaagcccagnnagtatcctgctttttagctgagtnanattacttatgactttatgggncatggttgagg

SEQ ID NO: 22179 - DNA, 232 bp, Homo sapiens
  misc_feature 131, 139, 145, 150, 162, 165, 172, 176, 186, 188, 191, 193,195, 211, 217, 220, 225, 229: n = A,T,C or G
agggaacatagtttttgtccatagagttgttttatttcaaaatggtttgtgaaaaccaaaacacatattaaaacagtgatattaactggttgatttttcttctttttttttttttggttttggttttttgnaaacgganttttgntttgncccccaggttgnagngcagggncgtnatttgggttnantgnancntttgcctcctggtttnaagggnttntcccncctnacc

SEQ ID NO: 22180 - DNA, 694 bp, Homo sapiens
  misc_feature 648, 662, 692: n = A,T,C or G
ggggtgcccctttcccctgtggaccctacgccagcctcagcagaaggggcccagggtcccttccttgccaccaagagcaacacgcatggtggggccactgctcttcccagcattcccgcataaacagaggaggagctgggtggggtaaggagaagggcaggggaaggagtgtgaagaggagaagcaggtggaagacagtgagaggaggctggaggaatgtgggagtaggggtagggagaatactgagaaacgaggaggctgtgcagaaaggcagcactggtctggccttacaggacacagccaaggcacaggaagacagcctgggtggacagggttagttcccagaaggaaatgtgggaagaatgtgtgtcaagcaggactcttggctcaaggagcaaaatccaaagtttatataaaaagcccagaggtgggccaacgcggtggctcacgcctgtaatctcagcacttcgggaggctgaggcgagtggatcacttgaggtcgggagtttgagaccagcctggccaacacagtgaaaacctgcctctactaaaaatgcaaaaattagcccggcacaatggtgcacacctgcaatctcagctctcgggaggctgaggcaggagaatacttgaccggcaggcggaggtgcngtgagctgaatcanccatgcacttttttagacaagcagatcctncc

SEQ ID NO: 22181 - DNA, 879 bp, Homo sapiens
  misc_feature 572, 613, 680, 684, 706, 709, 729, 765, 767, 768, 773, 781,790, 800, 802, 817, 828, 842, 851, 855, 856, 858, 868, 869,872: n = A,T,C or G
gggatttagaatcagtgcaacccacggttaaaaaaaaaatgtagcagatgaattcaacctacaggaacattcttaccattttgttgatattttagctataaaggtaagtagagagggaactgggagagtcatgtaaagaactatatcagtatggaaatatccatagtgggtcagtaattgagttaaacaattgaactgtagccacattcagcatagtgcctccttgttatacagtttttctatccctagcaacagatatgtgattcttatttcaagaaaaataagatacgttacatgccagaagattttttgatgacagtactccctcctattcttcattttttaaaacaacaaccaaattggtggggaggcagccaaaatttgaggtaccaatgcctctcgaacagatgtcgcaccattattttttagctcgtttagatgaataaacatgttaaactgtgaagtattacattttagattttttcattaaaaaaagagacaatctgtttactgtcctaattgagacaacaatccttgtggttgccagttttggcagtcataacaatgaactntaatatttggaccaatcaagtaaatggtactatgaaggctntagcatgtgtaagttctgtttcatgggccccatcttagtagacatgacggtaaattttatgatactntgtncctctttcaaaagtgagacctnaanattaaacccaatcaattttntaacaaacggatgtttagtgaaaaatcccatgaatntnnctgtnaacttgcnagtaaattngactgaactncntgacttccaagacangggccatggtntttttaaaaccctnacgtaagtnatgnnangcgtaatttnnctntctttaa

SEQ ID NO: 22182 - DNA, 482 bp, Homo sapiens
  misc_feature 325, 379, 395, 403, 437, 445, 448, 452, 461, 464, 475: n = A,T,C or G
tgtttatattatactggatgtgtaaatgttgtgttaggggtacatttggagaatcaattcaaaatatctagataacatgatgaccagataacccatgataatagtcatttctcgtcatgtaaaaatctgtcactggccgggcgtggtggcttatgcctgtaatcccagcactttgggaggccaaggcaggtgggtcacaagatcaagagatcgagaccatcctggccaacatggtgaaccccatctctactaaaaaatacaaaaattagctggatgtggtggcacacacctgtactcccagctactagggaggctgaggcagganaatcacttgaacccgggaggtggaggttgcagtgagcccaaatggtgccctgcnctcagcctggtgacanagtgaganactctgtctcgtaaaaaaaaaaaaaaaaccctgnggcgtttntcntaanccacctganaancttggtattgnccccccc

SEQ ID NO: 22183 - DNA, 716 bp, Homo sapiens
  misc_feature 18, 641: n = A,T,C or G
gggggttccatccccagnagtttctgatttagtagctctgggtgaaccagggaagatttgcttttctgatgtgttcccaggtgttgctgatgctgctgcttgtcctgggacttcattttgagaatgactgctcgatttagaacttttgtcattcttatctcctctttcctcttaatctccctttctcatcctcctcctaatctgctgagagctaagaacacaaagatatcttttagtacctctttttttttctttttttttaaatgagaaaaaggctttgagtcaaggacttgaattgtttcctgtgaataaggtacatgagctttatattatcctttggctgaggctagtatcacttcatttctggttaatgtctgtgttctgaataactagagttattgttgaattcatgaatataggagttgccgatgcttagtcatgaataaatctgggaaacggattccttccaccttggtaatgttagtgagacaaaatataaattagttactataacttttagtttttcaaaatacttaggaaatgagtagcataagtactgtggctgtttaaaatataaaaccctcaagcagagttcatggatggaaaaaaaaacaaccctatggttctggactagtaatcanaatctttatttacatgtacccttaaatgatgttttaaatgttacaaaaatcactaattgtcctgaaactgtctgc

SEQ ID NO: 22184 - DNA, 751 bp, Homo sapiens
  misc_feature 675, 682, 700, 708, 715, 720, 722, 731, 746: n = A,T,C or G
gggacccaacacacatgcatttcctccttgccttctcagtattgccatcgtgaaccagaattgtcacctccaatttaaacagtgaaggcctttgttaggaagaggggcagggtgcagagggggatggttgctttttctaaatcacagctctgatcaaatccctcctaagcagaagccttccaggctcccctccataaggctccaggtgtttacttaccttgcctgtcaggggcttctgcagcttgcttcctacctgctatctccactcctctccaaaccaccatatcctgaggcttctagaaagcaaactctggcggcatggggttaatgggtctgtgtacccaagacactgtacctgggtgctgtcatctgcctgactgaccttcctgtgtcctggtccgatggtgtctttgatcctatagctaagatcaagacactgaaaatctctagactcaagtctgtgcttttgctgggataaagtttgtgttgagtacatctaggctgggtgtggtagctcacgcctgtaatctcagcactttgggaggccaaggcaggtggatcatctgaggtcaggagttcgagaccagcctggacaacatggtgaaaccctgtctctgctaaaatacaaaatagccaggtgtggggaggcgcctgtatccagctctcagagctgangcagganatccttgacctggagcanaggtgcangagccanacgtncnttgcctcanctgggttaaggagcntgctc

SEQ ID NO: 22185 - DNA, 744 bp, Homo sapiens
  misc_feature 672, 728: n = A,T,C or G
gggggagggtggggaagactctaaatctctatcttacatcatacacagagaaattaattctacatgaattatagacctaaatgtgaaaactaaaactataaaacttctaggaaaaaacactggcaaaaatttttgtggccatggtaggcaaaatacgtcttggacagaaaataagcattaagcaaaaaaggagaaaaatcgatagaatagacaatcacactaaagccttttttaaaaagatgcttcagaaaataaaaaggtaaaccagaaacctaaagaaaatattcactcaagttggagccacaggggtcttggccttcgaggagagcctgaggaagaagcagaaccgtggacgtgaagaaaatgatgaactgaccagaatccgtgaggacctcatttaagagagagaagatctgtcacagacgcccctgaccaactgccagtccccccttattctgtctgtttgattctctctggtttcatattttcctctctgttaacctccactcatttttgaactagattgctttgaaaactaaagtttccctgaagtctaaaaaaaatattaattatacttacatctgacaaattataaagtgtacaactcaaatgacctgcatttttttaagtggccaaagatcctcttcccaaagatttaaaataccataaccnctaagatgtcatgattagactgtctgaggaatggaagtaaacccctgactccttancattcatgtactaaag

SEQ ID NO: 22186 - DNA, 668 bp, Homo sapiens
gggattcactagcatttgaaaatgaaggacaaattttgctcccttctctacaccaactttgtatgccatgggtttttaaaatgtgaaccctgcccatatattgtttctctgggcaccggccttcagtcatctaactcccttgcctcaatgaggaagtgaaactccagggctgtggagaccatgcagattccctgaataatcggaagggctcaccagtgatttcctgggtccccttcaagccttggctctgccaagccacagcttagctctgccatagcctctgactacagacagtcacagaggtttcattctccctcacctgtgcatgcacattgtcttgtctgttttctcttgctataaagggatacctgagactgggtgatttagaaagaaaagatgtggcctgggacagtggctcacgcctgtaatcccagcactttggaaggccgaagcaggtggatcacctgaggtcagaagctagcctggccaacatggtgaaaccctgtctctactaaaaatacaaaaattagctgggcatggtggcacatgcctgtaatcccagctactcgggaggtgaggcaggagaatcacttgaacccaggaggcggaggaggcagcgagctgagatatgccctgactccagcctggtgacagacgagactcatctc

SEQ ID NO: 22187 - DNA, 708 bp, Homo sapiens
  misc_feature 659, 690, 707, 708: n = A,T,C or G
ggggctcatgcctgtaatcccagcactttgggaggctgaggcgggtggatcacttgaggtcaggagttcaagaccagcttggccaacatggcgaaaccccgtctctactaaaaatacaaaaattagctgggcgtggtggtgcatgcctgtaatcccagctactcaggagactgaggcaggagaatcgcttgaactcaggaggcggaggttgcagtgagccgagatcgtgccattgcactccaacctgggcaacagagtgagactccatctcaaaaacaaaaacaaaaaacaaaacagaaaactgtcttgtattttggctttgtggtcagtttctgaatccaaagttaagtattttttctatatttcacagtccatgagctgtttttaagtcttacttttccttttcttagaaatgttagtaacaactagggccgggcgtggtggctcacgcctgtagtcccagcactttgggaggccaaggtgggtggatcgcttgagaccaggagttagagaccagcctggccaacatggtaaaacctcgtctctactaaaaatacaaaaattagcagggtgtggtggcgtgtgtctgtaccccagcccttggaggtaaggaccaggatcgcttgaccaggaagtggagttcagtgagccagatcgcnccctgcctcagcttggtgacagaggagactntgttcaaaaaaaaaccnn

SEQ ID NO: 22188 - DNA, 628 bp, Homo sapiens
  misc_feature 548, 566, 594, 602: n = A,T,C or G
cttttggaaaaactcttttgctactgctattgagaccagagaacattttctctaaggaggcctcataaatgataatagtattaatcactaacatttaattcagtactttgcttccgttacctcatttaatcttcatagaaaactggtagttattctacttttaaagatgagaaaactgaagcacagagaggttaaagaaattccttagagtcacacagctagtaagaagcagaactgtgatcccaacccaggtctatctgggtccccagccagggcttttatactaaatcacatcaattcttgcaagtttccatgcagtgtacactggaatgaattggaaagggattttcctgtttctcaccactccccacaataggctgcaatgaaatcattccaggcagaattaggcaacgacaattccattggtagtcaatctaaccaacagtcaaggatggatgaagctggaagtcatcattctcagcaaactacacaggaccaggaactaacaccatgtgttctcctcatagtgggagttgacatgagaaccntggcccaggaggaacatncacttcaggcctgcctggactggggcangggagganacatttgaaaaagctatgctgggggc

SEQ ID NO: 22189 - DNA, 757 bp, Homo sapiens
  misc_feature 546, 589, 601, 606, 623, 626, 639, 657, 662, 675, 680, 697,704, 722, 729, 733, 745, 751, 755, 756: n = A,T,C or G
gggccgaaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggtattctcatgaccaagcaagagctttccttcagcgataaaaaggaggtgtgcaaggtggttttacacagactcatccaggattctaatcagtaccagtttggtaaaaccaaaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgattaattccagcagtacttccggggtcagcaaactgtgaggaaagctntactgcagtggccttaaaagaagctgggcagcataatcttcanaagcactgccgngggtntttggtcgcagcctatntanttgatcgcatggncccatccatgcggcctcngccgngattctggcaggnggagnttcaaagagctggaganttaggtnggatcctcaaaatacccnggcgtgntgcnaaccaattcaanttccanaacnnt

SEQ ID NO: 22190 - DNA, 702 bp, Homo sapiens
  misc_feature 1, 638, 687, 693: n = A,T,C or G
ngtctcaatattcagtatgtcttttttatccaacctaaattgtgaatcctttcttttggctggtttgaatttcattagggagggtgtcacccactgtgcatgagcacagtgacacacaccctgtctggaaagattcttgcttttttattttattttattttattttattttattttattttatttttactagtctcactgaaggtaaaagatttcttttggaatcaaagtagatttcattttcctttgtgatgtcattagaaatttttagcctttgtgtcaatggaaatggagagaaagaaagttcatgatgacatcacaagattctgttgccttgaggactttgggcaaaactaagtaaaatgcataattcccttgtgtgcgtgtgttccccattctgctacgaagcagtcaaaatagcacatcttatgtcttcccgtgagctacaaggctgtctctcagagccccattgttccataaatgcatgtcagagtctaccacagtctggtctacccttatttagctgctgttttgtcaatgtacttggaagaacaattaacatttgggattcaacgtctgaatacaggcagtgaatagacccaagcatataaaagattcagacgccagggtaagaaacanaacctatagttggtgagaaaaaagaaagcattttacaattgctcagtgnttacanaaactgacc

SEQ ID NO: 22191 - DNA, 785 bp, Homo sapiens
  misc_feature 10, 632, 661, 673, 686, 730, 735, 757: n = A,T,C or G
agacgacagnaagggggctgaggcaggagaatggcatgaacccaggaggcggagcttgcagtgagctgagatcgcgccactgcactctagcctgggtgacagaggaagactctatctcaaaaacaaaaacaaaactcatcatgcgatttttatttggaaaaaaattttcctttatgtatcctattcaacctaagccaatatgtcatccctcaaagggaactttgagcattcgctctgcactgtagaactcaggctggcccagcatgctgtttcagacagctttttctccatttccactctcacttcacagtgcagtttagattgctacccagtacttcccaaagcaagtgtgtttttcttttcttataccttttggccattattctacatcctgaagcattgtctttctttattattttatttatttatttttgccagacaagatcttgctctttggcagaaaaaaaatgataacaaataaattaggggtttaaattagtataataacatctgctgaggaataaatgaataaaaataataattaaaacaagacagtgcttcaggatgcagaataaaggctggagggcagtggtgcagtcatgtaccttaaaaccctgagtcaagcagtcctnctcagtggctagactacaggtgcatgccncatgcccgctancattaaacttttngagccggcgtgatgccatgcctgtatctagccttggagctgagnggcanatgctgactcagagtaaaacanctggcacatgggaaaccgtttctaaatc

SEQ ID NO: 22192 - DNA, 707 bp, Homo sapiens
  misc_feature 594: n = A,T,C or G
gggatcttagggattacttcctatcataatgtcaggcagcagttaattccatattaatatagaagcacacgaggagtacttgataaactactctgccagttttttattgaatacggacacaatcgctttgaaagagaaaatcaagtgatgacatcggaaacaggattattagagagctcctgactgagtaaagaaaaatctaaatgacaaatggccggtcgtgcaggtggagattgcgttctgtggttgcctgcgccatccctgagagcatccagagaaaacagggaaaaatgtccactgcaaccttccacccgccgcctgaatgtgagggctgcagccacgtgtcacctgctgctgtggagacagaatctgagccgcacacctgagaatttccatccacccctcagcagccttcttcccatgtctgtcctgttggcagctaacatgtttagtatacagtccaaccaaagactgcaaataataacctcaaagaagctgtggcaaagagggcagagatcaaagtggtctctgtgggaaagtagctcttgcagggatccacctcccaaatgtggtcagcagtagcagtgacctcangacagcagccccaccgcagcgcagccaacacgtcagagagcacctggacctcaccagatgccatgtgcatcagagaagaatgaactatgttaactggcatcaactaaaactcg

SEQ ID NO: 22193 - DNA, 735 bp, Homo sapiens
  misc_feature 2, 4, 18, 21, 25, 27, 32, 40, 69, 97, 98, 324, 539, 734: n = A,T,C or G
ananttgggcccttgagntcncttntnctttngggccgcngcggcctacggcctgcgaggagtacgacngtaggggggaagtgacaagctaaagcannagcccagcagcattccagcaaaatgcctgtgcatgctttgctggcagtggccagcggtcatgactgacaggacaatagccacatgaaaagcagaacttcctttttctgatactggttctgacttgctctctgattactgcctgaggctggttcacctactttttttttcaattctaagagctgcgttgtgcttttccaacgcattcatttttgcttgctttaaatnccaagtaatttctattgtctttaaacaactgcctacctaaaataattattaaatatatagctaaaacactaaattaaataaacttacattgttttccttgctgtaagaattctctaagcctttcttattttaatatgcatcatgaacctccagttgaggcaatgtgcaacacattttgagagacatgatctacctgttggaatcttaacatttanaacagatatattgatcagtgtataatttttggattatcaaagatgggaataattgagctataatatataaaataagaggatttatatatgtttgtttttttactccccatttcacctgctacttctttatggataacagttatcccacttgatggaatttttctcttttcatccattacttttttatttaaaggnt

SEQ ID NO: 22194 - DNA, 734 bp, Homo sapiens
  misc_feature 2, 4, 10, 28, 34: n = A,T,C or G
anancttggncccttgcgctcgcttgtncctttngggccgcagcggcctgcggcctgcgaggagtcgacagtaggggatctacaaaattctggttctggtctcggtgaaaacgataataataatacctgctttatataattctaggaaagaagtgtgtacatgaagaatgtgatttctacccataagaaactgaatctaggccatagtgatatattttagaatgtaggtttgttgttcataggtacaggttgtgaaggaaattattataaggactcaggagataattctagtgcagaagaaaaggtcaaatcttcaaaggaagcatattagttcctaagccacagaattctcagtgtgtaccactcttgttcaaagtgtctaaatatttccacaatcataaatttatttgtgggtgtccaccttttgcatctggatattaaatttacacatggcttttatagctggaatgaaatccagatttttttccagtgataccatataaagtcttaaaaaatattgatttccttctttttggggggtggtcagacctggatgaaagcatattgctcctattgctagagaaataatccattatgtgtttcagatactttaggtgttgtgcttattatttacattatataataacactttattagggttctgttatattttgtaataacctctgactgggatcagcacttgattatgatctacagatagaaataacgtatgg

SEQ ID NO: 22195 - DNA, 619 bp, Homo sapiens
  misc_feature 578: n = A,T,C or G
ggggaattctgattctctaattacaagtggacttcagtgagttaaaaatacagacatcagctggaacttgaatggagggtaggggctttgctgggagttgcctggtgagggaaatattttaaaaagactttgagtaaaactgttgtaagaccaacaggttcgtatgcccatttgcacagtaacaaatcatttgcagcagagaaagagtttaatcattgcaagtgcagatcagggagataagaggaaaccctcaaatccatctccctgaaaggagttctgggctgggatttttaaagggattatgaagagtgagggtctggaaatttgggattcttgattggttggagtaaggaggataaaatcatcaggttttggaaaatgaattatttggtaagtcagcttctcttggagccctatagaccagcctggccgtcagtagttttactggtatgcaggacctgaaagaatatcttaaaggaaaaactgaatgtttcataatgttcaagttgttatctgtacagcagttgaggggaactatatcttgtgtaacagggtctatgtgattctagaacattcancaaacatctatgaggaagcaggtcagaggaagctgacctat

SEQ ID NO: 22196 - DNA, 607 bp, Homo sapiens
  misc_feature 7, 8, 9, 10, 11, 12, 14, 15, 21, 32, 35, 38, 39, 41, 59,66, 77, 80, 538, 539, 543, 545, 547, 549, 551, 553, 555,563, 567, 573, 574, 580, 596, 602, 605: n = A,T,C or G
ttttttnnnnnnanncaacgngggtcgttaanacntgnnantgttgcttttggccgcancggcctncggctgcgagnagncgacagtagggggcccaccctttcaaacaaatttggttgtagtttgctataataatatactaaatctatgtttatttgaaaggagcctttaccttttaaagcaaaatgcactttccttaaatataaaagtaatatggtttactttaacatttaaagttcaccttatctggggaggcagaaggaattttcatagtgcttactgtgttaattattatgagagatgaaccatatgtgataggtaaagtacatgtgtaagaaagacaaaaaaattttcctctttttataatccatgaaattcgaaaacagaaaattattcaaagaataggcaaatgtcatgacagaacttagtgtgagcaagtcattgagaattaaaatctaacttttcaggtcagagagccttgaaatacttacaataaagttataaaggcctaggtatttttctttcttttttttttttnnaaangnantntngntntgcccccnaggntgaagnncagggncccaaaggcctaaatntttttntanag

SEQ ID NO: 22197 - DNA, 670 bp, Homo sapiens
ggggtcaaactatacagctgtctgtcctacagttttttattatggtgtagctgtatttaaatacaaagagggccaggtgcagtggctcacacctgtaatcccagcagtttaggaggccaaggcaggggatcacttgaggtcaggagttcaagaccaccttggccaacatgatgaaaccccatctctactaaaaatacaaaaattagctgggcatgatggcacaagcctgttatcccagctacttgggaggctgagacaggagaatcacttgaaccctggaggtggaggttgcagtgagccgagattttgccattgcactctagcctggacaacagagcgagacttcatctcaaaataaataagtaaataataaaaataaaaagagatctaattgcatctgtcttttaaaattgacttatcttttaagttatttgacatgttttatagtttttataaaagtcgtaggaataggaaaaggatttacatatatcccttttcgcatctgaaagctgactaaataaccagtattacaggctggtcatagtggctcacgcctataatcccagcactttgggaggctgaggtgggcggatcacctgaggtcaggagttcgagaccagcctggctaacatggtgaaaccctgtttctactaaaaatacaaaaaattag

SEQ ID NO: 22198 - DNA, 746 bp, Homo sapiens
  misc_feature 2, 13, 17, 18, 29, 40, 42, 58, 60, 63, 71, 95, 512, 525,530, 535, 540, 545, 555, 606, 623, 634: n = A,T,C or G
antacttgggcgntaanncttgcttgttncttttggccgnancggcctacggctgcgngnagnacgacagnaggggaaagcatttgagtttcagnggccatgaattgatgaattgcaagtttgtgccccatagctgcacagactgcctgaagttacatttagagactgaaatcactgcaccttaaaaacaaaagattgagctgcactgtattcctgtaagtcaaagctttctgtaccttcttctgtgtttctgtgaccaacccaaaaaaggacaaaaacattggtaacatagtaaccagacatgagtaaaaatttgaatgtccctggagaaatatatgtttaaatgattttcttcttaaaaaaaaaaagttgttggtctcaatattcagtatgtcttttttatccaacctaaattgtgaatcctttcttttggctggtttgaatttcattagggagggtgtcacccactgtgcatgagcacagtgacacacaccctgtctggaaagattctngcttttttatttnatttnatttnatttnatttnatttaatttnatttttactagtctcactgaaggtaaaagatttcttttggaatcaaagtanatttcattttcctttgngatgtcattanaaatttttagcctttgtgtcaatggaaatggagagaaagaaagttcatgatgacatcacaagaattctgttgccttgaggactttgggcaaaactaagtaaatgcataattc

SEQ ID NO: 22199 - DNA, 641 bp, Homo sapiens
  misc_feature 587, 590, 601, 609, 635: n = A,T,C or G
agcgcgtcagctgattggcaataggctgacggtggggggagtagataggggaggcagatgcagttggtgggtatggctggtacttccaaatacagccaaagtttatgcacttaacatgtattaggcacagcgctaattactataagtgattgatttgacttccccacatctttatgaagttgagtatgttattcctttccctcttttatttacttttcgatttatttttatttttttagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattattttttaatttttgagacagagtctctctctgttacccaggctggagtgcagtggtgcgatctcagctcactgcaaccttcgnctnccgggttcaancaattctnctgcctcaacctcctgagtagctganactacg

SEQ ID NO: 22200 - DNA, 757 bp, Homo sapiens
  misc_feature 2, 10, 13, 18, 20, 27, 29, 34, 42, 58, 656: n = A,T,C or G
antacttggnccnttgangnttgcttntnctttngggccgcngcggcctacggcctgngaggagtacgacagtaggggactttttttcctttggttagatatccagtagtgggattgctggattggtagttctacttttagttctttaagaaatctccatactgttttccatagtggtactaatttacattcccaccagcagtgtaacagtgttccctttcattacatccacaccaacatctattgttttttgactttttaattatgagtcttcattattaatagagttcattccaaggtcttttttatttattgttttgatttgtgccctcaagctgtaatggcagacaggtaaagactgcaaatccttaaagaagaaaacaaatggatattaaaacagaaaaaagagaaaatgctaaattgtgaagaaggttaaaagacaagagaggggccgggcacggtggctcatgcctgtaatcctagcactttgggaggccaaggcgggtggatcacctgagatcaggggttcaagaccagcctggtgaaacattgtttctactaaaaatacaaaaattagctgggtgtggtggtggacacgtataatcctagttacttaggaggctgaggcaggagaatctcttgaacccggggaagangaggttgcagtgagccaagattgttccactttactccagcctgggcagaagagcaaaactctgtctcaaaaaaccaaaagcaacaccaccaccaccacacc

SEQ ID NO: 22201 - DNA, 743 bp, Homo sapiens
  misc_feature 2, 14, 18, 30, 43, 50, 60, 63, 70, 75, 219, 223, 225, 234,237, 246, 249, 250, 253, 256, 258, 268, 270, 272, 282, 285,291, 296, 298, 300, 308, 310, 316, 319, 323, 328, 332, 342,348, 363, 378, 391, 393, 398, 403, 404, 416, 418, 421: n = A,T,C or G
  misc_feature 433, 436, 439, 447, 450, 455, 474, 476, 479, 485, 491, 493,496, 508, 514, 526, 528, 536, 539, 548, 550, 567, 573, 578,582, 586, 593, 599, 609, 639, 641, 682, 692, 704, 706, 719,720, 726, 731, 739: n = A,T,C or G
antacttggttcgntaanccttgcttgttncttttggccgcancggcctncggctgcganagncgacagnagggnatgtattgaaaacttggccattttaccccattcctatgaatgaaaactatttggtgaatcagaggatagtctgaattgggatatgaaggccagtataagtgtcagttagcaaagtcagctctagtttagttttttttttttttntttnanggcgtaccnttnctaaaagtntannttnggnanccttgtaccntntnaaaaactttnaangggttnacagntntnggcaaatngnctaatncanaaanctaancttnggttcatgtnttcaangtctaaatgaaaaangggaaaataaaaaanctaaaaatgaaangngattncatgnncttctccttttnanctnttataataaatngancanatttgatnttnggggnaaatccactcaggcaaagngncanaggctnggttgncnttnaccctttagggncttagnggagttaatgananctgcaaanggncatcaagtntnggggcttcatggaaaancaacanttttncagngagngtgttancttagnggttatggtnttactgcagggacatggatcacttagggananagcgtttcaggcttgggtcagtcttaaagcaaatctcatgnggagggtttntgctaacctgcntnttttacaacacannactagncagtntgctggantata

SEQ ID NO: 22202 - DNA, 718 bp, Homo sapiens
  misc_feature 2, 9, 10, 24, 45, 47, 48, 49, 57, 64, 109, 111, 686: n = A,T,C or G
antaaactnnggtgcgataaaccntgctttgttgcttttggccgnannnacgacagnaaggggnagtttacaatctgctgggctgaggatcaacacatgttcaaaaagnanaggaaagaagtcaagggagatcatgccagatggacttaatttcaatgaagaacagggtcttcctgcctgtaagaaggaggcactctctgcttctgtcatgtgctaagcttcgtcaaacagattatctctctaaaggtagaggcctgtgattgaccgctgtaccaatgactgagcagacataaaagtcagcctggatggctaccaccactaatcagatttgtctgctgatgcaaggcccttcagtcattccagaactggtaaatggagtcaccctgaggacaggccctgctgctgattgatgtccagtgtgggcagctctcttggctgctcaacattcagagaggctctccttgtttcagtgctaaatgattgacagtcagggtgagtatttcaggaggaagagtcccccgcccactccagccatgtggcaaaggtatttgcttccttgggaaggaagtgatttatctgtgggagaacactgtttgggcaaagttgcgtaggaacagcgtctgtctctgcaagcatgtgtgtatgtgagtgtgggcataaagcagcaagagtggaaggtaaagacnacgtgaacgtcataaaagaacacttcttttta

SEQ ID NO: 22203 - DNA, 360 bp, Homo sapiens
  misc_feature 1, 158, 182, 208, 256, 264, 265, 266, 274, 284, 299, 314,330, 334, 335, 336, 346, 347, 357: n = A,T,C or G
nacgacagtagggaacaatattggtcttccaggtgttactcatttcaattatgtgtagtataccaggacagacctattttcatgtcttatttctttaaaggagctgcttcattggccgggcgccatggctcacgtctgtaatcccagcactttgggangccgaggcgggtgggttacttgangtcaggagttcgagaccagcctggcnaacatggcgaaaacccccttctttaacttaaaaattccaaaaaaattnccccgggnnngggggtcnccccccctgntatttccccaccttncttggggggggcctnaggccaggaaaaattngccnnnaaccccaganngggggggggntcc

SEQ ID NO: 22204 - DNA, 635 bp, Homo sapiens
  misc_feature 1, 380, 403, 418, 429, 432, 452, 453, 455, 472, 480, 483,510, 522, 523, 524, 550, 552, 555, 556, 557, 559, 571, 577,589, 596, 606, 607, 615, 627: n = A,T,C or G
nacgacagtagggggcacttccggtggtgccaaatccgtttccgtggtaatcaggccggctggtgagggtacagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaangtgttgatgtggccatctctcanggaatcaacccctanctttccttggnagnctttttaacccccttaattnncncttgggaaaaggaaaantccccccntcntgggtttaaaaaaaagggaaaaaaaanagccctttgggnnngggcccttttccccaaaaaaaaaaantnggnnntnttttttcccctnaagggnggcctttttttnaggaaanccctcttttnnaaaaatcnccggggaaaagnggggggaa

SEQ ID NO: 22205 - DNA, 738 bp, Homo sapiens
  misc_feature 7, 8, 10, 14, 18, 21, 44, 46, 47: n = A,T,C or G
taaactnngntcgntaanacntgcctttgttgcttttggcccgnannacgacagtagggggatgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcggaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcccgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaa

SEQ ID NO: 22206 - DNA, 762 bp, Homo sapiens
  misc_feature 2, 12, 15, 17, 21, 22, 35, 71, 344, 697: n = A,T,C or G
antaaacttggntcnanaaannctcggcttttttncttttgggccgcagcggcctacggcctgcgaggagnacgacagtaagggggtgacaaaacctataaaatattttctacacgaaatacattacattagaataaaagtctgtggaaatgaaaataagagctcaaaggagcaaaaaaattgatgtcaaatttcagactattaaagaacagtctgtttatagcaattggacacctgatagcatataatattcatactctattgcagccatcccttcctttttggcactagggaccagttttgtggaagacaattattccatggatggagggagtgggggctgntcggggagatggtttcaggtgaaactattctacctgagatcatcaggcattagttagattctcataagaagtgcgcaactgagatttcatgcgccgcccacaatagggttcacgctcctatgagaatctaatgccgctgctgagctgacaggaggcagagctcaggcagtaatgctcgtggcccactactgctcacctccttctgtgcggtctggttcctaacaggccacaaactggtactggtccatgactcggtggttggggactcttgctctattcaatacgcttaaaagaatgatgttggccaggctggtctcgaactcctgacctcgtgatccacccgccttggcctnccaaagtgctgagattacaggcgtgagccaccacgtcctgcctcattagtgttattatttccaag

SEQ ID NO: 22207 - DNA, 185 bp, Homo sapiens
  misc_feature 25, 30, 41, 59, 68, 156, 165, 166, 168, 172, 181: n = A,T,C or G
agaaggggatgagtcctttggagancagcnaggcgtggaangataagaattcatctatnaaggtgtcntgtgggcacctgaatggtgaagggggagtgttatccttgtggctacccatgctggaggacaacaaaggctaaggtcctgtgacatgtntgtggtacnntnctanaaagaccangggg

SEQ ID NO: 22208 - DNA, 723 bp, Homo sapiens
  misc_feature 2, 11, 14, 18, 19, 24, 30, 41, 43, 59, 60, 61, 65, 67, 73,706, 713: n = A,T,C or G
tntaactggtncgntaanncttgnttgttncttttggccgnancggcctacggctgcgnnnaagnangacagnagggggtatttctgtctttaggtctttgaggaattgccacactctcttccacaatggctgaagtaatttacactcccacgaagagtgtaaattaaaaagcattcctttttctccacaaccttctcagcatctgttatttcttgactttgtaataatagccattctgactggtgttagatggtatctcattgtggtttttgatttgcatttctctaatgagcagtgatgttgagcttcttttcacatgactgttggtcacatgtatgccttcttttgaaaagtgtctttttctaacttttcatctgctccttaagacctgcttttggagaaaagtgtatcagtgccagagagtgtggtaaggggtgttttccttacatgatattgttacatgtctacatgatcttgttacatgtagtaaacaagatgttcatgcctaattgaattctaggatgggcatggtggctcacgtctgtaatcctagtgctttgggagactgaggcacgtggatcacctgaggtcaggagttcgagaccagcctggccagcatggcgaaaccccatctctactaaaaatacaaaaattagctgggcatggtggctgccacctgtaatcccagctacttgggaggctgangcagaanaattgcttga

SEQ ID NO: 22209 - DNA, 601 bp, Homo sapiens
ttttttgcagtaaatcttgctgctgctcgctttttgggtccacattgctttcatgagctgtaccactcaccgtgaagatctgcagcttcacttcagagcctagcgagaccacgagctcactgaaaacaaacaactccagacgcgctgtcttaagagctataacactcaccgcgaaggtgtgcagtttcactcctgagctagtgagactacaaagccactggaacgaagaaactccaaccacgtttgaacatcagaaggggcagactccagacacttcatcttaagagctgtaacactcactgtgaaggtctgcagcttcactcctgagccagcgagaccacgaaccgatctgaacatcagaagggacagactccagacgcgccaccttaagagctgtaatactcactgcaagggtctgcagcttcattcttgaagtcagaccaagaacccagcaattcccaacacacagggaccagcttctttcctaactcacttaggctcttcgtgctgctctggcaactaacacccttggctgcaggggcttggacgctacccttagtcactgacaattgtgtgaaggctgctgtcgttaacttcactt

SEQ ID NO: 22210 - DNA, 408 bp, Homo sapiens
gggatcatctctgctaaccagctagtagctaaccagctgaaggaggaatttagagtaagctagacatttctatctgctgaacttttatttagtccttgtgtgacttctgaacttttgcaatgaaaaaaattactggccaggcatggtggctcgttcctgtaatcccagaactttgggacgctaaggcaggtggatcacttgaggccaggagttcgagaccagcctggcccacactgtgaaactctgtctctactaaaaatacaaaaattagctgagcgtggtggtacatgcccataatctcagctacttgggaggttgaggcacaagatttgcttgagcctgagaggcgaaggttgcagtgagctgagatttcaccagtgcactccagcctgggtgacagagtgagat

SEQ ID NO: 22211 - DNA, 168 bp, Homo sapiens
  misc_feature 100, 134: n = A,T,C or G
ggggggcttgcctgagggtgctttgatctcaaagtgttctcgagagaagaataaccccaacgaagcctggtgtgtggttcaaaagtgaagctctgctttnttggagcaggtgatgaggaaaagcgaagtgattncattagtatctgtccacttctgtgatggaagcat

SEQ ID NO: 22212 - DNA, 672 bp, Homo sapiens
  misc_feature 1, 9, 15, 426, 489: n = A,T,C or G
nacgacagnaagggnagttaaaaacatgccattttcatttctaacattttaagtatatggtttagaagtggtaagtatagttctatttttttttgcaataggttttagataatttttgtcttacaaaagtaaaagtgaatactcattaattctgaaacaagttagttagcttgctttagttagatagcaagagaagggtccctggaaagtccctggcccttgggtcagtgtctcatccctgcataatataaaaggaatcctggaaaaaatcaagctgcagacactaacaaggtaactagcacatggtgttgtgcttggagacctgcccatggctgcacagacagaaaaacctctggcatatttggataaaaacttgtacaaacctccagctcactgagataagggaacaagaccgacctggcatanaaatgcctttgtttgtccaggcacagtggctcatgcccgtaattccagcaatttgggaggcanaagtgggcggatcacctgaggtcgggagttcgagaccagcatgaccaacatggagaaaaatacaaaattagccgggcatggtgcctcatgcctgtaatcccagctacttgggaggctgaggcaggagaatcacttaaacccaggtggcggagtttgctgtgggccgagatcgcaccattgcac

SEQ ID NO: 22213 - DNA, 699 bp, Homo sapiens
  misc_feature 2, 19, 22, 23, 26, 28, 33, 41, 56, 69, 78, 185, 505, 524,526, 540, 572, 579, 603, 624, 630, 638, 652, 658, 677, 679,680, 681, 683, 690: n = A,T,C or G
antacttgggcccttgagntcnnttntnctttngggccgcngcggcctaggcctgngaggagtacgacngtagggggnagtaatgcggccctgtacattgaattctggctctgccacttattagctctgttctagattgcaaccaaggcaatgtcttactacctcagctcagaaaaccacctggncccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctggttttcatctccgacaatgtggatcacattgattcccttattggctttcctgagcagaatgctgaaaagctgntctctgctgctgaagccananagaaaattactganccaggggccgggctggggctttcttaaatttnctggggnctttggaaatttggggctttgctnccctgggttgggaaaaaaggntttttnggaatttncaaaaaaagcttgngggaantaaaattttttcccggggncnnnanccccccnggatttttt

SEQ ID NO: 22214 - DNA, 700 bp, Homo sapiens
  misc_feature 1, 8, 19, 22, 29, 693, 699: n = A,T,C or G
ncggcctncggctgcgagnagncgacagnaggggaagacatttctattattttatcaacaatttaaaaactatctttatttaccaaagagtactaaagtcacagggacctgaaaagcatttgggttatttaacttatgagccctcatttatttataagtcaatggtatcacaaccaatatacaaacagccatgtatatatgtacacataatacagacaggcacaaataaagacattatagctttgatttaaaactcttaaccatgagacctgtaaaagtcactagcttgaaaggatggtgggattcaaactgtgtctttgtgaatgaaaaaggttaaagtttatctctctcacagggctgaagcccttacggagttttagagaaaacatgatagcaaatttacttctcaaatcagggagagagagacagagagaatttggcttctttcaagaaggagtttgggtgtgttagagaaagatttaaaatggatgccaaggtaacacaaatgataggaaaatgccatagcattttataaggagaccaattttatttagataagtagcttttaatttagcctgttttccaactggactgctatgttcagggcagagcccattaagaaacatgaccaacaaagcatttgtaatttttaatggcctaataatttatgtgaaaagcaggtgcagttgggangcagant

SEQ ID NO: 22215 - DNA, 703 bp, Homo sapiens
  misc_feature 1, 2, 3, 5, 6, 7, 8, 13, 16, 25, 31, 37, 50, 51, 63, 155: n = A,T,C or G
nnnannnnaaacnggnttcgttaangttgtnttgttncttttggccgcanngggtgcattagnaatgaggccattagttctttgtggttaaccaaaatctcaagatttcttgtaatgagagtaacttttctttctgggatccctgacaaaccggnaagagagtgctgctgaaatgtgggaaaaacagctgtgttataacaggagctgccagccccccacacagctggctgcagagataattaattgtgaagagagtaaggaagtaattcacataattgtgtaaatgttaagtaatttacgtaattgggtatatatacaaatgggtttcttccctaagctatttttttaaatacagaaaaatctaatctacaagcagttgattattaaggaaccaatttttaaataaaccaaaaaaagtatctattctaatgtgtgctatttttcacaaaaaaagtgttttcctgtgactgtatcctgcatcccttgttacaagtgtgtgtgcatgtgtttgtgtgtgtgtgtgtgtgtagataagtatatgatgtctttctgggactatatgcttaatctcactacaattacttttgggttattccatcagcaacacaagtaaatctctctagatactatttatctcaggagtgacaaatatgtgttaagaatgacttctattacccctgcattataagtttattttttccac

SEQ ID NO: 22216 - DNA, 658 bp, Homo sapiens
  misc_feature 2, 3, 9, 11, 15, 594, 618, 642: n = A,T,C or G
gnngacagnangggnatatttaaaggtttgccttttgcttctcgtgggtacaagccagagcagagcagtggttacatgggggtagaatggtgactcgtttttacctgactgtggatcagctgggtggttcctgaatctcactgggctcattgtggctctttgcttgtcctgtatttactgtctgtggtagtgagatagaagaaccaccatgttcttctggttctagactcaaactacagggagaaggaagagatgtgtctggcatcatttccgtgttggagtaactttgtggtagattgctgtggcctttctttgtggcctgccacttgtcttacattcttcagagcatttatgcacaggagcataaatatatgattttcatcttgccattgaaagtagactttccggccgggcgtggtggctcatgcctgtaatcctagcactttgggaggccaaggtgagcagataacttgaggtcaggagtttgagaccagcccggctaacatggtgaaaccccatctctactgaaaatacaaaaaagttagccgggtgtggtggtatgcacctgcaatcccagctactcagtaagctgangcaggagaatcgcttgaacctgangggtggaggttgctgtgagctganattgcaccactgcact

SEQ ID NO: 22217 - DNA, 579 bp, Homo sapiens
  misc_feature 537: n = A,T,C or G
ggggaatgttttcttttttaaaaatacctggagcatatatggcatgttgttgagatttgttaaagctacagttgtgagggtatgggtattcgttactttttgtaatgtttgaagtatttcctaatgtcaaaggcatctcaaacaattttttcttttttttaagagatgaggcctcacactgttgcctaggctggaatgcagtggtgcaatgacagctcactgcagcctcagcctcccaggctcaagcgatcctcccacctcagcttcttgagtagctgggaccataggcatataccttttgtactttttgtagcgacatggtctcactacattgcccaggctggcctccaactctgaggcaggagaatggcatgaacctgggaggcggagcttgcagtaagccaagatcacgccactgcactccagcctgggtgacagagcaagactccgtctcaaaacaaacaaacaaaaacatcaatggctgggtgcagtggctcatgcctgtaatctcaggactttgggaggccgagcaggcanatcacctgaggtcaggagttcaaggccagcctggctaacatt

SEQ ID NO: 22218 - DNA, 697 bp, Homo sapiens
  misc_feature 2, 9, 676: n = A,T,C or G
gncgacagnagggaaggtgaatccaaaactaaaggtccatatccaggccgtaatccaagcagaggtgtgaacaggatatgagaaaaaatctaatacctgtcattggtgaaagtacttatgagtggtcagttggtactaagaaaggggcgtggagaaaggaaatacgacagcaattgtacccactttgggatagtgatattcataaaaagaatttccttgggagcagggataaacatcagaaaacagagttttagaaaaagagaagatcaagaagtaccacgttcgatgaaacactgagttataggacagtgagtatcattgatagaatagaatttaatttctgagtgtctgggcagccagctccaagtctgaattagtgagaagtcactattcccatcattaatgtccagagtgacccaaagtttttgggaaaaactcaagtagtcccagatgcagtattccacaccacggaatgctcatagaaaaaaaaatgagtttcattttagggatcaactacaggttgcaattttcaataggatggtcaagaaagacattattgaggccaggagtggtggctcacgcctgtaattccaatactttcggaggttgaggtgggcagatcacctgaagtcaggatttcaagaccagcctggccaacacgacgaaaccccgtctntagtaaaatacaaaattatcc

SEQ ID NO: 22219 - DNA, 699 bp, Homo sapiens
  misc_feature 2, 167, 630, 679: n = A,T,C or G
gncgacagtagggggcacagagtgttttgaggaaagaagtggtgggacgtcactgtctgtggaaaatttcaaggaaaactgaaggatcattgagatgaacagtgtggcagaattgagaactcttgatgtttcagtgagctttaatggaggaaaatctgtcatttcangatcattaattgtcacagccacagaatgttctaacgggatcgcagccatcattgttattttggtgttactgctactcctggggatcggtttgatgtggtggttttggcccctttgctgcaaagtggttattaaggatcctccaccaccaccaccccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgangcggcagtatgaccgagtttctttgatgcgacctcaggaaggagatganggccggtgcataaacttctc

SEQ ID NO: 22220 - DNA, 665 bp, Homo sapiens
  misc_feature 26: n = A,T,C or G
ggggttttttatcctgtagggcaggnagtggttgtagatgccctctcatgtgctgacatactgattgatggtggcttttaaggtctctcctgagtctagtaggaggcaggcttcctaactgtcatggacaccaggcaggcaggtaggggaatgaagcaagatttggcagcgcagctgctgtgagtttgctctccagtggcttggaaatgggaagtaaaggattctgatcttatgtgagaccattttcagactgtcctagtctgccctcacatatccctggaatggacacatacaggctggtcagggctttcttggggcactgaggtgggagaagctggaggcctgggcagggtagtggaactgagagtgagaagccccctacacttggatctcttgcgtatcacacgagactcatttattgatgactgcctagctggctcataatactgatggctgaatgggggtatgaaaactggtcctcaagagtatccagtcttattggaggaataatgcaaaaacaaacaaacaaaaaaggataaaataaaagaaacaaaagcccaggtggtaaattttccagtcttcttggagaagtaacacagaaaaaaaggtaaaataaaagaaacaaagcccaggtagtcattttgcagtagagctcagtgactaag

SEQ ID NO: 22221 - DNA, 737 bp, Homo sapiens
  misc_feature 2, 8, 9, 11, 14, 18, 19, 30, 41, 43, 61, 72, 467: n = A,T,C or G
antacttnntncgntaanncttgcttgttncttttggccgnancggcctacggctgtgagnaagacgacagnagggaggatatctatttataatgtttctatctgtgaaaatatatttatatggttatttacacactctgtattccattaattgtgtaaataattgtataaatatattagtaatgagtgggaatcttactatcttaattgtggtaggaaaatgtcagaattattctctaatgtttttactacattaaaggttttcagagccagtcttgcttcttttcttttttttttcgagacggagtttcactctcgttgcgcaggctggagtgcggtggcatgatctcggctcactgcaacctccacctcccgggatcaagcgattctcctgcctcagcctcctgagtagctgggcttacaggcgcccgccaccacacccagctaattttttatatttttagtanagacagggtttcaccatgttggccaggctggtctcgaactcctgacctcaggcgctccacctgcctcagcctcccagtgtgctgggattacaggcatgagccaccacgcccggctccgtctttttttgtccatgcacacacacacccacttttgtcctttcagtattattttgaaagaaattctagatgtaatattattttttgtcattaagcgtataagtgtgtatttctaaagataagaaattttaaaatatataaaataatgctgtt

SEQ ID NO: 22222 - DNA, 443 bp, Homo sapiens
  misc_feature 410: n = A,T,C or G
ggggatcttaaaatcatttgcaaaaaaagttcttaaagctaaaactgatagaagctttaagtgagctttatttgaggtatgggttttagtttgtagggaagatggcacttgggagcagcagctttgagcatcttgcatctgcttcctgaggccgtcttctcactggaaacattttcatacctgaatgaaagcagtttggtctgattttgttaagacaaaagataaagagcggtagcaaagcctcaaatatcatgaactatgtttttaccagccaaaacgatctggagagttttcaaagcatgtgccagtgtgaatgacgctttttgaagatcactcagggataatggtggtatttattagatttttaatgaaaccttttgaagggctcattataatgtgttcatacgaantgaaagacatatttggcattacaagattaaaat

SEQ ID NO: 22223 - DNA, 694 bp, Homo sapiens
  misc_feature 535: n = A,T,C or G
ggggctaataaatgtgttagtgtgaaaagttaaatagttccaaggttaacgtggaaataaaagtcaaataaatatgtttctttaataaagaaaaattcacttgcctttgaacatgacaggtgttttttaaatcttcagttgcgttaaggtaatgaactcagatttattaactggtttgtgtttgtatacacaattaatgttaaatgcaaaatcctttaaagtctaaatgactattgatctgtattttaaagaataatttttgtaagcttattttgatactaaaatgcattccactgtcatattatctaaacttctgggaaatgctagcacaattttgtctctttggagttatatttattttcatgatgaatattttaaaacttaacaacctattgtaaactgttatttttgcagttatgtttgcctaacacacaaacacaccaagcatgttcctgtccccaaggtctttgtactttttgttgcctttacatgaaatccactctccctaattatggcccagccttggagctctcangtctgtcagggctctgcagaggattacctggttttgggggaatgttttcttctaaaatgtggctctatctttattatgtttggtggtttccccctacctggcattatgtatatactcgtgcttgtttaaatcactttccattaatatccaaggtagaat

SEQ ID NO: 22224 - DNA, 679 bp, Homo sapiens
  misc_feature 13, 675: n = A,T,C or G
ggggtggtcaggnaaagtatttggtgataggatgcaattcaggcctagaccaaggtttaaatgttctctcttctattagcctcacttggcaacaggtactggctgatcctgggcttcatctgaaggagatggaggccagtgaaccttttggttacagggaggtgagggactggaggagggggcagatggtggaagagagtttgggagaggaggctataaaggaaagctgggaggggaatatggaggtgctgttgagagctctaggaactttactgagtcagaaaaatttttctacagacagtgtgaaagagcctcagtagtttgactgagatttgaattatttagctgttttttggcttcttaataccaagtgaaataagcagaccgctgtgcatccaaaagctttgttcctttttgctctagggctgtttttagatggactaatttagggatataccaggagcccccaccatagccgaagagagtttttggtaaggctttgccagtgagaaagcaagcagacagtattagaactatagcggcaaagcaggagtttgataaggtgaggtttcaattgagaagttcccatgggagaagcaggattaaacagacagaagagagaggcctcataaagagcaggggaaaaattccagcccaggcattggggagtggatnccca

SEQ ID NO: 22225 - DNA, 341 bp, Homo sapiens
  misc_feature 2, 13, 16, 38, 43, 52, 57, 61, 63, 88, 98, 102, 105, 119,133, 135, 145, 147, 156, 237, 246, 248, 257, 264, 283, 284,290, 292, 305, 306, 307, 313, 319, 329, 331, 338: n = A,T,C or G
tnttttggggtancgnttaaagaacctttggtcttttnttttnctttttttnggggncccngnaagaccggggcccctttacggggcnttggcccggngaanaanaaacggaaccaggnaaaggggggggggnanccccccgggnanaaaaaaaanttgggccgggtggccggggaaaaaaaaagggaaccgggcgggcccccccccaaacgtttggaaaaattacctttaccgaanggggccccncnggggacccncccgttngaacccccaatttttggannaaaccntngccggggtttttnnngggttntcgggnccagaaaaancntttcccngaa

SEQ ID NO: 22226 - DNA, 387 bp, Homo sapiens
ctagtaataattatagtacataatagttattttgcactgtattaaaaaactagcacattatcagttctcaagtatttgaagtatgttttataagaatccttttcggccgggcgtggtggctcacgcttgtaatcccagcactttgggaggtcgaggcaggcggatcacctgaggtcaggggtttgtgaccagcctggccaacatggtgaaactccgtctctactaaaaatacaaaaattagccaggtgtggtggtgcatgcctgtagtcccagctgctcaggaggctgaggcaggagaattgcttgaacccaggaggcggaggttgcagtgaccagagatcgcgctcagtgcactccagcctgggcaacagagtgagactccttctc

SEQ ID NO: 22227 - DNA, 659 bp, Homo sapiens
gggatatgcaacttgcctcatatttctgttgaacggtattagacttgacttgcgatcttgacaaaggcagggacttctctttcctgtttgccagtacacccagtgcctagtgtggtgtctgacacatagtagctgcctaatatacatctgtgggacagataaatgactcagtttacttgtgtggtttctgttcactcataacactggtttatacctgaactttgccttaagactcctcaactaaccagcaaattctctttaatatttcttagttcaggttctagtttaatctcctcatttctttaccttaattgtgtataatcagcttttcttaaaagtaaggtggaagtttttgacagaattctattgcctgagtggtaatccttcccagcacatgaatttgtcacattagtctctcctagctttgagaatttgatctattttaagaaatgtcctggctgggctcagtggctcacacctgtcatcttagacctttgggaggcccgaggtgggcggatcacctgaggtcagaagttcgagaccagcctggacaacatggtgaaaccctgcctctactaaaaatacaaaaattagctgggcatggcggcgggcacctgtaatcccagctactcaggaggctgacattagagaattacttg

SEQ ID NO: 22228 - DNA, 364 bp, Homo sapiens
  misc_feature 354, 357: n = A,T,C or G
ggggcaattattatgatcaagtgagattatttttgtgaagccatgtaaactataaagtgctttccaagcatgaggaattactgtggatgatcttgagtttcacatggaggtcaggagcagttaaaattgttggttgtgataccatccataatctcttctctcaacaccctctgcaagctctaagggggggggattgtaggggtcacacaggtgttattgctagaaaatgaaagagcagaaaggcttcacaagcccactgagaaggacttagctcacacttctgggaaccagtgtccaaggcgtgtgaccataggaacagagactctctgtcaggaaggagtcaccagctgactncanggcccgg

SEQ ID NO: 22229 - DNA, 695 bp, Homo sapiens
  misc_feature 1, 9: n = A,T,C or G
nacgacagnagggactctaagtattatttaaggctattctgtatgccatgaatttgctttagtctctgatttttaatgcaaagttactggcatggatcaaaaacaaaagatacttcatttttgctctctttaatattgagttataaacattactggttcttctgatagaaaagctttcatccccactcctgggaaccatatcaaattatttaggcactttatttggagttagagtttgaaaaggtttctgtttgtttgtttgtttgtttttgagatgaagtctcactctgtagcccaggctggagtgcagtggcgtcatctcggctcaccgcaacctctgcttcccaggtacaagccattcgcctgcctcagcctccagagtagctgggattgcaggtgcacaccgctgcactcggctgattttttgcatatttaatagagaagaggtttcaccatgttggccaggctggtcttaaactcccaacctcaggtaacccactcacttcagcctcccaaactgctaggattacaggcatgagccaccacgcccggcctgaaaagtttttaaagaatgaaactcaagtattttctcattcatcatccattggagttaaggtgattttatttctatcatggaaagaatagccacttggtcatgtattgaggagtaataaatggtccctgatcagctcacg

SEQ ID NO: 22230 - DNA, 681 bp, Homo sapiens
  misc_feature 5, 6, 7, 8, 9, 10, 11, 12, 23, 34, 36, 43, 53, 56, 63, 550,596, 625, 631, 648, 655, 656, 660, 662, 673, 674: n = A,T,C or G
tgggnnnnnnnncttgcttgttncttttggccgnancggcctncggctgcganagncgacagnagggtaacttagttttcatagcaaatgctctattcacattcgttttcatctttataagaaataattaatttatatatgtaacaaattcaactggcataaacaatgtcaggaatagttttcgcaagcagacaactccaggtatggaggcaaggtgagttgatgaatcagagcgaatcctaccttcttttggattctgtaggtattgaaaagcagtcagtaggttttaaaaaggtaacagagagccatagttaatccaggaagttgagtaaatcaaggttagttaataaaattttagtattttaattaagaaattatctttgcatcttgtgtaatgtgaaatgtataaagcatcaaatgtgaaagtcacacaatgagggcaagaaggctttaccatcctttgctggaggatggtaaagatgaattcattgaggttagttgaacttaagtaatggatagatttaaatccttcctgaatgaaaaaagaaanggaaactgactttttcttgggacactgtcctttcccaacatgggtnaaataaccaggggccaaaataaaattttnctgaangggcaaaagggggggancctgggnntttncnggatttttttnnaaacccc

SEQ ID NO: 22231 - DNA, 686 bp, Homo sapiens
  misc_feature 1, 7, 19, 76, 81, 88, 155, 293, 380, 512, 562, 638, 649: n = A,T,C or G
nacgacngtagggggacanctcgcgggggattggtttccacactgtggaagctttgttcttttcgttttttgcagnaaatnttgctgntgctcactttttgggtccacattgctttcatgagctgtaccactcaccgtgaagatctgcagcttcncttcagagcctagcgagaccacgagctcactgaaaacaaacaactccagacgcgctgtcttaagagctataacactcaccgcgaaggtgtgcagtttcactcctgagctagtgagactacgaagtcactggaacgaanaaactccaaccacgtttgaacatcagaaggggcaggctccagacgcttcatcttaagagctgtaacactcactgtgaaggtctgcancttcactcctgagccagcgagaccacgaaccgatctgaacatcagaagggacagactccagacgcgccaccttaagagctgtaatactcactgcaagggtctgcagcttcattcttgaagtcagaccaagancccagcaattcccaacacacagggaccagcttctttcctaactcacttangctcttcgtgctgctctggcaactaacacccttggctgcaggggcttggacgctacccttagtcactgacaattgngtgaaggctgntgtcgttaacttcacttgatcaccttaggctcctggg

SEQ ID NO: 22232 - DNA, 716 bp, Homo sapiens
  misc_feature 1, 643, 701: n = A,T,C or G
nacgacagtaggggtaaaagcttgacttgtgccctttttttttggctgaaaatgggggatgaaatcaaggatatattgattttaattatttgctaaagacatatttattgaatatttatggagagccagtgccaagaattctgagggatatgaaaatgcttgttagtaggctaccatggaacttagtttagtaggtgagaaagtcttgaatgtgaatagctgaacaagtaatacaagttggcagtattttatgggtgttacaagtgatgacttaggttcaaaggaataagcagttatttctagctggaggaatcagaaggcttcatggatgtaggacttgaaaggcatcttatggacatattagtagaagatgtactagttggagcaaacaacactgggaaagtcctgatgatttaaagcttctctgatgtatcttaattttattacataacccgatgtttaacaaatgattggattattaatattaccattttttggtcttaaaaagaatattggttgtgttagatgattcagcatagtattgtagttctcaaagtgtgatccttggcagcatcaacatctcctgctaacttgttggaaatgcagattcttggctgaatcccatatctagccgttgagtcanaaagtggtgtggggattcagcaccctgtgctttaacaggtcttattttgacagagccncttttacttaatgac

SEQ ID NO: 22233 - DNA, 631 bp, Homo sapiens
  misc_feature 403, 418, 500, 547, 557, 611: n = A,T,C or G
agctgatgattaaggttgagaggcagaagtacattgtgtcagggaggacctttcccttttatgcatgcacctggcatttatcacctttaacaaagtgtgtgtgtcatgctgtgctgcttgcttaaggggctgtatgcctccagtctgagtcacatggtaactgcatcagcagtcttagcctgtagcattttattatttcttttcaaagtttacacttggcctaatacttagacattttataattctttacagtaaatgaaactatacatgagaagatgggcatacctttggattaaaaaaaaaaaaggctcagttctttaaagtttcttatccttgattttcctaacacggtccaaagttcaggactggctccaaacccataaacctgtgtttagcaagcaanaaacataatccccanatagtatagtttctctggtttatgagtcacaatttcataaaatcatcagagtgcttattaattccaaccacgtatagtaaanaaccttcagatgaactgaagcaagggttcttaggcaagttgccgganagagttctanaattctaaactacctgagtagctttgctgaaatgttgcttgtatttgctactgnggccattttatgatggccat

SEQ ID NO: 22234 - DNA, 729 bp, Homo sapiens
  misc_feature 4, 10, 15, 16, 17, 25, 36, 47, 51, 58, 60, 63, 102: n = A,T,C or G
tttntaactnggggnnnaaaaaccntgttttttttncttttggccgnaggnagacagnanggnagctatagctaggcctgctcctctttgcacagctcaagnatgacgtgtacaattactttggcacctcaccagctctttcagaccttttccatgcatgatgggaagacaggtccattctctgagagtccctcactccctccccctcccaaattcccccttacctggatgaaatcctgatgtaaatggaccttgcctgcaaatagaactgaagggacctgttacgtcatcaggcctggcagagctcattggcagagaagttaagagttttattttagacccagagaccaggctgtgcagatccagctagaacaggtctcttctggctcagcctcagctgctggccctcctgctgtggttactggggctccaaaggatggaatgtcagggggatcatgctgcacagtgagcaggacaacctgacggccagaccaaatgcactccaaaggaaatctcaggctagggtaatacagccaaggtgctgcctctacaatcatgggaggtttcaaccttctgggagaaaagccctaatgcagcacatgatggtatagatttgatccaggaaggcagagtaaacaaactatttaaagacatgagtcttggctgggcacggtggctcacgcctgtaatcccagcactttgggcggccgagacgggcggatcacgaac

SEQ ID NO: 22235 - DNA, 671 bp, Homo sapiens
  misc_feature 16: n = A,T,C or G
cttttcctgccctggntctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccgagcagaagtctggagcacgtttacagccattctgaagaaagcataccgaat

SEQ ID NO: 22236 - DNA, 695 bp, Homo sapiens
  misc_feature 25: n = A,T,C or G
ggggtggaatatttaagccacgagnaataagtactataaaagcaagaatttataatagggtctttaatgatcagttctgttcttacacagcttctccccactcctactccttggaagcaaccaagtggtatgagttggcccctactcaccccctccctggtgtcagtggaccacatcagggaagtgaggttattttttcacttggaggaaacaaagatatgtaactcagtaccctacttttgccatgaggttgccagtgggtggagggagaagacaaacttccacctaaccagtctgcaagaaggaagtataagttagtactctacttttggtaggatggtattagtaggtcccatcaggaagataaacacgcacacccacccagctctcaggttacacatcaatagggaaccatctacgaaataataagagagaaaaattctcataatataaaaaaaaattcaggacacaataaaaatcacttataagacaaaagaactaggaaatcataacctgaatgagagaaagacaacagacaccaacacagacataaaaaaggggttggggctgggcgcagtggctcacacctgtaatcccagcactgtgggaggccaagatgggtggatcacttgaggtcaggagttcaagaccagcctgtccaacatgggtgaaaccccgcctctactaaaatttaa

SEQ ID NO: 22237 - DNA, 689 bp, Homo sapiens
  misc_feature 2, 134, 146, 149, 156, 166, 170, 176, 198, 210, 216, 219,221, 228, 242, 269, 276, 278, 293, 303, 304, 318, 339, 371,398, 453, 467, 482, 486, 493, 539, 541, 586, 593, 596, 617,621, 622, 627, 631, 632, 641, 642, 650, 651, 659, 663: n = A,T,C or G
  misc_feature 664, 671: n = A,T,C or G
gncgacagtaggggaatgaaaactatttggtgaatcagaggatagtctgaattgggatatgaaggccagtataagtgtcagttagcaaagtcagctctagtttagtttttttttttttcttttaaggcgtaccnttactaaaagtntanctttggnaaccttgtancatnttaaanacttttaaagggttgacagctnttggcaaattgnctaatncananaactaanctttggttcatgtnttcaatgtctaaatgaaaaatgggaanataaaananctaaaaatgaaatgngatttcatgnncttctcctttttanctcttataataaattgaacanatttgatatttgtggtaaatccactcaggcanagtgacagaggcttggttgtcatttancctttagggtcttagtggagttaatgaaaactgcaaatggtcatcaagtcttggngcttcatggaaaancaacacttttacagngagngggttancttaagggttatgggattactgcagggacctggatcacttagggananagcgtttcaggcttgggtcagccttaaagcaaatttcatgtgggnggggttntgntaaacctgctttttttcaacncagnnctagncagnntgcctggannttaatcannagggcaangtcnngggaaanaaaggaaattgaattttt

SEQ ID NO: 22238 - DNA, 681 bp, Homo sapiens
  misc_feature 4, 242, 265, 312, 315, 323, 344, 419, 501, 520, 549, 624,661: n = A,T,C or G
gggnattatcactcatctttctatgtgcacatgtgttatttccatatccagagggcacagcatgcataaatgcatttattgggcatctactatgcactcggtatgtgatggacagttccacacaatattatttgtgttattccctcacaatagcctggtacagggttatctccttttaatagatgacaaaactgaagccaggaggtgtgcattgctgttttttttttttattcttgcctagngtttccattgatttctccctganagttttgtaagcctccttctacatctttaactacttttatttcctgnggnattgtctntgctgtccctgacaaaggctntaaacaatgggcatgtcaggactggctggattccaccaattcccaaacacaagtattttttctcctccatagttnggttcacttaatggccattgcttcctcattttcttgccaagggacccctccaaccaatggcctcctctctaggctggttggngatcaacacacccttaaanaataaccagcacattcagtctctgggcanatgtgcctctgagtgtgtttcccactggggtaaagtggaaggttgtattcctaaaaacaaactcatgtcccaaanaccttgagtttgctttttctcaaggggccatgaattntttatttattataggccaac

SEQ ID NO: 22239 - DNA, 177 bp, Homo sapiens
  misc_feature 154: n = A,T,C or G
ggggtgtgatttatttttaataacatccctttatgcccaattttgataaccattagtcccagtaaattctcttatgtttagtccttacttgaattttactttttaaaccactgagttagaacaagaaaacagcataagcagtgacagaaaaccnaatgcagaactaccaaatgacgc

SEQ ID NO: 22240 - DNA, 743 bp, Homo sapiens
  misc_feature 2, 8, 11, 15, 44, 46, 53, 62, 64, 67, 81, 693: n = A,T,C or G
antaactnggngcgntaaaaacttgctttgttgcttttggccgnancggcctncggctgcgngnagnacgacagtaagggnattcatttacaaaataaagcactgttttccttatcagaattgaagcattggagtagatatgtcttatgcttttggagagtaatcatctgtacttacatatattttttctctccaagatactgagtctctttattttaaatatttttttggggggcttcaggggtctgttggttgattacataaacattttgtttaatcacggtaacatttggtcttcacaatctgtgttggtggctgggtggcttttatatgtccccaccccactccaccctccacaagggagacataattaacagctagctcatcaagaactgtctgtcaggggtgagaccaacttgcccctacattttaattgccagaactcttttttttttaaataatagcaaataatgaattgatcaaaaatctaatatttggtaatgatttattaaattttaaaaatcaccttaggtattagtagtaaataatagaattctcatttaacaattttatttttcgaatgaaatgtatgacactcagttagattagctttgtagctttattttcatatatgatgtggtaagctttagaccaagatcacaatacgtggattaattttagaagaatttttangtttgctttgatgggtcctgagtttgggggtcaaactgtataaagattaa

SEQ ID NO: 22241 - DNA, 690 bp, Homo sapiens
  misc_feature 4: n = A,T,C or G
gggnatgttttaatcattttgggtgttttcaaaacaaatggtgagattaggggttttttttctcttctatttttggcccctttcctctggagagtccttctcttgtgtttagttcttggtgttcttagtatatttgaagaatgcttttaagtatttgaaatgtgtgtacatggttgaaaggggatgaggaagaagaaaccgaaaacttcatgaccctgctcaaaccaatacccataccccagccctaaagcagtgtccgggcaccacatcttcaaggaaggccccttggaaacccctcatgggccagtcctctgacccaggtgatctcctaaccccctttatgtattcttatgaggatatatgataaagaacggactgtgagatttgttgttcaaatttttccccttagaatgtgagctcagtgggtaatagtaccatgttggctctgtccacagttctactatcttcagcatagggcctggtatacagtaagcgcttaaaaaatacatgtcaaatggctgggtgcagtggctcacacctgtaatcctagcactttgggaggccgaggcgggtggatcatgaggtcaggaattcaagaccaacctggccaagatggtgaaatcccatctctactaaaaatacaaaaatagccggcatggtagcaggtgcctgtaatcccagctactaggg

SEQ ID NO: 22242 - DNA, 711 bp, Homo sapiens
  misc_feature 1, 9, 26, 329, 412, 619, 622, 624, 647, 664, 710: n = A,T,C or G
nacgacagnaaggggagatccactgnattgcaatgcaatgggacaatatctggaagcaattttatccagaaaaatcaatagctttaaaacaattcacaaccttggacctaatacctctacttctaggaagctagcctatgaaggtttctgctgaaggatgtttatcacagtattatttataatgtgaaaaagccaaagaggagacctaaaatgtttcaaagatgaaaatggtttgataaaattattttttttttgagacaaggtctcactcttgcccaggctggggtgcagtggtgcaatctcggcttaccacaacctccaccttccanattcaagcacttctcctgcccagcctcccaagtagctgggaatacaccccaccatgcctggctatttttttgtattttagtanagatggggtttcaccgtgttggctaggctggtgtcaaactcctgagctcaggcaatccaccttcctcagattcccaaaatgctgggattacaggtgtgagccaccgtgcctggcgataaacaacatatttaaactctaaaatgttatgcaagcattccaggcatgcttttggaaaaactattaatcccccaaaagatgcttatgtanttntntagactaacagaccaagattctncaggacacttactttgntaaatgtctgaagtaaaatgtaatgctgatataaaagtgacctgant

SEQ ID NO: 22243 - DNA, 750 bp, Homo sapiens
  misc_feature 2, 11, 15, 19, 20, 32, 43, 52, 63, 66, 78, 88, 119, 574,575, 581, 585, 591, 596, 613, 624, 635, 649, 659, 667, 685,686, 689, 698, 702, 709, 712, 714, 720, 740: n = A,T,C or G
antaacttggngcgntaanncttgctttgttncttttggccgnagcggcctncggctgcgagnagncgacagtagggnatttctgagnaacactttaatatatttccacacctactggnaatctaattcagtcgatcggataaaagaaagacttttttgttgttgtttttgaaaatccataatgtagcaggttctgcgctggttttttaatgtattttatttttgtgctctcctgccaaaagaaaaggctgataagtaagtacacagtacaacatgtaaattcgtataaaaatatgcttgtttagattgctctacaataactatattaaggtaaattgtgtgtgtgtgtgagagagagagagagagagagagaaacagagggagaattgactcaatgtgttttctatgaagagtcttagcttaggaatcaggtaacagagaggtcctagaccatagacccagccatcaactagcttgctgatgttgaacagatcaactctcaaccatagactgaagatggaatgaagatatcaaaagttccttttagcactgactagatttttttttttttttnnaaacanagtntcactntgtcncccaggctggatttcantggcatggtcngggctgactgnaccctccttttccngggttcaagngattctcntccctcaccctcctgagnnggngggattacnggcncataacnccncncccagntaacttttgtttttttgganaaaggggggt

SEQ ID NO: 22244 - DNA, 675 bp, Homo sapiens
  misc_feature 2, 9, 201, 203, 207, 209, 212, 214, 221, 226, 227, 236, 246,248, 250, 253, 259, 267, 273, 276, 282, 293, 300, 307, 310,319, 320, 324, 327, 330, 332, 338, 345, 350, 353, 358, 371,376, 380, 383, 392, 395, 407, 415, 420, 428, 443: n = A,T,C or G
  misc_feature 446, 457, 458, 479, 482, 486, 493, 497, 500, 503, 505, 520,523, 526, 532, 559, 564, 576, 594, 606, 611, 614, 618, 636,644, 672: n = A,T,C or G
gnagacagnaggggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttaaaaaacaaantnttgntntgncncccaggntgganngcaggggcncaatctcggntnantgnaagctntgcctccngggttnacncctttntcctgcctaancctcccnagtagcnggnactacaggnncccnccnccntncccggntgatttnttttngtnttttnagaaaaaacggantttcnccgngtnacccagganggnctcaatctcctnacctcggnatccncccgcctnggcctccaaagggcnggnattacaggggnnagctaccgcccccggcctatnatnttgnactttcnaacnganccntntattttctttatttnaanaanatttcnccccacttgaaaatcacttgttagttnttggnaggaattcagtngggcaatgataacttttntgggcaaaaacnttctnttntagngaactaatgaaaaaaccncgtttttncaatttttcttattccttaaatcccctnttt

SEQ ID NO: 22245 - DNA, 739 bp, Homo sapiens
  misc_feature 2, 12, 15, 19, 31, 42, 60, 62, 65, 72, 78, 87, 101, 121,705, 706, 713, 715, 723, 724, 725, 727, 736, 737: n = A,T,C or G
antacttgggtncgntaanccttgcttgttncttttggccgnagcggcctacggctgcgnanagncgacagnaggggnattgctggnattgcatggtgggnactatgtttagtttctaagnaacttgccaaactatcttcctaagccgccatatccagcttcttatattccagccagctctgcatctttcccaaaagctgtacattagctttttggattttagccatcacaataggtgtgtagcggtatctcgttgttttattttgcaactccctaatgacaaatcttattgtaaaattgaggtaaacttctagaatactgtcattttgctactgatagctagtgaggaaaattacatggtgttttatctgaaatattaatgaaatgtgtcaacatgtatcattgtgaaacaatttttaaggctcaagtctacttttaaaaaattgtggtaaatatatataacaagaagtttatcatcttatcattattattattattattattattattattattattttgagacagccttgctctctcgcccaggatggcgtgcagtggcatgatctcagctcactgtagtcctagttgctgaggtaagaggattgcttgagcccaggagttcagggctgcagcaagctttgattgcgccactgcactccagccttggcgacagactaagacgctgtctcaaaaaaaaaccannacgaccnanaaaaaccnnncngaaaaattnnct

SEQ ID NO: 22246 - DNA, 747 bp, Homo sapiens
  misc_feature 2, 12, 13, 17, 25, 28, 39, 41, 57, 60, 67, 72, 89, 667, 683,686: n = A,T,C or G
antacttgggcnnaaancttgcttnttncttttggccgnancggcctaggctgcganagncgacagnagggnattcattagtagtcagnataagcataaatcagtaaaatctctttaaaattttttctttaggaggttacatttcaaaaatttcaattctgattcctaggattgggtaagaaagtgggggaaattgatattcttaaatattgttggagactgtatacactggtgcacttgttttggaagataatgtggcaaaaattatcaaagatcatataaatgtttatgccctttgacttaccaattcccacctttattaatttatctcacgggaataattgtggatatttgtaaatatgtatatacaaggatgttcatcagaacatcatctcagtatggaaaaacttgtaatgtcttaaaggcacatcagtaaggattggttcaatacatgtccagatactctgaagccatttgaaaagttgtgcaagaatattttatgtgggaaaatattcacgatatattgctaagtaaaagattatgaaactataggagtttttatttacaaatatactggctgtgtgtgtgtccatgtatgtatgtatatatgtatatgtgtgtgtgtgtatatatatatataaatacatcaaaaataaacatatactantatattgatgttggtnggnggatttattggtaatgctgctctcctccaccacccccaagtccacccacctttgaactttc

SEQ ID NO: 22247 - DNA, 678 bp, Homo sapiens
  misc_feature 395, 475, 637, 654: n = A,T,C or G
ggggtttctctatccaatcatttgggaatactttgcctgctatttttgttttatattacattttggttaaaacagtgcttgaggccgggtgttgtgactcacacctgtaatcccagcacttcgggaggccaaggcagatggattgcctgagcctaggagttcaagaccagcctgggcaacatggcaaaaccccatctctactaaaaatacaaaaattagccagacatggtggcgcatgcccgtaatcccagctactcgggaggctgaggtgggaggatgtcttgaatctgggaggcagaagttgcagtgagccaacatcacgccactacactccagcctgggcaacagaatgagaccttgtttccaaaaaaaaaagaaagaaaatgattttttanaaaaggagcccggcgtggtggctcacacctgtaatcccagcactttgggaggctgaggcaggcggatcacctgaggtcanaagatcgagaccatcttggctaacacggtgaaaccccatctctactaaaaatacaaaaaattagcccggcttggtggcgcatgactttagtcccagctactcggaaggctgaggcaggagaatcgcttgaacccaggaggccggaggttgcagtgagccganattgcaccactgctctncaggctgggtgacagagtaagact

SEQ ID NO: 22248 - DNA, 711 bp, Homo sapiens
  misc_feature 1, 22, 682: n = A,T,C or G
nacgacagtagggtagcaaggnaaaataatcatgttaattattaatgtcaaccagcgaatgagaaaaaggtgatatggcaggtccatcacatagataccctcatgatattgtgcaattatttagtagaaaaataaaaatgaaagtgaatggccctaagtagctagcacaaaagaggtagatatttggatgaatgacactttgaaatacgtatattgaaacacaaatcatacacacacacacacacacacacacacgtaatacgtgatcattaatctatgacattgtagtattagggtagtaactctattaagatttaattaaaaaattagtaattcttccaaatctgatattataagtgggctaaaaatgtaatcataatgtattttgaatgtttcacttctaagcacaaatagaaataatctaatgaatttccatgtaaatataatattagttatattgaaataattaagaatgcagaaagaatataaatttagtgaaacattttcccttcccaggaaaatctagctgcataattacattgtagtaaaattttgcttgtcaaaatttatattttacagccaggcgcagtggctcacgcctgtaatcccagcactttgggaggccgaggtgggtggatcacaaggtcaagagattgagacaatcttggccacttggtgaaancccttctctactaaaaatacaaaattagt

SEQ ID NO: 22249 - DNA, 731 bp, Homo sapiens
  misc_feature 3, 4, 14, 15, 27, 32, 43, 61, 62, 63, 66, 73, 75, 79, 88, 89: n = A,T,C or G
ttnnaactggggtnntaaaccttgttntgttncttttggccgnagcggcctacggctgcgnnnagncgacagnangggnaatgccagnntaaaggatttgaatttattttatatgcagcaggaagacattttgattactgacctcagtttcatattttaggtaagtaattctgagtgcacagtagagcgtgtattggaaagaggaaaagagattggaaacaagaagaatatgtaagaaactctggctcttgatgtatgataaggctctttagttgagaatctttcagcatgtaaccttttactatcatgtaatcttttaagccttatcacaaaaagccttcagggcttccttggtaacttcattttgactttgttaaaagaaaaactttagacgaaatcaatttatcagaatttgtttttgtgttaaaggattaatgaatttggcagcacccaaaattagaagtagttcagggagctcttgttttaacagagtaagcggcagacctttgcaggctgaatgtggaagcgaagtaaagaaattacttgattggactgggcatagtggctcatacctgtaatcccatcattttgggaggctgaggtaggtggatcacttgagctcaggagttcaagaccagcctgggcaacatggtgaagctccatctctacaaaaaatgcaaaaattagccaggcatggtggcacatgccagtagtcccagctacttgggagg

SEQ ID NO: 22250 - DNA, 692 bp, Homo sapiens
gggatttaatttacccccatctttgaataatttgtctcagaaagtttaatatacatacaaggttaaacaactggttagtgttaaccctacaccatgtcttgatctcaatactgttctttgcgctgttgcatcctttaaccaattaattaattaattaattaaatgcaatttttatcacatgcctactaggtgtcaagaattgtcctgcaggatggaggcacattagtgaacatgacagacaaggttcttgtcctcaattcacacatctcatgctatcttggaagctgtatgttgcctgacttggagttctaatcaactgatatatacaacttattataattttcacttccaataaagaaattccatttgttgattttcctaacacgttatcctcctattcctgtttgtttataagaagttaaataaaaactatacatttcaaaagacaaaataaaatctacctactcttggctataactaggccggcttctagatattagctctcttaatttattatgccatttattcatgtgatgattgacctactgaagccaagttgaaatgatacatgttacattccatgaaatgttttctattccagtcattcagacatcttttagttgccatctacctgctgctttgtgaattgctgagatcaaagaaactgctgaacagagttagacattgcattt

SEQ ID NO: 22251 - DNA, 423 bp, Homo sapiens
  misc_feature 385, 390, 392, 393, 394, 395, 396, 400, 401, 402, 403, 404,405, 414, 416, 417, 418, 419: n = A,T,C or G
gggatatgtgaaaactgcagctcaaagaatttaaaagacatgattgaaatcccataactaggtaaagatggtcaagtctggagcccacatgtcgcggtccccccacaccctgttacggagagtgcgaggcttcaccaggaagctcttttggctcaaggattagctctggggaagtgcagcaggcaggcctgctttgcatccttttaccagcagaaatcctacgtttgtttcaagtttctagttctttttgttttttttgtttcttaccagcatggctctgggagttatttacacaatttaattttaaaagagacagtccccatcactaaggttccttggaaacttatcatgcaaaaaaaaaaaaaaaaaaaaaaaaaagcgcccnttttncnnnnncccnnnnnnaaaaacttngnnnnttgg

SEQ ID NO: 22252 - DNA, 485 bp, Homo sapiens
  misc_feature 337, 479: n = A,T,C or G
gggcttctatagctttctttccattcatggttgtcaggcctgctttgtggcctttttctcttttgtacagaatcacatgcaatgctgcttgcacaaagatatctaaatttctgtctgaaggacctattgcttttgtgaaatgcctccagactctgtttggttccaaggacaagaagtaggaagtcatgttttttgcttctttatatttttgatttttccttttgtggctatatcaattgtaacaaagtcagcttctttttttgtttttttcgaatagagataaggtttgcctatattgcccaggttggtcttgaactcctcggctcaagccatcctnccacctcagcttcctaaagtgctgggattacaggtatgagccaccataccaggccacaaaggaatatttaaccattttgaattaagctttgtatccttgcatccttagaattataaaggtgttagaatttgcctgtgtttancaaacc

SEQ ID NO: 22253 - DNA, 670 bp, Homo sapiens
ggggaactcagccctgctgctctcattatgtcttccccaaaccaggaggcagttgcaggtcagtgattacccatggaaagagcatctggccaccaccaaaccttggcgttctactctaccctagaccagtaggtaagcccaagtccacacatgtctatagggcatatcctctggccttgtccaccttgtgtggctgagtaacaaccacaaaaatctcacccagcatgggagcctgtcatacagctgtgcccaactacaggttccaaacaacagagccagggaagacaacttgcaactctacctaatcagacatggctgcagagtccaaacagcagcctcacctgatggcaaagttcagctagtggtttcactgatcacagagcacagccagaaatactatttgatctcagagcacaggaagcagctcagcccaattatagaacctgacaccaagcaaaggctgccagccacccctccagaatctcaggctagactaaatggtaaagatctataaccaccaaaaaacacctgcaaaggctggaaaatttggctttctcctcaaatgcacaggcataaggacacaaagataatgaaaaatcaggcaacatgacaccaccaaaagaaaccaataaagcttgtgtaatagacccagaataaatggagatctatg

SEQ ID NO: 22254 - DNA, 678 bp, Homo sapiens
  misc_feature 668: n = A,T,C or G
ggggcggctgcctttatcaggccattctggtggaacaggttagcttcctgcaagggtggaaaggaaaacgatgttactatttttagcctgcctcttgtgtacagcaaggtgggctgatgtgctaagcagaaggaaagtgaagtgtgagttgctttctgcccccaaccttccatttccacccctacttcccaaaacctcccccagaggtggaatgtcaggacatctcacatgtggtgcacgaagagtataatgaccaactttatttctacaactagtgaggctccttgtcactgcctttctaaaagcttgcagtcttacaaacaaacttgtgtgcacagacatgagtggataaaatattgggtcctgcctagcaaaaccaggatctttgatttggggggaagggttggtgttgctctctgttaacatttccatttattcttgacctctataaagagtaaattataagaatggggtgggaggattggaaagttggtggatggtaagtttgggtgtcaagtattaagaaatcctggcttctcagcattttctttgcagggcacatttagcagaattttctgcctccagcagggtctttgtggctctgaaggacctgccaccgtgggggtggttcgcttttataatctcatggtagcactctcagcccaaanaagtgtcatc

SEQ ID NO: 22255 - DNA, 684 bp, Homo sapiens
  misc_feature 348, 349, 357, 360, 363, 365, 370, 371, 377, 384, 389, 392,393, 396, 398, 400, 405, 412, 423, 424, 430, 433, 439, 448,462, 473, 477, 479, 484, 489, 504, 505, 517, 564, 571, 574,581, 594, 608, 610, 616, 624, 642, 657, 660, 662, 665: n = A,T,C or G
gggtctaagcttcattccagaacatactttcatacagctgtgtctatgtttggtatgtctttgaatatgcataagagtctaagtatttgcttctggaaatatttacttccaacttctttaaagataaagcatctcatttatttagaatggaatgtttgaagttggaggagtctttagagatcatcaactccagcttcttctctctgcagctgaaggctggaggatccagagagattcaggggcttgcccaaaggtcatactgattgatcagagttgaagttgacttcatagcccagtgttctttcctctgcaccataaaggagcaattcttttttttttttttttttnnaaacaaanttncantnttgtnncccggnctggagngcaanggnncantntnggttnaccgaancctccgcctcnngggttnaancatttntttggcctnaccctcccaagtanctgggactacnggcntnccccnccacncctggctaatttggnnttttaactaaanatggggtttctccatgtgggccaggctggtcttgaactcccgacctnagggganccnccccttnggcctcccaaagngctggtttataggngngacccnccggcccnccccataagggacaattntaaagctgaagtttncananccnctgtaataaaaattaaaga

SEQ ID NO: 22256 - DNA, 682 bp, Homo sapiens
  misc_feature 22, 604: n = A,T,C or G
gggggattgttataagtcaggnaggaaggagaagttgctccttaaaaacccttgtattatgccaagaccctaatttctgtcttaaaaaagtatgctttacaccttaaagcagcacttttattttgcacattgataatgctgtatgtatactttctttttttccattttattttatttaaaattttttttattttaatagcttttagggtacaattgcattttggttacaatgctgtatgtatacttccatgtagttttcttaatcagtaaaatgatctttcatgttaaagtctctatttgttagttttccctgactgtaattttctttctaccttgtataaatgataaaaatagactctaataaactgagtgtgctctggcatactagttattgacatgtttatattcacaaatataaactccaggctggctgtttttcttggtgaatgttctccaggctggttatttttcttggtgaatgtaatgtactgtctttttagagtaagttactaagctggttactaaatcaggaatattttagttataaaactttagatttttaagaatattggccaggcacggtggctcacacctgtaatcccancacgttgggaggccaaggcgggtggatcacctgagatcgggagttcaagaccagcctggctaacatggtgaaacctgt

SEQ ID NO: 22257 - DNA, 698 bp, Homo sapiens
  misc_feature 8, 17, 19, 22, 30, 46: n = A,T,C or G
gcggcctncggctgcgngnagnacgacagnagggggcggtctgagngaccggttcacgtgcaggcagcggcggatcatattccttcatctaccatggctcagccgggaactctgaacctcaataacgaggttgtgaagatgagaaaagaagtgaagagaattcgagttttagttatccgaaaacttgtcaggagtgttggccgactgaagtcaaaaaagggtactgaagatgcactgttaaaaaaccaaagacgggcgcaaagattgcttgaagaaatccatgccatgaaggaattgaaacctgacatagtaactaaatctgctcttggtgatgatatcaactttgaaaaaatcttcaaaaagccagattctactgcaactgaaagagcaattgccagactagcagtacatcctcttctgaagaaaaagatagatgtgctaaaagctgctgtacaagcctttaaagaagcaagacaaaatgttgctgaagttgagtcatcaaagaatgcttcagaggacaatcattctgagaatactttgtattcaaatgataatggaagtaatttacagcgtgaagcaactgtcatcagtgagcaaaaagtcaaagaaaccaaaatattggcaaagaaaccaatacataattcaaaggaaaaaatagcaaagatggaacatggacctaaagcagtgactattgcaaa

SEQ ID NO: 22258 - DNA, 709 bp, Homo sapiens
  misc_feature 2, 12, 23, 41, 43, 73, 142, 630, 686: n = A,T,C or G
tncggctgcganagaacgacagnagggtttcttgaactagnanataaactgtgttacacagtggcaccatggnaaatatttaagcaaaatgaatttatgcaagatgtagaactcttttctatgttgttcattaagacatggnaatggtttcaatgttttcaaaatatcaaaatatactctttagtggaagataaaatgatttataattaaggcttgggaacaaactcaatctgctgctttttacttattagtgaaatggagcatattatttagaacagtttcagtgaaccaaaggcagaggaaaaatgttctttaccacttttgagagtcagctgctagggagagagactttctgttgtggatggtgcacaaggttcctcccacatgccagctccacactatttgttgtgacagtttggaaggctttactgaaaaggattttaaggtttcttcctggctcagtgggaaagtgtcattatgggttagcaatttatcctttgtgttattatattagtccatttgcacactgctgataaaaacatatctgagactgggaagaaaaagatgtttaatggacttactgttccatgtggctggagaagcctcacaatcatggcggaagacaaggangagcaagtcacatcttacatggatggtggcaggcaaagagagagcttgtgcagggnaactctcattattaaaccatcag

SEQ ID NO: 22259 - DNA, 652 bp, Homo sapiens
  misc_feature 641, 648, 651: n = A,T,C or G
gggggcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggataaatcatacggtgattttagatgatccatttgatgaccctcctgatttattaatccctgatcgatcaccagaacctacaagggaacaattagatagtggtcgaataggagcagatgaagaattgatgatttcaaaggaagatcagctgangaagtanaana

SEQ ID NO: 22260 - DNA, 566 bp, Homo sapiens
ggggatagcaaagggttgcccttggctacaggaggacgcgggctggcaggcttggttcctggcgagtttctaagcccccgcctgcggtctgaggcaccggctgaaccatgtcggagatcctgtgccagtggctcaacaaggagttgaaggtgtcccggaccgtgagtcccaagtcatttgcaaaggcattttccagtggctatctacttggagaagttctacacaagtttgaacttcaggatgatttttcagaatttttggacagcagggtttcaagtgccaaacttaataatttttctcgcttggagccaacacttaaccttctgggtgtgcagtttgatcagaatgtggcccatggcatcatcacagaaaagcctggggtggcaacaaagctgttatatcaattgtacattgctcttcagaaaaagaagaaaagtggactgactggagtggagatgcaaaccatgcaacgtctgacaaatttaagacttcaaaacatgaaaaagtgatacttttcaagagagacttagacacatgataccacgtcaaactgatttcaatctgat

SEQ ID NO: 22261 - DNA, 693 bp, Homo sapiens
  misc_feature 31, 677, 685, 691: n = A,T,C or G
acgtggggattatgggaactacaactcaagnatgagatctgggtggagacacagagctaacccatattacattgcaacactgttattctcctttctccaattggctacattttaataaatgataatatgccactttcagcaatgaccttggagtgaagtactctggctccccgctggtagaagtccaagcacggctttttgaaaaggttaagatgtgacctatcctttaactcggcaattccactattgtgaattaatcataaagaagtaatgagcatttacaaaaatgtgtatgtgtttgtatatcagtgtgtgtgtgtgtatgtgcacacacacatccacatacaaatatgtgccctcatgtgtgtgtgtggacaagaagtcagaggcaatagattgaggagtaaatggtgacaaaggcattgattgtaaacaagtcttcctaggaaattacttatgaaagatagaagaacaaagtagctggagcaagaggtaagacctgaggaatctttttatgttagggaagatttgaacctgcgtaaacattaatgagaaagaacaaataggctaaaatagatgagaccaaaggagaagtgaagggaggagttcaccaagaagcgagaggtatagaattggcagcacaggtggaggaagcacctattacattgggctggganggagtgangtacanat

SEQ ID NO: 22262 - DNA, 613 bp, Homo sapiens
  misc_feature 377, 393, 396, 397, 408, 418, 424, 469, 502, 516, 536, 553,556, 557, 563, 567, 587, 588, 589, 598, 599, 600, 602, 603,610: n = A,T,C or G
gggggaatctcagaatcaagttctggggtcagggcccacaattggtggtttaacaaatcatccagatgaaattgatgcacactaaagattcagaaccactgttttaactactaccctgtcatagtccattttctagtgcttatcacagaatatctgaaagtgggtaatttataaagaagagaaatttatttcttctagttatgactgaggagtcccaggtcatggggctgcatctgttgagagcctccttacttgtggggactctctgagaagtgccaaagttagagcaggagtgccaaaagttagagcaggaaccagatttcctggtcttagcatacaagaaaatggaggcgatgggaatagagtgtgcgtttctnaagtttaagaagtcanganngaaagaaatanagcatactangtacanagggtgactgtgccaagcaaggttttcagttggggtgggcaggancagtaaaactcatggaatggaggatgtgctganatacttgagaacangcctgaggagatggaaaganatttaaacctttatctnttnntgattntatnatatgaacctctgttccttnnnatgttcctnnngnnaattgtnctt

SEQ ID NO: 22263 - DNA, 750 bp, Homo sapiens
  misc_feature 1, 9, 631, 638, 652, 677, 699, 721, 722: n = A,T,C or G
nacgacagnagggggtcttgaccgaggaagttgaacagcagccactgcagaacctctagaacccatgtccttcatctttcctactgactagaacattaatcttcaggaaggatacagaactgcagcctgagggcactggtggatccctctagagaaggggaagaagaatggcaaccactagcaatattcaactcagaatcatattccctgtcattcctaagaaacaaatgccctaatctacaggaggaagggcaaccaaaatgtatcctgaggttcctggtggaaactcactgtacccagaggaggagaaaagaagaacacaaaaaactctacccatggggaaggggcaggaatgtgcgctacctaacattacggtatatctggagaaagctcaggaacacttgtgaaggacacaccaccaagactcttgttcagagtgcctacctgaggctgaggcttaatcggaacatcagataccatcttctctcctccactctccaaccaccacactaacaagctttgagaagaataacagtggaatacaacttggagaaccatgcaaagggagacccaaagccaaggagggacactcatagccaagcagatagcagtcttcacaaacactagactnctgaccnattaacagaacctnccactgagaactaacagaggaggangcttctctctccagctgcatgngcttacctggatcactgtctanngaatgttggcttcacaaaatacagacta

SEQ ID NO: 22264 - DNA, 628 bp, Homo sapiens
  misc_feature 314, 347, 399, 505, 527, 534, 552, 556, 570, 573, 574, 581,582, 584, 587, 600, 607, 622, 623, 626: n = A,T,C or G
gggagtggctcacccttgtaatcctagcactttatgaggctgaggcgggtggatcacctgaggttgggagttcgagaccagcctgaccgacatggagaaaccccatctctactaaaaatactaaaaattagccaggtgtggtggctacatgccaaggattacatgcctgtaatcccaggtacttgggaggctgaggcaggagaatcactttaacccgggaggcgaaggctgtggttagccgagatggcgccattgcactccagcctggcaacaagagtgaaactccgtctcaaaaaaaaaaaaaggaataaatncctttataacagaaacttctaggtttcagatanatagacccaatagcatatattttaagaagtatccaaaaattcaaatatactntgtcaaaataatattggagaatctcttttttataatcaaatttgacctatatctttaaatattatttatcttactttgttaaagatacatgtaaggccaggcgcantggctccccctgtattcccacnctttggnggccgaggcggacagatncaanctcaggagtttganacnncctgacnncntgnaaacccctttttnctaaaanccaaatttactggcnnggnac

SEQ ID NO: 22265 - DNA, 703 bp, Homo sapiens
  misc_feature 554, 581, 605, 614, 630, 644, 646, 650, 651, 658, 661, 681,694, 695, 696, 697, 698, 699: n = A,T,C or G
gggcagcatcggcatcaaccaccacctggctagaaacacaggccccactcccaaacgagttgaatcaggatctgcatttgaataaaatcccaacatgctttataccagacaggagttgacagtagtctaatagtagatgtagggatgtgtatgtatgaataagaaatggagttgctccactttcctcatgtttcctcttttatttcccttgcctactagaagattacatttgggagaagccacttcccctctctggatctctgtttcactacctatgaggagattaaactagactgtctataagagtccttctctgagttgttctctgatcttggattctaaaggctggcacttgtatgaaaccagctgtcctgctttctggaaaaagtccagcgccattgttaagcaggaaaatttctcctgtgtggttctgccaaaacaaaagctcagactattattcagatctggctggcaagagagatttgtcaactacatgtttattgaatgatgaaacagctgcacacattcctgcacagaaaacacacattgtctangtgacaaagagtaatgtggacactcanggccatcttctgacccttgctagnttttttggnagttggttggtttggntctttggatttttngntggnntggggcnggnttgaaaaggggctattttgncctccggtggagnnnnnnctga

SEQ ID NO: 22266 - DNA, 724 bp, Homo sapiens
  misc_feature 468, 603, 606, 609, 611, 620, 631, 653, 723: n = A,T,C or G
ggggacaaattaccaccagcttaaaacaacatttgttctctgacagtttctgtgggtcaggattctgggcatagcttatacctggatcttctgcctaggttatgagggtgccatcagggtgttggctgggctgcgttcttaactggaagttcaactgagggagaatccacttgtagacttagtttgctggcagaattcatatcctatggttgtaggattgaggggcctatcttcttgttggctgtcagtaataagctgcattgaccacctaaagaccatgtgaagttcttgtcatgtggactttcccaacatgcctacttgcttcagggcaacaaagaaagtctagaggtagtctggtagtaagacagaatcttactataacatgacttaatcactggggtaacatcccatcacctttgccgcattctttgagttagaagcaagtcacaggttctgcccacatgcaanggggaagggattatagaaagataggaataccaggtggtggaaatcatggagggtcatgcaaacttagaactttatgaagtaggcttgttagtcatttattcatcagatatttattgatgtaacatatacttttanccntgnanagtactggnatttgagtttnctctagtctcacaattagaaancagacaaaaatatgaaaagactgttttaccctgacctaaaagggaacaaccagggagcccatgtgcttgna

SEQ ID NO: 22267 - DNA, 804 bp, Homo sapiens
  misc_feature 122, 566, 626, 686, 696, 708, 717, 721, 725, 751, 766, 771,787, 793, 794: n = A,T,C or G
gacgacagagggggcggcacagctggtttgagcaactgaactggaaacaagatgcaggaccccaacgcagacactgaatggaatgacatcttacgcaaaaagggtatcttaccccccaaggnaaagtctgaaagaattggaagaggaggcagaagaggagcagcgcatcctccagcagtcagtggtgaaaacatatgaagatatgactttggaagagctggaggatcatgaagacgagtttaatgaggaggatgaacgtgctattgaaatgtacagacggcggagactggctgagtggaaagcaactaaactgaagaataaattcggagaagttttggagatctcagggaaggattatgttcaagaagttaccaaagctggcgagggcttgtgggtcatcttgcacctttacaaacaaggaattcccctctgtgccctgataaatcagcacctcagtggacttgccaggaagtttcctgatgtcaaatttatcaaagccatttcaacaacctgcatacccaattatcctgataggaatctgcccacgatatttgtttacctggaangagatatcaaggctcagtttattggtcctctggtgtttggcggcatgaacctgacaaganatgagttggaatggaactgtctgatctggagcattatgacagacctggaggaaaccctanaagccatganacgtgttgctgnctcatgcgngctntgtnctctgaaaaggaagcgattcccaggngctgagctcagcttntttantgccgactttttgganaatggnnggattttaaa

SEQ ID NO: 22268 - DNA, 336 bp, Homo sapiens
  misc_feature 255, 259, 267, 276, 281, 288, 289, 294, 303, 304, 311, 313,317, 320, 321, 327, 330, 332: n = A,T,C or G
aggggaatttctgaggcagacaccgaagaactaaaagatgcattaagcatgttggtttggaagagtttgaagaatagatagaggaatagaatggtggacactgacaatctttggagccattgagggaaatgtggcttctgttgtttctggcaaggatagatatgtatgtctggaagccaatcttagctcttgctttacaatctcttatgatgtcttcttttttttttttttttcaaaaaaaaaacccttaaagancttnaaaaaaanggttctagnctgtngcccttnnctatnctgggtttnnagccccnanggtnganncccccnttngntgca

SEQ ID NO: 22269 - DNA, 780 bp, Homo sapiens
  misc_feature 475, 571, 611, 652, 658, 673, 675, 687, 711, 716, 724, 727,732, 735, 743, 750: n = A,T,C or G
gggattcaatttctcagtttcaatccagaatgatcaggtaaatcaactgttttctttttatacttcgttaaaaggaaagtggggaggggggtggtaatttttacaggtttaatgtagttaaatgaatgtacctaaaggttgaagatttttgtttagttgcagaaaatagagtttaacgtctgtgtttaagataaatttaatgtctaaatgtattttatttgctgtataacactgaaagcactcattagagaaatgttgagactgaattttttaatatgctgatctttattttctaactttctgtgctgattaaattttattatctgtattcatcagagcgtaggccatacaaatgaatttaaagacatttttctttgacatcctagacaaaaatagaaaagagagtcattaaaaaaaatttttaggttgtgtgtggtggctcacacctgtaatcccagcgctttgggaggccaangcgagaggactgcttgagcccaggagtttgagaccagcctgggcaaaatggtgaaaccctgtctctacaaaaaatgcaaaaatagccaggtgtggnggcgtgtcacccgtggtcccagctccttggtggatgaggnggaagatcgcttgagcctgggagatgaactccgtgagtgcncctgcnctcaacctggggaanancaaaccccgctnagtaaaaaaaaacaaccaaaaagnttaanaaatggcnttnttccnggnaaaaatgntttttgnggaaaaaaaaaaaaaaaaaccccgcgccct

SEQ ID NO: 22270 - DNA, 690 bp, Homo sapiens
  misc_feature 6, 182, 215, 220, 224, 258, 280, 298, 299, 308, 310, 313,321, 351, 392, 398, 449, 462, 475, 486, 512, 538, 545, 579,631, 649, 658, 673, 675, 681, 685, 686, 689, 690: n = A,T,C or G
gacagnaggggagcattctgttttttgatattgagtattttataaatcctttattcttctgcactataatttctgacaatcctcccgagcttttgaggctataggattacttgtgtctgtgatttcttgtgtcacagatttctgtgattgggagagcggactactgtttttttttttttganacagggcctcaatcccattgcccaggctagggngcaanggcncaaactcggttcactgcatccttaacctccctgngctcaggcaatcctcccacctnagcctcccaagtagctgnnactataggngngcnccaccacncctggctaatttttcaaatttttggtaaanacggggttttgccatgttgcccaggctggtctcaaactccngggctnaagcaagccacctgcctttgcctcccaaagggctgggattacagggatganccaccatgcccancctctgtttactntttttaactgnaagctgttgcataaaactgctggcanaagttccccatattcccattctattngccccanccatttatattttctgcttctaacataaaataanctggggatgggggaagcataaaaaaccaaaatccaagtttattggatttgtntgcaaactaaaaaaaaancctctgagngagggcctgcttctntntcccanttcnnacnn

SEQ ID NO: 22271 - DNA, 493 bp, Homo sapiens
  misc_feature 221, 244, 305, 395, 399, 411, 413, 415, 418, 419, 451, 452,466, 469, 472, 476, 483, 485, 487, 489, 492: n = A,T,C or G
ataaccttgacagttttgaggagtactggtcaggtgttttgtagaatattcctcaatttgggtttgtctgatgttttcctcatggttagagtggggttatagatttttaggaagaataccagaggtgaaggtccttctcactgcatcatgtcaggagttacatgctatcagcttgatggtgtattaactttggacacttggttaaggtagtgtgtgttggntttttgctgctgaaaattactgntattttccctttccatacttctgttctttgggaaaacagtcactaagtccagtcatgggangtggtgggtgggaaagattacattcaaccccctggagtgggaatatccatatgtagatttggaatttttctatatgggaaattggttctncctnccccctatttgntncntcnnatggactcatgttattttgatttgggaaccannttatttgtgcttantgnccnctgntttagantntncnggng

SEQ ID NO: 22272 - DNA, 772 bp, Homo sapiens
  misc_feature 10, 624, 655, 668, 678, 687, 693, 694, 721, 726, 742, 750,761: n = A,T,C or G
agacgacagnaagggggaaggttttaagtagagaaggttaatgatgaaattgtgtgatacaagatcaccctgtcagcagggtagaggatagattataggagtgggagaatagaggcaagaaaatgagttaggaggcaactgaaattgttcagacaggaaacaatgaagccctgaactaggacaataactgtgggaatagacagagaggaggagatatgttcaagagataggcaaaattgacacaatttaataacctttgggctgggcatggagagaaggaattttggattgctcccaggtttctgccttatacaactaagcaagaaaagctatgaggaggaagagtagattttggaggatgggggaagattacaaatttacttttgaaggtgtttaatttgggggtgttaggggagcatccagactggcagttggatttagtcaggaatgctggagatgtcagggacagactttggcagtcatctgaatcatccaaatcatggtaatagttaaaattatggagtggacatttctcaggaaaaatatattgaaagatgacaaaagggagaaggtcctttatatacagtgcatttctggaatggagagaggaagaggagcctgcanagatatcatgagcactattatgtgccagtcnttgtgctagatangggagaccanatgactggncccaannctgctgcaaagtgtcatacttgtcaantttanaggtcttattaccttncccccccnaggtatgctanagaggatgccc

SEQ ID NO: 22273 - DNA, 714 bp, Homo sapiens
  misc_feature 101, 117, 225, 259, 319, 340, 410, 437, 443, 472, 505, 533,571, 596, 599, 602, 603, 604, 608, 615, 639, 651, 661, 662,689, 697, 706, 707: n = A,T,C or G
aattatgtagagttaggtccctaaacaaaattctttgtttctcttgtatttcttcttgttcttgtcttgatttttttttttttcccttctttgttagctgngttctataattatganagtagcacctttgaggcatttgatagttaccttagggatatttactgatcacagtaaagcaccaaggtactgcctggggagtagttgaataaaataaaaaaacttcanaagtaacttttattgttctcttactaaatgaagngatgagtttatagccatcttttatcagttaggatcagttagcttttttgttggagtcagngcttttgattacaagtaatanaaaatcctgataactctctttaaacttcagggaaattcattatctgtcataattagtccaaagatggggnggctcaaagcacaatatgactaggggncaagtngctcctcttccttctggcctccttcatgngtaacctctggcctcagggtagtaacacctaanagcagttcccactatcatgtctatatgngggctgcctcggaaaaaaagggctctcgtgctgggcanctctgtagggagtatggaaactttnccncgnnntaanccctttnttggctcattccccaaaaggcctntgcccttaaccncttctttcannaacctgaaactcccctttaaaactttncccccacncccggtttnnagggggg

SEQ ID NO: 22274 - DNA, 618 bp, Homo sapiens
  misc_feature 382, 405, 487, 489, 492, 508, 510, 515, 523, 535, 548, 555,562, 565, 566, 568, 576, 581, 593, 599: n = A,T,C or G
ggggattttttttctctcttgaagcatgtagagtcttcttttggtctccagtgtagtgatatctcacaatgttatgccctttcctagatacttactgacttccattttgaaaaattttctttagttatttgatgatttcccttcctcttttttctatttttggtactcctgttacgtgaatgttgacatcctggtctagtctcattttatctttttttcccctgttttctgttttaagttttttttgctgtactttttgagaaatttcttcaactttatgagtttttcatttctgctgcaatttttaatttccaggagctcatttttgttttcagagtactcatttttagagcactttacttttataaagattgcagtctgntttggtacatataccgttattanttgggaattctatctattgaaagagtgagattttctcttctatcaatcattcaggactcatggatttttcttttattcattngnagncaatgagtataatggncntttgntaagtttnaatgtatggggncttttaaagagtnagggagnggttttntanncntggagacnttggnaaaggaaatatntctttngccggctgggcccagcctg

SEQ ID NO: 22275 - DNA, 581 bp, Homo sapiens
  misc_feature 401, 444, 448, 452, 497, 512, 523, 526, 537, 540, 549, 551,552, 562, 564, 568, 570, 572, 576: n = A,T,C or G
ggggaaattcatagggaaggcctccatgcaggaaacttgggcaggatttctatattacaatattgaggcagaattccttcttcaaaaacatgtttttgcttttaaggccttgagctggtgggatgagagccagccatgttatccagggtactttccctttacttaaagtcagctgattgtcaattgttaatcatctctacaaaaccttcacagtgccacctcgattagtatttgaccaactaactaggcatcattatgtagccaagctgacacataaaaattaagcacccctaggtgaaaaggtactgcctgcagcagaagagggtgtgaggggcacagagccccctcctggtcatgaaacattgaagtcatgcttcacctagtcatgaagcattaaaggntgtggcagccttgttctccatgctttttcagtacatttgatgntgtntggngggggcaggagcatataagccagtgcaaatggtttttgttgcggnctccatacagaccangggtctatttnttntttttttaaanctngaaagaagntnnaacatttacntnatcntnanagcnaaaag

SEQ ID NO: 22276 - DNA, 771 bp, Homo sapiens
  misc_feature 580, 583, 620, 676, 677, 683, 690, 693, 702, 707, 709, 727,729, 739, 763, 765, 769: n = A,T,C or G
gggatgggctgcccagaggtctcctctaaagagacagtctctagggataagaacatcacgcacctcatgaggacatgtccaggatcaagccccaccagtgaggacctaggtgccaatctgaacagcccttactaagggacagtgatcagagagggtctagggagaacagaggttcaggccatagaggtggtgtggttggaatgtttattctagaaattattcataggcacaatcgaggctgtcaaacttggtaaagaatggaaactcattctacaggcctggttttagcctgcagcaggcaggcagcagggtatgagtggagaacaaaacactgtgaacagcatttcaggatactggagagaggagcaggtatacacagaaatggtactaaagtgtgcatttgggctgggcacagtggctcacacctgtaatctcagcactttggaaggcaaaggcaggtggatcacctgaggtcaggagtttgagactagcctggccaacatggcgaaaccctgtctctactaaaaactcaaaaattatccgagtgtggtggtacacacgtgtaatcccagcagctcangangctgaggcaggagaatcgcttgaacccagaagcagangttgcagtgaggccagatcgtgccactgcctcaccctgggtgacagagtagattcnngaagangaagaanaanagagaaagnccccnanaggccgagacgagcccgncnaagtaggaanatgaaaaaaaaaaaaaaaaaaccntnggcntt

SEQ ID NO: 22277 - DNA, 684 bp, Homo sapiens
  misc_feature 10, 490, 495, 507, 514, 549, 555, 568, 572, 584, 602, 607,633, 642, 645, 649, 664, 667, 668, 672, 673, 682, 683: n = A,T,C or G
agacgacagnagggactgttggcaaaggttggcctctttttcttgctgcacgtggctcgtatttaatatactactgcagaataactttgatctctctgcctttagacagaagtcaccaccactatccccctaaagctattggctagcatttctttaaacaagcaggctgcacagagctcctcatgtgactccagcaggggaggaagggaggaagttgcgtgggttggacacccagagctaagaagtagagagatgtaggtagaagggccagccaattggcagcagtaggctgcaacagccacacacttgccccgggaagtgggaaataggagggatgctagagcttggtttctaacatggcaaagatctatgagagcgagagagaatagtaatggagtaaaccaaaggaagaaataagatgcctccagagggatatggcagctttaaaacatggcctcaaaatcctttgacactccttccatcaagaaanggggnctatgtctcttncccttgnatcctcttgggactgcttgaccaatgggatggggnagaggngtcagtttctggngcanaccttcaaaaanggggcgcttctactttgngtatnctgagaagcttgctcccggaacccancccacatgntgngaanaaaccctaaaaaggnccnntggnnaggaactgnng

SEQ ID NO: 22278 - DNA, 577 bp, Homo sapiens
  misc_feature 91, 123, 127, 189, 222, 294, 297, 323, 326, 328, 330, 343,348, 362, 374, 378, 380, 398, 435, 444, 461, 464, 468, 476,487, 509, 510, 515, 525, 526, 528, 537, 550, 553, 554, 559: n = A,T,C or G
ggggggagggtctcaagctttccccggtgtcggcggcaggtggaatttccacgctttatctgcgcctgcgccgcgcgggattcgcggtccnagctgaagaggttcgcggtccggtttcacttntccnaaccctgaggcagtgtgtgaagctgggacgccagccatgttccagaccgcttggcgccaganacaatcttactctgtctcccaggctgagtgcantggtgcaatcacagctcactgcagcctccacctcccaggcctaagtgatcctcccaaggagttgagactcanttnagactacaagaaccagtgacctttgnggntntngctgtgtacttcncccanaatgaatgggccancctggactctgngcananggccctgtacaggggaantgatgctggagaattatgcaatgtggcttccctggcnttcccattnaccacgcctgttctggnctnccantggagcangggaactgccntgggcctcaatcctggaacctnnggcanggaggctttnnangtttgtccnggatgaggcccanctnnaaagnaggttactccaaggatct

SEQ ID NO: 22279 - DNA, 573 bp, Homo sapiens
  misc_feature 370, 402, 424, 440, 489, 491, 496, 498, 507, 522, 525, 529,531, 542, 544, 545, 551, 553, 559, 567: n = A,T,C or G
ggggagctgcaaatacatatttttgaatgagtagtggttatcggtcaggataggctgagtcatgctctgataataaagtgcctcatactccgcagtggcttccccagcgttgtgtttctcatgttccaggtccggccaggctggcagctcctgctggtcatgttttcctcatgttctgtatctggcacaggctggcagctcctgcttcttgtcatgttttcctcgtgttccatgtccggcacaggctggcagctcctgcttcttgtcatattttcctcgtgttccgtgtctgacgcaggctggcagctcctgctggtcatgttttccttgtgttccaggtctggccaggctggcagctcctgcttcttgncatgttttcctggcgttccatgcctggcacangctggcagctcctgcttcttgncatgttttccttgggntccttggctcacgcaggctggcagctcctgctgggcatattttcctcgngntccgngnccggcacangctggcagctcctgnttnttgncnaatttccttgngnnccttgncngagcangctggcanctcctg

SEQ ID NO: 22280 - DNA, 524 bp, Homo sapiens
  misc_feature 479, 484, 486, 487, 496, 501, 505, 506, 509, 511, 513, 514,515, 516, 521, 523: n = A,T,C or G
gggaactatcttttgggaaaggatgccattcctaaaattaactcccttctggcaaatttctccctgccaggtacctaacctccccagcatgatgtttttctaccatttgccttttggattcctagaagtattttatttggatgtgactggtttgaatttggagcttttagagcaagacatttggaaagatagcatgtgagtgaatttatgtatggaatgaatgacatgtgagaaaactcttgttagacatgatgtttcctatacagaagaaaagatacaaacttgattgcttcagtaaaaacacttttagagattgtgtttccttttttgtgagacagcgtctcgctccgccacatacactggagtgtagtggcacaatcttggcttactgcaacctctgcctcctgggttcaagtgattctcgtgccacagctacccgagtagctgggattagatgcacccgccaccacacccagctnatttngnnttttgaganagacngggnnttncngnnnnaccangnt

SEQ ID NO: 22281 - DNA, 715 bp, Homo sapiens
  misc_feature 1, 7, 666, 696, 701, 711, 712: n = A,T,C or G
ntaagangactgagggataataaaacaaaattactggccaggcgcggtgtctcatgcctgtgatcctagcactttggaaggctgagactggtgaatctcttgagctcaggaatttgagaccagcctgagctcagtgagacagtgagacctcgtctctggaaaaaatacaaaaattagccaatgatggtggtatacacctgtggtcccaggtagctgggaatacaggcacaccccaccatgcctggctatttttttgtattttggtagagatggggtttcaccgtgttggctgggctggtgtcaaactcctgagctcaggcaatccaccttcctcagattcccaaaatgctgggattacaggtgtgagccaccgtgcctggcgataaacaacatatttaaactctaaaatgttatgcaagcattccaggcatgctttggaaaaactattaatcccacaaaagatgcttatgtaattatatagactaacagaccaagattctccaggacacttactttgttaagtgtctgaagtaaaatgcaatgctgtatataaaatgtgacctgaagtcaggtcccagtcttttcatctggaaaattctgttattatactgcccttcccctttataggtttctgtaggagttaaaatcactttttcaattgctgantatgctaacactggtagggagctaaaatgncactnttgtcctatnngcc

SEQ ID NO: 22282 - DNA, 594 bp, Homo sapiens
  misc_feature 423, 455, 479, 486, 504, 506, 524, 535, 540, 544, 553, 558,570, 571, 574, 582, 585, 586, 591: n = A,T,C or G
ggggatcactcctcattaaaaaccaccttcattgctgccaaaaaaagagagttggggggtgggggcagtggttgagagaggagaatactggggagatttctattctaaataacattgaccttttattcatgaacccaaatcaggccttctccagtagccaagcctggagaaaaggatctgaaagactgtgcgtgatgaaaattaggttgctggatgttgcaatggggggtgccataaggaggggccatgcttcagattctcccatccttcaaggctccattctccatagtctggttctgccggggtgtcctctgtagccctgatcctcaaacgtcatcgagcctcctgagcaatgccaacccgatgtctcactgattctctttcactcttctctcatgtttaggaagatccctcctgcggcanatagccccctgccctcgccagcagcccacatnaccacccccgtttccagcatccgntttgcanccctttcaccaaccccantnctgtgtatcttccttcanctcccctcaanctggnggcntacctcttnttacntaatgacattcnnccntgctctcnaannccagnttt

SEQ ID NO: 22283 - DNA, 694 bp, Homo sapiens
  misc_feature 8, 473, 497, 500, 556, 579, 585, 616, 621, 622, 631, 642,645, 646, 654, 660, 661, 664, 669, 671, 678, 692: n = A,T,C or G
cgacagangggctccgtcattgcctgagtgttgggggtgctgatttgcatgctgtgttgaattcttcagtacacattcagtgggttaggttctaaagtcaactagcagagcaaagacctcataagtcaaactgtcctctaaagtccttgaattgcctattagctcagaggcactccccctgctagaggcccagcggggcctgaggaaacagcacgttctgtgtcccatttccctccccagggaaagcaggggaccgggcactgccacttcagctttttgtcctgggtaccatgaaatctatgtaaatggaacgcatgtgaaggaactgcactgtgtgagctacactgtgtgaagcactttattgggagtgtgagatcccactcaagtgtattttgaaaaccatttctggagaatgtgtgagaagagaaacagggctgacagtgatgtggaaggagagagtcaggacagctgangtcctgtcttggctctgtcatctncangcagctggggtgcccggggcagccacttctctcctcggagactgctcccactctgngccactgcttgctcgcccaccgncatctncagcacttacagggcacctgtcttcatgggngctannaacattaanacaaaatgaanggnnctaaactngacccnnctnttgangncttgcanctccaaagggtctntg

SEQ ID NO: 22284 - DNA, 731 bp, Homo sapiens
  misc_feature 9, 480, 487, 545, 560, 579, 592, 641, 650, 658, 662, 679,691, 699, 704, 712, 715, 716, 721, 724, 725, 726, 728, 729: n = A,T,C or G
gacgacagnagggaattctcagtataagccctttgtcgtttctatgcctatttaaagtctcctaaaggtgtaattgactaggaaggatgtagttctacactgccatttacctatttaaattcatccttgtgaatatctttgttgttgttgttgagacagagtctcgctctgtcacccaggctggagtgcagtggcgtgatcttggctcactgcatcctccgccttgcaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaagtgctgggattacaggcgtgagacactgcgcccagcctcatccctgtgaatttcttattgtacacaagttctttcactatctgngtgcagngctctgagggacagacaaggcttgggtgtatatgccaaccagatctattgaagatcancttggttcgtactangtgcaagtgtagcatgtcncatgtgaccatgntggatcattgacatttttaggtatgtactgcctacattatgatgaaganctgagcggngttagatntaantattttcctatgaatanaatatactgatntgggcaancaaanaaaggcanaannaagcngannngnnaa

SEQ ID NO: 22285 - DNA, 336 bp, Homo sapiens
  misc_feature 171, 209, 234, 246, 261, 270, 273, 278, 287, 294, 296, 302,309, 311, 315, 324, 327, 332, 333: n = A,T,C or G
ccagggtcagtccacttggcctgaaagttaacgtcacatattcagatgtcaaggggtttctgtgcatgcttttgaagtattgtgtttgggcttttacaacatgtgcctcactgtttcgcatctacagagagagtgccgctgagagaggagcctgagtggatccgtgcccanatctgcattctctgtcctcaccacttctccctgctggntgatataaatgtggggataacgtcnagcacaaaggantcaaaaattgatcanggctggtgnggnggctnacgcctatnatcctancnctctgngaggccnangcangaggactgncanggccnngag

SEQ ID NO: 22286 - DNA, 690 bp, Homo sapiens
  misc_feature 1, 2, 5, 10, 18, 179, 571, 588, 593, 594, 608, 617, 622,626, 632, 649, 664, 666, 674, 677, 679, 680, 681, 687: n = A,T,C or G
nntcnacagnaggggganaagagttggaggaggaaagggaaaaccttctcagagagcatgaaaggctgctaaaacacaagcagtaggtggtggtccattctgaatttagagtgagaatacatcgtaggttaaggccattatgaagccaagctcaagtctgtgtggagcagtaaggcttnaggttattctgttctcttcatcaacatactctgagaagaaatgcaggaatggcaagatgcatgtttcctaaaaatagattcatttatatttttgatgcatgatacaagtttacatctgtgggagagtatttgaatattatgttcataaaatagcaagtggaataagagaaaaagcactccacaaactgctggaaaactttttgttttggataccatgacaacaaaaataattatgatggtaactaacgcttgagtgcttgtatgcgaggccctgggctcagcagtttgctttaagcatcctgtgctaatcctcaagacaccctgtgaaaggttagaggtagcctaatgagaaagtggaatctcagtgagggtccatgactggtctgaggccncctggtagcactggcanaaccnngattcttaacccanatctactangcttnacanctgtgnaaatcttaccactggcncttcccctaccccantntgtattgnctngnnntatttntaa

SEQ ID NO: 22287 - DNA, 811 bp, Homo sapiens
  misc_feature 2, 3, 4, 11, 15, 16, 22, 23, 24, 35, 46, 57, 59, 694, 718,760, 784, 789, 790, 803, 810: n = A,T,C or G
annncttgggntaannaaccannnttttcttgttncttttggccgnaggtagacagnangggcattcacatcttctgcctggctttttggagtctccattattccatgacatagaacaaaacaaaaaattagtgaattaatctcgaagctttacttcttcattttcccccactggtgtctgaacttttgccaatgtattttcagccctgctataaactgctataagtgagatcactccaattttatgcagcagttttctgaacctttggcttgttcaatttgaagctgcttgtgaatgtaactttgttcaaaaagctgacagagatagctgcgagtgaaaactccttggcttaaaattgagccccttccgggcatgatggctcatgcctgtgatcccagcactttgggaggcccaagcgggtggatcactagagctctggagtttgagaccagcctgggtaacatgcaagactccatctctatttttttatttaaaaaataaataagtaaataaaattgagcctcattttttaacctaattgaaaatgggtgataaaaatgtatacattgcgaccaggtgtggtggctcacacttgtaatcccagcgctttgggaggccgaggcaggtggatcacctgaggtcgggagttcgagaccagcctggccaacatggtgaaacttcgtctctattaanggtgcaaagatcagccagtgtggnggcacgtgcctgtatcccgctgcccggaagctgaggcagganatcgcttgacttgggaggctgcanttgcnngagctgaaatccnccttgcnt

SEQ ID NO: 22288 - DNA, 790 bp, Homo sapiens
  misc_feature 1, 10, 588, 695, 713, 714, 759, 761, 773, 774, 778, 785, 788: n = A,T,C or G
ntacgacagnagggatagtacataattgataaattaatttcagatacatattcttgctttgaaccaaattagtaaagtgactaatttatctgcatttcagagaaattgtgcagtttaaagttgaatctagagagggagggctggtttctttggggttaaatttctgtagattcccaaacactgacatcaaatctttagtggaacctggaaaaaggaaggagaaagtattttagctcagttaatgttcttccttcgttagatgtgatgaaaaatacacagtctaaccattgtgtagaagaaatacttgtttcttaacagcagcaacaaaatgtcatttattaagcacttacagacatcttaccaggctttattctttatttcatttagttgttacaaccagcttatgaagtagtttatcagtcagtattagacatctaacaataacagaccagcaaccctcaaatcccagtgagatatatatatgtgtatatatgtatatttgatgatatatatgtatatttgatgatatatatatatgtatatttgatgatatatatatatatatatgaaagtttacttttagcttangatacttgtgcagcaaataggtcaatggtagggagatggactgtgctcatcactgtattcagactgacaagaggctcccacattgctggtgttgtgcaaaaggaaanaatgtctggtcagggcanngactcatacttgtatctacacttggaactgagcgggggaccctgngnagagtcaaactnnctgncaatggnaancc

SEQ ID NO: 22289 - DNA, 824 bp, Homo sapiens
  misc_feature 2, 3, 4, 5, 6, 9, 17, 34, 36, 49, 50, 52, 58, 60, 65, 76,229, 230, 636, 672, 715, 724, 771, 791, 792, 801, 808, 816,819, 823: n = A,T,C or G
gnnnnnacntggtttanaaacccattttttttgntncttttggccgcanntngacagnanggggnagtcagctggntgggacaagttctgggcagccatgcagctctctcagatggtgttcctgaggggaagagagggagagaaagagagagagtgtgtgcggagtctgtgcacacatgggtcgtctgcagcagctctttcagacagcttgtgagaaacgccagttgtnngggggcctcccaacaatgacaaggtgcacagtatgcatccgatagacaaaggaggcttcagaagatgagacctaggcgagtgatcctggaagctggagttcagggcagaaaaatgctgccttcctccttaggtggcacattattatctgctgtgggaagtttggcagtgcccacgaagaccccagcgccacattgcaaggtggctgcaaggccagacctagctgtgtggttattagcacagaggaggttcccctctggagagggaaggggcctttctacttcctaatgatgtttaatggatgactatcttaaccaaagggagaggggaaaagtcatttgtgtgtgtgcaagtctcaatcaagttcgaataaagataataagctaaagtatgaagaagttgccttangtaggagtcctaccttctgaagtggctcatctgaangcatttgtccactgagtgttgaggctttaaaactgttcattgncacataggngccatttgtagatttcgaggagtttttatgattctgacttggccttnctgacaaattcatttcattnngttcttggngcattgnaaaatctncangcant

SEQ ID NO: 22290 - DNA, 813 bp, Homo sapiens
  misc_feature 3, 4, 7, 13, 15, 16, 21, 22, 28, 34, 47, 55, 699, 712, 731,748, 756, 763, 772, 773, 777, 778, 795, 796, 799, 804, 810,811: n = A,T,C or G
aannttnggggtnannaaccnncttttnttgttncttttggccgcanacgacagnaagggcagaaaatgccaacatgtgtcattagcgcaggtcccatgagacattggtttggttggttccttggttggtgcttgatgtgtgtttggcagtcagtgtgggtttgtgaagcactaggataaattagaataaaaattcttgaacatctgatagcattttccaggattggattgagggttggaattgggtttggtaggaccaaattaaaggcatgcttaaaattttgctctcacattgtttacacaggccacctatattaagcatgggatttagtagttgtctcagctctggatttagagaatgaggtgtttttgttttgtgagttgttatggttttaaaattccagtgtttgtagtttgttacttaaaatgtgtgtgaatcaattggtgatgccaaagaaatttccaaagttagatttactttgcttgatatccccatttttttaaagtccacatccatgagggtcatatttataaaactcttgatgaaagaaaatttcccatatgtgaagtctcattaaaatggtatagtaatatgtcagagttgttcatttccagctgcagtcttgactgatgagtattctcatgaaaattctttcaaaagttcataatttggccttgaaatcactgtcttcaactaancttaaatacctgnctgaagctgaaaatgcttnattcttttgaaactgangaacgttnatccttntaagtactnngcannacacagttatccgtagnnctnttttnatattnntt

SEQ ID NO: 22291 - DNA, 742 bp, Homo sapiens
  misc_feature 528, 556, 614, 623, 624, 684, 703, 726, 735: n = A,T,C or G
taggggaacactacaagcaaagacattcacacgggcattatggctgtgaatataggaaggatccaaaaagacccgtcgcgtggagaatggacagtgagaaacatggacagagtaaaccaaggattccctctcgtggaaatatatattaccagtcttatgaacatagatcaccttcccctaacataagaaactctttagaaaatgtttatatgtataagcctcacagaggatattcgcctggaagaggggacagtaacaggagagctcagtatatgcccaaatactcagagggtataccctacaaagagcatgaaaggaattcttatccccagaaagtgcaaggagggcatagtcctgatgaccacagagttagaggaagtggaaaaggagggaaaccacctcagaggtcaatagcagattcttttagatttgaaggaaagtggcatgaagatgagttgaggcaccagaggatacaagaagaaaaatactcccagtcaactagaagaggctctgaagactttgagacangagctcatttcagaagaggtatcctgangatcgtgatttcagaaaatttggcacacatcaaaagacctaaagacgtggagaggttnaaagcaganncctgccaggaccccaagtggagcctgacattccttccccttaccaaagacacagaccacnggaccttggcccaaacttntcgcatgctggagggacaccaanaccagttcncaaccag

SEQ ID NO: 22292 - DNA, 838 bp, Homo sapiens
  misc_feature 5, 14, 21, 33, 44, 46, 91, 672, 765, 795, 802: n = A,T,C or G
atatnttgggggancgaaaanacttttttgttncttttggccgnanggggagtatgggttttcagttgaggttgaagagagaagacagggnattgtaaccagaaaattcagaatggaatgcagttccctccagaactcctgagcttcatgacagtcatagaagtggattccttttagtttcccctcaccccgcaaacgtaccgtaataatgcaggatacagttattagttccctactcaagctataatccctcagtttgaatttacttgactttattctgaattgttcctcaaagatccctcagtgattatgttaaattctgtaacattattgtaatggcttagaatgatccttaatttaatgtaaaactattatgagttttaaatgatttattgagagcccactgtgtatgcccactatgccatacttgagagggagacaacagaagtataaaactattttcaggggcatattaatcttattgaagaaattagactgttttacatgaaagcaattaatgaagtagagaaaatggaatccagtgctaatctctggtcagaatattatgttattaatgcatgaggcagataagtagaatacagaatcagaaaattgtcagaaaaatatctgaagatttggatggccttggctgtctaagggaattttcattgntttggaagcttatgataagtttgattacaaatattctttgtaatagggcgacccatgatttctcatccaaacacttggctgggaagcagcctnttatattacttgggacacaggagtgagtanatgaatnttcccctacttcaagattgatcattacccaataaag

SEQ ID NO: 22293 - DNA, 632 bp, Homo sapiens
  misc_feature 524, 542, 551, 555, 558, 565, 574, 576, 580, 596, 609, 617,625, 628: n = A,T,C or G
gggtttacctgtgtgtgtagatgtgtgtgtttctttcttgctttttgtctgagtgcttttgtttctgtcagatgagccacatattcatatacatatacatgaggatgcatatacacttgtgttagaaatcatgaatttacaccaatgaatatgtttaattccagtccattccacagggtttcttcttctctccttcagtctttatttactcccttttacaacctgtctctgaaaaaatatctttacattaacccagaggtcaatcctataataataacagtttcagaatttctttagaagtacgtgcattttttattgtccttagttatggctagaagattatgaactacaaccattatctttcggcttaccaatataaaaagcaaggggagataaagcatttccccttctgtgtctcaccttttctcttttccccttccagattatgatacatatatcattaaaaaaaactgaattaattaggccgggcatggtgactcacgcctgtaatcccagcactttgngagaccgagtggtggatncctgagtcnggantcnagaccancctgatgancngganaacccctctttccaanaaaaaaaaaaaanccctgggncctttttntanatcc

SEQ ID NO: 22294 - DNA, 844 bp, Homo sapiens
  misc_feature 6, 14, 21, 23, 24, 25, 30, 36, 49, 56, 66, 68, 69, 77, 82,91, 727, 734, 764, 768, 775, 785, 787, 811, 813, 814, 817,825, 826, 827, 828, 836: n = A,T,C or G
aatatnttggggcnaacaaancnnnctttnttgttncttttggccgcancggcctncggctgcganannacgacagnagggnattaacagnaataggagcctcgtggcatacctagtggtactgagttattaatactactggcccacctgtcagaaattatgcagtttagctgtgtattttcatgtgacagtgtttataaaatgtcttgttggcatcagaagactgtacagccttactgtacttaagacatgctgtttttaaatgattgttttctccttttccaaagttaaaatctgctgtatttatttaagattttttggtgtgtgtatgggggaagaggggaggtggaaggatgaaaagattctttgcactaagtttgcttttggttaaaaagaagcctgtattcttagatcttaaatctagtctcactatactaaaattagtcccctaaactggatttactttgaaacttttggatgacctgactaatttaaatattgtacaatagttaagaaggaggacttttagtgttacacaatggttcggttcctggccatatcacttactagttttgttaatttctttttgtgttgggcacattacttctttaatctttaatttccctatctaaaaaagtagtaaaaataatgccctcttcagattgttttccgaggataagtgaagtttagaaataaagcactcaccatcaagcactggtccttacancttaacnggcaaacctgattttcctcctcctcctctnctanactcttnttctatatgntnctccactgtactggataccttaangnnaangggaatcnnnnagtttaantttttttt

SEQ ID NO: 22295 - DNA, 803 bp, Homo sapiens
  misc_feature 4, 13, 14, 17, 18, 25, 29, 36, 47, 49, 50, 51, 58, 60, 63,69, 646, 752, 753, 759, 766, 774, 796: n = A,T,C or G
atanttttggggnnaannaacaatntttncttgttncttttggccgnannncgacagnanggnatgagnataatggtactagggagtagagtgcaaggaggtcatagtgtcaaatgtgcgtaggtggaatggaacataagaggctgtgcttaggactgtttttcatgtttggtttagaagggaaggtaaatgtgacagtaacgtaaaactttttaaagataaataggtgaaagaaacaaatcagaggtataaggaatagggaagatttaacaggagactagaagggatggatcaactctgtagacgtggagagggagaggaacgcttttttctttaaggtaaaaggagaactagtatgattgggtgctgttataagtgaattgagaggacttacagatttttgatctgagtgtctggatgagtagacttagtaggttgactttagagaagtaaacttctaattaattcaaatactggttttcctgttttggaacatgttcctttttcatccattgtttcttagttttgtggcactttgctggttttcaagctagtgggcatcaagcttttctctggccagttctttcctatcctgaaacccttcagtggaaaaacaaatcatgttctgccttaagagtatgatggntattaagctattttgtattccttggaggaaaggatatacaatcctggggattcaaagaagtgcttcttgaaatgaatgtgaagttttagtatcagactagaggtcnnacatcntatgtanaagcctanagttcctttctccatttctttncttgggt

SEQ ID NO: 22296 - DNA, 708 bp, Homo sapiens
  misc_feature 13, 19, 21, 22, 28, 34, 45, 47, 54, 63, 65, 67, 68, 75, 77,92, 135, 141, 227, 249, 252, 342, 402, 425, 439, 505, 514,521, 538, 546, 554, 597, 598, 607, 615, 619, 625, 629, 634,648, 654, 660, 663, 672, 680, 686, 693, 694, 701: n = A,T,C or G
taacttgggcttncgatananncttgtnttgttncttttggccgnancggcctncggctgcgnanannagacagnangggttgccaaaaaanaaaaccattagttttgactgttaaaggcagttctgaaatctantttgtnaattagtttaggtcagagcctgtagctttctttccttatgcttagagtgattataactattgcaaatgaaatgaaattcaatgcangacatgtggctagtttttctgntantactatcttctgtcactttatggaaaacttgacattatagttaatatttcaggagtgggttgagagatttccaacagggcaagggcattngagacttttcacctggtcagctgtttagtggtttcgtattctgggctttataattataangcatccttagaatctgatcttcnttgggataaaggcnactcatgaaggagcaacagcctataatcttgaaggatgcactattcaatttgaccatttgacatanccatggganacttcanttgcaaaagttggccanataatcancatgtcangtgtcttctgagagagcctctgctagtgctgggaatcctggtnnctcttttanaggatganattngggaanctgngtgtngaacatgattctgngacctnctgaantanccccttaanagctaatngcttanatgaccnnaatacangcttcca

SEQ ID NO: 22297 - DNA, 757 bp, Homo sapiens
  misc_feature 536, 564, 568, 629, 633, 675, 681, 684, 692, 720, 724, 728,733, 737, 742: n = A,T,C or G
gggagagatggggtttcactgtgttagccaggatggtctcgatctcctgacctcgtgatctgcccgtctcggcctcccaaagtgctgggattataggtgtgagccactgcgcccagtcagtaaattgaatttttaaaaagtttttgagaagcattagtattaggcaaaacagagaccagtattttagacagtccttagatgaattagaatgttacagataaggttctctcttttgagggaacaaattaggaacgaaattgacacctcttttgtagcaacactgtaccaggcctttgatggagtgaggcaagcacaagtaaaaaacactatagtatttcccactgatttgagtgtgactttttctaagttgtttacctggatgctgtagatctgtgattgttttccatagattccatcaggttatgttaggtagttttgttttgttttttttggttttttttttgagacagagtctcgctttgtcacccaggctgcagtgcagtggcgtgatctcagctcactacaagctccgcctnccgggttcacgccattctcctgcctcancctnccaaataactgggaccacaggcacatgccaccacacccgctacttttttgttttttagtanaacngggtttcaccgggtagccaggatggggttgatctctgacctngggatntgncccctcgnctcccagggctgggattcaggcggagcncccnccanccctntttnggagnttaaatttttctagg

SEQ ID NO: 22298 - DNA, 747 bp, Homo sapiens
  misc_feature 1, 9, 528, 685, 701, 737, 746, 747: n = A,T,C or G
nacgacagnaggggtctcttggtttttaatgaagttggtggcaatattatcgcaagagtcttaactcagactattcagtagataacttgattgtttagatgaacaaaatttgcaatccaatctggtcaaacagtttggatttttctcatggaattgtgtgtgtgtgtgtgattatctgtgttcatttcttatctctaaagcaaccttcatcattactttcagtgtctttcttttttctctactgagaattaagataactctcgatctttgggcacttcaagttccattcctcagtgatccactgttatgcagtggaaaaagctttaagaggcatagtttctaatcccaacactgccatgtgctactgtgcaaaactttgggcaagtcatttagacattttgagagcctcgactttctcttatatgaaatagcaataataagacttgtcctgaagggctgggcacagtggctcatgcctgtaatcccagcactttgggaggccgaggcgggcagatcacctgaggtcangagtttgagaccagcctggccaacatggtgaaaactcatctactaaaaatacaaaaattagccaggtgtggtggtgcatgcctgtaatcccagctactcgagaggctgaggcacaagaatcgcttaacccaggagttgaaggttgcagtgagctganatgtgcccctgcactncagcctggcacagagcagactctgccaaaaaaaaanccccccccnn

SEQ ID NO: 22299 - DNA, 797 bp, Homo sapiens
  misc_feature 1, 9, 37, 675, 694, 716, 725, 729, 779: n = A,T,C or G
nacgacagnagggatataaattttttaaaaggccagnatgcagtggtgcattctgatagtcccagctactcaggaggctgaggtaggaggatcacctgagcccaggagtttgagagtctgagagtttgaggccagcccgggcaacatagcccaggttttgtctctaaaacatatacatatatgtgaatatatgaaaagtatcagttgtatgaatgaataaattaattctaccttttgagacttggtaaatatttagcatcctctcctgttgcccataaaacgttaagaaaggggagtccggccaggtgcagtggctcatctgtaatcccagcacttagggaggccgaggtgggcggatcacttgaggtcagttgttcgagaccagcctggccaacgtgataaaaccccatctttactgaaaatacaaaaattagctgagtgtggtggctcacacctataatcccagctactcaggaggccaaggcaggagaatctcttgaacccgggaggtggaggtttcagtgagccaaggttgtgccactgtacttcagcctgggcaacagagcaagactccgtctcaaagaaaaaagaaagagaaaaaggggagtcctagtaagtgtgcccagtctgtcaccatcaagatagtgagggcagcacagtggcctgcaagtcaantagcctggatgagacttanagctgctctttcaactgagctntgctctcanttcnactccaaagtcttggcatccaaatccagctgaaccggccctttggccacnagtctttgcttctagcag

SEQ ID NO: 22300 - DNA, 811 bp, Homo sapiens
  misc_feature 2, 3, 5, 13, 17, 25, 35, 48, 49, 57, 59, 73, 79, 134, 228,385, 476, 502, 509, 550, 613, 674, 678, 680, 681, 682, 684,688, 689, 701, 714, 741, 745, 764, 772, 778, 780, 805, 807: n = A,T,C or G
anncnacttgggncaanaaaccatntttcttgttncttttggccgcanntagacagnanggggcttccatgtncctgcngttcttgaatcacacctaccaggtcaacttcttgtgtctgtgacttgtgcggtangattggtctgggaatgaatctaacaggcccttttggctttgtgaagacttgttactacccaggttgtctagcattctgagctgtatggggagcncagtcatattttggctgtatttcactggcagtaaaaatcttgacattccaatttcccttgaggggtagtaattgtttaggggttgaaactggagaggaatccaacatctggacatggcaggtacagtagcattggagtctggcagacttgagcccanatgactgttccgcaactaactaaacaatatccttgggcaagtcattttcttcatctggggctctggagggccgtctttttcctctgcctanatattctggcttgtgtgatagctcancctttangaattgttctggattactgctttttatcttcctcaaaaagnagccatcactccaagtgctgaggtgacaaggggaccgtcctgttggcacctatctcatgtttnggctgtggtatccctctttgaggtgggtaggagagcccaggatgctggaggctccttgccngcangnnnanaggnncactctaaacantctcctggcttgntcccctgcccacacccgcacttgttanaganacaggagtcagtttttttntgtgggcngagacnangcatctgtaaaactttcaaaaagangntaaa

SEQ ID NO: 22301 - DNA, 744 bp, Homo sapiens
  misc_feature 2, 585, 648, 686, 707, 709, 731, 735: n = A,T,C or G
gncgacagagggggaaagtgtcaaagaaaacccagaactggacagtggaacggcagattttactcaggactgttgcagtagaggaaatgaaagctcagtgtagaactgggctccactccaaatacagcacaggcaagtggggatatatagccaaggagcaggctgggtttggtggatggaaaatcatgaagaggaaccgtcagaggtgagggagattctggctaaaatgacctcacaggattcttgctgaagacaggccagggtgaccaggcatcacctgggagatggtgagggttgaggaacctgagaagatactgagcatggccagatttagccaggtttttgggaaactgggctcttgaggacagggcccaacagagagtggctcctaagaacctatctagagtttggtcaaggagagagtccttgtcaaaaggctaaactcaaacatagctcatttcattatttatttgcttacttgtctgcctgcagcaggaaataatatacctagggaaattacttctttctatccctatggggaaaaaaacaaaaaagatttgatactattttcatttgctgcatggntaggtcatctgatcaatacaaatgcagtgggccaaacctaaatggataccctctctgtgccangacttggggtgcagtggtgagtaaaacagctccagctntttcatgccagggatactctntntttctgattggagcctgtcaanagtntggcatggc

SEQ ID NO: 22302 - DNA, 826 bp, Homo sapiens
  misc_feature 11, 13, 22, 26, 33, 44, 46, 48, 55, 84, 636, 759, 816: n = A,T,C or G
ataacttgggncnacgataaancttncttgttncttttggccgnangnagacagnagggacctttcctcttgtctctttctagnagatggaaggaaaagatgggtccaggtctttattttcatccttcatagactagaagcctgctttcacattaccatacagtcttctttcctgtagattccagaataaatcatgcaaataacctcagaaatgacaaagaaagtcccatgctctgatcatttttttcagaacgtttgacagcatactgtaaacacacattaaaacaaacaaactcaacattaacttctgaatgtgtaaaggacatttaaaagtggctccatcaataagttgtgctgggaaaactgaacatcgacatgcaaagaatgaggctaaggccttattttacaccttacacaaaacttaacccaaaatggattaaagacctaagtgtaagacccaaaaccataaaacctagtaggaatcatagggggaaagtttcgttacactgaatttggcagtggttttttgaatatgacgtcaaaagcataggcaacaaagggaaaaatagactgggtctatatcacactcaaaaacttctgggtgtcaaagaacacaatgaatagaatgaaaaggcnacatatagaacagaagaaaatacctgcaaattatatatctgataaggagttaatatccagactatataagaattgcaaacccacataacaaaactacatgatttaaaaatggcaaagacttanacacatttctccaagatgattacaatgtctagaagctatgtgaaagagctcacatcnttatcataag

SEQ ID NO: 22303 - DNA, 779 bp, Homo sapiens
  misc_feature 2, 12, 14, 20, 21, 22, 34, 45, 47, 54, 63, 65, 67, 68, 69,75, 77, 81, 616, 620, 689, 733, 734, 736, 742, 745, 746,750, 753, 757, 759, 764, 769, 771, 772, 775, 777, 778: n = A,T,C or G
antaacttgggntncgatannnctttttttgttncttttggccgnancggcctncggctgcgnanannngacagnangggnaatagtcatttgaaaggaatttgcatggccagtttgttgtactgttgtaaattaagtgaggatcataaagctgaaagtgaatttagaaatcatttaatagaagcttctcagtttacagatgagcaaactgacctacaaccttaagtgacctatttaatgatacacagcaagctaatgctgaatgtaggtgtatgatttttgattgaatgtttttgatctaatgcttatttcttccaagttatttcagagattgtgttattttattttctttgtaattaatgaatagtgttgtttcacaatactttcagaaaatgtttgttttagctgggtacagtggctcatgcctgtaatcccagcactttgggaggccgatgtgggtggatcacctgaggtcaggagtttgagaccagcctgcccaacatggtgaaaccctgtctctactagaaatacaaaaattagctgggcatgatggtggacgcctgtaatcccagctgcttgggaggctgaggcaggagaaattgcttgaacccaggangtanaggttgcagtgagtcaagatcatgccattgcactccaacctgggcgacaagagcaaaactctgtctcanaaaataaaaaataaataaaatgttcgttttatatgagtttgccnnanaaaaanaannaaanaancccngnggccnttttncnnaancnna

SEQ ID NO: 22304 - DNA, 558 bp, Homo sapiens
  misc_feature 490, 492, 506, 511, 515, 518, 525, 529, 534, 537, 542, 550,551, 552, 553: n = A,T,C or G
ggggaaaaaaaatgaccttgaggagagcactggctcttactgtcaattctttatttaccatcttcccaagtgggattataacatcaaattaaaattaaaatatagaagttcttttaatttgaaccagaagtttctaattttgccttctgtgattcactcaggaagacttagtgtatggatcagattttagggaggcaactagtatcttagaggtagataagcttagttttactcaattaaccaaagaagaaatagataaattggacttcatcaaaattttaaaattgtgagtttcaagggatactgtcagtaaaaatagacaacccgcacgatggaagaaaatgtttgcaaatcttgtagctaagagtttagtacccagaatatataaagaatttttgtaattcacaacaaaatacaacctaagaaatgaatggccaaaggattgaatagacatttctccaaaaaaaaaaaaaaaaaaaaaaaacccctngnggccgttttttacntaaanccanacntgataanatcnttganganttggncacccctnnnnaaaaa

SEQ ID NO: 22305 - DNA, 773 bp, Homo sapiens
  misc_feature 11, 21, 43, 60, 67, 71, 72, 82, 85, 87, 105, 114, 127, 137,221, 222, 223, 229, 252, 256, 264, 273, 288, 294, 300, 301,313, 317, 319, 322, 333, 334, 393, 403, 414, 460, 461, 470,480, 496, 534, 535, 549, 552, 553, 580, 587, 592, 606: n = A,T,C or G
  misc_feature 625, 634, 637, 644, 662, 663, 687, 704, 721, 726, 747, 751,764: n = A,T,C or G
gggatagcttntttcagtccncaacaggcactgctttccaaantggctaatggctaatanaagggcngatnntccatcatancananagcaattatttagggcantaaagcaantgacattttctgngagtgtgagntgttaactgaggtacttctcatgcaactagagtggtcgggggtattgtcaagcacgagaatttttggtttttacaactggctannngaatangaagatgcctctggcgaagatgngtgncacatgcnggaccatgngaaaagatcatagangagatntattcnnatgatgtttgangagntntangttaactgtgnncgaaagatttgaaacagcccgaaagtatcaacatttgtggtatgcttcataaacagtanagtgagaatnttttcttttgnctattatggaaagctgaatactatattttctgatggaaaaaataanncactcagtngactttcaanactcttaacagtctantgaccacgcacggtggctcatgcctgtgatcctagcannctgggaggcccgangcnnatggaccggccagatcgcttgactggnagttcgngaccngcctggcaacgtgncgaaaccccgtctctgccnaaatcacanagnagctgancttgggggtgctgcctgnngtcctacctctcggaggctaggcnggaggatccttgatctngaggcacaggtgcttgncccanactgccctgcctcacctggtncaangaacccctcccanaaaaaaaaa

SEQ ID NO: 22306 - DNA, 736 bp, Homo sapiens
  misc_feature 7, 11, 13, 36, 52, 55, 56, 62, 68, 70, 74, 82, 99, 107, 109,119, 125, 146, 193, 214, 223, 276, 303, 324, 464, 488, 581,649, 656, 661, 718, 719, 722, 728, 729, 734: n = A,T,C or G
gtaaganagtntnatctcctgccccagacatctggntgcctcttttgatttntgnnatatanctgcgntntganatcaacgnccactgggtttgcttancttatatntncatctgtaangccacnctttgcactacaaacaggatnggatgactatagattcttcagctcgtcttccgtaaatatttcttacntatgttggtccccccacacantacaaacangttttctttgtgcttaagaaaattcagcatctctcctgttaatgtatgtcagnccaactgttagagcttcagtgaatacnaaaagaagtttccatattcanacttcatatattattatttgtaaacgcgtgttaatctaaagttattcaaatttttaagctataatagtagctttaaattttctgtaaaaattgtgggtcgggcacagtggctcatgcttgtaatcccagcactttgggangccgaggtgggcggatcacttgangccaggagtttgagtccagcctgggcaacatggtgaaaccctatctctactaaaatacaaaaattagccaggcgtgtggcaggtgcctgtatnccagctctctggggctgaggcaggagaatcccttgacctggaggcaaagttgcagtgagccaaatccnccattgnctccncctagcacagaggtaaactcctctgaaaaaaaaaaaaaacccctgggcccttttccnnaanccaacnnaaaanct

SEQ ID NO: 22307 - DNA, 807 bp, Homo sapiens
  misc_feature 12, 14, 15, 19, 22, 23, 27, 34, 45, 47, 54, 689, 722, 728,738, 768, 780: n = A,T,C or G
atatcttggggncnncganaanncttncttgttncttttggccgnangggaagnactagcctgccctgctcacatttctctcataattaaacacaatctatctggaccatccttaatttgcaaagcacagatagatctaaattttccttaattattatttcctctttggtggatttctgaaaagaagtgtgtgtgtgtgtgtatgtgtgtttgtgttcagacatctgcctatctatagctaagcttctgattaaccaagttttaatctatctacctcattgcgctttgctattttctctttctttatcctccaattgctccactaggtggggggtctggagggcaaacacattcattatgttgccagcaaacaagataggaattgcactgcaggggacaaaattaaatttacagctttcccttgtagatgtcataaactattgatttaacacaagaggagaaagctgcaatgatgggggcacaactgcagcgtatagctggactgtgtctggggagaggtcagcaatgactgccaacagccaagtccagacatctgagatcactcctgcccacaggcaaagggtgaaggaagctagacttggtatgcttgctataagagcaaaatttcaacctagaagcacggtctgctcagacatactatctgtacacctggatgaagcatgcatgantaatatggaaagaacagattagtgaaggttacntcaagntcttggagcnttgcctgtgagggcttaaaaagaacagtgngagtcaggctanagagcgataactgagaaactctattct

SEQ ID NO: 22308 - DNA, 762 bp, Homo sapiens
  misc_feature 2, 9, 19, 22, 67, 70, 114, 125, 142, 170, 185, 223, 233,244, 364, 386, 397, 404, 427, 484, 500, 505, 510, 519, 616,672, 704, 754: n = A,T,C or G
gnagacagnagggtatggnganaccccgtctctactaaaaatacaaaaattaactgggcgtggtggnacntgcctgtagtctcagctgctcgggaggttgaggcaggagaatcncatgaacccangaggcggaggctgcagngagccaagattgcgccacagcactccancctgggtgacagagngagactctgtctccaaaagaaaaaaaaagaaagttccnggttatacanctggcagtaanacaggaaggacagagctgggtctccttcggtgtcactgctccttgattttacccccatctcatttacactctgccttgaattatctctttataccactagagtgctgaaagagaccacanattttgattcagcgtggctcanggagtgataanatcactngctatgtagctgtgactttctanagaattaaaaaataaaaggctttgcctgccctggacattggtcttgtaaggctgganaacaattgagacgccnctgcncccancccactttnatgttcttgactgtgttagaaacaacacagtattgattcacttatgacctttgaggaatcaagaggggcgggtgaaatattggagactccttgagtngggggctggcttggagggtgtcacccttggacaaaacttaagtggaggtgagtaanggccctgctcccctgtgctgcctgccttaaangatgtgatcatctggaggcaaatagcttgtgcttgaggccaggagttcanaccagcct

SEQ ID NO: 22309 - DNA, 802 bp, Homo sapiens
  misc_feature 2, 12, 14, 19, 30, 41, 43, 58, 60, 62, 63, 64, 70, 72, 76,106, 721, 730, 733: n = A,T,C or G
antacttggctncnatacncttgcttgttncttttggccgnancggcctaggctgcgnanannngacagnangggnaagcttttccccttcttccagctgactggnagaactattacctattcactagcatttgaaaatgaaggacaaattttgctcccttctctacaccaactttgtatgccatgggtttttaaaatgtgaaccctgcccatatattgtttctctgggcaccggccttcagtcatctaactcccttgcctcaatgaggaagtgaaactccagggctgtggagaccatgcagattccctgaataatcggaagggctcaccagtgatttcctgggtccccttcaagccttggctctgccaagccacagcttagctctgccatagcctcatgtgactacagacagtcacagaggtttcattctccctcacctgtgcatgcacattgtcttgtctgttttctcttgctataaagggatacctgagactgggtgatttagaaagaaaagatgtggcctgggacagtggctcacgcctgtaatcccagcactttggaaggccgaagcaggtggatcacctgaggtcagaagctagcctggccaacatggtgaaaccctgtctctactaaaaatacaaaaattagctgggcatggtggcacatgcctgtaatcccagctactcgggaggttgaggcaggagaatcacttgaacccangaggcggangangcagcgagctgagatcatgccactgcactccagcctgggtgacagagcgagactcatctcaaaacaaaa

SEQ ID NO: 22310 - DNA, 858 bp, Homo sapiens
  misc_feature 11, 16, 20, 27, 40, 56, 58, 59, 66, 742, 770, 783, 794, 805,820, 839, 843, 849: n = A,T,C or G
tttgacctacnaaccncttncttgttncttttggccgcancggcctcggctgcganannagacagnaagggaggcgcgttaagctggttgggacccgggaaggcctccctcttaaggtctttcccacacctctgcaccttgttacctgactttcggcttcaggatccgcagcgtgcacccgcgttccgtgagtgccctataggcagtcagcatgcccctctgcgtgtccctgtgttacggggacgccggctgggagccgcagagctatctcagaactagggcgctctcctttgggcacctccaggccattttcctttcattcgagcccacagggttagagataaaccctcactccgttgcttggggacaagggcttcactccctgtcccgagcttgcggctgagcttgagggtggctgggtcatcctggccccccactggatgggaattggctgctctggtgatttctgtgacatcccagaccccaactgtggggctctggagcggactgcgcttcacttcgtggggagggtgtttccacctaggccactcttatttctcttcacatccccagatctgtcttctgagactttgcccttctccaggaagagcactcaggagaccaggaaaatggccacagggctcctgagagccaaaaaagaagtgagaattaactgtaattctatcttggctgtcaacagaatgggtcccattaccttttcttgtcctggagctgccttgtnggattggcaaagtcattcctaaccctantcattcctagtcntaaaaaaggangatttgaatantcttgaaagcgtccnatctgtcctgtcaggcgcncttnaactgncgactgggg

SEQ ID NO: 22311 - DNA, 754 bp, Homo sapiens
  misc_feature 2, 9, 11, 14, 17, 22, 29, 36, 49, 117, 715, 719, 720, 727,736, 737, 745, 747: n = A,T,C or G
anttactgngnccnaanaaccncgctttntttgttncttttggccgcancggcctaggctgggggatcagcatcgacagcagtggcagaaacgtcaggccgtagccgaagcctcggnaaggagcggcccacggcaaagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattatttttttatttttgagacagagtctctctctgtcacccaggctggagtgcagtggtgcgatctcagctcactgcaacctccgcctcccgggttcaagcaattctcctgcctcagcctcctgagtagctgagactacgggcgcccgccaccatgcctggctatttttttgtatttttagtagagatggggtttcacccgagatggtctcaatctcctgacctgatgatccgctgccttggcctcccaaagtgctgggatacaggcgtgagccaccgcgcctggcctatttttttttttttttaaattataaangggnntttgcanccaggctgnnggcagggnancccccaa

SEQ ID NO: 22312 - DNA, 816 bp, Homo sapiens
  misc_feature 13, 14, 17, 19, 21, 23, 24, 28, 36, 49, 56, 68, 71, 79, 89,659, 728, 764, 781, 782, 784, 785, 788, 805: n = A,T,C or G
atatctttgaccnnacnancncnncttntcttgttncttttggccgcancggcctncggcctgcgagnagnacgacagnagggatcagnaactcatatgagtgtgaatgacatcattatggggatcaaaactgtaatttatagagcatatcatttgcaaaattggtattttattagtaacaaatcacatgtgatatctctcaaataccatagtattatttaggggtaatcactgctctgaataccctaaaatctaacaattaggccagctcagcaaagagcaggctgccccactatggcacataaagtgggtaagaggaaggactttggaattagactgcctgatttctccacttcttagcagtgggaatgaaattctaagaggccttaggttctttatctgtaaaatgaaacaacatatataaagaaattggtaactgggtatagttcatagtaagcagttggtaaagtcaaacttatattgtagtgataatttcaccagcatcctcatctaatagggttgtcatgagcgctaaaagagacaatgatcactgatgcacttaaatagtacttgtcacacagtgaggatcagtaaatattaaatgctgtcatggctattactgatgtgtggtgatgactggtattactgtcattattggntctttgtcatggcagcttcctatcacattgttttactaaactgtaatggttggtatgtcctcaactatntgaggaaaggtaaaaaaaaaaaaaaaaaaaaaaccnctggggccgtttttccnnannccnaatgaaaaaaccttggnagttgcacccc

SEQ ID NO: 22313 - DNA, 723 bp, Homo sapiens
  misc_feature 2, 9, 11, 29: n = A,T,C or G
gncgacagnanggggcagcgccggcccgnttgccaaaacaaaggggatttggtgatggaggctttgttagaaggaatacaaaatcgagggcatggtgggggatttttgacatcttgcgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcacacttaagcagtaaactggagcgggctaatgacactatctgtgcccatg

SEQ ID NO: 22314 - DNA, 636 bp, Homo sapiens
  misc_feature 435, 591, 595, 602, 614, 616, 619, 621, 624, 626, 628, 629,630, 631, 632, 634, 635: n = A,T,C or G
ttgtatcatgtcatgcagtgaactaagagttctcccacatgtcatattacttaatttaaaataagaacacacttgtgaggtgaggacagtgcttgcttattacttttcggcacaagtcattatagggaaagataaaatgaaatagacacacacctggcctttggcataaaggtaaatttacagtattattaatttggagagagcactttagagattggctttgtttgttgtatttcttctttctgttttggcaggagtgaaaagcattttattcttcaaaaaatatgtatgtccccaaggccaggcatggtggctcatgcctgtaatcccagccctttgggaggctgaggcaggcggatcacctgaggccaggagttcaagaccagcctggccaacatgatgaaaccccgtctctactaaaaatacaaaaattanctgggcgtggtggagggcacctgtaattccagctactggggaagctgaggcaggataatcgcttgatcccgagaggcagaggttgcagtgagctgagatcacaccattgcactccagcctgggcaacaagagcaaaactccgtctcagaaaaaaanattnttttatntttttacacccncnccncnccncncnnnnncnnc

SEQ ID NO: 22315 - DNA, 763 bp, Homo sapiens
  misc_feature 432, 434, 462, 610, 663, 708, 716, 719, 724, 726, 733, 736,756: n = A,T,C or G
gggggacctggacttgttgagaacctgttcaatgacagggtggaaatgcaaagcttggtattgtgtgctgtggttggtgttcaggagtcaatcatttccagggctacttaatgtctatttaaccaccagatgccaagcagagttctccctcaaggctatgatgatactcttcatgcttgacctaataaattcagttcatgtcaaaaatagatggcttatgcctatagttccagcactttcagagacagaggcggagtttgagtccagcctgggcaacagagtgagaccccgtctcaaaaaaagaaaaaaaaaaagaagaggttttttatttcaatgacttaatacttccggttaatgtcatgtgttatatagttatgcagtgtaacacagcctcatgattgaaggattgttttagtatattgcaagctgcananaggcaaaggcccagtctttcatctttgngcatatccttactgcttaggataatgttgggtacacagtaggcatctaatcaatgcttcttggaagggtgctagaactagtgaaaatcatctgttaccagatgttgctttctttttattcgtacacctccgttgatcataaagcctgnggccgcatcagtagctaaatccaaaacaacctgcagcttcatcatattcttgnctgaatgcattttctggctttttctgacctgccatccaggaatgngctactantancaaangncaaagcnccngagaggaaaaactgaaattntactgct

SEQ ID NO: 22316 - DNA, 481 bp, Homo sapiens
  misc_feature 172: n = A,T,C or G
ggggctgtttcctttttctacaacaggtttctcaaaacactcttttaaaagactagctggacatggtggctctctcctgcaatcccagcgctttaggaggccaaggcaggaggtttgcttgaagtttgagaccaacttgtgcaacaaaatgaggcctgatcccttaaaaaanagactcattcaatgtgtttagaagttcagtccgggcacgatggctcatgcctgtaatcccagcactttgggaggcagaggcgggtgggtcacttgaggtcaggaatttgagaccagcctggccaacatggtgaaactctgtttctactaaaaatacaaacattagccggacattgatggtgcgcacctgtagccccagctacttgagtggctcaagcaggagactctcgagcttgggaggcagaggttgcagtgagccgagatcacaccactgcactccagcctgggtgacagagcaagactccatctc

SEQ ID NO: 22317 - DNA, 625 bp, Homo sapiens
  misc_feature 503, 506, 581, 584, 598, 622: n = A,T,C or G
actgaatcagaatttaaattttaagatcacccagatgatatattttcatttaaaagctgaagccctagttccaaagaccactccagtttagccttatcttgcccctatagcctggtccttccacctcctccttcccctccttctactttgtctccactggctctcccttctctaggctcacaatggacttttcctgcctctagctctttatgtacaaagtgacctctgtccagaatttcctttcctgacctaagaaacttctacatagttgttatgaccgagaccagatatcctctcatctggagtttcttttcaaactatggcatctgacaaattacaattatttggttctgtcctctgctttatagcacattttgcttctatcttcttagcgctgattgtgttgttagaattacctgctaacatgtctccttccccactagactcggggatggtggtttttttggttctttggtttggtttcctcttctccgaacttaganagntcaggtcatagtaggcccctaaaaaatgttgtcaggctgggggggggggctccgtctgtatccaccctttggagntgngcggcgatacaagnaaaattcaaacccctgccactaangaa

SEQ ID NO: 22318 - DNA, 579 bp, Homo sapiens
  misc_feature 4, 5, 17, 19, 24, 28, 36, 49, 50, 472, 500, 506, 507, 526,529, 533, 536, 539, 540, 546, 554, 560, 568, 570, 571, 574,575: n = A,T,C or G
atanntttgacctaacnanacaancttntcttgttncttttggccgcannggcgagtagctggggttacaagcacccgccaccacgcccagctaatttttgtgtatttagtagagctgggttttgccctgttggccaggctggtcttgaatgcctgacctcaagtgatctgcccccccgacttcccaaaatgctgggactactggcatgagccagtgctcctgtcctcattccattcttcaccgtggtactgaccatccatttattcagcaccaattgtgtgccagaccttgtgtcagcattatggaggacttcccttgggaggcttgttagctgtacttgcaatctgatttgggttcccaaatcagcatataacaccaggtatttctctaatagagtatgtgccacactttctgctaactgcctgtttatcagtgtccccacatcccaatatctggttccttcaagggcanggagcacagggtatggcgtcagagtggnactcanngatgtttactggtgggtanaangaanggntannccctgnttttgaanactttntgttctancnngcnnaaat

SEQ ID NO: 22319 - DNA, 811 bp, Homo sapiens
  misc_feature 2, 15, 21, 22, 33, 46, 53, 62, 64, 67, 74, 76, 94, 102, 107,600, 656, 672, 677, 704, 722, 723, 736, 739, 749, 758, 759,760, 778, 804, 808: n = A,T,C or G
antaactggggctanaatccnntttttttgttncttttggccgcancggcctncggctgcgnanagncgacagnanggtacggctgccgagaanacgacagnagggnataataacgttaaaacttgtttagaaattaactagtattttttgaggtttaaagaaccttccagttttactatattagaaggcttcttttattgtatgcggtctaatttttattaaaagttcaggccatgaaaggttaagtatgtatcccttcaaaggaaattccattatcagagttagaattgaaagtaaaggctgggcacggtagctcacgcctgtaatcccaacactttgggaggccgagacaggcggatcacgaggtcaagagattgagaccatcctggccaagatggtgaaacctcacctctactaaaaatataaaaattagccaggcatggtggcgtgcacctgtagtcgcagttgccaggtaatttaagtgctgcttggtgaccagcttgtagacagtcactctatttatacccgcagactgaacaggtgcagccttttgccaagtctacccaacaaggcagccagctttgtattttaaaaagcanagttcggccgggcacagtggctcacgcctgtaatcccagcactttgggaggctgangtgggtggatcacaangtcancgattcagactagcctggccaaatggngaaacctgtctcccttanngtagaaaaattantcngcatgttggnggcgcctgnnntccagctactcagagctnagcaggaaatcgcttgacctggaggngagntgc

SEQ ID NO: 22320 - DNA, 700 bp, Homo sapiens
  misc_feature 143, 604, 605, 613, 619, 632, 646, 647, 661, 683, 684, 687,689, 690, 694, 695, 696, 697, 698: n = A,T,C or G
aggatctatctgcagttggttttgaattgtgtttggaagggagacgtgcactattataccccatggagataggaaaggacccccaacaccatttattgaatgattctctccttgcttttggtttgtggtaccttctaggtatntattctctaagagcaggtctgcttgtggcctcttggttctgttgcacttgccagttggcttgttctggagccatcctgattaaattatattagccttagaattagagttattatgttgtgtgtgacagggtctcactctgtcacccaggctggagtgcagtggtgccatcatagctcactgccatcttgaacttgtaggctcaagtgatcttcccgcggcagcttcctgattagctaagactacaggcacgcaccaccatgcccacctaattatattcttttctatttttttattttttgagatggagtctcgctctgttgcccaggcccaggcccgagtgcagtggcgcaatcttggctcactgcaacctccacctcccggcctcaagcgattctcctgcctcagctactcgggaggctgcgacacgagaatcgcttgaaccccgaggcggaggttgcanngagctganatcgcnccttgcgctccancctgggtgacatanngaggctttttgccnaaaaaaaaaaaaaaaaaaaaannggncnntttnnnnnaa

SEQ ID NO: 22321 - DNA, 812 bp, Homo sapiens
  misc_feature 13, 16, 21, 24, 34, 47, 63, 65, 67, 68, 75, 77, 80, 81, 660,704, 744, 759, 761, 763, 764, 770: n = A,T,C or G
cactacttggggntanaaacnatntttcttgttncttttggccgcancggcctacggctgcgnanannagacagnanggnntattttcaggatgcgcaggaaggagcccttaggcctaagattctctaattttatgagccttgttctctaatttgattttcctgtcttaggaaaaggcccctattatttcagtaccttaggaaatctgccacgctatcttgttacctaagtgaagttgtgatctacaggataagctctaatcaacagcacgcattttgtttagtctcctacagaacccatgctttctcacattttcttatgggttggttttactccaggcatgcctgtgagtggttatgttaaagggatacctgaggaactgtcctctcattaggcatttccgcttagtgatccctcctcaccttctttctcccactgtctggcgtcttgtccctgcagagaatatcaacaaggggaaaatatcccctttggtgcttgtgacttcttcagtgcaaattttgctgcaatttctaaatgttgcaataaatggcattgaggaatctgaatggctatttggaaaatacaactatcaatacctcacctcacattgacaccaaaataaattccagataacttacagaatccctattaacaaatcanccctagaaagcctgaagaaaatagaatatttatcaagcttccanagctagaaggatttgtaaaagcttagtgataaaataagcncaaatgaaaccatcnanannctgacncataaaattcttcagttacaaaaaaaaaaaaaaaaaaaccct

SEQ ID NO: 22322 - DNA, 778 bp, Homo sapiens
  misc_feature 503, 612, 716, 720, 723, 732, 739, 743, 745, 770: n = A,T,C or G
ggggcaatcaagatgtcagccagggctgcagttctctcgaggctcagcagggggaagatccacttgcaagctcactcatgcgtctgctggcaatactcaggctcttggtggttgttggccaaggtgtcttgacaaaatggctgaaattccctcccttcccccaacccctaagaaagagatggtaggtagagaatggacgtggggggaggggggagaagaggtggatgccagagtattatttttataatctagtcttggaagcaacatagcatcattgtggcctgttatttgtggggcccaatgcaaaagaaatatatgaagtccctagttcaaaaagcaggaagaagtccccttaaagggttttttctttcttctgttggtgtctttttcttgacttcctatggtgatttttacttgctttgtcattctgagtagagaaaggttaaaattttaaataattagcataattttaccattcatttttatattgtactatgccaggnttagatgcaaatataagagcatctaatttttatatagaatcaccaaaattacacaatttgtatctcatagcttatacattcatgtgtatttcattcttacaagaatagnggaaactacacaaacgaatttaactgttttattgcacatcatgatgctcacccattctacaactctgcctacctttgcttgctgataaaaatactgaaggaaanaaancanctgccctgncttttcnccangnataatttcagataatggtggctatncaggaagc

SEQ ID NO: 22323 - DNA, 689 bp, Homo sapiens
  misc_feature 2, 9, 11, 41, 689: n = A,T,C or G
gnagacagnangggttgtctgtggagtggatgctgcagggnagggtgacatcccagttagtcctaagagccagactgcctgaagctcactgtaacaagtcctgccttgaggaagaaggaagtttgcctctgtgaacctcccacctgggccgaagggaagccactctctctgctgcctctccccaaccttttccttctgtggtcctagtgaacctctcaccccctgcctacaggcctggaatctcaagaccatgatgacctctcatcactcctgaatccagagctttccctttacaaaggggaaactgagacctggagcagggctgatgttcagccagcgcacaagggaatggctgaattggtggtaaaatactgaaatagttccagtgtggatggaaaggggccactgccctgagcatctctactgcccacctcatcccttcctccaggaccctgggtcagcaccaggagtgtcaaagtggccaggattggccggagcccatgctaatggctctgccagcccttctccccaccagagagggcagggggattcaggccctctagaggtagcattgtgaccgtgtctgcagtagtcaatccttgtgtgccacagtccctgactttgttgataagggcatcagcctacatccctctggtactcagtgataagcatctaaaatcttcttaaan

SEQ ID NO: 22324 - DNA, 681 bp, Homo sapiens
  misc_feature 171, 536, 559, 633, 644, 681: n = A,T,C or G
gggagtccgtaatacattgtgctataagtttgatccagttagatagctcaaataacagattaatattctttactgggcatagaccctgtcccagagcatatcagggcatccgttattattttgtgggttaaatgggacctcatctaggactttttggaatggaaatagcanttataaaataagttcattagtacatatgcacttagtaaacatgtactttgaatctccctgaatcccaccccaaaagagttgaaaaatgtgaacagcaaaacttaaaaccctatgattaggtgacagaagatcctcacaaatcccaaatatgaatgggaccaagcatcaacaatttcaaaacctgtgtgatatcagcatttgtgagggaaagtaatggggccacctgatagccaaagaacaggaaacctacaaagttttccaaagtactcactggaaagtgaagtgggctgtctcaggagagcatgtgagactcgggtgggagggtacagatctagtggattctaatttgccagtgagtgcaagangactgagcattgaaatgttttangctctatgaattctgagaagtcagaactaaagttcccttctaagacaaatcctgctttggagaaaaaaaaaatntcggagtaaanctaagctgagttgaaaaaaagggaaaggaaagaggcn

SEQ ID NO: 22325 - DNA, 345 bp, Homo sapiens
  misc_feature 11, 17, 19, 26, 28, 29, 30, 37, 56, 62, 66, 68, 72, 86, 88,89, 91, 97, 214, 220, 233, 236, 251, 257, 258, 261, 266,273, 274, 275, 284, 308, 320, 325, 327, 336: n = A,T,C or G
ttttacaagancacatncncttgagncnnntggccgnaccggccttcggctgcganaatctncagnangggnatttttacgtgggngnngngggggntaatttttttcatacatgggagggtgtgttaaaaaatattccttcctgggtgtctaatgtgttagatatgccgttgtaggcgaaggctttttctgtgattcgtttttaagtgagganattganaatctttcatatnttnttttggggggggggnggatannaanaaagntacacannncattacttntattgaaggattactctgtgtctnaaattgctggcncttgntncagctttgnctcactttc

SEQ ID NO: 22326 - DNA, 856 bp, Homo sapiens
  misc_feature 2, 4, 9, 13, 14, 15, 20, 22, 23, 35, 46, 48, 55, 66, 69,77, 89, 720, 721, 762, 763, 823, 830, 832: n = A,T,C or G
ananacttngggnnncgaanannctttttttgttncttttggccgnancggcctnacggctgcganagnacgacagnagggaataaggnaaggtcttctgcttctggctatgacagagttgctagaatcagatgaattcatccactgagaataactataaaacttgagaacaactataaaacttggacaaaatacaaagcaaaacaaaacaaaatctgaaagctctgtagaacaaccagggcagccaggacctcagggaccaagatcctggagagaaggaaaacatattgaagtgagtactgctctgagtacagctatttcgccttggaatgtttgctgattcaaggcttggggcatagaggcataaaaaatgacgcattcttgagcctgtggcagttgtactgggctgaggaaaccaaaaatggagttcagagttaaattaagcagttactacatgaggggccaagatctagagaaaagtactatggacagctaaaaccaatattctatgtgcatttttccttcaaggcattttctgatatccaacaggctaaactcaagacaagacacagaaaaaaaacaagtaaaaaaatacctattaggaagattaaaaactggggagagaatctgtcagttccatgattctgaggagacaaagttggagtgcaagtctcaccaaagaggagaaactcagcttttgattcacaacctggaaatctnntcataagagtaaggacaattatacctagattagcctcactnnccaagggatcttctcaactcttaaaaaattaaatctttgtaaaaacacaatatcagccanaaccccntntttctacccatatttatcttcact

SEQ ID NO: 22327 - DNA, 799 bp, Homo sapiens
  misc_feature 18, 32, 33, 35, 36, 37, 45, 227, 228, 310, 313, 332, 381,412, 430, 448, 469, 493, 541, 554, 555, 561, 574, 580, 588,595, 608, 612, 650, 676, 691, 711, 731, 737, 740, 742, 745,756, 759, 785, 788, 799: n = A,T,C or G
attacttgggtaaataancccctttttttggnncnnntggccgantgtatacagaggggcacttacactgtaaatgaaacatatacaacgagtgtaaaaccagtaagtgtacagcttaattctatgctctgtcctgcacctatcctgaataaagctggagaaactcttgatgtttcagtgagctttaatggaggaaaatctgtcatttcaggatcattaattgtcanngccacagaatgttctaacgggatcgcagccatcattgttattttggtgttactgctactcctggggatcggtttgatgtggnggntttggcccctttgctgcanagtggttattaaggatactccaccaccacccccccctgcaccaaaagangaggaagaagaacctttgcctactaaaaagnggccaactgtggatgctncctattatggcggtcgangggttggaggaattaaaagantggaggttcgttggggcgataaangatctactgaggaaggtgcaacgctagagaaagccaaaatgctgtggngaagattcctgannaaacanaggaacccatcangcctanaccacctngacccanacccacacaccancctnctgagacaaaatggtacaccccaattaaagggcgtctngatgctctctgggctttgtgaggcgnagtatgaccgggttntttgtgccacctcagaaganataaggccgggcataactcncccagntcntntcnttaagggagcnganacaaaagtccaaatggccattttccnttntgtttcacccn

SEQ ID NO: 22328 - DNA, 321 bp, Homo sapiens
  misc_feature 3, 6, 8, 12, 17, 25, 31, 36, 40, 49, 52, 58, 61, 65, 70,75, 79, 84, 189, 192, 195, 207, 212, 213, 230, 240, 244,253, 266, 267, 270, 295, 300, 301, 304, 313: n = A,T,C or G
ctnagnancatnatctnagtttttncaaatnctctnaggnaacaatagnagnatcatnatncatnaactncttgnaagnatggnactctaaactttggtttacctccatgggaaaataaagatttagaaaaccaggtggggaaaaacatttcacttatttaaagactatttggaataataatttttttnggnaantggttggccccnccccnnggttggaaaaaaccccnttaaaaaaancggnaaattttantggtaaaaaaacnnccnccattttttttttttttttaaaaantcccnnttntggaaaccngggccccc

SEQ ID NO: 22329 - DNA, 804 bp, Homo sapiens
  misc_feature 4, 12, 16, 22, 34, 45, 47, 54, 64, 67, 75, 82, 88, 89, 623,688, 775, 778, 797, 799: n = A,T,C or G
attnttggaccntacnaaccancttgtcttgttncttttggccgnancggcctncggctgcganagnacgacagnagggggnaaaggnntattgtttttctttgggacagttatgatcttggcctctgatactaggatctaataaagcaagctgactagaaaagtaaaagcagtagctctgtgtaatgtgtgagctgtgaatttgttgctttcaagctgtttgttgtgttgtggcctgttctagtggactgggatcctgaggttttataacttaattttattgtagtagtaggcaaaatgctctttgtacctcagtttcctttcctgctctgtttcctcttttgagaagataaatgtgtacacgttaattctcccagtttcataacatgatggtgaaagaaaatactgtaaccaggggtgttttttaaaaaatgaagtgcaaggttgatagcaatttttgcatataaatgagtattaccgccttcagggttttcattctgggaggctatacacttatatcattctccaaaacttttttggtactgagtattgtgaaaacattaagtcattttcaaaacaaccttgaagctaaatagctaagtgatatttcctttgttccttangcatcattgtacaatggtggattatataacccttatggtcctcgactgtaagtctaatagggaangtggtgaagagagggaatgtgggtggcacagtttactttcaagaaaagtcaaaaaaaaaaaaaaaaaaaccctgggccgtttttcgnaanccactgaaaaactgggggntnccccc

SEQ ID NO: 22330 - DNA, 689 bp, Homo sapiens
  misc_feature 479, 482, 660, 662, 663, 675, 679, 683: n = A,T,C or G
gggggaagtagtagtaaaagataaaactggaaacgtagagctggattggagagaacctagagggagtttagaaaatttccttgggtgatgtggagttgctctgttggcatgaaacattgattagagggagtaataatgagataaatatgagagtttggaagatgaatctggaggaaatattgaagggagcaagggactggttgcagggaaactagctgggtggctattgtggtaaactgaggatgacatattgaggatctagaatcatcaggtagtagacagaatgattaaaaagaaatgcacaggccaggcgcggtggctcactcttataatcctagcactttgggaggctgaggttggcagatcacgaggtcaggagatcgagaccttcctgaccaacatggtgaaaccccgtctctactaaaaataaaaacattagccaggcgtggtggtgcacacctgtagtcctagctactcangangctgaggcacgagaattgcttgaacccagtaggtagaggttgcagttagccaggatcatgacactgcactccaccctgggtgacagagcagactctgtctctaaataaataaataaataaataaataaataaatacctacctacctaccaaaaaaaaaaaaaaaccctgggccctttncnnatccactaaaanctgnagtncccccc

SEQ ID NO: 22331 - DNA, 822 bp, Homo sapiens
  misc_feature 2, 8, 12, 19, 20, 31, 42, 44, 60, 62, 65, 72, 642, 743, 744,751, 763, 777, 796, 814: n = A,T,C or G
antcttgncctncgaaccnncttgcttgttncttttggccgnancggcctacggctgcgngnagncgacagnagggcaaaaatttgtaaatagtgacaaaaaaggcattcagacccactggtatgattttggtatatttctttctacttactgcctatatggcacattatctttttacattgtaatcatggtgtatgtataacttgaaatgttttcctttgacattataccatttttctttgttgtcacattatctttaaatcattttattttaaaaacttatttaaaaatacataaatatatgtttgtttgcagtcaaacaatataaaaatacatagaataaaagattttatcacttctacccacaaattccatttttgaaacccataagtaaccccttttaatatcttcccttgcatgtgcatatgtgtgtatggttttatttttttacagataagcaggatcatactacctattgttttttcaacttgctttttcacttagtatgttggagatcgttccatgccagtacatacagattttcctataaccattatttaaaatgtgtgtgtaatattccagggagcaaatataataatagtggctaattaaagtagtagttacagaacactccctgacttncaggcattgggccatgctctttcacatgtatttaatcttttatacagtcctgtgaggaagatgacatttcttccattcccagatgaggaaccgagtctcannattaagngcattgcctcancctggggacaagantttttgaaaaactggtctnaaaaaaaaaaaacaaacnaaactttt

SEQ ID NO: 22332 - DNA, 776 bp, Homo sapiens
  misc_feature 4, 571, 587, 660, 683, 726, 758, 761: n = A,T,C or G
gggnatttcctttttatcaatatcccttgactatttttcttttggatgattgattttccttttgctataagtttttagaagcttttttctatgtattttaacatttctgtctgtgatattttgtgtgtgaaaaaaaacacactcaatgtgttttttcctatttttctcacttgaaaacaccaatcaacacagacagaagacttctgtgaccaaatatgggggatctctctgcaagaaaaggcagcccgttctgcagtagacaccagctgggtggcctccaattcagttttgacaccatctatttggagatagcatcagatcctacaggttgagggctcaggccccaaaactggccacccccaacccgccacctcagacacagatgaaagtccagacctccaaacttctgacaggctggttttagtttgggggttcccacaacttcctctttgggttcgatcagtttgcaggggcagctcacagaactcagggaaacacagttattggttattacaaaggatattacaaaagatataaggaaaaggtcaaggagcttgcctgccttcttcangaccaccacattccangaacctctaagtgttcagctctctgaagctctctgaccctctcctttgggcttttatggagattcattgctangcatgattgattagcccaggctntggctatcaacttaatttaactcctccctcccaaaggtctganaaggctgaagtccacgctctatcccgcctggnttntgggaccacccatcg

SEQ ID NO: 22333 - DNA, 845 bp, Homo sapiens
  misc_feature 3, 4, 11, 17, 23, 29, 35, 46, 48, 55, 65, 68, 75, 77, 96,717, 759, 760, 820, 839: n = A,T,C or G
ttnnttcttgncctacnataccncttgtnttgttncttttggccgnancggcctncggctgcganagncgacagnangggggaggtatttccaagnacatagtcccactaaaaaggtgggactttaagaccacaagttttataactttagtatcctgatttttaaaattgaaaatatttgctaatttttagactttgttagaagtaataaactgtgttttgcaccgtggcggtgacctggtaactctcgggtgtcactcagccagccttgcttcttggacaaggactatagtttatatttctaacatctcccccagcacctagaatagtctcttatgcagagtaggcacctcttttaaaagtaaattggattaacaaattacacagcttattgtcagcaattgttatgcttttaacagccagaaggaacagttaacagaaaagacacaggatgtattaaaaatgaaccagttctgtctacttttgtactttttcacagtaagcattttggtgttggggaaagtatgactacaaagctcaccatcttctaagaggaggaatatattcagctcagtatatttaacgtattttaataagtttttaataatggtaaccatgactcctcggggaaagatatattattcaatgtatctttgaagaaaaaacctacaatacacttttgaaatgttttcatacaaatgggtaacatttaaagtgngatatatcatgggctgggcataatggctccacctgtatccannctttggaggctgggcggcagatctcttgagtcaggagtcgagactagctggccacatggngaaaccctgtctacaaaancaaaat

SEQ ID NO: 22334 - DNA, 771 bp, Homo sapiens
  misc_feature 497, 562, 608, 617, 636, 642, 680, 698, 715, 719, 732, 736,739, 743, 747, 760, 769: n = A,T,C or G
ggggtttatgttgctgctttttcaattggtctaggaccaatgccctggctggtgctcagcgagatctttcctggtgggatcagaggacgagccatggctttaacttctagcatgaactggggcatcaatctcctcatctcgctgacatttttgactgtaactgatcttattggcctgccatgggtgtgctttatatatacaatcatgagtctagcatccctgctttttgttgttatgtttatacctgagacaaagggatgctctttggaacaaatatcaatggagctagcaaaagtgaactatgtgaaaaacaacatttgttttatgagtcatcaccaagaagaattagtgccaaaacaggctcaaaaaagaaaaccccaggagcagctcttggagtgtaacaagctgtgtggtaggggccaatccaggcagctttctccagagacctagtggcctcaacaccttctgaacgtggatagtgccagaacacttagganggtgtctttggaccaatgcatagttgcgactcctgtgctgctcttttcagtgtcatggaactggntttgaagagacactctgaaatgataaagacagcctttaatcccctnctcccagangacctcaaaggagatgagnacaagncctagtgatctcttttctgagcaggattcagggtaagnaaaagtactgctggttanacttctaccttttacanacancttgataacatgnctanganaatnaccnccctaactttttnggggggcancc

SEQ ID NO: 22335 - DNA, 724 bp, Homo sapiens
  misc_feature 11, 13, 16, 624: n = A,T,C or G
agtacgacagnanggnaagctggggcctcttcaggcgtcctgggctgagagagaaagatgctagctccgcaagccggggagggaacaccgccacattgttacatggacacaccgccacgtggacacatgaccagactcacatgtacagacacacggagacattaccacatggagacaccgtcacacagtcacacgaacacactggcatagtcacatggacggacacacagacatatggagaaatcgcactgacacaccaccacactatcacagggacacagacacacggaggcatcaccacatggacacactgtcacactaccacagggacacgagacatcacactgtcacatggacacaccatcacacacatgaacacaccgacacactgccatatggacactgccacacacactgccacactgtcacatggacacacctccataccatcacaccaccacacacactgccatgtggacacaaggacacacagacactgtcacacagatacacaaaacactgtcacacggagacatcaccatgcagatacaccaccacatggacatagcaccagacactctgccacacagatacaccaccacacagaaatgcggacacactgcncacagacaccaccacatcgttgccacactttcatgtgtcagctggcggtgtgggcccacgactctggctctatcgagaatacttgacatatagtgaagac

SEQ ID NO: 22336 - DNA, 641 bp, Homo sapiens
  misc_feature 531, 630: n = A,T,C or G
agccagccaattttggaataaggagaggtattaaaatagattgctttgatttaagtctcctgaacggtaggttacattgaggctctcgtcggagcactggccagccggctttccccttcattccacgtgttgtaatgtgttaatatgcccagctgacgtttttgcctgtttcttagtttgacatcaacaacaagatcgagttctgacgctctgcaggggcgatacgcagctcctgaattggaggtaagttcatttccttttcctgtcctgcttcatctcagaagatccatttctcaggagggccttttgtgtttgtgtctttatcagtctgcattccgtgatcctgtttttctgctgaggaaagatttttgtatagaaaaataaatgctggccgggtgtggtggctcacgcctgtaatcccagcactttgggagtccgaggcgggtggatcacctgagtcaggagttcaagaccagcctggccaacatggtgaaacccatctctactaaaatacaaaattagccagctggntgctcacacctgtagtcccagctacttgggaggctgagacgcgagaatacttgaccctggggcaaaggtgcagtgagccagggcataccctgcctccanctggcaaaaag

SEQ ID NO: 22337 - DNA, 677 bp, Homo sapiens
  misc_feature 556, 597, 608, 642, 661, 668, 669: n = A,T,C or G
gggcatacccatttaccacaaaccccagaaacaaactttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacatgaaaatgaaatacaattcaaaataagttaaaaaaagactttcctaacatttgatcanggttctgtctttaatcatacggaagatttagtctagtaganaaacacaaganacattttctggaaggagaaaaaaaaaaaaaaacnctgggcgttctcgaatccnactgaannccttgggt

SEQ ID NO: 22338 - DNA, 801 bp, Homo sapiens
  misc_feature 2, 5, 6, 7, 8, 19, 25, 31, 42, 44, 61, 69, 626, 629, 725,727, 755, 760, 762, 768, 769, 770, 771, 780, 786, 791, 792: n = A,T,C or G
tnacnnnnctacgataaancttgtnttgttncttttggccgnancggcctaggctgcgatntagacagnaagggtacccagtgctttggggtgcttggtgccacccagcactgtgagcacaggttcttctaccttggggccacacccagttacctgtatctcactgcacagcagtggctgttggggaccaggcccacccctccatgtcccacctcctgcaactgcagcctgagccttcccatcagcctggggtggtgcagacccatgtgccattgtggatccttcaagttacctgtgtggcagagaggacgtgtgagtgccgtccaaacccaaacactgagagggtccttcccattgcccccacggaagtaaggtgccccagtgctaattccacttatacttgctggtggcaaggacacttctcctccttattaaagtgggggattggctgggtgaggtggctcacgcctgttatcccagcactttaagaggccaaggcaggtggaccacctgaggtcaggagtttgagaccacaagcctggccaacatgttgaaactccatctctactaaaaatacaaaaattagtcaggcgtggtggcgtgcacctgtaatcccagctacttangangctggggcaggaggatcacttgaacccaggagttggaggttgcagtgagccaagattgtgcccctgcactccagcctggtgacagaatgagacttntnccaaaaaaaaaaaaaaaaaaaaaaaccntgggncntttttnnnnatccaactnaaaaancttgnnagttgaacc

SEQ ID NO: 22339 - DNA, 820 bp, Homo sapiens
  misc_feature 2, 4, 10, 11, 16, 19, 22, 28, 34, 45, 47, 49, 56, 63, 739,745, 773, 777, 781, 787, 792, 810: n = A,T,C or G
anantcttgnnctacnatncancttttnttgttncttttggccgnangnagacagnagggggnaagcctcttaagctttggtctataaccagcccactgtcagttctgccaagattcccttggccaacacaaattgtattgtcaagccccacatcagcagggtgaggaagtatacctggccagttctagtaggaggtaactcgaagtcatatggcaaagaaggtagatgtatatggaggagcaaagcactgagaacaataatttcattcacaatggtagagaatgaataagacggaagagagcagtttgggccaaactagccttttgggagcttgcgagacctaggctgactgggtgaaaaatcatatgcatttggtgcaggtaccagcccaggccttggcatttcctgtacattcgctggcatgcgctgcctctcggctggctggacattgatcatatcctttcactgcgatggggctcgtgggagtgctgcctatctgtgggaggagcagaaggatgggcctgattttcttcgggtcagccatcatgacctgacaggctgccaactgtggtggcaggagtgtgacaagctgagagggcaaagaggacaataaggaccacagtgttgaaggaggccaggggcttgcctcagcctaagtcccacctgtaatagtcagtgacaggttagcatcagtgcctgtgtgtaccatgtcccatcttcataagatcctaggctgtncttcanacctgcctttacttcaagaacagcttangagngagngacttncttanccaccactcaaaatgcanataaaccagc

SEQ ID NO: 22340 - DNA, 549 bp, Homo sapiens
  misc_feature 314, 390, 434, 468, 469, 504, 509, 519, 521, 533, 534, 542: n = A,T,C or G
ggggctttctttctagcgctctctctctgtctgtatatgtatatatacttacaaaattattttaatggtaaataatgtgagaataacttacagatactgtgcctctctggccctgaacacttggcctgtatcctttaagagcaaggacgttctcttatacaactcaaggaggatcatcacatttaaaaattttgaggctgggcacagtgtctcacatctgtaatcccagcacttcgggaggctgaggcaggaagatcgctgtggccaggagtccgagaccattctgggcacatagcgaaactgtcttgacaaanaattaaaatattaaaaattagttgagcatggtggcatgtgccagtagtccagctacttgggaggctgagtcaggangatctcttgagcccaggagttcgagctgcatgagctgggattgngcacttgactcagcccggcagcaaacacaacctnnttttcaaaaacgaaaaccaaaaaaaaaaaaaaaancctgngccgttttcngnatcccactgaannccttgggngtgcccc

SEQ ID NO: 22341 - DNA, 855 bp, Homo sapiens
  misc_feature 2, 8, 11, 15, 21, 23, 24, 36, 44, 48, 50, 57, 66, 68, 70,71, 72, 78, 746, 759, 782, 786, 796, 800, 829, 830, 834,835, 837, 838, 840, 852: n = A,T,C or G
antaactnggnctancgatanannctttttttgttncttttggnccgnancggcctncggctgcgnanannngacagnaggggttttttggcttcttaataccaagtgaaataagcagaccgctgtgcatccaaaagctttgttcctttttgctctagggctgtttttagatggactaatttagggatataccaggagcccccaccatagccgaagagagtttttggtaaggctttgccagtgagaaagcaagcagacagtattagaactatagcggcaaagcaggagtttgataaggtgaggtttcaattgagaagttcccatgggagaagcaggattaaacagacagaagagagaggcctcataaagagcagggaaaaaattccagcccaggcattggggagtggatccccactggaaacaaagagccaggagaagtcttcatcccaggagacaaagatccaggaagaattttccagccaagagccaggctcaggagtcagggagtaaatgtcttcttgacgcagtgagccccagaaagaaagacttctagctgagtagatgcctttcaaacaaagaagtctgggcctctaatccagcttcagacaatgtaatcagaatcttcatcaaaatctgtcctcactgtgattcgatggacatttatctggagcactggatattggaatcactcaccaccagatacccaaaagcagcagactgaagacaaagtcttggtgtgtgcttanagattggtattgngtccaaagtctaatgggggtcanatcngatctaatcntggncaaaaaaaaaaaaaaaaaaaaaaagggcnntttnncnnancccaatgaaaanctt

SEQ ID NO: 22342 - DNA, 768 bp, Homo sapiens
  misc_feature 2, 9, 14, 28, 539, 603, 647, 690, 700, 705, 710, 712, 728,729, 740, 741, 744, 749, 750, 764: n = A,T,C or G
gnagacagnagggnattcctttcacagnaggctgttggtagcccttgcttagaatcagtttttttttatctagagaagatagatttgcttgagtcctaccacactcacatacttttgtgagatggctgcttatggaaaggatattgtttttctttgggacagttatgatcttggcctctgatactaggatctaataaagcaagctgactagaaaagtaaaagcagtagttctgtgtaatgtgtgagctgtgaatttgttgctttcaagctgtttgttgtgttgtggcctgttctagtggactgggatcctgaggttttataacttaattttattgtagtagtaggcaaaatgctctttgtacctcagtttcctttcctgctctgtttcctcttttgagaagataaatgtgtacacgttaattctcccagtttcataacatgatggtgaaagaaaatactgtaaccaggggtgttttttaaaaaatgaagtgcaaggttgatagcaatttttgcatataaatgagtattaccgccttcanggttttcattctgggaggctatacacttatatcattctccaaacttttttggactgagtattgngaaacattaagtcattttcaaacaccttgagctaaaagctaagngatatttccttggtccttaggcatcattgacatgggggatatntaccctatgncctcnactgnanctaatagggaaggggnnaaagaggaatnnggnggccnnttcttcaaaaaaancaaa

SEQ ID NO: 22343 - DNA, 759 bp, Homo sapiens
  misc_feature 2, 9, 19, 22, 48, 59, 61, 79, 91, 93, 108, 109, 112, 124,136, 142, 146, 159, 172, 173, 175, 191, 233, 281, 283, 334,343, 350, 353, 370, 394, 471, 498, 512, 537, 542, 548, 603,606, 607, 653, 662, 681, 697, 711, 718, 719, 725, 736: n = A,T,C or G
  misc_feature 743, 749, 750: n = A,T,C or G
gncgacagnagggtatccnttncacagaaggctgttggtggcccttgnttaagaatcantnttttttgtatactagcangaagataaatantncttgagtcctaccannctnacatacttttgngaggatggctgnttatgnaaanggatattggtttnctttgggacagtnntnatcttggcctctgatnctaggatctaataaagcaagctgactagaaaagtaaaagcantaggttctgtgtaatgtgtgagctgtgaatttgctgctttcaagctgntngttgtgttgcggcctgttctagtggactgggatcctgaggttttataactnaattttatngtactantangcaaaatgctctttgtncctcagtttcctttcctgctctgnttcctcttttgagaagataaatgtgtacacgttaattctcccagtttcataacatgatggtgaaagaaaatactgtnaccaggggtgttttttaaaaaatgaantgcaaggttgatancaatttttgcatataaatgagtatnaccgncttcanggttttcattctgggaggctatacacttatatcattctccaaactttttggtacngannttgtgaaaccttagtcattttcaaacaccttgagctaatagctaangatatttcnttgttcttagcctcattgnccatggggatatttanccctttgggcctcnactgaanntaaatngggaagggggnaaaagangaaagnnggtgggcca

SEQ ID NO: 22344 - DNA, 715 bp, Homo sapiens
  misc_feature 1, 9, 31, 606, 653, 665, 679, 696, 698, 702, 706: n = A,T,C or G
nacgacagnagggaggaaactgtgtcatagnataaagctttgaaataatgagatccttatgtttactagaattttggattgagatctatgaggtctgtgacatattgcgaagttcaaggaaaattcgtaggcctggaatttcatgcttctcaagctgacataaaatccctcccactctccacctcatcatatgcacacattctactcctacccacccactccaccccctgcaaaagtacaggtatatgaatgtctcaaaaccataggctcatcttctaggagcttcaatgttatttgaagatttgggcagaaaaaattaagtaatacgaaataactcatgtatgagttttaaaagtgaagtaaacatggatgtattctgaagtagaatgcaaaatttgaatgcatttttaaagataaattagaaaacttctaaaaactgtcagattgtctgggcctggtggcttatgcctgtaatcccagcactttgggagtccgaggtgggtggatcacaaggtcaggagatcgagaccatcctgccaacatggtgaaaccccgtctctactaagtatcaaaaattagctgggcgtgcagcgtgtgcctgtaatnccagctacctgggaggctgaggcaggagaatcgcttgaccccggagngtaggttgcagngagtcaagatcgcnccctgactttaacctgngnaganctanactccgtcc

SEQ ID NO: 22345 - DNA, 204 bp, Homo sapiens
  misc_feature 154, 159, 161, 164, 166, 168, 170, 175, 176, 178, 180, 186,187, 190, 192, 199, 203: n = A,T,C or G
ggggaaatcaaaggttaatgattttttgttcattctgatttgtcattttattatctgttatcggtctaaagtgctaatttacccatttgatttttctgctagacagataacttttaatttttcaaatttggcagacactttttttttttttttnaaaantnttncntncnaaatnngngncccatnnaananccccccncccnt

SEQ ID NO: 22346 - DNA, 727 bp, Homo sapiens
  misc_feature 467, 604, 612, 641, 652, 654, 663, 672, 719, 720: n = A,T,C or G
gattatctattctataacttccaaatgaaatcggtaaatgatttcttgagtacacattcaggggattaaaaaaagatgtcacttttaactggaattgtcaaagaaggcttcgaaaatatgtggcaaatgaaacttctttaaggaggatgagattaattgtgtagtgatatggtaggggatagaaaagtagggaactccaggcagtattgtttcatttatccattcagtcatcaccaggtataatgccatagtggcaggaagcgtagggtgatttgggagaatatttatgaattgcctacccagaataggagacacagggtagcacttctacaaaggtgacatcaatatggtgtctttaatgctcaagtaacagtttgcctatgatggttaaaaggaataagaacagatatgttggggagaggaaatagcacatgcaaaagcacagatacatacaggtttatggaganttcaggggactagtagtgaattggtatggatgaagcatagtatgaatgtgaccatgagcgaaggggtaacctgggggagctcaaacgggtttagcaaatagtgaatccctttacctggtaatttgaaggttgcaganaaattaanaatctatctatctatttatctatctggcncatgaaaatgnanacagaatanttttcaccnctggataccagttcagcttctgattattttattttctgggcaagaannatttgta

SEQ ID NO: 22347 - DNA, 866 bp, Homo sapiens
  misc_feature 2, 20, 26, 32, 43, 45, 52, 63, 66, 74, 79, 111, 659, 680,705, 711, 742, 768, 772, 799, 810, 820, 831, 838, 846, 859,861, 863, 865: n = A,T,C or G
anatcttacctgcgataacnccttgnttgttncttttggccgnancggcctncggctgcgagnagnacgacagnagggnattcttactaatcagtggggctatagcagagnattaaaccgactgagtttctgcctttatagagtttacctttgggtgatggagacagaaattaaatgaacaaataacttaagataataatgttaaatggagaaaatcaagctgggaaaggagattaggggttgcttctgttgagagtgggtgttttctattttacttagataaggcttgaacaaattaaagttttgggccttacagacatttggaggcagactgttacaggaagagggactagcaatgctctaagggaacttgcctggaaggttcgagaaacagcaagaaggccattggcgctgcagtggaatgattgagaggagtctttggtaagaatttagattaacgatgtagtaggagaatagacaatgtaaaaactctttggtgcctgcaaagaccatctcttaatctgaactttgaagacgtagagctaacatgggatagaatttgatttacacattaacaggaccagaaaggctgctgggttaagaagaagtggtaggacccagtgttgaagcagggaggcactggaagctattgacattgntcgcagatcattatggattangtcagtataatgacctaacatgganaggtantggttggattttgtaaatatttgaagcatcnagtaaccttcttggattggtgtaagntganaaaagtgagagtcatgatacttaattnttggcttagtnctcaaaaggntgcattttggnaaagctntaagacanataactgggacanantnant

SEQ ID NO: 22348 - DNA, 779 bp, Homo sapiens
  misc_feature 2, 4, 10, 15, 17, 19, 20, 21, 25, 27, 33, 46, 48, 55, 61,722, 728, 740, 752, 754: n = A,T,C or G
anancttggnctacnancnnncttntnttgttncttttggccgcangnagacagnaggggnaatacccatcgtccgtcccacccactgcccaagtccatccctcacacactcaccctgccaatactcagcctcctgatcagagtcaccagtcctagactggcccccacagattactgttcataccaccgtcagagggatctgtccatgcacaggctgacctgtgcagcccacaggctggagcgctcagcatggcactctgttggtgttctatgactatatgctggagaagtgagagagcaaatgaatggcttatttcacctccgccattccccacctccttcattacatgtcagtaacaccacctactcgcggttcctggagagaccggcagccgccctgggcagaaagggacaaagaaaatgtttcgcagcacgcgggacctgcaggacctaggcgggggagaggcttgggagtgggaactagcacccgctgtaaggtctgccataagacttaatgtttgtctccaatgggatggagtcctggcataagcaaaattaatattgataacgttattattatttaaaatttgtaaatattgtaaaatattttagaaacatctactttgaaacatctactgggcgagaccaggagtgatggctcagcctgtaattctggaatttcgggaggccgaggcaggaagattcttgagacaggagttcanaccagnctgggcatgtancagacctggctntnttatcaataaattttttaaaaggga

SEQ ID NO: 22349 - DNA, 666 bp, Homo sapiens
  misc_feature 464, 516, 520, 529, 558, 590, 597, 605, 612, 650, 652, 663: n = A,T,C or G
ggggggagggtctcaagctttccccggtgtcggcggcaggtggaatttccacgctttatctgcgcctgcgccgcgcgggattcgcggtccgagctgaagaggttcgcggtccggtttcacttctccgaaccctgaggcagtgtgtgaagctgggacgccagccatgttccagaccgcttggcgccagagacaatcttactctgtctcccaggctgagtgcagtggtgcaatcacagctcactgcagcctccacctcccaggcctaagtgatcctcccaaggagttgagactaagttgagactacaggaaccagtgacctttgaggatgtggctgtgtacttcacccagaatgaatgggccagcctggactctgtgcagagggccctgtacagggaagtgatgctggagaattatgcaaatgtggcttccctggcattcccattcaccacgcctgttctggtctncagctgagcaagggaactgccatggggcctcgatccctggaacctatggcanggangctctaaangtatctgtcagggatgaggcagaactganaaggaagattactccaaggtcatgtgtccaanaacaaantccttaantgatggngggggcctgcaggaatgtttccacaccttactttggancncctaaacaccncag

SEQ ID NO: 22350 - DNA, 859 bp, Homo sapiens
  misc_feature 2, 3, 5, 10, 13, 17, 21, 27, 33, 44, 46, 53, 64, 67, 74,84, 91, 153, 666, 768, 777, 778, 788, 795, 820, 822, 823,827, 828, 830, 831, 834, 835, 838, 842, 851: n = A,T,C or G
anntnttggnctncganacancttgtnttgttncttttggccgnancggcctncggtagcgagnagncgacagnagggggaagnactaagnagggtaagttgtttctctaagaatccacgaaatagatcagaacttgaagttaattccaaagnaggcaatgcacattaggatgaacaactattcctcttgaatttctcaactcatgttataccttgttatgtcctttaccctagtttaccagaagggcacattaggagtacatatattataaaaccatgatacaattaaaatgacatggagtcaaacaaggaaactgtctttcttccagagaaattacatttcaaattgaaatttcagaggtgacatgaatggaaatattgtaaaagtgatattgctatcgtcttttggccatcagttttctgaatatgccttctaatatttagatccctggagtgaaagaggggaagtcttgggaactcaaactccaataaattagaggtcaattataaggccatataaatgtttggtgcttaaagagcacctcactaaaaaatgataggtgcaggccagacgtagtgctcacgcctgtaatcccagcactttgggagaccaaggcaggcggatcacttgaggtcaggagttcgagaccatcctggccatatggngaactctgtcttactaaaatacaaaattagctgagcctgtgatgggtacctgtatcccactactcggggggctgaggcaggagactgcttgatctagaggcnaggttcagnngccgaatcgntcctacnctcctgccacacgaacagactcctntnnaccnncnnccnnccnaccnaaaaaaaangagaaggg

SEQ ID NO: 22351 - DNA, 733 bp, Homo sapiens
  misc_feature 1, 9, 554, 581, 589, 601, 603, 611, 612, 629, 671, 677, 681,682, 686, 709, 719: n = A,T,C or G
nacgacagnaggggacttttgtttttctcttcataatagtttgtttcctcaactaaaacgctatctcactgtaagttatcattagttttgtcttccctatttgattaaaagtctcttgtgccatctgtctcagactgctttgcacacagcaggtactgaatagagttgttggttaatcactcaatgtagtcacacaatagtgaatcattatacaaattcctgaaagacttcaactcctccccttgctaatggtttttatggaggttaactttttaatatcaccaaaccaatcgtggggaaaatttacagagttctttcttttttgctttattaaagaatagtgttagccaggcgtgttagtgcacacctggagtcccagctacttgggaggctgagaggcaggagaatcgcttgaacccaggaggcagaggttgcagtgagctgaggttgccctactgcactccagcctgggtgacagagcgggactctacctcaaaaaaaaaaagaatagcgccatgatatgtcaactctaaaaatgatgtttttaataaagngaaatcctggggaaaaaaaaaatcttnttttggancaaaattattantnaagaccannatttcatgctgattaanacccttctttggtggttgaaacacgatgggttaaagtagggnaccttntccnntttntaaggaatggaaaataaatttcncactgctgangggggagcccccgg

SEQ ID NO: 22352 - DNA, 847 bp, Homo sapiens
  misc_feature 6, 10, 11, 14, 18, 19, 25, 31, 42, 44, 60, 61, 64, 72, 74,77, 79, 91, 212, 222, 225, 227, 231, 232, 234, 246, 269,273, 279, 280, 281, 287, 289, 290, 292, 294, 296, 299, 302,303, 309, 315, 319, 325, 327, 329, 332, 334, 341, 347: n = A,T,C or G
  misc_feature 360, 362, 365, 369, 371, 377, 379, 381, 384, 387, 390, 394,401, 403, 420, 424, 435, 457, 461, 464, 467, 469, 477, 484,487, 491, 496, 498, 503, 510, 514, 521, 522, 531, 534, 538,540, 547, 555, 556, 569, 570, 585, 591, 593, 610, 636: n = A,T,C or G
  misc_feature 671, 699, 708, 709, 720, 725, 731, 772, 778, 796, 806, 820: n = A,T,C or G
taacgnaccnncgntaanncttgtnttgttncttttggccgnancggcctacggctgcgnntantcgacagnanggngnaagaagataagnatgttggaataattaagtaaagacaaagaagggaatagagaaaagatgtaatcagaggaggagaaagagattaaatgtatgtgaatgttttgcaaaaacaaaaaaaaaaaaaacccttttnaaaggaaaanggntngtanngnattgtaaaaaantgaccaccaaaattaaccccaanattnccctgnnnccccantnntntntnacntgnncagggncaaaantctnacctcntnanggncntaacccncccccnctttttttttttntntgnaaantnaccccnantnggntgngtntagnatcatancngggtcctgcccttgatncttncaaaatttttnaaaaacccaccctttttagggnacanggntgncncaaaattnggcaaanttntttncctgnanctacntacaggnttcntacagcnntccccacantanttanancaaaaanatttttcnnaggttgggcccanntgctcacgcctgtantcccancnctttgggaggccgaggngggcggatcatgaggtcaggaaatcnaaaccttcctggctaacacggggaaaacctgtctnttctaaaatacaaaaattacccagggtnctggcgggnncctgtatcccnctgcncaggancctgggcagaaaaaggcgtgaacccgggagcggacttgcangacctnaatccccccctgcccccnccctgggganaaacaaggcccccncccaaaaaaaaaaaaaaaaacccccgc

SEQ ID NO: 22353 - DNA, 769 bp, Homo sapiens
  misc_feature 2, 9, 11, 331, 359, 611, 638, 649, 672, 691, 698, 714, 728,733, 752: n = A,T,C or G
gnagacagnangggttaaatctgctgctaagtctgcccgtttttcaagtaagtgcatttttaaaagccccacatgggaatttctcatggacttacaggcttctttgtttttctgcatgtctccatctcatgtcatcttttaatctttcccttctaacatgctccatgtgaatgtttcttatagatagttgccacataattttcgtatatttcttatagatagttgccacataatttttcaattacaaatcagatgccacataaacagtttgccgtcagaaacttttttttttaacatttccttggaacgtatctgtggagtaaatcatggngatctttttgaactcccagttaggtttntctgatactgaacatgaactcaacagattctttgtgtttctaaagactgtatttagattcacttagatgtttagttagcatttcctatgtgtcagccattgcattggtttctttcacattttatttcataattaaattattcttaataatgaaccagaagtgccatttcactttatgaaagtagaaaaatgaaattttagcccagatttcctctgtgactgctttggtggggtgtgcaaggactggggtgangtatacccaagatgaaatagatgacgngaaatgtagantgagttaaatataaagttatganatatcactttcttttaaanaaatgcnctattatgggggagtnttggcttaggaaanaaaanaaacttctgacctactacntctttagttgctggcta

SEQ ID NO: 22354 - DNA, 778 bp, Homo sapiens
  misc_feature 1, 25, 596, 689, 747, 754, 758, 771: n = A,T,C or G
ngggttaaaggaattcatgcatagnaaagagataatagactatctgcagttcattagtagttgtattcagattgggaaaacaaagtgttaattgttgaaagttgtttagggactgctgggtcttggagtcagcacctgggtttgcattccttctctgcaattttctgtatatgatctcaggcaagttacttgaccactctaaaccctggcttcctcatctatataatatagatgatagcatctgcctcacagggttatcatgagaattggatgcagatgtgtacaaactgttccgtgaggcatcaggcactcagtcagtcactaatactatcagcttacaaagctgaggattcaatcatccagtcattagcaatctgttgttgggatgtgccagtgttatctagcaaccagttggaatctgatagcaatcagaaattagataggttattcctggattaaacagtatattcatataagtgattgcttggatcctcatcagaagctgctattgaaaaatagtgatatggctggccgggcatggtggctcatgggtgtaatcccagcactttgggaggccaaggcgggcggatcatgangtcaggagatagagaccatcctaactaacacaatgaaaccctgtctctactaaaaatacaaaaaattagccgggcgtgcttctgtgcctgtantcccacctgctgggaggatgaggcaggaaatggcatgagcccagaggcaggcttgcangagccanatcnaccctgcctccanctggtac

SEQ ID NO: 22355 - DNA, 661 bp, Homo sapiens
  misc_feature 7: n = A,T,C or G
gggcagnatcatccattttaactttgcattttccccttacattgcgttgtcttacatggcacattctttcttctaccacggtatctttggccgtgcttgtacctgatgttaagatgcctttccttttcctctgcatctgttttgttttaggaatgatttgtttgcaagaatagttcccaccccaacaaacttaagtaaaagcttatgttatttgataggacagggatttattatagagtaaaaatgaaggaaagtacagtcacctgagactgaaaacagccactcagtgaccaaaacagctcttctcacaccttttttgaggctgcttgtttggttgtttcttatttctgcatctctattcttttttaaaattttttctggtcgagcgcagtggctcatgcctgtaatcccagcactttgggaggccgaggcgtgtggatcacatggtcaagagatcgagaccattctggctaacacagtgaaaccccgtctctgctaaaaatacaaaaaaaatattagccgggcatggtggcaggcacctgtagtctcagctactcgggaggctgaggcaggagaatggcatgaacctgggaggcagaccttgcagtgagccgagatcacgcactgcactccacctgggtgacagagcagactctgtctc

SEQ ID NO: 22356 - DNA, 834 bp, Homo sapiens
  misc_feature 2, 3, 9, 14, 16, 19, 20, 31, 51, 62, 65, 72, 666, 674, 750,809, 818, 820: n = A,T,C or G
anncttggnctacnanccnncttttttgttncttttggccgcagcggcctncggctgcgagnagncgacagnagggcgggttgcagctggccaagggtgatcggcatgttggtaaaatttattccaaatgttcttcttttctggattatgtcagacggtctctaaagaagcttggattagatgagtccaaggtatgactgattttcccaaaatattttgtgaaacttctcagaagttggtgagtgtggaagcctttgctctggctgcgaaatactattctgtacaaaacttgggaatatgtactccttttgaacagttgcttgtagcccttcgaggaaatcaaaaccagagaattggtgaaaatcagaaggcagttgagtttattaatatgaagaaatctcatgaagttcaggcaatgtcagagctgattagcagtattgctgactactatggaataaagcaggtgattgacttgggttccggtaaaggctacctaagctcttttttgtccttgaagtatggcttaaaagtttatggaattgattcttcaaataccaatactcatggagctgaggagagaaacagaaaattgaagaaacattggaaactctgtcatgctcagtcaagattagatgtcaatggactagcattaaaatggcaaagaanggaagtgnaaaataagttaaaataaagctgatactgaggaagtgttaacacagtcctccaatcagaaagagcctacctcagctntttgcctgattttctgctctggatttctaatatcaaaaccaatggacccttcttctcancccctcgananaaaaaaaaaaaaaa

SEQ ID NO: 22357 - DNA, 765 bp, Homo sapiens
  misc_feature 2, 9, 22, 23, 31, 46, 547, 711, 713, 738, 739, 748, 761, 764: n = A,T,C or G
gncaacagnagggctgcctggnnggcggagnatattttatcacagnagttaagggtggagaaatggggagaagaaattgataggttttccaaaccttgctttgccttctggtgtcagatgataattgtttttgcaaaatgctgcagggtgagagagagtgagactgacttactcttttcagcattaaactggagggaaagaattacagtgggagctgaagagtgacctggtatgtgtgggtgatgaatagaagaacactttaccccaattcttctgaagcacagtaaagaggaggaaaatgaaccagtttgcaaaagtgggtctacgttagctgaaaatatgcagcccttgagtttatatggagttctagacagatggacacatgtaggtactgccgctgagtgggcaggtgtattacaccttgctgggagtgaatgatggcttatttgtcagcgatttacaaatcctaagatggagaggtagcacgggagtacaaaggccaatgcagcctcaggttcacgtgcttttgagatgattaagaaatgcnaagttaggctggcaaggtggctcatgcctatgatcgtagcacttggggagatcaatcctagcactttgggaggcttaagctagaggattgcttaagctaaggtgggaggatcgcttgacctcaggagttcaaaacagcctgggcacatagtgaaacctcgtctntnttaaaaaaaaaaggcccgggctttnnctcaccctntatcccgcctttnggng

SEQ ID NO: 22358 - DNA, 781 bp, Homo sapiens
  misc_feature 13, 533, 565, 702, 703, 709, 710, 772, 773, 774: n = A,T,C or G
ggggagaccaggnaagcggatagcgtggagtgacggtgccaccgcggcgcatgccctgtacagacttttggggaactgggtactgatgaacccgaacaggagttgcttctggttttaattctactactactggtgcatgatttacagctaaaccagatggagattgcgccattgccctccagcctgggcaataacagtgaaaatcttctcaaaaagaaaagaaaagaaaaaaagatatatactcccctaagaaaagaaaaaaagctatatactcccctcacaaactggggacctcaagatctccaccctaaaatagttattttgaatttccccctggcaatgtaaaccgagagcttatctgcacaggtgtgggacagaaccaatccctctgcacacctgagacaaatgcctatctgattgcttcccctgccctattgtttacataaaaacgcagggtcactgaggcagtcgaaggcataagtgactattcctcctcccgctctcacatataaattgtgtatttagtgaaaggntgatcaaagactcaaagaatgtgatcatttgntatctacctgtgacccggaagcccccaattccagttattccacctttccagactgaaccaatgcatatcttacatgtattgatgatgtattatgtctctgcaaatgggtaaaccaactgcagcctgacacttgggcnncattgnnagacctcctgagctggtacggggcattttaacctggcaaaaaatttctaatggctgaactannnatctttg

SEQ ID NO: 22359 - DNA, 742 bp, Homo sapiens
  misc_feature 2, 9, 592, 629, 632, 646, 651, 656, 671, 681, 702, 713, 714,722, 729, 737: n = A,T,C or G
gncgacagnaggggtttaatattttgtgacaaatttggcaacttttaaaaagttgtttgaattgaatagtgcataaaattaatagatgtttttcagaaaatccattattaagagtagaggaatgaggagaaatattcgttctaaagagaatcaaaaccacaatgagagattgtcttacccccgttagaatgacagttaccaaaagacagtaacaaatgctgacgagaatgcagaggcaaaggaacgtttaaacactgttagtgggaatgtagacttgtacaaccgttatggagaagagtatggaggttcctgaacaaactaaaaatagaactaccatatgattcagcagtcccactactgggtatatatccaaaagaaaatccatatatggagacatctgcacctgccatgctcgttccagcactattcacagtaccgaagattggaatcaacctgtgtctatcagccaatgaacagataaaatgtggtatatataccccgtggaatactatttggccattaaaaaaccaaattctggtattctcagcaccatgtatgatcttagaagacattatgttaagtaagccaggcncagaaagataaatactcctgtcctgtcttatgtgganggnaaaaagatctctanaagtnagagnggctctgcctttatntcggggcttnggagtctaggggggagatccntgaggcctggnnttgaaccncctgacncctttttnaaatt

SEQ ID NO: 22360 - DNA, 817 bp, Homo sapiens
  misc_feature 2, 6, 7, 12, 20, 27, 33, 44, 46, 47, 48, 49, 55, 57, 60,63, 69, 406, 456, 624, 630, 672, 716, 722, 738, 745, 761,788, 796, 802, 805, 807: n = A,T,C or G
tnactnnggctncgataaanctttgtnttgttncttttggccgnannnngacagnanggnagnaaaaancaaaacagtcacctctcaccttttttttctccgcagtgatgcagttgaatacaacaatggctgtaggtatgctgcagaaatatcattcaagtgaaacagaagggctttcctggccagacacagtggccactcctgcaatcccaacactttggttggctaaggtgggaggatttcttgcggccaggggttcaaggctgcagtgagctgtgatccaccactgcattccaggctgggcatcagagtgaggcctctctctaaaaaaaaaaaccactccccaaaaaaagggatttgcaaataccagcctttcagcatgaggatcacatggaggaacattaanatacagttgctgggacccagccctattgattgtaattcaaaaactgaggnggggcctgatttagctccatcattggaatccattccgatttgaaactctctgggttggacagttcaagagagatcctaaagaaagcaaaatcactgtggactgaaatgagtagacaaggttttctgagcatggtgaaatatgatctgggcctcgcttgggagggctgnggccangccttgagtccttggctcagtgggaccttctgaaacagcctncagctgcacccctgcttcctttgctttggatgaccccctcacantttggngctgtgggataagtcnacctgancggagttaacccagtntaaccaacagcctcccaaacctggcanggctggtntgctgncgntntgggtcttgg

SEQ ID NO: 22361 - DNA, 795 bp, Homo sapiens
  misc_feature 2, 4, 12, 20, 21, 32, 43, 45, 52, 62, 65, 73, 78, 594, 643,684, 739, 746, 751, 753, 754, 755, 770, 771, 778, 786, 787,788, 789, 790, 791, 792, 793: n = A,T,C or G
anancttgggcnacgaacannctttcttgttncttttggccgnancggcctncggctgcganagnacgacagnagggnattcttttcttgttctctttatcagtaatataaggtttcacaaacagttgtctgcaggcaacatgttctgaatttcttggcaaaaaggactgatgagaagcaaaatatgctaggtattttttatttttgggttacagtctgatatgctggggacttaattcataatttttttaacacaagtatgtgttatagtgtttattttcatgcctggtctacttgagcactattaggtgatgcttagcatcttcataatcattgaagccctatttatgtttacttgaattggacagtctcttttggaaaatgtcagagagcgagcttctgttcatgtcacataaaagtgagatgaggccaggcacggtggttcacacctgtaatcccaacactttgggaggccaaggtgggtggatcacctgaggtcaggagtttgagaccagcctggacaacatggtgaaactccgtctgtactaaaaatacaaaaaattagccaggcggggtggcacacacctgtaattncagctactggggaggctgagcatgagaatcgcttgaacccaggaggcanagttgcagtgagccgagatggtaccattgcactccagcctncacctgggtgacagagtgagacttcgtcccaaaaaaaaaaaaaaaaaaaaccccnggggccnttttncnnnatccaacagaaaaanntggagantgcacccnnnnnnnnaa

SEQ ID NO: 22362 - DNA, 846 bp, Homo sapiens
  misc_feature 2, 15, 17, 23, 24, 35, 46, 48, 55, 65, 76, 81, 90, 114, 771,780, 782, 797, 802, 812, 820, 826: n = A,T,C or G
anttacttgggggancnataaanncttttttgttncttttggccgnancggcctncggctgcganagtacgacagnagggnattacatgnatgcctgcaccccccaacccaggnaccaaacattctgaggacagctggataaaagcactaaagcaagtatatgtgaaagaaaagaggaaggactataatataaagtggaatgttgagaagaaaagctggaaaattattgcatgggaggaactaaggcctcattgtggtgatgtttaatccatgataaggatgacaacagggagacatctctgcacaagtatgtgtcagggagaagccacccttagtgaagagactcataggtgtgagttcggcagaggttagaaagtttggctgcagacagcctgaggaagatataagtagagggatggagaatcctagggcctgggagatgaagttagatatctgctcctttctgacaacattgccctaaaagtcagcacttttcaacaacatataatatctcataatttatgtggaccagaatctggacacagttcagttgggtacctctgcctttaggtcttttatgacattgggactgtggtcttaactgaagctggactgggaaagcatgagcctttaagctgactcatgtgaaaattggcaggtttagtgtggctggagagcctgactttccttctctctactggtctgagcccccctcaggctctgtatgttggtctttcttggacatctcatagcattgaacttgcttcctgngtttgaggntncatagagagagagantaacnaaaggggtcncaaagaangaaaanatgaggcccacaggaaaccc

SEQ ID NO: 22363 - DNA, 818 bp, Homo sapiens
  misc_feature 7, 11, 14, 15, 27, 38, 40, 47, 57, 60, 68, 579, 659, 706,710, 720, 742, 750, 766, 777, 785, 797, 801, 803, 817: n = A,T,C or G
cttgggnaacnaannacttttttgttncttttggccgnancggcctncggctgcganagnacgacagnagggggggtttgtagcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggataaatcatacngtgattttagatgatccatttgatgaccctcctgatttattaatccctgatcgatcaccagaacctacaaggaacattanatagtggtcgaataggagcagatgaagaattgatgatttcaaggaanacanctgagaagtnaaaaataaaggcaaaaaagagntaaactcngctttcttttgagaanggggaaacctnctgatgcnatttaacctcanaaangnctgttgggggtaant

SEQ ID NO: 22364 - DNA, 690 bp, Homo sapiens
  misc_feature 5, 8, 10, 17, 18, 23, 29, 40, 42, 49, 59, 62, 69, 71, 77,629, 639, 640, 648, 659, 661, 664, 668, 669, 671, 673, 674,676, 677, 682, 684, 686, 687: n = A,T,C or G
aacgnggntncgataanncttgnttgttncttttggccgnancggcctncggctgcganagncgacagnanggtagnattagccacatatctaattggtgagtacagcatacctagctgtacagtgctctgctcaccaaagccaaagatgggcaggtggctgcattctgctgccaggtaatcatctgaacctcgttggcaggcattgaagcaaaagagagagaggaatttgcagctggctggaaatattaagagtattagcaagagggaggaagtgtggctcaaagttataaaatgttgtgtgtgtataaaaagaagagagttctatttttgtatatgtatgtgttataaatagacatacctatagcatttcccaccagtgttctgtatcatctatgttccatcactgattaaattagaaaaatatcaccttatttgctttttgctcctcaactgcaaagatgtctttggtgaggtgctttactagaattctcttacagaaaaaaaaaatcagtaattcatcttgaggatgaaatagtagatgaagtataattaatgctttcagcaaatacaaatatgaactttttgtgaagatgaaaactgcattgctttttttttttttttttaaanacagggtctnnttctgtcncccagctggantncangggnntngnnannacccntngnncct

SEQ ID NO: 22365 - DNA, 660 bp, Homo sapiens
  misc_feature 374, 406, 452, 458, 544, 549, 552, 564, 568, 578, 606, 616,633, 644, 645, 649, 657: n = A,T,C or G
aaagtgaagaatggttgatacagtggcaagctgttccttttaggttactttaaaaagtcatggaatttcggatatacaaagaaagcataaggaatactctaaccagtatatatgtatacagtatccagtataagaatgaaaatgtaatgtagttattaaaacattatgtgtgtgcttccacaagcctgtcctcctttctaccttccagaagtaacttctctcttgaatttggtgttcgtcattctggtgcatgcctttacagttttacaaaatacacacgcattcccaaacataaataatactgtttcacaacataaattgtattatggtacatgttttaaaacacgatatacattgtatctgttgcaagtcangttccaagggaaatggaactcagaagattaangctgggggccaccagtgcctcatgcctgtaatcagcactgtgggangccgangcggcagatcacttgaggtcaggagtttcagaccagcatggcaacatagtggaacctcatctctactgaatacaaaaataaccagngtggnggnggcacctgtatnccanctctcaggangctgagcagaaaatccttgacctggagnggaggatcangagccaatcaaccctgnctcaggctggnncaancaactccnttc

SEQ ID NO: 22366 - DNA, 812 bp, Homo sapiens
  misc_feature 6, 12, 19, 20, 31, 42, 44, 51, 60, 62, 64, 65, 72, 74, 90,91, 97, 722, 732, 770, 779, 781, 782, 791, 805: n = A,T,C or G
taactngggctncgataanncttgtttgttncttttggccgnancggcctncggctgcgnananncgacagnanggggttctgcgccggnnccgggnagaggggcgggcgccattgtgcttcgctgccgactgcatttcctcagtcacgggcctagaactccaaggagaaaggcggcgaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcggattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcagacagagtncttctattcncaaggagcaagaccaaaaaaaaaaaaaaaaaaaaaagnggccctttncnnaaccccccngaaaaccttggggntaccccc

SEQ ID NO: 22367 - DNA, 853 bp, Homo sapiens
  misc_feature 6, 10, 12, 15, 19, 20, 32, 43, 45, 61, 63, 65, 66, 73, 75,585, 707, 713, 771, 789, 798: n = A,T,C or G
taactngggntncgntaannctttttttgttncttttggccgnancggcctacggctgcgnananncgacagnanggtgaatgaataaagtataatataaggagtaattggccaggcacagtggctcacacctgtaatcccagcactttgggaggccgaggtgggcagatcatgaggtcaggagtttgagaccagcctgaccaacatggtgaaaccccgtctctactaaaaatacaaaaattggctgggcgtggtggcacgtgcctgtaattccagctacactcaggaggctaaggcaggagaatcacttgaacccaggaggcagaggtcgcagtgagccgagattgcaccactgcactccagccttggggagagagggagactctgtctcaaaaaacatatatggagtaattatatatatcataaaagatgtataagtagaaataaagcactaggatatttaggattcaaatggtttattttgccatatgatattaaaagttgctttgaagtaagagcattttgtgttttccagtgaatgacagtggacttaagggacattagggacattccctaatgtcctanggaatcattagcttatgtaatattgcaaaccatgagactggtggaatcacacagaatgtaagaagaagaaaaacatttaaggctggcgcagtggctcacgcctgtatcccacactttgggangctgangctggcggatcacgaagtcaggagatcgagacctcctgctacacagtgaacccatctntctaaaatcaaaaattanccggcgcanggtaggcgcctgtaacccactctcgcagctgaaaagaaatgctgacccggagcaa

SEQ ID NO: 22368 - DNA, 720 bp, Homo sapiens
  misc_feature 18, 25, 27, 637, 658, 665, 674, 676, 685: n = A,T,C or G
ggggggttctgcgccggntccgggnanagggcgggcgccattgtgcttcgctgccgactgcatttcctcagtcacgggcctagaactccaaggagaaaggcggcggtgcgtgttgctgcgagtgggacgcgcactggtcggtgccggctcaggagccgggaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatgatatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaaaacagattcctctattantaatcttatggattatagtcnccgaagnggggatttncnacttctctntgtcagacgagttcttcttttcccagggcagaccc

SEQ ID NO: 22369 - DNA, 722 bp, Homo sapiens
  misc_feature 18, 19, 25, 28, 667, 699, 722: n = A,T,C or G
ggggggttctgcgccggnnccgggnagnaggggcgggcgccattgtgcttcgctgccgactgcatttcctcagtcacgggcctagaactccaaggagaaaggcggcggtgcgtgttgctgcgagtgggacgcgcactggtcggtgccggctcaggagccgggaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatgatatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaanggggattcacaacttcatctatgtcagaagantcttcttttccaggacagaccan

SEQ ID NO: 22370 - DNA, 818 bp, Homo sapiens
  misc_feature 2, 7, 15, 18, 19, 20, 21, 25, 32, 43, 45, 61, 71, 94, 161,174, 186, 395, 413, 422, 452, 460, 464, 470, 473, 530, 682,699, 702, 704, 709, 716, 748, 750, 751, 754, 761, 783, 791,793, 796, 798, 803: n = A,T,C or G
antactngggttacnaannnncttntttgttncttttggccgnancggcctaggctgcganagtagacagnagggtgctcaggctgccgccganatcgtcttccttgctcccggtctttccaccatcggtttcgccatcaagaactgcccgccaaattttngcagcgtatgaangcttacatccantaccgtatcgccctctgcttgcacttggagcttcacctcactttctccatgatcatcatcaacgagactgtccgtaccgacctcatcgtcttcattgccctcttcgccgatttggccaccgttgccatcgcctacgacaacgctcactctgagcaggtcccgtcgagtggcagcttcccaagatctggatcatctccgtcatcctcggngtccttctcgctaccggnacctggatnattcgtggtactctcttcctccgtgagggnggtgtcgnccancgcttnggntccgtccaggagatcctcttcctcgagattgcccttactgagaactggctcatcttngtcacccgtggtggcaagaccttccccaactggcagctcattctcgccattctcggtgttgacgccctcgccaccatcttctgtatctttggttggttggctggtgacccgcacaacacctgcccccttccttcttcttcccaacgagcgtntcgatggctggaccgangtngnaccgncggtggngtctgggcctactcattgggggtaccatcatntnnccntggttantactcttaacaaaaccctggtnacaacctngnggnanaccgnactgccgaaccaaag

SEQ ID NO: 22371 - DNA, 506 bp, Homo sapiens
  misc_feature 6, 9, 12, 17, 22, 28, 39, 41, 56, 58, 61, 68, 70, 73, 439,442, 445, 447, 448, 449, 455, 458, 459, 460, 466, 474, 480,487, 488, 491, 495, 504: n = A,T,C or G
tactgnctncgntaaancttgnttgttncttttggccgnancggcctaggctgcgnanaancgacagnanggnttcactattttgttgaattcaacggtatgtcaaactgacatcagaaacttcgatgatacaggcttagatgaaaggctttagtaggccgggtgcggtggctcacgcctgtaatcccagcactttgggaggccaaggcaggaggatcacgaggtcaggagtttgagaccagctgaatccccgtctctactaaaaatacaaaaactagccaggtgtagtggcaagctcctgtaatcccagctgctctggaggctgaggcaggagaattgcttgaaccccgggaggtggaggttgcagtaagccgagatcatgccactgcactctagcctgggtgacatagcaagactccatctcaaaaaaaaaaaaaanggnttnannncagaanaannntggaantgggaacnaaaaanttcccanngtnaaantttcctttntg

SEQ ID NO: 22372 - DNA, 829 bp, Homo sapiens
  misc_feature 2, 4, 12, 14, 26, 33, 44, 46, 122, 725, 746, 752, 813, 817,826: n = A,T,C or G
anantttggggntncgataaaacttntttgttncttttggccgnanggggccctaatctacagggaggaagggcaaccaaaatgtatcctgaggttcctggtggaaactcactgtacccagnaggaggagaaaagaagaacacaaaaaactctacccatggggaaggggcaggaatgtgcgctacctaacattacggtatatctggagaaagctcaggaacacttgtgaaggacacaccaccaagactcttgttcagagtgcctacctgaggctgaggcttaatcggaacatcagataccatcttctctcctccactctccaaccaccacactaacaagctttgagaagaataacagtggaatacaacttggagaaccatgcaaagggagacccaaagccaaggagggacactcatagccaagcagatagcagtcttcacaaacaactagactcctgaccacattaacagaaacctccacactgaagaactaacagaggaggaaggcatcctcatctccaagcatgcaatgtgcttacctggaatccactgtcctagatgacatgtttggctttcaacaaaaaattacaagacttacaaaacagcaagaataacagtctgaagggataaagcagtcatcagaagtagaattagatttgcacagatgttagaactctcagacaaagatttaatggctacaatcaatatgttaatggctctatgganaagtaacagcatgcagatatntagccntgtcgccaagagatgggaactccagagagagccattaaaattttaaatggaacagaataanagcnttatgagtntca

SEQ ID NO: 22373 - DNA, 678 bp, Homo sapiens
  misc_feature 2, 4, 10, 17, 21, 28, 30, 36, 48, 50, 51, 59, 61, 64, 472,493, 531, 534, 556, 566, 568, 591, 614, 632, 648, 668: n = A,T,C or G
antnaacgtngttaacnatanccccttntnttgttncttttggcacgnanntcgacagnanggnaggttaagccaaaataatgtggagtaattataacagatttccctcacagcttattaaataatactaaatatgtattgctggcactgcctctcccacatcatatggagacatttgtaggaacataatagcaggttacacagtaatctgttcttgagctgctgtagtagatattcagtgtgtatgaggaggaaaggtgctagtgagagggcagaatgggaaaaacaatttattttttttgagacagagtcttgctctgtcgcccaggctggagtgcagtatgcagtctcggctcactgcaagctctgccttctgggttcacgccattctcctgcctcagcctccgcagtagctgggactatgggcacctgccaccatgcctggataatttttgtatttttagtaaagacnggggttcaccttggtagccangatggtctcgatctcctgacctcgtgatccgcccactnggnctcccaaatgctgggattgcangcgtgagccncncccctggccgaaaaacattttgncctgaaataccaaactaatttancctattttggccaacaanaaattacctaaaaaantttctgcttttaagggaatncctacttttt

SEQ ID NO: 22374 - DNA, 736 bp, Homo sapiens
  misc_feature 504, 561, 634, 668, 681, 683, 695, 722: n = A,T,C or G
agggcattccatcttatttttgatatttttctgtctaatttctaattgtttatattgacaggttacatgctcatttagataatttggataatgaagaaaaatgaagtttaaaaatcaactcaaatcccaccatctggaaaaaaaactaacaaacatgaattgagcttcatttcagagatgacagtgtctcactttttttacctctctctttctgtttctttggtttcatcgaatttggagcctctcttgagctttgatgtcttttaagatgcccactctgtttgctcttatagatcattcgttctttctatttgagtccctaaagtattattgggatttctgaagcttaaccaaaatatgtctcagtattatgcatttcctgaaacatggagtgttctttcagtctgcgtatcagtttgttctagctcagggaatttttttttaaaaaagattaagtttggctgggagcagtggctcactcctgtaatcccggcactttgggangctgaggcgggtggatcacctgaggtcaggagttcagaccagcctggccaacacggngaaaccccatctctactaaaaatacaaaattagccggcatgggggggggcgcctgtatccccactgctcagangctgaggcaggagaatgcttgacccagagggggnggtgcatgagccnanatccaccttggnctccacctggcaacagattgaactccnccaaaaaaaaaaaa

SEQ ID NO: 22375 - DNA, 793 bp, Homo sapiens
  misc_feature 2, 7, 20, 21, 24, 26, 32, 43, 45, 52, 73, 75, 94, 507, 532,537, 566, 600, 605, 635, 643, 649, 653, 682, 687, 709, 726,728, 736, 740, 755, 756, 760, 761, 763, 788, 792: n = A,T,C or G
antactngggctacgataannctngnttgttncttttggccgnancggcctncggctgcgatagtacgacagnangggttggcttgaaaacacngttcttaaaccccagtatgcagaacaatcactagaatagctgttagtaaagattactgtgcccaatcttcagaaattcttctcattcaatacatcaatagtaaggcccaggaatggaaatatcctcattttcccatttaaatattgtggataaaattccttgtttagtcttatttgaaagttatttttctaactcctgaaatcacttaagcctgtgcttctcaaacctgggtttaagccccctctagggtttatgatatgtgccaggggatgggtgaagtcataaaatcgacatggcatatcttcctggagtgtcagttttatacaaagatttaaaagtaagagaaaattaacatttaaaatgtaacatggagctgggtgtggtggctcatgactgtaatcccagcactttcngaggctgaggtgagtggatcatgangtcangagttcgagaccagcctggccaatatggngaaaccccgtctctactaaaaatacaaaaattanctgancgtggtggtgcatggctgtaatcccagctntttgggangctgangcanaaaatcgcttgaacctgggaggcggaggntgcantgagcccaaatcccgcactgcnctctggcctaggcacanancagactcntctnaaaaaatattaattnnatgnncntgaaccaaaaaaaaaaaaaaaaaancccng

SEQ ID NO: 22376 - DNA, 769 bp, Homo sapiens
  misc_feature 567, 618, 660, 675, 678, 685, 693, 698, 707, 709, 722, 723,737, 741, 743, 749, 753, 754, 764, 767: n = A,T,C or G
gggggtacacatcattataaacattggccttccagtgttacagaatgtgctctaaattgagtcctttttttgttctaggtggtgagtagtcactatgacctcctttcagtatagataattttccacttctctttcatgtgctttattataaagacaaactcccctccccattaagaccccttatgccagagccagcactcttgctagaagagtccctgccaagggccgtcccctcttcttttctactgcccttgacatgctgccacaaatactgccttgaccatcagagctcctctgtgtcctgcctcattcttcatcccttctagggactggggctgcagatcttaggaactggaggaattcataggcactctgggttcaaatcttgagtaggttcgtaacccaggcattcacagtaggactgagattcttggcaagggtagttgtttagggatatgtgagacaggtgtgaggaagaggaagtaaaccatgactgaagtttctagttgtgggagaacatcgatgcctctgactgaggacatgagctggtttgtggggaaaggtaangaatttagttttagttatgttgaatggacccatttgccctaataaatgtgnggaatgtcactaggctattgagaatttaaatctggactccanaagattgatatgaanagnaggttangacattanctgcntaagatagnantaaatcctattcnntctctaaaaacccnaagnanagtttnatgnnaaaaaaaaanaanct

SEQ ID NO: 22377 - DNA, 693 bp, Homo sapiens
  misc_feature 1, 9, 30, 675: n = A,T,C or G
nacgacagnaggggaacctgtagccaaggnaaccctttgggaattttaatgattactgtgaatggtgaagacagttttgaagaactattctttgaaggatggaatgttaacatttcaaggacctgtgaagagctctgggccaaggttcccaccagatactctaagccattagagaattaggcatgctcattctagattctttgtcttttatgaaaccacatctagagtgtatttaccaacatccctgtgataatgagtttgcaaatcatcatgtatatgatacatgatatatattgtgtaaatatacgtgtgaatacataaataggtaaagaaacccttttagccttgtttaatacagtctctccttaaatccattatgctggaaatacttgtttggggcacagctagcagcacagtacatcagccacagcaccaagcaactttcatttattgtgttgtctagtgcacaccacagccctacaaggtagatattattgcccatctctcctttatagataagaaggataaattaacttagtatgccagcatttgaacccagttaatttttaagttaagctagataggtccacagtcctgtttttcacaatttcagaatggaaaaactctgaaactgcaaacctacatgaactaagtttaatcctacctattgggaanattatatatttactgaac

SEQ ID NO: 22378 - DNA, 712 bp, Homo sapiens
  misc_feature 470, 494, 525, 602, 617, 618, 620, 632, 633, 643, 652, 658,666, 676, 682, 685, 686, 691, 693, 706, 711: n = A,T,C or G
cttatctgtgttgttttttgaggaagaaatgataccttgccctcctcccacctcagtggtagaaaacctttgatttatatcattgcaagttttcaaccccacactaaggacatactattttatttcttcttccataggaacaatgcacctttgtctgtgtcactggatggagattttccaaccctttaccacagtagcacaactctgcattagtgcaaaatcctgggccccaaaacaatccttgttcctctcctgatggagaagtatttttcttgcatccctcccccagaagcagtgatcctttgcctggtctcaggtgggatagggtagggtatgagaggtttcttaaccttctcggaaagctgatgtgttttgctgcttcttatctcccagaaacagtagacttttgcgtgggttcatggacacagatgctttttttgccacagaaaacgaagggttttgattcttangagagaagcaaatgttcatgtagncaatttttttcttatttattttttgctttgnttattatttcagtagtgatgagtatgatcattattttccacttatgccacttgcactctaatattttgttttattanccccctttacagttnncnctaatcaatgcnnataacatcantgggggatnaagggnttttttgnaacaaattgnggtttnacnnaattngntttttcctcttanccaant

SEQ ID NO: 22379 - DNA, 255 bp, Homo sapiens
  misc_feature 1, 9, 151, 215, 220, 221, 222, 223, 229, 231, 234, 235, 236,242, 243, 248, 249, 250, 253, 254: n = A,T,C or G
ntagacagnaagggttgcaagacaaaagtgaggagggcgagataaaaaagagaagagctcggctccaaggcacctcttcccactctgcagacacccccgaagccctccctttggattctggtgagggccccttagtggaatggcatcccanggggtgcccctttctgccttccagagctggagacagatgacggaagaccattgaaggaaaaaanttttnnnntttttntnagnnnaagggnnggggnnnaanna

SEQ ID NO: 22380 - DNA, 838 bp, Homo sapiens
  misc_feature 2, 13, 20, 21, 25, 32, 43, 52, 63, 66, 74, 488, 637, 639,692, 716, 724, 732, 736, 753, 761, 777, 778, 779, 785, 814,815, 820, 828: n = A,T,C or G
anatcttgggctncgataanncttntttgttncttttggccgnagcggcctncggctgcgagnagnacgacagnagggataaaatattttctacacgaaatacattacattagaataaaagtctgtggaaatgaaaataagagctcaaagagaaaaaaattgatgtcaaatttcagactattaaagaacagtctgtttatagcaattggacacctgatagcatataatattcatactctattgcagccatcccttcctttttggcactagggaccagttttgtggaagacaattattccatggatggagggagtgggggctgttcggggagatggtttcaggtgaaactattctacctgagatcatcaggcattagttagattctcataagaagtgcgcaaccgagatttcatgcgccgcccacaatagggttcacgctcctatgagaatctaatgccgctgctgagctgacaggaggcagagctcangcagtaatgctcgtggcccactactgctcacctccttctgtgcggtctggttcctaacaggccacaaactggtactggtccatgactcggtgggttggggactcttgctctattcaatacgcttaaaagaatgatgttggccaggcgcngnggctcactcctataatcccagcactttgggagtttgaggtgggcagataccangtcagagatcgagaccattctggncacatggngaaacccntctntctaaaatacaaaatanatgggcgngggggcgccacctgtnnnccactnctcagaggtgaggcagaaatccttgaccnnaagcnaggttcantaacaaaatt

SEQ ID NO: 22381 - DNA, 837 bp, Homo sapiens
  misc_feature 2, 13, 15, 21, 25, 32, 43, 45, 52, 62, 65, 72, 74, 739, 769,786, 795, 829, 833, 836: n = A,T,C or G
antacttgggttncnataaancttntttgttncttttggccgnancggcctncggctgcganagncgacagnanggctgtctcagcatttttaataaaaacaaaaagtggaaataatctaaatgttcaggtccaagggactggttaaataaagtatcatgttttgacatggatatactgtgccaacataaaatgacacttgcaaagaaaatgaaaaacaaaaagtatatatagtgtggttataacccggcgtcggggggtgggaacgaacttacatattggggttagggaggagcatcattgacactacttagtgactgataaaactatgaaggatttgttttttttttctactctagtgtgctttcaaatttttctttcccaagcagacatgagtttataaagcgaaataagacaatggaagatacttgcttcaacaaacctattctatcctttgataagacaaatctcaaagtataatattaataattctgctgagcaactttatccatctatttctaaagcaagcctttaagaatcaataaatggacacgcatggtggctcatgcctataatcccagcactttgggaggccaaggtgggtggatcacttgagatcaggaatttgagactagcctggccaatgtggggaaaccttgcctctaccaaaatacaaaaattagccaagcatggtggcaggggtctgtatcccactactcagaggctgaggcaggaaatcncctgacctagaggcggaggtgcacagacanatgcccactgcctccancctggcacnacagactcctctcaaaaaaaaaaaaaaaccccgngccnttnt

SEQ ID NO: 22382 - DNA, 837 bp, Homo sapiens
  misc_feature 2, 7, 10, 17, 18, 24, 30, 41, 43, 50, 60, 63, 70, 75, 83,629, 728, 732, 743, 746, 774, 785, 786, 790, 794, 797, 811,813, 814, 818, 819, 836: n = A,T,C or G
tnttggnctncgataanncttttnttgttncttttggccgnancggcctncggctgcganagncgacagnagggnaaccgtgnaaatacttcttcaagttaagggttaggatagggaagaagaagcaagttctgtatgcacaagcaaaaggttggccctcaccatcaaagctcctgtcataaagagtgaatagaaggaaggattgttattattatgactttggttttatttaagtataaaagtatcagcactttaatgctcaaagtatagccataagcaagattagaaaatgtacttgctgtatattgttccagcaacactctgggtttgccctacatttgtatatagttggttttctgtattagtgttttatcatagaccgagtatcatttgtatatttttcaaaattacataaataaatcattttatcattttatttattaagtccagaaactgattttaggggtagagggatgagttgtgctatttaatcttactctggcggataaataaacatatggattcaaaggtgttgagtgagagaagactcttgatatgttagaagaccactgctctaggatatgtgtagaaacaaaactgacacataggaagtacttatgaatggttgntgaatgaataaattttcaggcctgcctgaaatatctatgtgacatgtgtcgacacatacagcccctctggtactcagtatcatattctgaaaaagaagngtanacaaggatttntancacctgtttacttttaaaatctgaatgngggggggctcnncctnaatnccncctttgggagccanannggcnnattgcttgacttagaant

SEQ ID NO: 22383 - DNA, 867 bp, Homo sapiens
  misc_feature 6, 9, 30, 41, 43, 50, 60, 63, 70, 76, 86, 106, 109, 115,432, 620, 650, 693, 707, 710, 739, 750, 761, 763, 771, 776,778, 780, 792, 815, 821, 822, 825, 836, 837, 844, 845, 860: n = A,T,C or G
ttttgnccntacgataccccttgcttgttncttttggccgnancggcctncggctgcganagncgacagnaggggnatggaggagnaaggaaagtggtgccagggnagnactagnattgtgatcatttcagtatttaaagttagataaaagctaagtctgaatttcagtaggaacagaggaaagaaaaggagacaagctccagagattcagaatatactcaagaatctcgagtagatagtaactaattggaaataggggagagcagaagtgagacactgaaatttttagtgtggttgactaagtaatgatactgccattaaccaacaccagagaaaccaaaataagagctgtgtgtgtgtgtgtgtgtgtgtgtgtgtgtgtgttggccattgtcgacaaaaatatatatgccctaaattggaagacttcgntctgttccatggtaattattgtgttttcctataagaaaataattttgctgagatttgttcctgtggtgttactgaaagatatagtagtaagggcccaagatttaaggtgagatgacctgaattcagtttctatctatatttctttcgacattcacacattgggctattcccttacctgcttttgaagntcactttcctcatatgaaaagtaggggatnctttcttattgcctatcccgatgaacaaatgaaagagcccttntaaaaatataaagngcncataaatgtgagtcgttagatttctacanactgttaggantggaccgtaananaggttttncccancncntgggtcccttantccttaactgtttttgaggtccnggctgnnttnttcttttcctnnggggtannatcattaagggggcntttgttt

SEQ ID NO: 22384 - DNA, 806 bp, Homo sapiens
  misc_feature 2, 6, 10, 11, 13, 14, 30, 43, 60, 63, 71, 77, 86, 87, 107,673, 758, 759, 760, 765, 766, 771, 772, 773, 774, 775, 778,780, 783, 784, 792, 798: n = A,T,C or G
tntttngggnnannaaccccttgcttgttncttttggccgcancggcctactgctgcganagnacgacagnaggggnattccctgnnagtacagcaactccctgggnaatggaagttcaacttgttggctttagaacaacataagcagtttcattgaacattcactgaatgtctcctctgtgctgagcccatgtcagggactgggtctttaatcatgttcttttatgcagcatccctgcactctacctgcacatgacttctgaacagcatgctctgcccagacagcctcagtgagggccaggacttgaaccctgtggaagcatgtaaagacatatttccgtggtggcagaaggctgagagttcagcatactgtctgtcttcacttttgagttgttctttcatctgcctaagactcatggcagagcactcatttcacaaactttcactgagtgccgactatgtgccaggcactgtgccatgtgctgaaagtacaaagactttaatatgtagtccttgacctcaaagagctcaagagtaattgacagaaattcctagatcatgatctgtgatgatgagaatcattccttagaagggcttgcatataaacatatttatatacttattttgtaggaaaatatccttagtaagcttgaaaaaataaggattgatcatncatgtcaagcctgacataaattttaataaatcagtgtgagcaaaaggaaaaaaatgtccaaaaaaaaaaaaaaaaaaaaaaaccnnnggggnnttttnnnnnaancnaannaaaaaacntggganttgaaccc

SEQ ID NO: 22385 - DNA, 336 bp, Homo sapiens
  misc_feature 16, 26, 157, 182, 199, 200, 220, 249, 253, 254, 274, 276,277, 279, 281, 282, 303, 308, 309, 323: n = A,T,C or G
tttgaaacatggcggnacgacgtagnaccagcaacaaactaccaacactgtagaggagcccctgggtcttatcaggctcagcctagatgagcgaatttatgtgaaaatgagaaatgaccgagagcttcgaggcagatttacatggcttttattggantccaaaccattttaaaattattgantctttgggggaaaaatnnttgggaaaaaaaaacttggnggggactttcctttttttgaaaaattttngttnngaaaaaaaaacccttttttntnnangnngaatttttttttttaatttcnccccnnaaacccggggggantttttttccccaa

SEQ ID NO: 22386 - DNA, 762 bp, Homo sapiens
  misc_feature 5, 10, 18, 24, 41, 52, 58, 62, 67, 68, 70, 72, 514, 518,587, 590, 600, 606, 613, 624, 646, 650, 662, 681, 686, 689,696, 698, 700, 705, 713, 728, 743, 746, 751: n = A,T,C or G
gggtncgctntctacctngatccncacatgataggaccatngctgaggttgnacaatnccanttctnnantntccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatgcaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggagatggcngacntgattgctgactccctaaaggatgacttgtccaaaatgtaaattggcctgaggaacaagccccactgcngtncatggaggcngtcagngtcctanacttagtaggnaaatgtttaattttgagactgntttngaaatgaagaangggagacccttgtcttccnaccanctntcggtcncntnttttnggctgagnaccccgttgtgaatnattccaaggttaacntanatttncaaaataaaga

SEQ ID NO: 22387 - DNA, 683 bp, Homo sapiens
  misc_feature 604, 623, 624, 640, 658, 674, 683: n = A,T,C or G
aggggggagtgggccccagtgttctcattgtacaaaggaggaagttggggctcagagatggaattggcttctccaaggtcacagggctggtaggatggcttatggatacacagcttcccagcttttgtcctgagctttttggctcatgaagcattttcacatccccatctcatttcacgtctgtttttgtttttgatcctggagggggtgcaacatcctcatttttacaaaggaggaagctgtggctcagagatggttcctgggctggaaagatggtttatggggtgggcagagatgggtgagctgatttggtggtttttatccttgatagaaaccagcaggtgtggccaggcgcagtggctcacgcctgcaatcccagcactttgggaggccgaggcgggcagatcatctgaggctggaagtttgagaccagcctggccaacatgctgaaaccctgtctctactaaaactacaaaaattagctgggcgtagtggtgtgcgcctgtactcccagctactcgggaggttaagccatgagaattgcttgaaccccggaagtggagactgcagtgagcagaaatcgtgttgtctcaaaccaaaacanccacaaaccacaaaacacnncaaaaacaaaaaaacncgtgatccattctgtcanccaaatcccacaggcntgttataan

SEQ ID NO: 22388 - DNA, 670 bp, Homo sapiens
  misc_feature 555, 576, 596, 602: n = A,T,C or G
ggggaatcttctgtagtgttttattcttggtgtttttctttgggacctgcatgctttctggcctttgctcctgctgagtaggcagacatatctggagaaaaccatggagtaaaggaaaagctttggaatttaaaattgatttatgtggaagctttttctgtggttgaaaaaaagtaaagaaaaaccctcctttctacattaccaattcccggcaacagtaagccaaacctgttgtatttgggagcaggcctgggtgcatggaaactgctcagaacagggaggtcaatgccattatgataatccagtgacttccatgggaagccatcattgagaaagggtacttgtgcagatctaaaatttggaacaaaacaccctgaagatggccaaactgatataacgttatgtaccttggtggagtgtcttggtctgtttgtgttgctttaaaggaatactagagactgggtaattttgtttatttatttatttttgagacagggtctgtcgaccaggctgaagtgctgtggcttgatcatggcttgccgcagcctcgacctnccagctactcgggaggctgangcaggagatttgcttgaatncaggangtggaggttgcagtgagctgaatcacacaactgcactccagtctggtgacagagtgagactccatccc

SEQ ID NO: 22389 - DNA, 728 bp, Homo sapiens
  misc_feature 534, 547, 557, 563, 659, 674, 682, 687, 696, 700, 701, 702,703, 706, 709, 712, 713, 715, 719, 723, 724, 726: n = A,T,C or G
ggggccagtattttggttagggttttaggtggtttttatatccactgtaaacttggatataacttaccattaaccagatacttaaaaccagggtattttcctaaggtttaacattggaagtggtatgtgagctgagccttgaagggtgacaccaagttttttgacacgaaaaggttggatgagctagctaaagggcttgttttttatcccgtagggcaggagtggttgtagatgccctctcatgtgctgacatactgattgatggtggcttctaaggtctctcctgagtctagtaggaggcaggcttcctaactgtcatggacaccaggcaggcaggtaggggaatgaagcaagatttggcagcgcagctgctgtgagtttgctctccagtggcttggaaatgggaagtaaaggattctgatcttatgtgagaccattttcagactgtcctagtctgccctcacatatccctggaatggacacatacaggctggtcagggctttcttggggcactgaggtgggagaagctggangcctggcaggtantggaactganagtganaagccccctacacttggatctcttgcgtatcacacgagactcatttattgatgactgcctactggctcataatactgatggctgaatgggggtttnaaacttggcctcaanagttcccntcttntggaggatntgcnnnnccnccnccnnanggtnaatnnanaa

SEQ ID NO: 22390 - DNA, 750 bp, Homo sapiens
  misc_feature 6, 11, 474, 558, 628, 662, 677, 680, 702, 725, 733, 744, 748: n = A,T,C or G
gacagnagggnatttgtataaatgtatggagtacaagtgtaattttgtaacttgcttatattgcatagtggtgaagtcagggattttagggtttccgtcacctgagtgacagacattgtacccagtgagtaattcctaacccttgtcgccctacttcctgaggacagtgacctgattccacttgtggactgtgggcttggcttaccttgtggatggctccagcccccagcagaaaacttagaagcatcagatcttagtgttgctgtggctttctgcctgtggttcaggctgcattgctggtttctgaaccttgcttttccttgacctctgtgtgtatcccagatctctactgtgatctgactttgtagcctcttccttgatcctgattgccagctactgggtacaacttagtctgctcccagcccaataaagaccccacctctggttccaaccttttcctggctgtcatcctangtttccaccttcttgagagccatcttttttagagaagtgcagagttcactatccaggtcctttggctgcatcctggccgggggnggggcaacatacagatattttcctcaagtaaaacattgaggcacactgggtagtgcttggtcatgcctgngttttcttttctggagcctgcctaaataatgganaatttttttgcaaanacngcctttctcctcctccttaaanaaaggaggttcatttgccttggntccagttnagaaaaaaatnatanaa

SEQ ID NO: 22391 - DNA, 763 bp, Homo sapiens
  misc_feature 586, 656, 679, 681, 701, 704, 711, 712, 728, 753: n = A,T,C or G
gggatatcctctttcaataagtattttttaactcccaaaacataattttcaatgtattccaaccagttcaactggcgcacgtcaaagttgaatacctgagaggcaagagagattatagattgccagaattgcagtgctggacagtcactttgtccacttgaggtttcttctacatagatgagtgaccttcaatttgggagacataggttggaccctctccaaaggagagattatttgagtcattatttcaaaggtactgataatatggattactatttacataggaatatttaaacatggatcaaacacaaacacttcacatttcttgtgagggagatttaaaggaaatagtattacatagtctggtgaaaacttatggttggcttggtatatatttcagctaaccgaggagtaattatttttaaaagtgatagaataatatgttagtgaccaaaacataaatgatgcaactttccctttcctcttaaattttggtgttatccctttgttctaccatcctttcctacagcattaccatttcattatgcagattaaactttgggaagcaaagccttaaggaataagntaccagaatttatatttaagaagagagtgattggtagtgaaagaaaaaggagtgatcacacatgggggangagtagggaagaaggagaaggananatgatctgttaggagaaaantgngcccctnnaaacgatccgagaggncataagaaaatgttaaaaattttanggtctttgag

SEQ ID NO: 22392 - DNA, 723 bp, Homo sapiens
  misc_feature 1, 8, 402, 477, 496, 590, 599, 619, 632, 633, 646, 648, 650,651, 652, 655, 660, 663, 687, 692, 695, 711, 716: n = A,T,C or G
nagacagnagggtgtcataagggtgttggccttgccagggccttcctgggtgaggcgaagaagggaaggtgagcctgatttagtcctctggcttctcaaagaggcaaatccttttcccgtcctggacgcttgtgtccacctagagtcctcgtcgtagcagtggggatggtgggaattcccagccccatcttctcccaggggtagtgacctgccacttcctctacagcttccgttcgggaattcacagggtctagtctgggactgtctaggcagctggaggaaaaagagggagctaagagtacaggaaaggatgggatgaaaataaccaaaaagaagattcacacttcttttgtttaaatttttatttttatttttatttatttaggttttggaacagggggntttcgctctgtcacccaggctggagtgcaagtggcaccattgtagctcactgcaatcttgaactccccgtttcangagactctcttgaacttangaggtggaggttgtggtgagccaagatcgtgccattgcactccagtctgggcaacaagagcgaaactctgtctcaaaacaaaacaaaacaaggncggcgccgnggctcacccctgtatccacnctttgggagcccnngcggtggatcaanangnnnganatganacntcctgctatacgggaaacccgctntctanaancaaaaaatactggcgnggggnggccctg

SEQ ID NO: 22393 - DNA, 631 bp, Homo sapiens
  misc_feature 2, 5, 11, 19, 21, 23, 24, 28, 34, 36, 43, 68, 74, 78, 90,94, 107, 111, 241, 242, 247, 259, 261, 267, 268, 274, 277,299, 305, 327, 353, 357, 360, 367, 368, 377, 382, 395, 406,408, 430, 441, 457, 467, 476, 477, 496, 497, 508, 509: n = A,T,C or G
  misc_feature 512, 517, 530, 541, 542, 543, 562, 563, 574, 589, 595, 621: n = A,T,C or G
cnctnacgggnctgggcgnanannacgnaccggnanggggagnagcatttcccgcaggagggaccctnccagtncgtnaacttggccagnaagnacgcttccttagnaagnacagcaaactgggaagactcagtgcccttttaacaggaaatggccctggaagccagtgggatgtagaatgagagccagttgggagaaatgtatgtctggagtttggccagaaatggaagaacattccccnnaaaangggggggggggnanaccttnnaaaaanaantcccccctgggggccgcccctncaaaangcccctcccggaaaaagaagtnaaaccctcggggggggggggttttancccnagnaaaccgnnactgggatngaaanagcccccctgganccaggggggananaaaatttcccttttaacccccnttattcctccnaaaaggagaaaaaacncgggcccaanttttggaannccaaaaggggaaacccccnnccaaaaaaatnnccnccccnaaaaaacccaaanaaaaaaaaatnnnttttctttttccccaaaannccccccaaaanggggggggggggganaaaacnaagagggccccccgggggaaaacccnttttaaaaaa

SEQ ID NO: 22394 - DNA, 745 bp, Homo sapiens
  misc_feature 2, 9, 11, 23, 33, 627, 652, 673, 727, 731, 735: n = A,T,C or G
gnagacagnanggggcccggggnaggcagcaangcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggnctattgcagagcaaagagtattaanatatggcttttttggtaaganaagcttaagaataaacttttggttgcatattgatggatgtctcaccatggcccntttntgtntcaggagacc

SEQ ID NO: 22395 - DNA, 576 bp, Homo sapiens
  misc_feature 390, 428, 444, 459, 461, 465, 544, 545, 547, 548, 549, 572: n = A,T,C or G
gggagatttgtagatttttactatgaggattaatttactaccaaggtcctgatttcaagattcggacctttttgagatgtcgttatttcccagtgactggtggtttaaaacactctgctaagaacgaaatggttctgtacttcacagaatgtcatctagcagggctatggggtggagtgggagtgtggctgtccctccgtcccagagggttctgtgatgcatgggaagaggcagccggagcagtggcttgcaggtgtggtccatggacccttgggagggggtgtctctaagaacctttagggcctttgtgaattcaaagctattttcacaagaacactgacatgttttttgctcagtgctgacatttgcttctgtggcttaaaagcagangcaggtaaaattgctgcacctcacacccataactacanggtgtgctgatgctgngggatcttcactgcncncccnaagaagaaagaaaatgttcatttactgaaaatgttcttgacaagtagcaaaaaaaaaaaaaaaaaccctgggccgtttnncnnnacccactgaaaaccttggggttncccc

SEQ ID NO: 22396 - DNA, 688 bp, Homo sapiens
  misc_feature 1, 8, 602, 606: n = A,T,C or G
nagacagnagggattgttttcttggtgaggccagtaagcttttgtctcactcctgggagggacagtagcaaggtcttacaggtctctctatcattgaagcaccctccccaaccctgccggttttggttgctggtgaaggcctttgacagtgtcctggtagggcgacggtgaggccagctcccgacctctggacagaagaaagcttacttgtctaggttggtgtcaaggggactcctgaacttaatgaacaccttagaaattatccttaaagtctcttcttccgaggagtggggtgggatatttcttgcagaaaatgtaaacataatcatttgaagctggaatgttaatattcaagagtagcttgtaaaaaagcatcttgtgaaattctcatgtgaatgctgaaccggctggatgtgaacttagctggacagcctggcctgtctttgctctgctcttctccgtgcggtttgcatatgtgcagggcttcctttgaagccttgtcccctcaaacaattcactgtctctacaaaaactacaaaaaattcactgggtatgttggcacgcgcctgtagtcccagccgcttgggagactgagctgggangatncctggagcctgtgaggcggaggctgcagcaagccataatcacgcactgcactcattctgggcacaaacagatacatgtcaag

SEQ ID NO: 22397 - DNA, 523 bp, Homo sapiens
  misc_feature 458, 481, 487, 497, 518: n = A,T,C or G
gcaaagcaggagtttgataaggtgaggtttcaattgagaagttcccatgggagaagcaggattaaacagacagaagagagaggcctcataaagagcagggaaaaaattccagcccaggcattggggagtggatccccactggaaacaaagagccaggagaagtcttcatcccaggagacaaagatccgggaagaattttccagccaagagccaggctcaggagtcagggagtaaatgtcttcttgacgcagtgagccccagaaagaaagacttctagctgagtagatgcctttcaaacaaagaagtctgggcctctaatccagcttcagacaatgtaatcagaatcttcatcaaaatctgtcctcactgtgattcgatggacatttatctggagcactggatattggaatcactcaccaccagatacccaaaagcagcagactgagacaagtcttggngtgtgcttagagattgttattgngtccanagtctatggnggttcaatccgatctaatctnggccc

SEQ ID NO: 22398 - DNA, 822 bp, Homo sapiens
  misc_feature 2, 12, 29, 31, 33, 47, 54, 64, 80, 370, 447, 571, 590, 641,676, 744, 768, 787, 795, 801, 807: n = A,T,C or G
antcttgggggnaaaaacccccttttttngntncttttggaccgccncggcctncggctgcganagtctacaggaggggnaaaaatattatctatcaaatggtagatacaactttcgaaagtctggatacttaggtgatatgagaaatgaatataattaaagtattagagaatattgttgagatttttttttcttagttgtcttgctttttcaattaaaaaaattagaggaatattagaaatgaatttaataatcctggaagattaatccctctttgccaagttaaactcaaatgactagaaaaaaaagtaacttgtgaccttgaagtgtaagtgaaattcggtaaactgtaggaggtagaagcctcaangaccgaggccagatgtattatacttggcatattaaaataatttcctgtttcatcagggttggtaagaaatgaataantattcataagagggagattcatttgaacattcaaatgaagcctaaattagcaggagaagggaaacctttgaagtttattaactaaaaattaggaagtaaaatggttttttaatagctgagtganttagtagtttgtctttganttaatgaatatgtgaggaatttcagttttttcagattttaagacttcatanggggctggtgtggtggctcatgcctgtaatcttanctctttggaagcctagaaggaagacacctgagcctagggttgagacagcctggcacatggccgttaanacatgtacatgttaacctgcttanagggtcattaatatgaaanaaagccancagggngctccnccgtatccaaccttt

SEQ ID NO: 22399 - DNA, 838 bp, Homo sapiens
  misc_feature 5, 6, 11, 13, 17, 18, 19, 24, 30, 41, 43, 50, 61, 63, 64,71, 73, 77, 661, 684, 740, 796, 800, 806, 811, 833: n = A,T,C or G
taacnnggttncnatannncttgnttgttncttttggccgnancggcctncggctgcgagnanncgacagnangggnaaagtcaggtacgtcttcattgattttacatcccagcacctagcagcacatatgacagaacaggtgaggtgctcaaaaagaattttttgtttcgaccatctataaagttgaatgtaagaggccatggaatgacctgtttgttcatctcattgattcattaagacatggaatgtaaaaggccatggaatgaccatctactgaaactaaaattagacattttaccataattatttttaaaccactataagtagatattggttaaaaactttattattgataaactcatgctgggtgagttttttaaaaactttctttcataaagtcacaagaaaaattgctatatttgaagatcttcattgtatatttatacaagttagcaaatgctgcctaacaaaccacctcaaaggtaattgcctaaaacaacacacgttattactcttgagtttgtgtatcagcagaatgactcctcctgtctcagtttgccttcattgtgtatctggagtcagctgtgcatcagtcagtcaactctgttgactgcaaatttctcttgaatggactcatctgtactctcctctatacattgnctgattttccagaaggctcacanggcttttgacatagcatgactgggttccatgggagtgagcagaacactcatgaggnccaactcagaaccagggcatggcattttcatctattctctaaccatgtaattgcanggcnattcanaaaanagacaactccttgctgaggaanaagca

SEQ ID NO: 22400 - DNA, 772 bp, Homo sapiens
  misc_feature 2, 13, 24, 26, 29, 43, 620, 680, 703, 750, 765: n = A,T,C or G
tncggctgcgagnagtacgacagnanggnattcctttcacagnaggctgttggtagcccttgcttagaatcagtttttttttatctagagaagatagatttgcttgagtcctaccacactcacatacttttgtgagatggctgcttatggaaaggatattgtttttctttgggacagttatgatcttggcctctgatactaggatctaataaagcaagctgactagaaaagtaaaagcagtagttctgtgtaatgtgtgagctgtgaatttgttgctttcaagctgtttgttgtgttgtggcctgttctagtggactgggatcctgaggttttataacttaattttattgtagtagtaggcaaaatgctctttgtacctcagtttcctttcctgctctgtttcctcttttgagaagataaatgtgtacacgttaattctcccagtttcataacatgatggtgaaagaaaatactgtaaccaggggtgttttttaaaaaatgaagtgcaaggttgatagcaatttttgcatataaatgagtattaccgccttcagggttttcattctgggaggctatacacttatatcattctccaaaacttttttggtactgagtattgngaaaacattaagtcattttcaaacaccttgaagctaatagctaagtgatatttcctttgntccttaggcatcattgacatggnggatatataccctatggcctcgactgtagtctaatagggaagggggngaaaagaggaaatgnggtggcc

SEQ ID NO: 22401 - DNA, 718 bp, Homo sapiens
  misc_feature 1, 4, 284, 354, 522, 549, 624, 628, 688, 705: n = A,T,C or G
nggntcaaaaactcatgggcacaaaaaactcatggacacaacagacactgggatcttcttgaaggtggaggttgggaggaaggagaggatcagaaagaataactattgagtactaggattagtacctgggtgatgaaataatctgtaaatgaaaccccaatgacaccaatttacctacataacaaatgtacacctgtacccctgaacctaaaataaaagttaaaattaaaaaaaaaacctagctattatggaaaaaagaaagtcattgtaaccccttctgttanatatacttttaaaacgttaaagtaacttttcacttgtaaatacaatgtgtttttgataaacacctgtcanagcactgtgttgctatatgtggcatccagactcttagcataacctctcatgatctatggcagctttaggtcagtcttaaaaaaaatgttgaaagggccaggcacagtggctcatgcctgtaatcccagcactttgggaggccgaggtgggtggatcacctgaggtcangagtttgagaccagcctgaccaacaangtgaaaccccatctctactaaaaatacaaaaattagccaggcatggtagcgggcgcctgtagtcccagctcctanggangctgagacaggagaattgcttgacccagaggcggaggttgcagtgagccaagatcatgcnctcagtctgggtatggncagactctgtctc

SEQ ID NO: 22402 - DNA, 688 bp, Homo sapiens
  misc_feature 506, 578, 582, 593, 599, 608, 613, 615, 651, 654, 665, 669,672, 680, 687: n = A,T,C or G
gagagatcttatccatttggttctcagaagtacagacttccattacagatttcagagtactaaaaaaatctaggtgtggggttctaatcctagacagctctttttacattatgcctgtagtctccacatcccacatgctttgattcagtttactgagatcaccacttttagcacgaaaattagaatcaacatgttttagtccagaaatcaattggaaagcctcttaaattaatattaaagaaaaaaacagatgaaagagtcataaccctccatttttctttactccttacaagactctccaaggtatgggcccctagtttggttatcattcattctagcctctaaacagaagcataaatggcaaacaactacccacctggcctgtccacaaccagagtggggggatgcagagtcagaaagtccaagaattcaggctctgccactaaatatctggacaaataatcttttctgagaattaactttatcaatagggataataccacctnctgcaaaacttgcaagggcacatgagatgtatatgtgaaccaccttgtcaaagttgacatgtcctgacaagngggngtcaaaaaatntttctntggcagggnggggntntgctgtccccaccttgggagctgagggggggcttgntgncttaaagtggnaccnccngcacgggnaatccgnt

SEQ ID NO: 22403 - DNA, 669 bp, Homo sapiens
  misc_feature 441, 461, 533, 588, 597, 611, 613, 622, 664: n = A,T,C or G
gggattccacattggcaagaagatgaggaggcccgcctactaccacactgttagcatacttgaatgtgggaggaaaatttaacaacagcaacaaaaaatccaaacaagcatactttttgatacagtattccattctaatcatttatcttggaaaaatgcttcaacagggatgcaaatacacatgtatgaggctatttattaatttttaaattagttgtataagcaaacaattgaaaacaatagaaatgctcagcagtagaatacaagtgttaaaaaattatgccatatccagataatagcatgccatgctgccattttgaaaacttgaggccagtctgtaggtgctgacacagatccatgtctagaacacattcatcaaaaaaaatcacaggctgggagaggtggctcacacctgtaatcccagcactttggaaggccgangcaggtggattcctgagtcnggagtttgagaccagcctgaccacatggagaaccccgtctgactaaaatccaaaattagttggcatgatggngcatgcctgtatcccagctctcgggaggctgagcagagatcgcttgacccggagnggaggttgngggacccggatgcncnttgagtcanctggcacagacaaattcgtccaaaaaaaaaaaaaaaaacccnggcgt

SEQ ID NO: 22404 - DNA, 665 bp, Homo sapiens
  misc_feature 427, 436, 453, 513, 526, 570, 621, 625, 652, 664: n = A,T,C or G
ggggttcacagactggcctaggagccctggattttaaggtaaaatcattgctttgggatttgctgtcagtccaaattggactttctgcttttcattgagccttccccctgcttctattcctctccccaaaacagtgctgctcacaggaactgtgtcccgacagaagtgtggacagttctccttttctctctgctgcctcatgcggttgttagaacaagctaattccatctgagtaggtagtatagcttttctttctgtttactattgctgggtgacaggagagcaagggcagaagttacggtagatagctcagctttacaaccattgccggggctaaacatgaatcctcaggaatcgggttggccattcctctcctcaaacgttgtactccctctgctggttttgagacaactgatatttccttaanaagtgtgangctctgccttcaaaacngcacagtctctttttcccagatctgcaactgtgtgtgttgcacacccccaagaaaacagntctttctggctgnggggaatgatttcagttcttggcaagatggcaggaataaagtanaaaaattccttttgatacattcttctacctcacattctaccccaatattgnggantttaacttgttggggaccccaaccacntttaggcggtgnt

SEQ ID NO: 22405 - DNA, 769 bp, Homo sapiens
  misc_feature 2, 9, 40, 591, 633, 701, 717, 721, 733, 742, 743, 762: n = A,T,C or G
gncgacagnaggggtaagtaactgtggatgttgcctgagnactcaccaatggcagggaaaatccaggcaattaacgtgggctaaattggacttttccaaagatgctgcctttgggaaacatcacacatgctttggatcagaaaacctaggcttctaatttgttgataaggcatgaactcaggagactgttttcagtcctagtgaatggtgataattgtaattataacagtagacaacatctcttttacacattttaaatcatgaaaatagaataaccttactgataattttagaaagtggtgattaaaagcacatttaagataatgccttaacacctagtcttttccatatgcatgatgtcttaatcacacattgcaaatcatggaacacagaattttaagcagcatttgtgtagaacttctcagttttactaatattattttattttattctcataacaaccttgaatagaactcagatcatctgtcaaccatgtattttgataacagcctttacagtgagcatagaaaatacagtagtggctaacaacacaggctccagatgtcagggtatctgggtatgaattctggngtcagcattcactaagcatatgaccttgacagtgatttaagnttcttttaacagagaatagtaatacctacctcatatatattggcagggatcatctacatccaggcttntttaggctgggctcangggnggttgacctgcnaaatggcannctaaagatcacattacgantgggaag

SEQ ID NO: 22406 - DNA, 829 bp, Homo sapiens
  misc_feature 2, 3, 7, 8, 9, 10, 22, 33, 35, 42, 52, 55, 62, 67, 76, 79,83, 91, 666, 723, 759, 761, 763, 770, 806, 828: n = A,T,C or G
tnnaaannnnctttttttgttncttttggccgnancggcctncggctgcganagncgacagnagggnattagcagnagncagnagaaaagnatcaaaggtcataataattgatctgctactgctgaaaataaggagtgagtgttttcagttttaactgttggaaatggcagtttgtgtttttccttgtggaatacaattttgttttctcatctggttgtgggaagtggaaataatgtgtctgttttctaggaggataaacatctgaatttgcacgaaaatagaatggcttagatttaatatttatctaggagtggtgctgaaatcagcaaaatttttccagggaaagactctctggggacttgaatttctttttaaatagacatattttataatttaccaattcagaagcttcctactctatcttgaaaaccttccaaagttcatatagtaatagaaaagctaattttgataaagggaatttctctagcctgaattggttgaaacaagtcaacataataatcataaaaatctagccaaagaaattgagtccaaagaaggtttaagcatgctgctacctattgttatatatgaatcaaggggtatgaaaaataagatgtccaggccaagtgcagtggcttacgcctgtaatcccagcactttgggangctgaggcaggtggatcacctgacctcaggagttctagacaagcctggccacatggngaaaatcatctctattaaaatacaaaatagtcgggngngnggcaggngctgtatctcagctctcggagctgagcagaaatccntgacctggaggggaggtgcagng

SEQ ID NO: 22407 - DNA, 600 bp, Homo sapiens
  misc_feature 2, 7, 12, 18, 20, 21, 33, 46, 62, 72, 379, 400, 418, 427,432, 465, 477, 485, 490, 495, 498, 513, 514, 515, 516, 523,544, 550, 563, 573, 582, 595, 599: n = A,T,C or G
antcttnggggnaaaaancnnctttttttgttncttttggccgcancggcctaggctgcggnaatagacagnaaggcataatccccagcactgccaccctcaaccccccagcgctgcccactgggaggctgcttctaaaacttcagccctgctctgccagcagcgcccctggggtgtcttcgtagccctgttgcccatcacgatcccttttctcatgcagtccaggctgcaagcccccgccgagggcttgggctgacttgttgtgtagtcagtgctgtgtctctgcacccagccagaagtggtgggacagccccccggctgacgggctagaacccatcatccagggtgtgtggaaagagcacatcttcccccccgacgnccagccactgggtaataattncaagaatttcagggccanccccacttnaaaanaggtttttggaaaccttcaaaaacccttttaanggggttcccacnttgggtangggcnccctnccncctgggaaaaaattnnnnggctttnggaacctcccttgggggcccnagaggnttttttttttttntaaagggggnaaaattttnaaaaaaccaattngccng

SEQ ID NO: 22408 - DNA, 799 bp, Homo sapiens
  misc_feature 1, 8, 18, 21, 28, 33, 190, 395, 522, 648, 685, 701, 708,724, 729, 733, 745, 750, 764, 790, 798: n = A,T,C or G
ncggcctncggctgcganagncgacagnagggnatccaattcaaaaaggcatctgaaaaatttaacagctgaaaaacactttctccttgctgggaaaacttaaaccttgctaggctttatgcaacttaaaaaaaaaaaatcacttctgtgctgagaactagcatgagaaatctcagcatgaaaggttggnggattttttttcttcataaaactaagcccaattgttggttttaagagtgatgccacaatatacatatgctttgttaggaacaaatataatctaatttcaagggcatcttcaacaaaaattagggggaaaagataaaggctacttaagcagtgatccagtgtctgaaagcaaaggttgagaacatcattgtaccatcaaggtctanaaatgctgctaaccctgagcgggttgttactgtttgaaaagcctatgggtatttgttttattgttgtctcactcaattcttacttagctgagagtatctcacaagggaagtactgctctgtgatggngtcctggactttgttttctatttgtttcagcacttcaataaatggtctggtacctgccattatgacctgtatgcatttgctgagcagtttttcaaaacaaaacaaattatgtggctgtatttctanaacgctgagccttttcaagatagtttagattagaacnccctagacccgtcccncattggntgttttactgaccctntttcnactnttcaggaaatanaaaanaaataggtggcatncaattgcaaaaaaaaaaaaaaacccnggcccttnc

SEQ ID NO: 22409 - DNA, 852 bp, Homo sapiens
  misc_feature 6, 7, 14, 20, 27, 33, 45, 47, 54, 63, 65, 67, 68, 75, 77,80, 90, 99, 714, 780, 807, 840, 851: n = A,T,C or G
taatgnngctaacnataccnccttgtnttgttncttttggaccgnancggcctncggctgcgnananncgacagnanggncattggtggnataggaagnatttggcttcttgctcatccccttactatatgtgcctctttaacatagcagcttgcttcatcaaagtgtacaagccaacaatgaaatagagtctcctagcaagacagcagtcaccatcttttgtaaccactcttggaagtgacatctgtcaactttgctgtatcctattgtgtagaagcaagccatgaggtttagcctacacttgagagaagggattaaacaaaggagtgaagatcaggaggagagggtcattgggcaccattttaaagtccccctactataactactaactataagcaatagaaattcaacataggccagcaaatgtttatatgtgagaagagatctacactgccatgttccaagggaaaatgtgccctggtgaaggatttgcaaggttcgccagacttgaaaattgatgcacattatgggaaggtctttcctaggaatagtcttaactgtgagatgcatctagtcaaagaaaatatgatatattcaacacataggccaacaataagtggttatatccatctaaagcattttatgctttggaattttgcaggtgtccattgagtcctgaaaatatagaagatacagaggaatgagtgatttaanggaaatagacagctatacatttcactactttaaaaacaacaacaacaccaaactggcaggcatcgngctctgcctgtatcccaccttttggancccagcagagatgctgacccagagttaaaccanctagcatgggng

SEQ ID NO: 22410 - DNA, 828 bp, Homo sapiens
  misc_feature 10, 12, 13, 15, 16, 18, 21, 22, 26, 32, 40, 46, 47, 48, 49,55, 57, 526, 591, 644, 647, 656, 664, 748, 751, 753, 761,765, 812, 813, 821, 824: n = A,T,C or G
aacggggctnannanncnccnntgtnttgttncttttggnccgcannnngacagnanggggacggtttccggaatatggcggggcgtttggctcttgctgcagccagagctccaggtctcgtcttcatttctgtgtcctttgttcttagaggtccagcctgtgtggccctgtgacccgcagatattgggagatacacagctaagactccaggaccccctggaagcctagaaatgtgactgtgcctgacgtgtagccctgtctggggagctctgcacgcgcaattccgcagtctctcccagattgtgcaagaaccatgggaggggcgtcagatggagtcttgctctgtcgcccaggctggagtgcatggcaccatctcggctcacagcaacttccacctcccgggttcaagtgattctcctgcctcagcctcctgagtagctgggactacagatgtgcaccaccacgcccagctaaatttttatttttttatttttagtagagaaagggtttcactgtgttagccangatagtctcgatctcctgacatcgtgatctgcccacctcagcctttcaaagtgctgggattacangcatgagccatcgtgcccagccctgtattatatctttatctttatcaagttgnggnctaagtgancatttggnatgattttgggattattgaatttgctgaagattggtgggttctgattgcgtgggcattttaaagatgtgacacatggggatganaanantattactntgtnggttaaaaaaaagttatatttgttattaaatgattgggcaaggtgannttaggtcngantctc

SEQ ID NO: 22411 - DNA, 785 bp, Homo sapiens
  misc_feature 2, 3, 12, 13, 17, 21, 32, 43, 45, 61, 182, 254, 591, 612,632, 645, 691, 749, 757, 763, 764, 767, 768: n = A,T,C or G
anntcttggggnnaaanacancttttttgttncttttggccgnancggcctaggctagggnataatatgttttaatcattttgggtgttttcaaaacaaatggtgagattaggggttttttttctcttctatttttggcccctttcctctggagagtccttctcttgtgtttagttcttggngttcttagtatatttgaagaatgcttttaagtatttgaaatgtgtgtacatggttgaaaggggatgaggaanaagaaaccgaaaacttcatgaccctgctcaaaccaatacccataccccagccctaaagcagtgtccgggcaccacatcttcaaggaaggccccttggaaacccctcatgggccagtcctctgacccaggtgatctcctaaccccctttatgtattcttatgaggatatatgataaagaacggactgtgagatttgttgttcaaatttttccccttagaatgtgagctcagtgggtaatagtaccatgttggctctgtccacagttctactatcttcagcatagggcctggtatacagtaagcgcttaaaaaatacatgtcaaatggctgggtgcagnggctcacacctgtaatcctancactttgggaggccgaggcnggtggatcatgangtcaggaattcaagacccacctggccagatggggaaatcccatctntactaaaatacaaaattagccgggcttggtagcaggtgcctgtatcccactctaggangctgagcnaaatgnnttnnacccggaggaaaggggc

SEQ ID NO: 22412 - DNA, 798 bp, Homo sapiens
  misc_feature 7, 38, 614, 642, 650, 654, 694, 698, 735, 748, 771, 778, 787: n = A,T,C or G
ggggggnatgatttttaaaactatataacgtacttggnaattcattctcacctgtagtgttaggtgaagatctaaaatttatttgcaaataaccaagtagtatttttagtgattttatatcctagttattaaatactaagggttcctacattataggcctgattaggagctttcttctttgttctattgagctccaagcctgtttctctgacaataccatgatggtttattgtttaggtgatttattatgtctagttatcgggttgagttaggttcctctcatttctcttccccaaactctgactcccagtttttctttgctgttctcacttattctccagaaggtttttagaacattttctaagcccttcccctcacttataattttttttttgagacagagtcttgctctcttacccaggctggaatgcagtggtgtgatcttggctcactgcaacctccacctcctgggttcaagcaattcttctgactcagcctcccaaatagttgggaccacaggtgcacgccaccatgccaggctaatttttgtatttttagtagagacagggtttcaccatattggtcaggctggtctcaaactcctgacctcaggngatcacccaccttggctccctaagtgtnggatacangggngagcccctgatctgcctactggattttgatataatatttnaacnctaaatatctgggaaagagtatctttaaatgcagttnctcactaaaaatnccatcttaatcattttgttatcngggagcnataaggttnatttgaacttg

SEQ ID NO: 22413 - DNA, 667 bp, Homo sapiens
  misc_feature 1, 3, 10, 12, 434, 452, 457, 575, 589, 611, 615, 633, 640,663: n = A,T,C or G
ngncgacagnanggaacttcagaaaatatcagcaacaattctgaaaacattcaagagaatacataatttatggagctaggagaaaatacataagactggaaatcattgaacaaccttaagttttctaattaccagtagaatcatctgggctaggatcaaaattcagccattccacactcagaggatatgcagacaagagtatatcatggtgtacataaaaagagtcttcttcttgattataaactgaaaagattgggaaaagagactttaatgtatcagaatgagtcatcaaaaatcacatcccgctcaaaaaacaaattctattaaatgtacgtgagccatgtgctttaaagtgagacatctgatattataaagagattccaggctgggcgcagtggctcgtgcctgtaatcccagtactttgggaggccaangtgggcggatcacttgangtcangagttcgagaccagcctggccagcacggtgaaacctcatctctactcaaaatacaaaaattagctgggtgtgggtgggacgtgccctgtagtcccagctactaaggaggctgaagcangagaatggcttganctggaggggaggggttttcaangggncttaaatccccccctggncttccancctggcgacttagtgagactctntcgc

SEQ ID NO: 22414 - DNA, 797 bp, Homo sapiens
  misc_feature 2, 11, 13, 16, 23, 652, 684, 700, 753, 772, 787, 794: n = A,T,C or G
tncggctgcgngnagncgacagnagggggaagggaatgaacataactgttggtataccaccacactcacccccgcattttgaatttctgacacaaaagaaaaatcctccatagaaactgagacctacactctccagcttctagagattgcctagtataaataacacctaccttcctaagaagaactttaatgtaaaatctataagttggcaaggcctacccatgtactaacagctttcaattaactttttagtgtctcattcctaaagataaatagacaatttaagatcacaagatttttttaaggaaagcctcctacgtaaaagaaaaagatcaagataaatcaacaggtaaagatgacactggaggaagtgaaaatttaacatatggaatagaaaagaaacttcattaaactttctttcatgtctgcagagagatttaagaaaatattgcctcataacacaagaaaaagtttgctctgaaaaaaggaaccctcaaagcctaagaaagatgtcttgactattaaaatgtgacttcaaaataaaaaattcaccaaaggaaaattcaatgggaactgtactcagaaagtaggacaaaaagtcaaagagatagaaatacttaaaattaaagttagagcaggcgtagtggatgcncctgtatcccacccttgggagcctgagcaganattgttggcccagagnttgagtcaagctagcacaagcagacctccctctcaataacgagtagactgtgntgaaccaagattttccagngtccacactgctaanggagtcnaaa

SEQ ID NO: 22415 - DNA, 789 bp, Homo sapiens
  misc_feature 5, 7, 9, 12, 15, 17, 19, 20, 27, 33, 46, 62, 63, 64, 66,67, 74, 76, 509, 613, 645, 651, 655, 666, 678, 715, 718,729, 742, 772, 776, 779, 780, 781, 783, 786, 787, 788: n = A,T,C or G
taaangngnctnacnancnnccttgtnttgttncttttggccgcancggcctacggctgcgnnnanncgacagnanggggaatgaatgacatgtgagaaaactcttgttagacatgatgtttcctatacagaagaaaagatacaaacttgattgcttcagtaaaaacacttttagagattgtgtttccttttttgtgagacagcatctcgctccgccacatacactggagtgtagtggcacaatcttggcttactgcaacctctgcctcctgggttcaagtgattctcgtgccacagctacccgagtagctgggattggatgcacccaccaccacacccagctaatttcgtatttttagtagagacggggttttaccgtgttgaccaggctggtctcgaacccctggcctcaagtgatccacctgccttggcctcccacagtgttgggattacaggtgttagccaccacgcctggcctagacatatttctaaagaaattaagatcttangctgaggtgggtggatcacaaggtcaggagatcgagaccatcctggctagcacggtgaaacccagtctctactaaaattacaaaaaaaattagccaggtgtggnggcgggtgcctgtggtcccagctgcttgggangctgangcangaagatggcantgagccggaggnggagcttgcagtgagcccagatcacaccactgcactncancctggggacanagcaagactctgnctaaaaaaaaaaaaaaaaaaccctgggccntttnccnnnanccnnnt

SEQ ID NO: 22416 - DNA, 829 bp, Homo sapiens
  misc_feature 8, 13, 22, 23, 30, 50, 60, 63, 70, 75, 105, 245, 247, 695,697, 743, 755, 766, 774, 776, 808, 817: n = A,T,C or G
tttttganctacnaaacccctnntttgttncttttggccgccgcggcctncggctgcganagncgacagnagggnatgaactacccagggacactgttccacagnatatatctggatgaagtttggcagttaactattatagactcttcctagtactggaaaaaagctttaaaatatatttaatttaagtttagagtcaagacagcctgaggctagtgagtaacatagatattttaggaattagngnctttaagactaacataagtcaaacgtttgtacactatttttgacatgtactacttattattgctgattgagattgtaatactgtattattgtcttcattttgcttatttaacactgaattttttggtattaggtactgtactggggttgggaagaagacttaattaaaagttactaaaaggttcttctttcagggagtttacaatgtaaatataggtgacaacaggctatagtactatgtggtaaattgtaattttgtctaggacagaagtcagcaactatagcctttagaccaaattcagctgctgcttgtacaccaccacaccccttcttttatgcagcttttgtgctactatggcagagtgagtagttagagactttatggccctctccaagcctaaaatatttactattggcctttacaggaagattggtaatccctgatctanangaattgaagtctttgcagaggaaatttaatttaggccttggaatgngagtagatttcnttccagatgcnggagagananaaagcttcagctaaaagcacacacaaaatggnctaacggtnctgttggaatag

SEQ ID NO: 22417 - DNA, 805 bp, Homo sapiens
  misc_feature 3, 15, 19, 33, 54, 64, 68, 74, 89, 96, 629, 665, 706, 708,711, 727, 731, 739, 749, 753, 758, 782, 783, 794, 796, 797,800, 802, 803: n = A,T,C or G
atntttttgacctanaaanccccttttttgttncttttggaccgccccggcctncggctgcganagtnttcagnaggggttgttcaagnaatcacntgtatataccatatttcatttattcatccattgatgaactgtgaagcagcctgcttttggctgttgtgactaactaatgcttccatgaacatggatttacaaatacctgttccagttcctgctttcacttcttctgggtgtctgcaagtttaagaatcaaaattttaaacaaatcaaattggcactagataagttacttgtaaggtttgtatggaaaaataagcaagagtagccacaacttttctgaaaagaacagtaactagaaatcaggcttattagataataaaacagaaattaaaagggttagaatattgtggttgtggtggactggcagacggaaaatcactgacgccgaatagaaaatctaataattggctgggtggggtggcttacacctgtaatctcagcactttgggaggttgtgacgggagaattgcccgagcccgggagtttgagaccagcctgggcaacatagtgagacccccacctctctacaaaaattaaaaaaaaaaaaatagccaagcgtgattgcncatgcttgtgatcccagctactcaggaggctgaggngaaagattgcttgaccccaggaggcaaggctacatgaaccncnttnttgccctgaactccancctntgggacanaccagactcncctnaaaanaaaaaaaaaaaaaaaaaaaacccnngggcccttttncnnaancnnct

SEQ ID NO: 22418 - DNA, 769 bp, Homo sapiens
  misc_feature 2, 3, 4, 8, 19, 21, 37, 40, 44, 45, 54, 57, 65, 66, 71, 500,566, 574, 575, 576, 597, 604, 617, 633, 640, 656, 660, 680,684, 694, 709, 716, 720, 730, 734, 750, 755, 762, 763, 766: n = A,T,C or G
tnnncgtngtaaaaaaccngnttttgggtgggccganccncctnnggctgcganagnagacagtnnggggnaatgaatgacatgtgagaaaactcttgttagacatgatgtttcctatacagaagaaaagatacaaacttgattgcttcagtaaaaacacttttagagattgtgtttccttttttgtgagacagcatctcgctccgccacatacactggagtgtagtggcacaatcttggcttactgcaacctctgcctcctgggttcaagtgattctcgtgccacagctacccgagtagctgggattggatgcacccaccaccacacccagctaatttcgtatttttagtagagacggggttttaccgtgttgaccaggctggtctcgaacccctggcctcaagtgatccacctgccttggcctcccacagtgttgggattacaggtgttagccaccacgcctggcctagacatatttctaaagaaattaagatcttangctgaggtgggtggatcacaaggtcaggagatcgagaccatcctggctagcacggtgaaacccagnctctactnnnttaccaaaaaaaattacccangtgtggnggcgggtgcctgnggcccagctgcttggnaggctgnggccggaggatggccntgancccgggagggggagcttgcngggngccgggatcncccccctgcctccancctgggngacngacgagactngtcnaaaaaaaaaaaaaaanccccnggggccnnttnccg

SEQ ID NO: 22419 - DNA, 324 bp, Homo sapiens
  misc_feature 189, 203, 208, 213, 227, 228, 242, 243, 247, 256, 271, 285,293, 316: n = A,T,C or G
ggggtcttttctggtcaaaatggctggtaagcaggccgtttcagcatcaggcaagtggctggatggtattcgaaattggtattacaatgctgcaggattcaataaactggggttaatgcgagatgatccatatacgaggatgaagatgtaaagaagccttagaagacttcctgagacctttttatgccngatgttcgcttaanaggcnctggnctgacttgaacttnnatctggctaagacnntggncaattgaanagaaattctgctgancgttctgaaaagtntccggaanaaaaaaaaaatgcaaaatatctnttttaatt

SEQ ID NO: 22420 - DNA, 852 bp, Homo sapiens
  misc_feature 2, 3, 11, 21, 31, 32, 33, 42, 43, 46, 52, 63, 68, 90, 619,647, 691, 744, 773, 798, 800, 807, 810, 820, 822, 825, 828,844: n = A,T,C or G
gnngaggaganaaaaaaaaanttttaaaggnnnttcttttgnncgntaaaancttgcttgttnctttnggccgagcggggggagccgggnattttgaggtttccggtggagcagaaacagggtttcaccatgttgcccaggcttgtcttgaactcctgggatcaagcaacctgcccgcctcggcttcccaaagtgccatgattacagtgtgagctactgcacccggcctcatatgattttgaataaggcatttgctttatgctttacaagtacctcttgacttgctactggtacctggaagagatgtaacacctgaccatgggacatcaagtgactgtgtgaatcaaactgcccatcatgaattgttgttatttgactcatcaaactgtacaactggatgaacacaggagcagtgcactacatatgggactggaaccatgaatgagcaggtgactcagactcctatagtacctgcctctactccttcagcacttctccctcaacccacataaactgtcatcataatgagttccctctgaccagttaatggaagagaaaaaagtatggatgttatggatatcctaacatatttctggccattggacccctagaaacctgnggtaagagtcctggaagtttttcaaggntcatcttgcaccttctagcatgcatatgtcggaccaaagcatgnagaatgctgcctacttctgctcttagttcatttaaataattcattactctganaaacaggggaggtctatggaaaacaaaanaccgcaagggcccttctacccttananacagganaangaggacccgnanaanaanaagactactgtatccnccattaac

SEQ ID NO: 22421 - DNA, 792 bp, Homo sapiens
  misc_feature 1, 9, 50, 617, 629, 681, 703, 715, 750, 754, 759, 762, 765: n = A,T,C or G
nacgacagnagggggtttataattttaatgtaaggaaggatttctttagnacatacaaagaacacataagaaagaaaaacactggcaaattgattatattaaaatttaaggccaggcatggtgtcttatgcctgtaatctcagcactttgggatgggaggccaaggtgggcagatcacttgagctcaagagtttgagaccagcctgggcaacatgacaaaaccccatctctacaaaaaatacaaaaattatccaggcatggtggcatgtgcctttagtcccagctatctgggggctgaggcgagaggattacttgagctcaggaggtcaaggctacaatgagccatgatcatgccactgcactctagcctgggtgacagagtgagaacctgtctcaaaatgataataaataaataaataaataaataaaacttatctgcatcagaagatgccacctccccacccaacaaaaacatgattgaattgtttgggataatgtattttcaattcatagaaatagacacagaattagtaatacagaaggaactccatatatatatatgtatataaagaaggccaggtgtagtggccccacgtgtagtcccagcactttgggangccaaggtggangatccttgaggccaggagttcagaccagcctggcaacatatgaagcctgtcnaaatacaaaattaccaacgtgngggccattgggnccactctcagagctgagggaggacctgaccagggntggntgggngtnttnatgcccctgtttcacctgaaaaaaaag

SEQ ID NO: 22422 - DNA, 297 bp, Homo sapiens
  misc_feature 124, 150, 151, 180, 193, 218, 221, 229, 236, 237, 239, 241,243, 250, 252, 260, 278, 281, 285, 286, 297: n = A,T,C or G
gggctgtaatggtgtgcttcaaggtatcacgtcatggggcagtgaaccatgtgccctgccccgaaaggcctttcctgtacaccaaggtggtgcattaccggaagtggatcaaggacaccatcgngggccaaacccctgagcccccctttnnaactccctttttggtggtaaaacttgggnaacctttggaaangaacccgggcccaaaaatttaaagnccncccccaanttttttnntngnanccctttntngccctttnggggggggggggggcccnttntttnnttttttggggn

SEQ ID NO: 22423 - DNA, 436 bp, Homo sapiens
  misc_feature 354, 356, 360, 373, 387, 418, 420, 421, 433: n = A,T,C or G
ggggggcagttgggtgggggtggggaagtataatggaaggcatggacgcaacatgctgtgccgtttagaagatgaaatacacatgaagcaaaaccctgttcgtgtacttcaaaagacagacacagggccgggcatggcggctcatgcctgtaatcccagcactttgggaggctaaggtgggagggtcacttgaagtcaggagttcaagaccagcctggccaaatggtgaaaccccatctctataaaatactttaaaaaattactgggtgtggcggtgggcacctgtatcccactattcggcaggctgagcaggagatcacttgagcctggagcagaggtgcatgcctgaatgcncnctgncccacctggtgcngaatgagattcttntaaaaaaaaaaaaaaaaaaaaagcgcctttntnnaaaccaaattanaat

SEQ ID NO: 22424 - DNA, 718 bp, Homo sapiens
  misc_feature 3, 10, 609, 676, 682, 692, 711: n = A,T,C or G
agnagacagnaagggaacgaggctgtctctcttcccttctcttgtttagctatgagattgacacatcatggggaaagcatttagaatgtacccagtgctttggggtgcttggtgccacccagcactgtgagcacaggttcttctaccttggggccacacccagttacctgtatctcactgcacagcagtggctgttggggaccaggcccacccctccatgtcccacctcctgcaactgcagcctgagccttcccatcagcctggggtggtgcagacccatgtgccattgtggatccttcaagttacctgtgtggcagagaggacgtgtgagtgccgtccaaacccaaacactgagagggtccttcccattgcccccacggaagtaaggtgccccagtgctaattccacttatacttgctggtggcaaggacacttctcctccttattaaagtgggggattggctgggtgaggtggctcacgcctgttatcccagcactttaagaggccaaggcaggtggaccacctgaggtcaggagtttgagaccacaagcctggccaacatgttgaaactccatctctactaaaatacaaaaatagtcaggcgtggngcgtgcacctgtatccagctactaagaggctgggcaggaggatacttgaaccagagtggaggtgagnagcaanatggccctgnctcacctggtgacaaaganattctcc

SEQ ID NO: 22425 - DNA, 677 bp, Homo sapiens
  misc_feature 391, 418, 425, 464, 470, 482, 485, 489, 492, 505, 565, 569,574, 576, 577, 585, 599, 611, 627, 638, 642, 656, 669, 673,676: n = A,T,C or G
gtagcctgtttagaattctcagtttattttcaaacttctggttcagtcagtttatcttaaaaaaaaaatgacagaaataagaagaggtgataataggaagtgtgatttaatctctgctgtgcaggtcacctgaggtgtatcacctaatgacagtgcagcagtaactttattttctccctatccagcatggtgtccacattaaaattgtgaatctctaaattagcattttgtgtctgccactttctacctttgtaccactcagcaggatattcacctctttaaatctcagctttctatctattcagtggtgttagtgtcatgcctgtcactcagaaagagtgaaacgctgcaaccacagcacagatatgcccaatgagtagtaaatttttgntggtattgctggatctggtactattgngaccggnattggtggtatgtatctgtacatcaactgtgattctagngatggntttggggattanaanatanacncctataaaactcnttaatttggatatatagcttgcagttccctttggggatgaagtaaaactgaaaggctgcnctgngacanannggcaaaanttctcctacccagntggccctacttnctttttaaatccaagngttaatcaaanaaanaatttggttctgantttttgccttcgnttcnttng

SEQ ID NO: 22426 - DNA, 791 bp, Homo sapiens
  misc_feature 28, 582, 638, 683, 688, 702, 720, 727, 730, 734, 765, 771,782: n = A,T,C or G
gggagttctgattttagttagcaaaagnaaaaataaaacttctctaggtatgcatatggttgtatacacattattcttatctacatataatatatcctgtttgtatcaggatataatttttgtatagttacatgcaagactgccttgaaagttcagatgaccattacattctttaaacccatagtttttagtctcttgttagtttctctaaaattattttttacagaccttaaatttgtaatgccttatcatagccagaggtgaattttgttgaaacttggagaaaaatttattccacccctttaagcgtacccaaaagggaagagagaactatttttcgttcaacaaaaaattttaaaagccttttttccttcagcggaaaactccaaaacagctttgtctcagaacgttaaacttggcatggataaaaaaatttgagttttgctttgtttgaggaaatttgtttttgaaacaacaatgttataaatatttttaaattgcctgctgagcatgcgctgtatctgactttattcatagttttaaacaccaccaaagtgcagtcttctgaatggcccaggtaangctggtgatttgatgatctttcgcagaagcaccttctgtgagtctactcagttttncagaaggaaaaagcgagagctgagttagactggcacctttctaantctanagcaaagtaattgnccattaagctgccattcnctaaggnagnctgncacttccttttttagagtgctgctactttcnctatcnacagggaatanaaaaaaaaa

SEQ ID NO: 22427 - DNA, 775 bp, Homo sapiens
  misc_feature 1, 9, 564, 646, 688, 712, 723, 725, 729, 757: n = A,T,C or G
nacgacagnaggggaaaaattggtttgcaactaaaatttagtcattaatgtaccgctttaaaggaaggaatggtggaggggccaggggtcggagaggcagagtatagggcataaagacccctggagtttggagacttccctgtccctaggtctcccccaataagctgtcactgtaggcttcctcatccataaaatgaaaggtgtgaaactagaatgatctgccttagaattcaatctctctgcaatgcagtgcaactagtgtttgtaaagaagttccagctgccgttcagaaccagaagcgtgaggaatccaaaatatggctttgccttttcataacaacgggaagcatttgaggtggcttgccgttcagcaagcattgcttaaatgtttgttgttagctgtgggggaaacggtagcatgataggcttctgctctcttccctgaagaacttttcatcagacacccttcttgtcagtcactcttaataaccttttgttcataatgttgtcagagacctaacaaaacaaatttttaaaagcaggtataaggaagcacgaagtttanggtcactgattatttttatatagccaaaagtatagatctcttttcagtcttggcatgacttatgatagtctttcatctaaanatgctctttaataagaaggtccagatattcctaactctaagnggggaggcaggatctggcttgtcnctatgggaccngnctangctaccagactgcctgaacagccatacnttggaatgctctgggctt

SEQ ID NO: 22428 - DNA, 681 bp, Homo sapiens
  misc_feature 490, 609, 626, 640: n = A,T,C or G
ggggggctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggangacagtttgatctggaaatgaatttcattatccaagaaggtgagagtattaactgcatggtggacctactggaaaatgtgacattacgtgccaagcagagtctggacatgttacagccnttctgaaaaaacatacngatcttcagtctgnctgagtaggcctgtgaaaatgcttggaaaattgaaaagtgc

SEQ ID NO: 22429 - DNA, 832 bp, Homo sapiens
  misc_feature 10, 11, 12, 13, 16, 19, 34, 42, 43, 56, 81, 89, 589, 607,613, 651, 671, 677, 682, 685, 703, 713, 718, 719, 729, 734,764, 765, 771, 773, 775, 791, 799, 806, 820, 822, 827: n = A,T,C or G
aagttttggnnnntanacnggggtgaaaacccgnttttgggnnggccgaagacagnagggggttagtgggtaggcctgagnagccgagnaaaactgagcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaaganggctgagactttagctgntgaganaaaagagcttcaaggacaactagcagacacaacatggnggagatagcctaataccacncggaanggagnagnatgaagatacaaatgctnaagctcaaangatcnnaacacaagtnggggnattttaccgaagaaagcgaagaaacaatcnnagggcnananaatgacggaaacagcncgagaatntcaaaangctttgaaacagcngnccggnaaaag

SEQ ID NO: 22430 - DNA, 650 bp, Homo sapiens
  misc_feature 1, 4, 26, 92, 294, 513, 514, 541, 553, 555, 561, 583, 586,629, 631, 632, 645: n = A,T,C or G
nagnacgacagtagggatctcaaggnaatcacaaaaatggcaattttttaaagttacattcctaagacactgactaactctacccaacaagnattatatctttaggttgcagaaacatccacgacattgtatacaaagaagggataggaggcataatagccaccatagaaaaggaaaatgcaatagtggggactagagttagtccaaaggcctttagataacactgaggtatagcccaagccagaaaattttagttgccctaggacccccttttaattccatgtgatggcttangtcccctgtgaaaagtagctagattggaatagacaagaagtcctaaaaatgaaagtaaagggttaaagttaaaccacgttgtaagtgactgattagtaattcccgtctgtttcattttagtcacgtagggagggtacaggaaattattagctctcatttttattctggtaaatcatgattaggggtaaggctgaaaaaagctggcccattagtaggtcnnaaccctgtaattttaatcaggcaatcngggccttaaaanangtaaangttttaaaactttcctgggggnttnccctcccccttaaattaaattttgggaactttttattgggccngnntttaaccccccgnaaaac

SEQ ID NO: 22431 - DNA, 708 bp, Homo sapiens
  misc_feature 1, 573, 586, 617, 644, 647, 648, 663, 668, 670, 681, 691: n = A,T,C or G
nacgacagtaagggtatccaaattcaaaaaaggcatctgaaaaatttaacagctgaaaaacactttctccttgctgggaaaacttaaaccttgctaggctttatgcaacttaaaaaaaaatcacttctgtgctgagaactagcatgagaaatctcagcatgaaaggttggtggattttttttcttcataaaactaagcccaattgttggttttaagagtgatgccacaatatacatatgctttgttaggaacaaatataatctaatttcaagggcatcttcaacaaaaattagggggaaaagataaaggctacttaagcagtgatccagtgtctgaaagcaaaggttgagaacatcattgtaccatcaaggtctagaaatgctgctaaccctgagcgggttgttactgtttgaaaagcctatgggtatttgttttattggtgtctcactcaattcttacttagctgagagtatctcacaagggaagtactgctctgtgatgggggtctggactttgttttctatttgtttcagcacttcaataaatgggctgtacctgccattatgacctgtntcatttgctgagngtttttcaaaacaaacaaatatgtggctggnttctagaacgctggccctttcagaagnttnnaatagaaccccctanaccgncncccattgtttnttttccggancattttcgccttttcgg

SEQ ID NO: 22432 - DNA, 551 bp, Homo sapiens
  misc_feature 3, 457, 467, 472, 473, 474, 479, 484, 515, 518, 526, 529,532, 536, 538, 539, 541, 545, 547: n = A,T,C or G
agnacgacagtaaggggtttgttttgagaccgagtctcacactgttgcccaggctggcgtgcactggcgagatcttggctcactgcaagctccacctcccaagtagctgggatcacaggcacctggtaccacgtctggctaatgttttgtatttttagtagagtttcactatgttggccagtctggtcttgaactcctgacctcaggtgattcacccaccttggcctcccaaagtgctgggattacaggcatgagccaccatgcccggccaccaaggtttttttaaaaccatattcttgcaaaattatttgcctttatacatgtaaagattggacttttgcttcactactttcatttttatacttgtagctctttctcaagctgaaaatcttggttcctgatttcatttactcatttagtctacagtacatatcactgtttcaaaataatgccagtntatttactancatannnctganagaanttttaagattactttatggttccttccgtcntcnaggactanagnggncccnanntnctgngnctga

SEQ ID NO: 22433 - DNA, 727 bp, Homo sapiens
  misc_feature 534, 585, 624, 633, 649, 650, 653, 675, 711, 712, 717: n = A,T,C or G
gggggtggcgcgtgcctgtaattccagctacccaggaggctgaggcaggagaatggcgtgaacctgggaggcggaggctgcagtgagctgagaccacgccactctactccagcctgggcaacagagtgagtctctgtctcaaaaaaacaaaaaatttttttaaagtaaatctaagagctaattatttgacaagtccaattagataaactgccaactatctaataatgggaaaagaaaggggttaaacttcgacacaaaatgtggaagaaggccaggcgcggtggctcacacctgtaatcccagcactttgggtggccaagatgggtggattacctgaggtcaggagttcgagaccagcctggccaacgtggtgaaaccctgtctctactaaaaatacaaaaaattggctgggtgaggtggtgggtgcctgtaatcccaacgggaggctgaggcaggagaatcgcttgaacccaggaggcagaggttgcagtgagccgagatcgtgctattgcagtccagcctggcacaagagcnaactctgtctcaaaaataataataattaatgtggaaaaatgtaagactgtnttttctgctataatttgaaacctaataaatggctattgnctagatttncaatgaccaatgatcnnccnaatcatatggaggaaataaaanttcatgttggattacactcttttggaggaggatttnnatccnaaaaaaaaaa

SEQ ID NO: 22434 - DNA, 748 bp, Homo sapiens
  misc_feature 11, 14, 22, 43, 494, 530, 603, 623, 631, 662, 671, 677, 698,728, 729, 735, 738, 739, 741, 742, 743, 744: n = A,T,C or G
tacggctgagnagnacgacagnaggggaaatacacagcaaagnataaaaataaatcccccgcactgccataccttcttagataatatgccttccctccgacttctttcccttgatgttttggtttggctagcccactggttttgccaagggttgtgtttagtcagtcggctctgaatgttgccagctaacagctaccttgatactcttggctctgagtgtaattaataccagaagaatgttaaaattatatttctttataaaggtagttctgttttaatttttttaatattacagtggttaacatgcatagatatcatctaatatttttgctgaattacacctctttagccacctgttaatttactaaggtgttaataaaatagtaaattacctaatgttaaaaaaattttagtttttatatatacacacacacaacacgtacacacacactttttttttttgaaacggagtcttgctctgtcgcccaggctanagtgcacattttttaaaatctcattttacccagganatgggctgcccctgggaactctggaaactgcatattttctcaccaataattgaatcatactttgaaactttgnaaatgactaaagacctcggnctaggccnccccttgccttgaaagctcaaaaaacaaagnggggaaaanactttnatgtttgttggggggcctganaaacttccaaaaaaaaaaaaaaaaaaaccnnggggcnttnncnnnnaccc

SEQ ID NO: 22435 - DNA, 768 bp, Homo sapiens
  misc_feature 7, 521, 629, 633, 640, 649, 657, 695, 710, 713, 714, 719,725, 733, 742, 753, 756, 760, 763: n = A,T,C or G
aagaagncattgagcctaagagaaacaagttgtccaagaacaaatagctgttcattatggagctaggacttatgcagaaatttgccagttactttctgactacaaagaaaaacagatgctaaaaatctcttctgaaaacagcaatccaggttgaagaagaaatgaagaagcatgaaagtaataatgtgggattactagaaaacctgagtaatggtgtcactgctggcaatggtgatgatggattaattcctcaaaggaagagcagaacacctgaaaatcagcaatttcctgacaacgaaagtgaagagtatcacagaatttgcgaattagtttctgactacaaagaaaaacagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaatttatgggctntcgaagaaatgaagaagcccggagtctcacgtcggatttccagaaacctgactatggtgccctgctgcatgggatgatggataattcctccaggagacagaaccctgnagcngcatttnctgcctggnatgagagntccagggcgacaaatggtctcaaaccattttggaaaangacctggatttcccntgnnttttnttttanaaaaccanaaagggtgnaaaaaatttanctntttntgnaaaag

SEQ ID NO: 22436 - DNA, 766 bp, Homo sapiens
  misc_feature 592, 598, 684, 690, 709, 714, 720, 722, 734, 737, 743, 747: n = A,T,C or G
ggctccttaaaggggctgactgcacttgaggcacccttttctattcctgcatgataacaagctctaacagccatgaccgtagtgtagccttgaaatcacaggctgtggataacaaagcagaaagagagcagcagtctgggtctctcatcttcatggacttgtctcatcatccctaagctgcttaatcagatttcctataattgacaggataaattttgggtatttaaggcattgtgttttagatctcttgttactcatttcgaactcaatccctcattaaaacttaactgctcgtattttattttatctgaggcgttcttcagtatatagctggtatgattgctctgtggaaatgtagtgaatctgtgccgttctacttttacagggtattttacaacactactactttatgtaaaaagttctctaataggcactcatttcattaattctcacaggcattatgatatctattttagagatgaacaaacttattctgcataggattaatgacagtattatgttcagtaacagcctaaaaaatagactttgatagcaaaaacatactggtttagattcctataaaaaatattgnggccangcatgggggctcacacctgtaatccagcactttggagccgaggcgggggacacctggtcaggagtcagacagccggccacatgacnaacccnctctctaaaaacaaaatanccagngggggngnggcctgtatccnggnctaggngcgnggagaaaccctgaccagag

SEQ ID NO: 22437 - DNA, 803 bp, Homo sapiens
  misc_feature 11, 22, 651, 663, 667, 675, 681, 688, 725, 731, 736, 738,747, 757, 761, 768, 782, 800: n = A,T,C or G
cggctgctagnaagacgacagnaagggtagtacaagttccctggcccaccacaattagcattctctattgcaacaaacatatgaacatataaagaacaaggaaatacacacatacacacacatatgatgtttttagatggtaataagggctttagagattatgcaacagagctaaagggatcaggataccctggatggggtgggaagggaactgagaactctaagatgagaagaagccaattatgcagagaaccagggagagatattccagggctcagccatgcaggcccctggtgataagaagtttggcatatttgtagcattaagaacaagaggggagtgacagcagatgaggcctgtggggtagagaaaaactaacccattaagactagcctgccctgctcacatttctctcataattaaacacaatctatctggaccatccttaatttgcaaagcacagatagatctaaattttccttaattattatttcctctttggtggatttctgaaaagaagtgtgtgtgtgtgtgtatgtgtgtttgtgttcagacatctgcctatctatagctaagcttctgattaaccaagttttaatctatctacctcattgcgctttgctatttctctttcttatcctccattgctcnctaggggggggntggnggcaacanttcttntgttgcngcaacagataggattgcctgcggggacaaataaattnagcttnccttngnagcctaacntgtttaccanaganaagcgcntgtggggccactgncgatactgatggttgggnaga

SEQ ID NO: 22438 - DNA, 675 bp, Homo sapiens
  misc_feature 19, 583, 588, 645, 651, 669: n = A,T,C or G
gggagtagacaaggcaggnaaggagtagtgatgttcctgagttcttgctgaattctgacagcgtgccaacactttgatttctctgtcaaaatgggtgggatttgatatctaaaaaagtataccattacatatctaaaagtatattgttacatggaatatggaagccactgatttaattctggaatgtccgtcaacatgacagccacctaaactcctctgaggcattgtaaacggttaggaaaattgacctttctacacactaaatctggcttcagtggctctcctgagctctaagggagttgggcaggggcagcctgagctccggctgtgagcatagctcaactgatgtgtagttagaatgttcatggaaggcccaggcttgctacttcccattcctttattttaaatgatgtagtgagccaggcgtggtggctcatgcctgtaatccccgcactttgggaggccgaggtgggtggatcacttgagcccaggagttcaagaccagcctgggcaacatggtgaaaccctgtctctacaaaaaaaacaaaattagccagcatgatggtgtgtgcctgtagttcangggangctgagggggagaattgcttgagcccaggagtggggctgcagtgagctgtgattgcncactgnctctagcctggggacagngcctac

SEQ ID NO: 22439 - DNA, 675 bp, Homo sapiens
  misc_feature 584, 597, 601, 612, 620, 644, 662, 675: n = A,T,C or G
agggagtagacaaggcaggaaggagtagtgatgttcctgagttcttgctgaattctgacagcgtgccaacactttgatttctctgtcaaaatgggtgggatttgatatctaaaaaagtataccattacatatctaaaagtatattgttacatggaatatggaagccactgatttaattctggaatgtccgtcaacatgacagccacctaaactcctctgaggcattgtaaacggttaggaaaattgacctttctacacactaaatctggcttcagtggctctcctgagctctaagggagttgggcaggggcagcctgagctccggctgtgagcatagctcaactgatgtgtagttagaatgttcatggaaggcccaggcttgctacttcccattcctttattttaaatgatgtagtgagccaggcgtggtggctcatgcctgtaatccccgcactttgggaggccgaggtgggtggatcacttgagcccaggagttcaagaccagcctgggcaacatggtgaaaccctgtctctacaaaaaaacaaaattagccaggcatgatggtgtgtgcctgtagtttcangggaggctgaggngganaattgcttganccagaggnggggctgcagtgagctggattgcncactgcctctaacctggngacagggcctacn

SEQ ID NO: 22440 - DNA, 755 bp, Homo sapiens
  misc_feature 1, 9, 510, 539, 541, 563, 573, 685, 697, 710, 723, 733, 746,754: n = A,T,C or G
nacgacagnaagggaatagaaatttatttctcacagctcaggaggttgggaagtctaagatcaatgtgtcagcatggttgggttctggtgaagacccttttctgggttgcggactgccgacttcccactgggttttcgcatggtggaaaaggcaggctcctttgggcctcttttataagggtactaatcctattcatgaggactctgtccccatgacctagccacttaccaaaggcccacctcttaataccatcatattggggattaggtttcaaaataggaattttgctgagggacataaacattcagaccatggcacccatgtagacagtacaccagttaggaccaaaaagataggaaaattcaaagatcaagttgagagggtcaatgtcggactaggagtttcaaaaagagaaaacaaatcaagtgttgaaaacttgattaaaacagtaatacaagaaaactctctggaatatattttcagaatgtatttccagggatgtttgtttncagattgaaaggattctttccagttactncntaaaatcaatgaaaaaagatcntacagcggcntaatcttgaacactaaaaataagaggaattctaaaatcttcagatagaaaattagactccttgaaagactaggaatcaggcctttttaattacattcaagctggatttaganacagggcctaanatctgaggaaggnggtcctttaattnttctggccantccgtttgttggnagtttatnc

SEQ ID NO: 22441 - DNA, 792 bp, Homo sapiens
  misc_feature 3, 26, 135, 144, 154, 196, 200, 224, 241, 249, 259, 277,306, 308, 377, 398, 432, 464, 540, 557, 608, 659, 664, 667,675, 718, 725, 737, 756, 766, 788, 789: n = A,T,C or G
agnacgacagtaagggggcaccgagnattatttaagtgacaaatgtactatattggattataatcagatgtgaattgccaaaaaaaaaaagtttacctgaaacaggagtaaaataagctgaaataggttgccaanatacctatntttttgaagngggaaattgaagtttctattaaattttaatacctactctaanaagngcttcactcaacagcaagctctgngcaaaataatctgtagngcttgctntaacgagctntaacgagcacctgccacnactgatcttaatctacttctgcactgcananacatgctgctgagggaccgcatctggagctcaccttcctctgggggcaatcagttttccttatcttggngaaaagtggcacctgctcaanattctcaaacatgccacattgggttgagatttanattctagccttgaaaataattctaggctctgnggttctctcagtacagcaggtcagcacgcctccatgctgcctgtgacaagaagccctcagagggcaaatcccacanacagggtcttcctctgngactctgaataggattctggcctggagtcagctcaaactgaatgtccaaancctcctggctgtttctttaagtctcaggctttttctacccaggctttcagncccanganagtttctntggcctgtaaatccaggggagccggagtggaaaacctggacanacccganccgctctgttanctgtaatctccggccctanacacttttgnatggcaacatcgctaattccgnngag

SEQ ID NO: 22442 - DNA, 555 bp, Homo sapiens
  misc_feature 375, 428, 436, 460, 464, 469, 476, 490, 493, 496, 506, 515,518, 531, 532, 536, 544, 552, 554: n = A,T,C or G
gagatgctctaatctaaattatgaaaacttgatatattttaaaggaatttactcagttgaataataaaccacaatcatcatgagtattttattttatataggcagacagtataaaacttttagatagttcattaataaaggaaaattgaacattttggaactttcatgtgattttagcaaactgcaaatcagtcaaatattaaatccgttaactccatgtgaaagtaaagaatcacttagaatgtacaatgtcacgttttctaattttataaatataaaatcagatatttttcttgtaagttttcttttcagaaatgaaaatatggccgggtgcagtggctcacgcctgtaatcccaacattttgggaggccaangtgggtggatcacctgaggcaggaggcaagagcagcctggccacatggtgaancctgtctntcaaaatccaaaattaactggggnggtnccccncctgtanccccctcttggagntgngcngagaacgctnacctggagnggnggtggggggccannaccnttgcctcncctggcgnana

SEQ ID NO: 22443 - DNA, 656 bp, Homo sapiens
  misc_feature 15, 30, 107, 114, 141, 156, 164, 185, 208, 214, 236, 249,257, 263, 285, 314, 327, 347, 363, 389, 390, 408, 415, 416,418, 492, 500, 527, 539, 540, 542, 545, 551, 554, 564, 598,601, 604, 621, 627, 631, 633: n = A,T,C or G
gggggttacagctcnctgcctagataagancaccatatactgagaaaaggaatactaacaaagaaccagacttttggcggggtacgagaggagagatgagagggagnggtaatngggggaaatcatcagttttgaatattntaagcgcttccccangaacaggnggccacatagatctatagctnagaagagagatctaagctagaanaaaaanttgagctactggcatggatganattacctaggaanagaatatntagcangagagggcctcaggtgagctanaggtactaatacgatgtggcatacgcggntagatacggggcnagggctttgtattcaggcangcctagattcaaatcntagctctactatctactgggaaatcnnattagttaagattaaaantgatacnngngggccaggcgcggcggctcacacctgtaatcccagcactatgggacgccgaggcaggcggatacttgagggcangagttcanaaccagcctggccacatggggaaaccnggctccttctanntntcnaattanccngggggatgcnggacccctggaatcccgctctcaggaactgggcnganaanacttgacctggaggggngggggnggancnagcaaaatttgactctaaaaaat

SEQ ID NO: 22444 - DNA, 501 bp, Homo sapiens
  misc_feature 337, 370, 372, 382, 387, 395, 397, 400, 407, 414, 430, 466,468, 469, 478, 485: n = A,T,C or G
gggtattataataatttcagttggcagtctaataaaagtttgttgaacacactgtattttagctttggtggcttttatgaggaacttacaatgtacggcgattaaagtgatttgaagtattgctattcatgcacagtatcatatttttgtaagtatttttcagctatagaaatatgactgtcctctgaataaaacaggtaacaggaaattcgaaaccctgggacattatgtcttatttatctgtgaaaggctatcatatagtcaggaagaatatgatagtatctactctcaatattcctattcaaaatttcttaaagaccaatttaacagacagacncatgtatcattgggtgccccagggttaactacntntgtccaaatnttggnttaaactncnttnttttgtntaaatgngatacctcttagaaancccaaagaaaaaaaaaaaaaaaaaagggccgctttntnntatccgccntaaaaanctttgggttgaccccc

SEQ ID NO: 22445 - DNA, 747 bp, Homo sapiens
  misc_feature 2, 522, 595, 659, 703, 729, 733: n = A,T,C or G
gnagacagtaggggaactacctacctaagcgatgaaatccaaaggtgaatcttttggttggtgattttgatgatagccacaaagcaagcagggtaatgctgatgcttcaagtcttggaaccacacttcgagaatcactgttataatgtacagcagaactgcatgatcagctgtatggtagccttgaaaaccaacaggccacaatcacagtgaaaacctcaggttggcagccactggaggatacaaaatgagtttggatctccttcaatgccccattcccagagaactgtcattatttgacctgctggtagttccctaaaggacgtgcaaggatgtttttatttgactggacacttgaagcttgccctgtatgaacagcccccatcttcccatgcttgtcaaaaatcagaggcaactaacactgcggcttcctgagagtctcactctgtcacccaggctggagagcaattgcacaaacacttggctcactgcagcctcaacttcttgtcctcaagtgatcctnccaccttagcctcctaagtagctgggaccacagtagagacggggtttcaccatgttggccagtctgctttctnctacctcagtgagccgcctgcctcgaaatcttattatagcgcttggcaactttataatgctctntggtacagtgactctattacttttgatatatgtatgctcctagnctcttctcttggttgtacaaattccnttgnataagcgtttgaac

SEQ ID NO: 22446 - DNA, 686 bp, Homo sapiens
  misc_feature 1, 440, 462, 528, 573, 577, 590, 593, 610, 637, 679, 680,681: n = A,T,C or G
nacgacagtaagggatatctataaaatgtaggtgagaaaatggaatcacagttttcgatctcacagatcactggtggacatagaagcacaaatcatgtcttttgatagaaaatagcttaaatcctgccaaaaatactttgtcttgtaagtgaaagtgcaagggttaaatttgactttaagcacatacacaaacatcaatgtttttcttgtctttacctctctgtgatgctttcctcttaggtggcttcactgccctgtagtcatttttttatgctggagcaacaatacccatcttgtagatccggatttaacctggatctcagaataatacctgagatcttttcacaaagatctcagaataagcctgacatggtatccatcagaatcatataatctctcccgaagattctgaacggatcatatgcctactcctggatcangcaatgtgtccaggtttgttangccagcctgtttgccagctaatgacagcttaattatacattgaaacattgcttggttaactcaagnttggaatgaaggatagctgtatgtcatgtttaagcaaggttttanccanaacattgttcttnttntgaaggtattcttttanaacagaccatccctggatcagccctcncctcctggagaacatgcaatgctggattgggggggggggggnnnccccc

SEQ ID NO: 22447 - DNA, 311 bp, Homo sapiens
  misc_feature 113, 117, 135, 191, 195, 203, 232, 239, 247, 255, 262, 267,269, 273, 284, 285, 293, 294, 306, 309, 310: n = A,T,C or G
tggggagaacggagcggacgccatggcgaccaacatcgagcagatttttaggtctttcgtggtcagtaaattccgggaaattcaacaggagctttccagtggaaggattgaangccnctgaatggtgaaacaatnccccattgaaggaacccgcgggtgatgcagctgctctgcaggagttaccaatgaanaatngtgccganattgaggaagactttctgggtcttaatcngactccntttagccnacttgaanagctccnaaaantnatcnttctgtccacnntcttctgnnattcccttaaantcnna

SEQ ID NO: 22448 - DNA, 719 bp, Homo sapiens
  misc_feature 11, 420, 467, 505, 508, 536, 570, 580, 582, 585, 610, 612,613, 628, 629, 632, 648, 651, 657, 689, 696, 699, 701, 718: n = A,T,C or G
gggcaaaaagnatagcaagtactgtttaaaccttactctttataaagttttggaaatcatctcatcagtgttaatcgtcatcataaattggttaataaagtttggtggtgtagacagtaaggaagacaaatatattaatgaaactttgtaatttagagggtattggaattattagaaaaactactaagtaagtgtttatgtttctggtcaaattgagagaaaaaacatcaaactagtggaacaatatcctaagttggaagtgaagtatcttactgtaagtcaatgatggctttgtattttttaaaatcttcataattgctgttggaaagttgacattatatttcattttataacttaaatgtgacattcgatgaatgtaatgttgccacaaaatctttttctactaaacctcattactgngtgtattttattatagccttttttgtgggaatatttatgaaccttanaataccctgaaagctaaatgggtcattctgtttcaagnggngagtttttttttttggaaccttctaaanaaaatggagacatgaacagtcttcagatcttttnctttttgaananctnggcggaccagggctccacctgtatncnnccctttggggcaagnnggnggtccctgagcagganacnccctgncccggggaaaccgccttctaaaaataaaatanccggccnacntngccgtttcccctccggng

SEQ ID NO: 22449 - DNA, 760 bp, Homo sapiens
  misc_feature 10, 534, 560, 594, 651, 661, 666, 668, 681, 736, 741, 745,755: n = A,T,C or G
agacgacagnaaggggacatatactaactcgtttgcttcccacggtggagatggttatgattgttctccttgaggaaagtgaagcccagagaaggcaagtaagtgccctgctcaaatttaattcacttgtgttgtctaacctcagtcactgtcctatcaccctgttttattttcttcggagccttgcttggaaaaacagtggtctactggtttgcttgcttgcccattgtctgtctcacagacagcacgagacatcgcctcatagatggcaagctccttgagtgcagggccttcatctttcttgttcacattcccaaagcttaactgatgctttagagaagctcagtgaatatttgtggaaagaatgagccactggcccactgaatggagactcctcgagggtgcactctgtgattattcatttctgttacccccacacttcctagcacagggcctggcacagatacagtgctcagtaaactgtttgttgagtgaataaatgaatgaatgaatgaatggaaaaaaattccagangactcagttgctgttgctcttccttncagactctgggaactagtggaaagtcttcagccncaggagatgtgggagatattctttctgatctctgtttggttctctggggattggggnggcccagagnggtcncnggcggaagctganaaaaaatggaatgaaaaatcctggaatgactcctgatatttttctgtcaaggcanaaganaaanaaatttaggnggccg

SEQ ID NO: 22450 - DNA, 623 bp, Homo sapiens
  misc_feature 1, 520, 521, 532, 534, 544, 557, 560, 568, 569, 577, 588,593, 595, 601, 607, 613, 614, 620: n = A,T,C or G
nacgacagtaaggggttatgcatgggaattagtttctcaagtcagtaagataaaaattctgtagaatcagaataccatcaggctgggcacactggctcacgcctataatcccagcactttgggaggccaaggtgggtggatcatgaagtcaggagtttgagaccagccttgccaacattgtgaaaacctgttctctactgaaaatacaaaaattagctgagtgtggtggctcacgcctgtaatcccagcactttgggaggccgaagtgggaggatcacaaggtcaggagttcgagaccatcctggctaatacggtgaaaccctttctctactgaaaatacaaaaaatgagcctggcatggtggcacgtgcctgtagtcccagctattggggaggctgaggcaagagaatcgcttgaacccgggaggcagaggttgcagtgagccaagattgcgccactgcactccagcctgggcgacacaagactcggtctcaaaaaaaaaaagaaaaaaaaaaataccnnggcccgggggngngccccttgtntccccccttctcnggnggttaggnnggagattnctttgaccccnggggngnagtttnttgggnccaggnncccccnttg

SEQ ID NO: 22451 - DNA, 645 bp, Homo sapiens
  misc_feature 403, 420, 442, 481, 576, 589, 597, 615, 617, 618, 619, 621,634, 635, 636: n = A,T,C or G
aaaaggacagctgctaaagaaaaggcagaatagaatagcacattgactttctttggaaatgagtgctaactgcatgaactggggcccttttaaataattttatcgtatgtttggtataactgtacatggttaaacaaagatttacaatctgggagacatgaagctcttttgaaatattccctgaggcaatgagacactattggagtaatatcagtcaacaaacaccatatttaaggcaaaaggaagacatgtagttttagagcatagcatatagtggagtttaaataatttaatactaaaatattaagggaaaaggtttaatttttggttcctaatattggattgggatcccaaaacctaaattttctttctggcttcatcactgattagatatgtggcatanaaacaaatagcttttgngatgtgggttacaatctaaagnggaaaatgtggcaagccaagggctccacctgtattccanactttgggaggtgaggcaggaggattgcttgaaccaagggttgtaccaccttggcagacaagaggcctgctctcaaaaaaaaagaatacccgctnggggcccttgagnccactttnagaggctaggggagatgntnnncnggaggtaggctcnnnacctgattc

SEQ ID NO: 22452 - DNA, 833 bp, Homo sapiens
  misc_feature 4, 12, 14, 17, 25, 31, 42, 51, 64, 71, 76, 78, 578, 638,641, 662, 748, 765, 785, 786, 795, 798: n = A,T,C or G
aacngtgctacnanacncccttttnttgttncttttggccgnaacggcctncggctgcgataancgacagnaaggnanctgggcgtagtggcaggtgcctgtaatctcagctacttgggaggctgaggcaggagaattgcttgaaccctggaggcggaggctgcagtgagctgagatcgcgtcattacactccagcctgggctacagagtgagactccctctcaaacaaaacaaaacaaaacaaaagcctgatagaaatgtgccctgtggacaggggtaggaggggtggcagacattccatgcagagataagggcacagaggctgagggagcatcaggtatttgggatactcttggtaatcaacaattgctagatacaaaactagaggctggagggaagtggcagaagttgagactggagtttagattgtgtgtcctgtagcaatatctccctgagcacaagagtgatgcgactgggttttcatgtttcagaggtcattttgacagcagtgaggacaggctggataaggtgagtggatgtgaggagtattgggagaggcgaatggaatcagctcgtanagtcgatgggccctgggaaaggggctcctggaagtggaggaaaggcaatgagatatttanganggagattcagtgggactgganagtgtgatatgggaagaagaagaatctggtggatgtgaaggcttgagtaaaatgtgggaagctgcagcaaaatccctcaggtaccnatgtaactgcgaggaangagtgacctgttaaaagggnnaacctgganaanaaaaccacatgaaacaccgtgaaaatcttggagct

SEQ ID NO: 22453 - DNA, 771 bp, Homo sapiens
  misc_feature 8, 18, 21, 56, 584, 596, 606, 644, 647, 676, 716, 718, 726,737, 750: n = A,T,C or G
gcggcctncggctgcganagncgacagagggagggatgactttgggggaagggganaaaatgtgaaatgtcagaaaggtattttccatggttcggcttggttaaaatttttaaggctgctaagcattgcattctggttacaatttaagatccagaagaggtatgccctcacactctgttcagattagctgtccaaatgcagatatttgaatgaatgaatgaatgaacgaattaattaactaattaattaatgagtgaatgaatgaaaatattgttgtcgactgtttccctctctcctgtaccagacccttaccggcagggaccatatatcattaatctctgaatccctagtttagattcagagcagatgctgaataacggtttattgaacgaaccagagaattttaaaagatagttgggatctggtatttcaatccttttgcttgtcctcatttttttcccatcactcattagctccaatggttgacagcagcgagaggagaagggattggatacagtttgcttcctgtgtatgaaaagctcaagagaaggcctgttggagaatctgtcccagatattactggngatgcttctcangactgcccgntagtctgacttccctcagcctacagggagttaactganacnctttccccttcttaattctggacttctcncctagaatctcctggcttgggggactggggaggcttaccncntgaaaccncccctcttttnaaggaagagtagnccagggaagaagcctacccag

SEQ ID NO: 22454 - DNA, 710 bp, Homo sapiens
  misc_feature 615, 626, 676, 700: n = A,T,C or G
gggataataaaacaaaattactggccaggcgcggtgtctcatgcctgtgatcctagcactttggaaggctgagactggtgaatctcttgagctcaggaatttgagaccagcctgagctcagtgagacagtgagacctcgtctctggaaaaaatacaaaaattagccaatgatggtggtatacacctgtggtcccaggtagctgggaatacaggcacaccccaccatgcctggctatttttttgtattttggtagagatggggtttcaccgtgttggctgggctggtgtcaaactcctgagctcaggcaatccaccttcctcagattcccaaaatgctgggattacaggtgtgagccaccgtgcctggcgataaacaacatatttaaactctaaaatgttatgcaagcatttccaggcatgctttggaaaaactattaatcccacaaaagatgcttatgtaattatatagactaacagaccaagattctccaggacacttactttgttaagtgtctgaagtaaaatgcaatgctgtatataaaatgtgacctgaagtcaggtcccagtcttttatctggaaaattctggtaattatactgcccttcccctttatangttttctgtangagttaaaatacactttttcaattgcttgacataatgctcacactggtangggagctaaaatgtcagctattgncctatgtgcc

SEQ ID NO: 22455 - DNA, 848 bp, Homo sapiens
  misc_feature 2, 11, 12, 16, 21, 22, 27, 33, 44, 46, 64, 67, 75, 652, 689,705, 733, 825: n = A,T,C or G
anatcttgggnntacnaaccnnctttnttgttncttttggccgnancggcctacggttgcgagnagnacgacagnaggggacttttgggttattccatcagcaacacaagtaaatctctctagtatactatttatctcaggagtgacaaatatgtgttaagaatgacttctattacccctgcattataagtttattttttccagtatttttttccctttgatttgagacttagcctaggcatcattcccaaagaagtgctccagacagccgccatgaatgaatcagaactggcccttggaaggaggcctacctgccggtcctctaatggacataacttacttttacctcacagtgttactcagtgctttatctactagggctcatgagatgcagtgttcatactgttttgtttccagaatccctgggtgtgttttattccctcagttgtatataacaggacgcacaatggggtcaggccaatattttttggctcttaaaaggactcttgctgaggtttgccagtacctgctgatctgcagctcccccagcttcataagcagtgataggagtactgagtcagccccaaattaaagaaccatacatagaacaatgccctgcagcagactcgagggacaaatctgaaagagcatncccagactcttgaggcatagatacctcctgaaataanggtctgccttctatangtcattactttggacatttaataaagcntaccaaaagaaaaatacatgtatttataccctcacatttcttttagcatctttagtttgcttacaggctgatacccctcattccaatcctanctcttacaaaaaaaaaaaaaaaa

SEQ ID NO: 22456 - DNA, 702 bp, Homo sapiens
  misc_feature 3, 4, 558, 634, 650, 679, 683, 685: n = A,T,C or G
ccnngggcttgttggtgttactctttcctcttcctggacttggcagacaggctggtcattggagacctcaggccacctggtcattggagtttcctgtggtgggaaaggagaatgctggaggtggttattgcagtgggcatgagaaaaggagcaggaaggagtgtatgaaagccaagaaagcaaaggagatgggattggcagatttccctgaagttggttccagagtagccagaagaggaggacattttaaagaagggtttaggctgctcttctagaagaaaactcctgtctcttgctcctatgatccaaggtttcagggattattttagatcctccaaggactagccttttgtttggccccatacagctgccagaccagaatttttgtgccatggatttcatgggttgctagcaagccttgcctatggttcttgtcaaagacctgtcactctagtctgcctttttatttttattttttactgggttttattgagacagttcgctctgttgcccaggttggagtgcacctggtgtgatcttggctcactgcaacctccnttcctgagttcaagcaattctcatgcctcagctcctcgggaggctgaggcaggagaattgcttgaaccagaggcanaggttgcagtgatccnagatatgccctggactcatctggctgganacanangagactctgtctcattc

SEQ ID NO: 22457 - DNA, 752 bp, Homo sapiens
  misc_feature 33, 311, 322, 345, 363, 377, 380, 386, 408, 450, 458, 480,482, 489, 500, 501, 533, 553, 559, 573, 581, 606, 666, 681,686, 693, 697, 706, 709, 711, 721, 733, 736, 747, 751: n = A,T,C or G
ggggaattcaaacctgtgtgtatcctgacaaanatacatattctatgaaaagtctttgctaataagtagaagatttctatttcacaacaagcaagaaaaagaatgagagaaggactagaaagtagatgtgatcatatgaataatgattttccttgctttttgcatgtatgtggtggacacatgcagaagtgacagcaggagttcgagaccagcctgaccaacatggtgaaatcccgtctctactaaacacacacacacacacacacacacacacacacacacacacacacacaatagccgggcatggtggngggcacctgtnatcccatctacttgggaggctgncgcacaagagtgacttgnacccaggaggcggnggntgcagngagctgagatcatgccattgcnctccagcctgggtgacgagtgaaaaaaaaatagtgataatanagagagcngggtgaccacaaaagagaatangntggaaanatttgtctaanngggggccctcttctcttatagctgcatatggntaagtttattttttccctanagcganttctagggatgaanaaaaaatncttttcagttttcctccccaggggngtatacctctatgggaaataataagcccatttttttttgagtatagttatatgaacgaanctctagggcagtttntcccnggcaacncctntactttttnttntnacccgggggngggggggggggnggnccttccagtanctgna

SEQ ID NO: 22458 - DNA, 800 bp, Homo sapiens
  misc_feature 1, 8, 18, 21, 29, 60, 555, 661, 681, 689, 692, 696, 733,745, 755, 757, 775, 794: n = A,T,C or G
ncggcctncggctgcganagnacgacagnagggaaggctctcataaaacttgacctctgnggcaatattaaaatgatgaaatttaggcttagtgaattctactgttatcatgttcaataacatttaaggacataaaagaattttataaaaacattttatatattttaagattgaaaagtttaggcaaatgtaagggcagagcatcaccaaacattatagtgggaaaggatgtaagaaacaaagtctagtgacttcatttttaaataagcaaattgaggcacagggtagggcacaaaggttacacaaaccatattgaccaccatcgcagatcatccttagagacctagacgtgatagtctatctgaatttacaatctgaggcttcaatctttccactacaatcagggtctaagcaatgtttcctgaggagcaaattgccttgggctcattttttgagacttgttgaattgtagtccccttcatcagaatctcaaattcatatataaaggagtatcctgaaaacattgggttgttatcaaaagaggtttttttgggngtttttttttggttttttggttttttggtttttaattttgtcctagtatcatgcctttgggtgagcaacgagtcctgtagaggcaatttatttgggtgacttaatntcttttgatgatttccaagnggcctaanacnttanaacttcagtagttaattgggcttccgactgtgaaccngtaatctgacanaccttagggngnggattcaactcccagggngggccaccctggggcaaangcctgt

SEQ ID NO: 22459 - DNA, 722 bp, Homo sapiens
  misc_feature 492, 518, 557, 610, 659, 670, 675, 715: n = A,T,C or G
ctaacattctccctatatttttggcatttgatgtaaaaggggaaaatctcattttaaaaataataaaatgacttaaaagaaaaaatatagcaaggaagtatttcggtccatttcaactcgttaaaaaacagccttattaaatagttacttgctgtaatcacctgtattttgccaccctttttggcagcatttatggcagtgctgggtaacagtgtgacctctctggtttatctctctctgcctctgtgtgaaagcattactgtcactactgtaaatgggtggtttataggctgtaatgattcttcattaggtacattcctccaactcttgggaaaacactcttttattgttacagagatgaatcatgctcccatttgaaacttttttttttgagacggagtctcgctctgttgcccaggctggagtgcagtggcgcaatcttggctcattgcaacctccgcctcctgggctcacaccattctcctgcctcanacttccgagtagttgggagtacaggngcccaccaccacgcctggctaatttttatattttagtanagtcagggtttcacccaggatggtctcgatctcctgaccttatgatctgcccncttgcctcccaaggctgggatacaggcgtgagcccccatgcctggcccnaacattgaaanttttncttattgcatttcccccaaaaatatatttgaaacaaattnttatccc

SEQ ID NO: 22460 - DNA, 232 bp, Homo sapiens
  misc_feature 78, 93, 106, 107, 121, 125, 137, 138, 152, 158, 166, 186,192, 200, 204, 205, 206, 209, 214: n = A,T,C or G
gggatcagatgcagtatttttgaatattgggcagcatgataacattactctgcaccagtttgttggtcaaataaattntgttttctctgcttnaaaccaatgttanncttagcccatggtnaaanaaaaaaatgcgnngattaacattactngcacantttttggncaaataaatttgtttttttntttaanccatgttntctnnnccnatggnaaaaaaaaaaaaaaaaaa

SEQ ID NO: 22461 - DNA, 683 bp, Homo sapiens
  misc_feature 441, 476, 577, 657, 662, 682: n = A,T,C or G
tttctctttagtcaaagcaatctattctcatggctttatttactatttatatatcaacaatttgcaaatttatatttataactcagatttctattttccaaaactgaaattgttcaaatttccacctcaaactgtgcttatcacctttaacttcaaaatttgttgtttctttttaaacaagtgatgccaccaaatacccagcttctcaagtcataaattgaggggtcttctttgacatctctttcttttacatcactgccctccctctaacactctaggttacaattaagtatatatctcttaaaaatacaaaagttagctgggggtagtggcacatgcctgtagtcccagctacttggggggctgagatgggaggattgcttgagcccgggaggttgagactgtagtgagctgtgattgtaccactgcactccagcctangcagcagagtgagaccctgtctctaaataaagtgntttgtatgcttaattattcatgtggaagtatgaacatcaattccagtatatatcagtatgaataaaattcagtgcaggaagatattttttatccagattanggtaacaaatatacaataggatttagagatactgatgtccatttcacaagtcaccaaaggttgcattggctacaggctanccagnctaattgggagaccaatctnt

SEQ ID NO: 22462 - DNA, 791 bp, Homo sapiens
  misc_feature 2, 8, 13, 16, 20, 21, 27, 33, 44, 46, 52, 57, 261, 267, 287,305, 326, 342, 356, 402, 442, 467, 474, 478, 482, 486, 488,536, 576, 595, 604, 606, 611, 626, 634, 666, 683, 687, 715,716, 726, 733, 736, 743, 791: n = A,T,C or G
antacttntgttncgntaanncttgtnttgttncttttggccgnangacagnagggntacattttttattaacagcatcggtagcagaatggtgtccagccagtagcagctcctctcccctggtgtcacaaacctcactgcagagtcgtgcccatcaaaatgggcactccaaggagtgttgtatgtgaaatggaatatccacagactagcatgtcttttttttttttattattatactttaagttttagggtacgtgtgcncattgngcaggttagttacatatgtntacatgtgccatgctggngcgctgcacccactaaactancatgtcaaaagggagnggctgggattatanacaacctggacccagggtaccgaaagttttactttttaaaattggnaatgtttgatgttaaagttttaggggtcagtaaatggcanagccctgttacctgaccaggttcanaatcagngganacanacananatgttgaacaggtggaaatcaaaatatccactttgggctgagtgcagnggcttatacctgtaatcccggcactttgggaggctgaggngggtggattgcctgacctnaggagttcnanaccancctgggcaaatgggnaaaccctntcctacaaaaatacaaaaatagctgggcgtanggcacatggcctggggncccncttctagggagctgagggggaaaatggnngacccagagncaagctncantgacctnaactgcccctgccttcaccctggggaaaaacgaaccctgttaaaaaan

SEQ ID NO: 22463 - DNA, 844 bp, Homo sapiens
  misc_feature 2, 9, 15, 21, 33, 45, 47, 74, 76, 80, 599, 637, 655, 672,678, 681, 694, 718, 723, 742, 773, 775, 781, 784, 787, 798,803, 816, 819, 821, 824, 829, 830, 837: n = A,T,C or G
anttcttgncctacnataccnccttgcttgttncttttggaccgnancggcctaggctgcgatagtacgacagnangggnacggggtttcaccattttagccaggctggtcttgaactcctgacctcaggtgatccacccacctcggcctcccaaagtgttgggattacaggtgtgagccactgtgcctggccagtgcactttcttttgagggtagacattactgttccccgccgggaagcattcctactgggtgtgcacgctttcagtgtctggcgtgacagattgtacaaagtgaacccagccacacagctaccgtccatatcacaccaccaccagcacccagatatctccctcgtgtcccccagtggctgcctagaccaggtggccctgccctgcctcctgtccccatgggcagatgttgcttatccctggcctctgcatgaaagaccaagcagagtgctatcttctggctgagacctccctgctgcctcatcaccgtggaaaggcacaggctggcttcttttccaggttatggactttcttactgtgtcactttgtggacttgggcacctgcagagtgcctggcatggtgagcangagttggggcatggcgtgatctaagcagggtttggaanggtctttgaatagccaanggggacagtctggaggngccctncanaacctgaaatgcnttgaagctagggtgactaccgcanatcanagcctgggaacatttaagnctaaggggccatgtgactaaaatcaggatgngntgaggnggncanactgatggcancggcncctaagaaatggntgncnttnggaanntgggggnccccccc

SEQ ID NO: 22464 - DNA, 717 bp, Homo sapiens
  misc_feature 1, 10: n = A,T,C or G
ngggtagggnagcattctcctcctcctctgtgcacggttgcggtggaactctgtgggcatccctctgagcctttgctggtgctctgcacacgctattaattacatgaaaaatattattacagcatttttaaaaacctatcaagcagctaatattttccgcccacccacatttaccacaagcaattttgcttccacttacctgcctgccactcatttcattagtttaagagaatgttcgtttgtgcttagagaccagtagatttcgagatggcacagagccacagtcattccacctgaaaggaatgtgtgcagaagcaaatataagagaagcagttgtgtcattgctcctgttagtaagcagtggatttcttgtaaagtttttttttgttcgtttgtttgtttttttaaaaaaaggaagaaaaaccggccaggcatggtggctctagcctgtaatcccagcactttgggaggctgaggcaggtggattacctgaggtcaggagttcgagaccagcctggccaatatggtgaaaccccgggcctactaaaaatacaaaaaactagttgggtgtggtggcagacgatgcctgtaatcccagctactcgggagcctgaggcaggagaatcgcttgacctgaaggcaaatgttgcagtgagctgaaattgcaccactgcacttcagcctgggcacaagagctaagctctgtctcaaaaaggt

SEQ ID NO: 22465 - DNA, 849 bp, Homo sapiens
  misc_feature 2, 4, 9, 14, 20, 34, 47, 54, 64, 67, 75, 81, 92, 125, 249,626, 662, 687, 696, 712, 723, 727, 735, 768, 771, 776, 809,812, 819, 828, 829, 830: n = A,T,C or G
anantcttnggggnaaaaanccccttttttgttncttttggccgcancggcctncggctgcganagnacgacagnaggggnaataaactgtngctctgctgtaaggcatttggtgttaccagggnaatatttgcagagggtaaaagtgtaagtatgtgacagcacacatggagtgggaccatctattttccataggatgttgcttttaaccccaggcacacagcactgaataatttctgtgcaacatanaagctttgggggaaatctgtggctgccgaaacagtttaaataagccagctagatagttagtgaattgattgttttgcaagtaaaatcaatttgtagcagtccactctttgtagctcagctctctaagttctgagatctggagcaattgcagtacctgtggaatactttcttttcccccctacaagtacagtctctaaggttaattatgtaccaagagttaaagaggcattgccaggagtaatgagaggaaaacgcacatcaccacaggcagatattctcaactcagtttctaaattgaatttttttttttttttacaggctgcaaaatacaagctggcagctctgcctgtggcaggtgcactcatcgggggaatggnagggggtcctattggcctccttgcaggcttcaaagnggcaggaattgcagctgcacttggnggggggggnggggggcttcacaggnggaaattggtncaanaaagaacngaaatgatggggaagctcctttcagctgtccanatnttccnccaactgacaaaaatgccgttaaaaccaatttngtnttttggngccacatgnnnttctgagactttgtgtgtg

SEQ ID NO: 22466 - DNA, 714 bp, Homo sapiens
  misc_feature 6, 8, 12, 614, 660, 693, 710, 712: n = A,T,C or G
gacagnangggnatactcatatttaaaaactttcattgggagtctgttagcttcttttccaaaacactcactcctaagattcatgattggtactttggcctggccttattttgggtctgtacttactggtgcttcattcatacatgcagaagctttggaatgcctcttccaaatgtctctttcctacttgttcaggacagtcgtttttcttgtatgtctgaactctttgagttgactagatttgcctcaacttgtcatagggattcaagatttttgcctcaggtttttggccgtattttcaagacagttaggtccaaaaagatgcagctcttctaaatttctgtctcaccctcttcctctctttttctcctctgtgtttacctttccagttatatttgtcagttgttttgatactcaaggtttctagaataaaaggtgtggccgggcgcggtggctcacgcctgtaatcctagcactttgggaggccgaggcgggtggatcacgagttcaggagttggagaccagcctggccaacgtggtgaaacctcgtctctactaaaaatataaaaattagccaggcatggtggcgggtgcctgtaacccccgctactcangaggctgaagcaggaaaatctcttgaactggaagcggaggatgcantgagccaaatcgcgccaccatacttcagccggncacaagagtgaaactcntncc

SEQ ID NO: 22467 - DNA, 705 bp, Homo sapiens
  misc_feature 643: n = A,T,C or G
gggggtcatattgggggagttgcagggggagagaagtagggagaagggttgtcctctttctttctaacctcccctcagtctatcctgtagtttaaattccatgaaggtgctggccatgtctattttgatcactgcattgtccttagcacctatcataacatctagacaatagcaggtattcaataaatgttggaatgtgtgaatgaataagaatttcaggctgaaaaatagagggaagttgttttctgcattcttgaaatcaatatcatattcctgtccggggaactgactaaactctgggtctttaggcagatatggaagtgtccttggcacagattcagttccatttgcaggtttgtgttcagtgtgtcctgtcatcatgactgtaccactacgccagtccctgggaagtggacctggcaccttccttcaccctcacatcaacaggaggacagttggagcctgagttcaagtttacctcaaataaaagcatgaatgggtagtcacccagtatccaacttcagaccaaagtggccaaatattaaacagttagttttacagttggatttcaaaataatgtaaagtatgttgctttgctgaaatatgagtcagctaaactcttatagtgatgatttggggaccnttttataacatttttttggtttgaatattttttctaaatttgagcttcagaaatgacacatc

SEQ ID NO: 22468 - DNA, 873 bp, Homo sapiens
  misc_feature 10, 11, 13, 15, 17, 21, 25, 31, 39, 44, 61, 65, 66, 73, 75,660, 679, 695, 727, 746, 759, 767, 803, 855, 856, 866: n = A,T,C or G
taacgggctnncnananaccntgtnttgttncttttggnccganccggcctacggctgcgnatanncgacagnanggggaggcattccccgccttaatgcctcggtcaaacgtcgtccgaggtccgcttccaggcctcggcacctctgccccagggttgctggggtcggctgcggaacggaaatctctttatcatccgtgagaaaagttagagaggaagtgggttcctttgacagagcttactccagaagaaagacttgggtaggtccccggtaatcaagaagttcgtcggccctgaggaagagcctgaggcttggagggacgtcacccagctgttctggggcgcagtcggacctcaagtttctcacctctcaggccctggattccgtgaacccgactgcgaaatgaagtctcttttccccagaaccaggaagtcaggccagcacctgacagatgcctgtggcgccagcagctcgctgagcctccacacgattgtaattcgcttgtttctccggcctccaagcttccagggaattagaaagtggaggcggcttatgggatcagatgagtacattcgcagatgggggaaaaaaagtgtacctgtcagcttggaagccagagggagacaaagggataaaagcaaaccctgtccaggtgcggnggctatgcttgtatcccancactttgggaggccangcgggcggatcgcttgaggtcaggagttcaanacagcctggccacatgggngaaaccctgtctntactaaanacaaattagctgcataatgcgggcgcccgatgccanctctccgggctgagcagaaatcctgaccagaggaaagttgatgacccaatcnncctccttcanctggcaa

SEQ ID NO: 22469 - DNA, 796 bp, Homo sapiens
  misc_feature 1, 8, 18, 21, 29, 46, 501, 591, 608, 670, 675, 696, 698,705, 715, 719, 720, 740, 745, 756, 759, 761, 792, 793, 794: n = A,T,C or G
ncggcctncggctgcganagnacgacagnagggaaggacataaagnattttataaaaacattttatatattttaagattgaaaagtttaggcaaatgtaagggcagagcatcaccaaacattatagtgggaaaggatgtaagaaacaaagtctagtgacttcatttttaaataagcaaattgaggcacagggtagggcacaaaggttacacaaaccatattgaccaccatcgcagatcatccttagagacctagacgtgatagtctatctgaatttacaatctgaggcttcaatctttccactacaatcagggtctaagcaatgtttcctgaggagcaaattgccttgggctcattttttgagacttgttgaattgtagtccccttcatcagaatctcaaattcatatataaaggagtatcctgaaaacattggttgttatcaaaagaggtttttttgtgtgtttttttttgtttttttgtttttttgtttttaattttgntcctagtatcatgcctttggttgagcaacgagtcctgtagaggcaaatttatttggttgacttaatattctttatgatgatttacaaagnggacataagaccattanaacttcagtagtttaattgggcctacagacctgatgaaaccagtaatctgacagaacctagnggggnggaattcaacttcccaagggngngaccacncatggggcanaatnnactgtgccaggggcatttcntcaanaaaagtttccnagnanaaaaaaaaaaaaaaaaacccggggcgttttnnnaa

SEQ ID NO: 22470 - DNA, 763 bp, Homo sapiens
  misc_feature 5, 10, 22, 24, 25, 28, 177, 180, 184, 345, 514, 577, 604,666, 718, 729, 732, 736, 741, 754: n = A,T,C or G
acagnagggnatagttcgaggngnnggntttacatctttaaacaactttgattttacttttgtatttggtgatagatactagtctgttttcattcttctgcatatggatatccagttttttcaataccatttcccaccagtgtatgttcttggcacctttgtcaaaaatgagttcantgngggnacatttgtacatttgttacttttctctattctgttccattgatctatgagtctatttttatgccagtaccatactcttttggttgctataattctgtggtataatatgaagtcagaaaatataattcctccagttttatttatttatttatttttgcttangatagtattatttcttatagtgaaagcattctatgttatttattattagtctaattttgtagttttacaatgctatcctcttttacaaagctatgatcaactcagtgtgtccagatcaggatcatttgtagctatttgcaaaagtagcaatattctggctgggcatggnggctcatgcttatattcccagcactttgggaggccaagacaggcagatcacctgaggtcaganggtcaagaccagcctggtcaacatggngaaaccctgtctccataaaaaacaaaattagccggggatgatggcagatgcctgtatcccancactcaggaggctgaggcaggaactcacttgaacccggaggggaggtgcagngagccaaaagngtnttgnttcancctggtaccaacngactctgcc

SEQ ID NO: 22471 - DNA, 792 bp, Homo sapiens
  misc_feature 6, 27, 55, 482, 555, 575, 608, 615, 647, 652, 667, 670, 676,677, 681, 694, 708, 721, 748, 767, 769, 781, 784, 791: n = A,T,C or G
gacagnaaggggtggcgcgcgcggggnacttaaagtaggtatgaagacacagggnagacgtcgggccacaagggaacccactgaggtggggaccaaagatggtggctctttgaattggagccaagcgtggtgggcacccgctgagttggcctgtcataaagacggagttgacactttatccatggggcatcctactttccctacctgtcaacagtttccctctagagtggtatattttcaggtgaattccatttatgctattttctttccatctcatttgttccttcatcagtaggctcggtgatgagccttcccgagggcagggtcgatttcatgtttggttcacagatgtataccaaatacttcaaacaggtataccataaccattgaatgaatatgatggaccctaggggaaagacacggttctcctaatccagtccttgaggtgggtgagtgtgaaggcagaaatggaaagtaatggntacaatatagcgagagatcttagagtaagcacaaatccattgaccactgtggaacaggcaggatacaccaggnacacgagaagcaggaacacnccaggaaagggttgctgagaagtgacatttgangccggcncggtgctcactgctgaatccacctttgggtgncaggnggcggatacctgagncangactcnnaccngggaacccctctntctaaatcaaatanccgctgatccggncctgaatccactgttggagctagcagnatccttaactgagcaagtncntgacaaaaaccntgntccctgna

SEQ ID NO: 22472 - DNA, 313 bp, Homo sapiens
  misc_feature 10, 27, 36, 111, 120, 243, 261, 269, 275, 279, 291: n = A,T,C or G
gggatggacnataatcagtcacagaanacctttaanaacaaagagacgttgattattgaacctagaaaatgcatcccgtattgaatctctggaacaagaaaaggtgatgangataagaangaaagaagatgagtctactgctctagtgaagaaatgagaagatgactcggatcagatctgaacaatagacaaaccctgctttgtactatgccacctttagtcccagcgctctgtgctgtcacnctctttctagtcagcacnctctactntaaagntcanccactcaaattntcaaaaaaaaaaaaacctggcc

SEQ ID NO: 22473 - DNA, 751 bp, Homo sapiens
  misc_feature 6, 7, 9, 12, 43, 45, 47, 55, 76, 493, 530, 540, 577, 579,591, 592, 593, 596, 599, 600, 604, 605, 629, 634, 651, 654,663, 671, 690, 694, 706, 717, 719, 724, 725, 727, 731, 732: n = A,T,C or G
attttnngngtncgaaaaccccttgcttgttgcttttggccgnancnacgacagnagggatgacatatttctgagnaacactttaatatatttccacacctactggaatctaattcagtcgatcggataaaagaaagacttttttgttgttgtttttgaaaatccataatgtagcaggttctgcgctggttttttaatgtattttatttttgtgctctcctgccaaaagaaaaggctgataagtaagtacacagtacaacatgtaaatttgtataaaaatatgcttgtttagattgctctacaataactatattaaggtaaattgtgtgtgtgtgtgtgagagagagagagagagagaaacagagggagaattgactcaatgtgttttctatgaagagtcttagcttaagaatcaggtaacagagaggtcctagaccatagacccagccatcaactagcttgctgatgttgaacagatcaactctcaccatanactgaagatggaatgaagattcaaaagttccttttancactgactanattttttttttttttttaaaacaggggcctccttttncnccccgggtggannnaanggnngggnngggctgcttgaacccccttttccngggtnaagggatcccccccccnccnccggagggnggggttangggccaaaacccccccccnttantttttttttttnaaaaggggttncntttgnncnaaannggcaaaacccggcccaagg

SEQ ID NO: 22474 - DNA, 810 bp, Homo sapiens
  misc_feature 2, 12, 15, 23, 25, 425, 489, 502, 505, 553, 570, 578, 585,605, 616, 619, 645, 646, 658, 690, 704, 713, 728, 748, 758,761, 769, 777, 786: n = A,T,C or G
tncggctgcganagnacgacagnanggagttatggtcttaggctatgccacacaatgaggaatagaaaatgccaattttcagagtgaagagaacatgaattaggaacaacgttgaatgctggagggatgtagagaatgactgttagtgtaccctaaagttaatttttataattaaaaccatcagcagcttctgggaactatttatgctgtgctattagagggcacaatattggggaatccaatctctaccttccatgggctctactctagttgtggagatatttaagtcagcaggccattacacaagagctatggtaaaggtatgagatcacatggtaggattgagggcaagggatgggacacatcacaccaaaacagataatcctctaagagacttgaaatataacagtccctgaggcatttangagtccggcagttcggtcactgatctccctgtgctatgaaaagaacctcttaactggtcagtcnttcagtagaatcntantcttttcctgcctgatcctaactggggttaaggagtcagtttgttgcnggtgaagggaaagaagngaagcccntaaaagngtttggtggttttggtgcanaacaactttanagngacatgagtaataacttggatttctnnctcaggggcttnttcagggtaaactgctggcagctggtcaagcnctcagcctttcagnggtgtttgncagttgaaaattggnaggttcagaaactcctggcncctttgggtntgngctcgccnctttgganggaggtganttgttcctgccccctttttttatt

SEQ ID NO: 22475 - DNA, 687 bp, Homo sapiens
  misc_feature 584, 595, 645, 656, 658, 675, 685: n = A,T,C or G
ggggagaaaattcattttggaggtagttggtccatatgcaatgagtagagcaaaccatcaagcattaattgacattagggtcaattcagcattgacttgagtttgtattgacttaacattgagttcaagcattaattgacattagtgtttatgttaagaggattgggccaggcacatcagcttacacctgtaatctgagcgctttgggaggccaaggtgggtagatcacttgaggtcaggagtttgagatcagcctggccaacagacgtgagccattttcccagcctgttttttgtttctttaaaaaaactgatagggatttttatggatatcatgttgaatctaaatcacattgggttattatataatcatttcacaatattaatttttccaagctatcaatatgggttgtagctcaatgtttttaatcattttgatcaatgtttgtagatttcaaggtacaaacttctgacctttgtacgtttatttctaagtatttctttaagttctccagcaaatggaagtgttttaaaattttcttttaaaattgtttattgtaaagtatggaattcaactattttggngctgatactgnatgggcaatcactgacttgtactagttcagtagatttggtggctctttgngatttctccananatatgtatctcaacaantaattacttntg

SEQ ID NO: 22476 - DNA, 800 bp, Homo sapiens
  misc_feature 4, 12, 27, 38, 40, 41, 56, 58, 61, 69, 75, 80, 83, 118, 599,604, 649, 665, 676, 684, 696, 709, 713, 733, 756, 762, 768,769, 778, 786, 788, 793: n = A,T,C or G
tttncctacganaacccttgcttgttncttttggccgnanncggcctaggctgcgnanagnacgacagnaggggnaaggnggnagcaaaggcacaccttacatggtggcagagcaagnacaccatcacacatacatacacacacacacacacacacacacgaaaggtaagagtagaagttgtcatcattttagctcatatgcagtgaattccatgaccaatagattgtgcagaaaatctgtctacttctttgtcttactcactatcatgagaacaacacaggaaaacccacccctatgattcagttacctcccacggggtccctccatgacacgtgaggattatgagagctacagttcaagatgagatttggtttgggagacagccaaaccatatcaccatctttgcaaaaataaaaaaattaaaaagaaatcatccatacttctttgtatccaatctttacaggtcaactccaaagttaatactgtaggtatagatgttgacagacacagaatcttttatgttaaaaaaaaaacttacacatatttttggtttcatcctcaaggtttactatataaacatctagtgaacttcttagtnttagngaatcaaatttgaagtttttggcaaagccaaattatgactggggnggggcatgtttaagtnttcaggtctcnacctgccnaattttaagggngggagttttactnggcnggtttaaaaccttggttttnaaaaaaaaaaaaaaaaaaacccngggccnttttcnnaccccatanaaaacttngngttgnccccccc

SEQ ID NO: 22477 - DNA, 746 bp, Homo sapiens
  misc_feature 1, 19, 22, 30, 458, 495, 554, 585, 598, 621, 638, 643, 669,670, 680, 682, 711, 714, 717, 718, 723, 725, 740: n = A,T,C or G
ncggcctacggctgctagnagnacgacagnagggatggatactaaaaggaaataacactaatgcttcattcatttttttattccaaataattttgctaagccccattacatagccaactcactgttagacactttgttttaaaggtgaaagagttaatacatttgcttccaaagaacttactagtaaagttacacacacacacacacacacactcacacacacacacatacacacacagagaatgagagagagaattacgtattctataggaaataaaggtaatatagaaaatctaaactaccattcaactgtaaattttttaaaaagggggtattttacttatacaattttgagtgataaaaaaggaacatcttcaaataatgagtctaaaagaataatgcaggttgtccgggtgtggtggctcacgcctggaatcccagcactttgggaggctgangcgggccggatcacgaggtcaggggatcgagaccatnctggctaatacagtgaaaccccatctctactaaaatagaaaaaattaggcaggcgtggnggggggcacctgtgtcccagctactcaggangctgaggcagganaatgcatgaaacccgggaggcanagcttgcagtgacccanatacncactgccctccagtctggcgggaaannaagactccgntnttaaaaaaaaaaaaaaaaaaaaagggccnttnccnnacccnanaaaaacttggggtgncccccc

SEQ ID NO: 22478 - DNA, 785 bp, Homo sapiens
  misc_feature 1, 8, 18, 21, 28, 570, 576, 585, 587, 602, 608, 612, 613,614, 617, 645, 657, 658, 682, 685, 689, 692, 705, 716, 717,726, 749, 761, 762, 769, 773, 778, 780: n = A,T,C or G
ncggcctncggctgcganagncgacagnagggggtacttagtgactgatttgtaatgaattaactacctgaggaaataaaaattgttatcacatgttaaatcattatcatcagaacaaaatctagtacttgccaatgtactatttagttctctaattctataatgaatatctcttgggtatatctgaggcaatcaagaacacctacgaaaaggaaaagattcctagatgaaaacgatgtttcagagcatctacactcttgaagcttaggtgcttgtgaaaggtgaaggagctaatatgtagaaaggcatatagaacagtgtctgacatataccatgtaaatgcttaataactgttagctgttgatttgtacaaaaagagatacaggaagggttgaatcatagactaataatattgattatctgcagcaggtaggtgagaatgtgctggaaaggactggggaatgggaacagagtacaagcaatgaaaggggagtgacagttctctgacttaccttttgtatgctttggactcttaaacctatctctctctctggctctctctcttttttnttttanacacacacncncaccacacacacacncacacncacnnnttntctttgtggggacaagggaaatctacanctttcaatgaanncattttgctccatattgggggganaanaaanatntaaatcctttttntttccagatanncaaaaaaanttttggtacaaaaaaaaaaaaancccgggcctttnntatcccnaaanatttntnccccc

SEQ ID NO: 22479 - DNA, 861 bp, Homo sapiens
  misc_feature 2, 4, 14, 33, 44, 46, 50, 63, 75, 486, 506, 598, 625, 644,656, 668, 676, 696, 698, 723, 733, 755, 758, 763, 767, 771,774, 778, 786, 807, 809, 823, 835: n = A,T,C or G
antntcttggggtncgaaaacccttgcttgttncttttggccgnangggnagcacttaaaagnaagttaacaagnaagcattttatatttattgggactttttgttgcattatttaatatcttggatattctttttgatggttgcattggatgggtagttgcatgttgatagattatagcttacttaaccatgaacatactgatgaacatttgggtctcagtcaatcaattatttattcatctatccaaccattcatccatctactttaattgcagttagacagttgactcttctttgaatttttttttgtttagaacagggtctcactcccgtcacccaggctggggtgcagtggtgtgatcactgctcattatggcctcaacttcccaggttcaagcaatcctcccacccttctcctgagtagttgggactgtaggcatgtgccaccacacctggctaattttttgtatttttattagaggcanggttttgccatgttgcccangctggtctccaactcctgggctcaagagatctacccacctcaacctcccacttctttgcatttctgttgaatttcagttcctgcagccccanagtctggtgggtcctgcatcccactgnctcttggctatggctaagnctggcagaccanaatctgaaaagngcagctgngcttacctcttctctgagangnagacccctgccggaacaacagggangggcctaggngactttgaactcaaaaaccttnttntttancaanattnggnttangccaacancagctactttttgcgggggcntngaacctgcgtttcntttaaaaaatgnggactagccctgccgcctttaatttt

SEQ ID NO: 22480 - DNA, 691 bp, Homo sapiens
  misc_feature 21, 394, 422, 530, 578, 585, 591, 598, 655, 659, 678, 682,684, 690: n = A,T,C or G
ggggtggttgaaatgctctgntggaagactcccattataccagcatcagcagtgtggaggggccagccagtaaagtgatctctctctggttggaatatgtagagaaaaggagacaacaccgtcgcccagaagtggaggttgccatattacttgcacaaacctcatgccgttaggtcttcagccacagccgatatttgcagagatgtatctccagcgatctatctccagagatggaacctggagaaatgaccaaacttgacacagccttcaatggttggataaatagctcattaacccaattagtagagaaagctgtgcaatccaagcactagcactgtttgtaggagttattaatggataacacaatgtattattaaagggcaggggtttttgnttttctttttttgggtttaagtcaaganattgtcggccaagcacagtggctcatgcctattatcccagcactttgggaagctaaagcaagaagatcacttgagctcaagagttagagaccagcctgggcaacgtancaagaacctgtctctacaaaaaaattcaatgaattaaccaggcctggnggctgcncctgtngtcacanctctcaaagcaaagtgggaccattgcttgagcaagaggtgaagctgaatgaaccctntctnccctgccttcaactggcanaaananaccttnt

SEQ ID NO: 22481 - DNA, 830 bp, Homo sapiens
  misc_feature 6, 12, 15, 27, 38, 40, 47, 57, 60, 68, 568, 583, 604, 615,619, 629, 653, 667, 689, 691, 709, 722, 745, 762, 772, 803,804, 806, 823: n = A,T,C or G
ttaccntacganaanccttgcttgttncttttggccgnancggcctncggctgcganagnacgacagnaggggtaaatcatggtcagttcttatgggccttgtaagccaagttaagaacattcaagatgaaagaacatgaggaggttgacagttcagatggacctccctggcagccgagtctgtggagtgaagggagggaagttaaaaacattcgagatgaaagaatgtgaggaagtttgcagttcagatggacctccgtggcatctgagtctgtggagtgaagggagggcacgcttggaggcggggccttcaggccttcctgcgcttgtgtctgtgagataaaggcctgaactaaggtaacagggaaggagaaaatgaaactgaaggaggtaaactggaatttggagactgacgaggagagaaaggaaagcattccagggaaaccccagttttttgcttggctactttgggtaggtgatggtgtcattaaccagaatcaaaatgtcagtggtagattagatttgagtggggaaataaaaagttctctttgagatcaccaaatttgangtacttgtggatttnccagaggcatcctcataggcncttaggaaganagcnagggattcanggtgattgtgtaggtagcaggtanccaagcgtaaaganactccaggaaaagttgtgtgananaacaaacctagacaaaanctgaaacaaaatnttgggctgggaagggactgctanttcctgaaggatgcctnaatccatccnaaaaaaaaaaaaaaaaacctggcccttttcnnanccattaaacttgagtgnccccccc

SEQ ID NO: 22482 - DNA, 757 bp, Homo sapiens
  misc_feature 417, 419, 480, 497, 533, 543, 569, 620, 622, 627, 630, 651,658, 666, 674, 683, 708, 718, 719, 745, 747, 751: n = A,T,C or G
ggggaaatgtttgttttgaaggcagagtaatagcaggctattcagtgtttgcaattacatgaatcattgctatggctgtagctagtgcactacaatttcctaaaaagtcttgtcactctcataggactgctctacatctggcctctgccaatgggaattcaggagtagtaaaactcctgctggacagacgatgtcaacttaatgtccttgacaacaaaaagaggacagctctgacaaaggtatgcagtagccaactatatcagcatgaggccgtacaatgccaggaagatgaatgtgcgttaatgttgctggaacatggcactgatccaaacattccagatgagtatggaaataccactctacactacgctatctacaatgaagataaattaatggccaaagcactgctcttatacngngctgatatcgaatcaaaaaacaagcatgggcctcacaccactgctacttggtgtacatganccaaaacagcaagtggngaaatttttaatcaagaaaaaagcgaattaaatgcnctggataganttggaaaactgctctcaacctgctgnatgtggggatcacaagtatagtcagcctttacttggcaaaattggtgttcntntaaanctnttggcaaccgcaaaagatgcnggtctanctatctgnatttgcantactttgcncaaaaaaaaagctaaatttttgaanccatccacannttaactgcttaggaagccaggtcagngngaanaccccc

SEQ ID NO: 22483 - DNA, 683 bp, Homo sapiens
  misc_feature 2, 9, 21, 365, 423, 453, 584, 615, 629, 630, 632, 646, 647,649, 656, 657, 664, 666, 670, 676, 677: n = A,T,C or G
gnagacagnaggggcatcagnatatatttatacatatatatttacctaactggaaattccaaagcatgcagcatgacatgctttggtcatcaggactgtttttctctatatgttttctgtgttggttttattttctaccattcctgaggaaaacctatagcagtcttatctgcaggatgagaaattcccccaaaggactctgattcaccctcatggtaccacacctgtacctgtccctggcttctggggcttggaggggtctgttattggtagacttgggaaggtgagtgcacaggagaaagcacatatgggctacacctgagagccctcgtctcaatgcggtgctttgttgatctctgatttangaatctccacatcctatcccacagactcagttgcccccaaagctgaatgacaccttgntccttgccctcccacagattactgactctncggattatctctgtacagctgagccactcattaagtggtagattagcaagatattgctctgaggaccctaagtatttgacttgctctactgacaaacttatcattcttggtttcccaaggaaaacctgagngcttttggtgcccccccctacccccttcaanaaccgttcctaaanntnacaaaaggaggatnnanccccaannggttaancncccnggctcnnattttc

SEQ ID NO: 22484 - DNA, 403 bp, Homo sapiens
  misc_feature 6, 11, 260, 389: n = A,T,C or G
gacagnagggnattgtgcatgacgtacttattggcaactaatgaaattgggcacctttttatttatttattggctgattagatattgaggccattatttaagaaattaaactaaaattggtccaggcccagtggctcacgcctgtattcccagcattttgggaggctgaggtgggcagaccacctgaggtcagtagtttgagatcagcctggccaacatgatgaaatcccatctctactaaaaatacaaaaatgagccangtgtggtggtgggtgcctgtattcccagctactcaggaggctgaggcaggagaatcacttgaaccaggggggtgcaggttgtagtaagctgtgatcacgccactgcactccagcttttgggcaacagantgagactttgtctc

SEQ ID NO: 22485 - DNA, 822 bp, Homo sapiens
  misc_feature 2, 14, 18, 34, 45, 47, 54, 66, 74, 93, 94, 112, 506, 512,521, 547, 568, 571, 577, 593, 605, 612, 613, 614, 629, 639,648, 649, 656, 659, 660, 671, 672, 693, 718, 722, 745, 754,788, 795, 796, 797, 798, 801: n = A,T,C or G
antaacttggggtncganaaaccttgctttgttncttttggccgnancggcctncggctgcgagtntcgacagnagggggacactactccagnnatagtggaatatcttggntacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattggatagtatattctatattatttcatanatctgnctgaaaganattgggaacaaaatatctaatgaaanaattctttaatttttacatancancttttntttttttttctggagntcacgaaacagncctgttnnncctgatttaatttcnggatctgccntttttttcnntgtttanaannctttatttggnnacattttacctttgcaattantcccaccgcaaaaaaagtttttgantttnaaaaaaagggttttccccggggnttttaaaantttgaaaaaaaaaaaaaaaaaaaaaccggggggnttttttnnnnccnataaaattttgggggcccccc

SEQ ID NO: 22486 - DNA, 759 bp, Homo sapiens
  misc_feature 2, 9, 15, 21, 314, 357, 466, 511, 518, 565, 599, 601, 628,635, 668, 710, 717, 718, 727, 731, 746, 753, 759: n = A,T,C or G
gnagacagnaggggnactggngtacagtggtgcgatcatggctcaccacaacctccgcctcccaggttcaagggattcccctgcctcagcctccctagaggcacgcgccaccacacccggctaatttttgtatttttagtagaaatggggtttcaccatgttggtcaggctggtctcaaactcctgacctcatgatccgcccgccttggcctcccaaagttctgggattacaggcatgagccactgtgctcggccttcacagttttttttttttaagtctattgctaatgcaacagctatgtagcatgcttaanccaaaacattgataacaatttggcaaataaacagcatgccagngtgcaagccaagcctctaaactctcaaacttttattctgctaaatttccaccgtagtttttagtcctaggaatatatatatcttaggctaaaacttcaaaatcatgggngaatttttggatggcctaacttatttaagtccacaaacttaaaanattgggngggatcactggctcacgtctgtaatcccccacattttaaaggctcangcaggatgactgcttgagcccaggagttcaaaanancctggcaacataatgaaatcccgtctntcaaaanacaaaattaacccgcttggggggccccctgttntcctacctctcagagccagggggggattgtggacccagaggnaaactcnnaacccgttngctntgtttcaccgggaanaaaaaanttgttn

SEQ ID NO: 22487 - DNA, 805 bp, Homo sapiens
  misc_feature 2, 9, 36, 609, 688, 719, 754, 760, 763, 803, 804: n = A,T,C or G
gnagacagnagggggaaagctgcctgtgacttgagnaaattgctcttactccctccttttctgttccttgtcagtgccctgaagtaaggagttgtagagttgggctcttctctgctgtggctgggcctgtgggaggcagctcatgagcctgactgccctagtgaatttcttcccaggtgtagtttttcaggtcacaattgaagcagtactggaaatgactctttgctcctaagaatcttcgagacaaataaggacttgggttaaaaaaacaaaacaaaacaagactgtttctattccattttattaattcagcagaagtcatactgaagacttgttcttctcctgttctcagctgcctgtctttttgccttttgcctctggttagcccatgtatgtgccaagtgtggcagtaaaggctgagtagtttttgaccacttactatgtgccaggcactgtgctaagatctctctgtacattgccacattcttcaatggcagtttgaaataagttctatcattattatccccattttaaagatgggaaaacagactgcaagaacttaagttgttacccaaggtcagaggcaatctgatgttcaaatccggtggnttctaaccatattgccatagttcctcttgcaggactatgcacctaaccacttgcagggcttgctggaggcagtacaganctgcgtccagagctgaggatggaatctgatntgaaacagtctcacaaaaaaaactttgacaatttntaaacnttnaatcctgttagcagccttatccaccttggagcgaaggggnnc

SEQ ID NO: 22488 - DNA, 756 bp, Homo sapiens
  misc_feature 160, 600, 665, 680, 703, 706, 709, 731, 738, 749: n = A,T,C or G
tgtgcgtgtggttggaagattacatggggaacagtgtgtgtgtggagggtttgatggaggacaggttattccctcagtgcctcttgacaccttccatgtggcctagtagaaatagaactttttccttggttcttagacattttaatgaataataatggcngctaattcttaggaacatattaagggctaaatagattttatgctattttatatttttaccttatttaatcctaaaatatattctgtggaataaatactactatcatttttattttacagattaggaaacagttgtagagggtacatggcacatcttgagttacacagccattaaccagtgaaacggggattacagcctggggatctgaattccaaaggccagagtattaagcagtatgctattatcactcatctttctatgtgcacatgtgttatttccatatccagagggcacagcatgcataaatgcatttattgggcatctactatgcactcggtatgtgatggacagttccacacaatattatttgtgttattccctcacatagcctggacaggggtatcttcttttaatagatgacaaactgaagccaggagggngcattgctggttttttttattcttgcctaagggtccattgatttctccctgaagtttggaagccncttctaatcttaacnctttatttcctgggggatggctntgntgncctgcaaagcttaaatggctgnagacggntggttcccatncaaacaa

SEQ ID NO: 22489 - DNA, 779 bp, Homo sapiens
  misc_feature 1, 2, 10, 551, 625, 627, 692, 693, 701, 736, 754, 763, 766: n = A,T,C or G
nntcgacagnaggggggtatgaaggagaaggggagctggtgactgagactgggtaggagcagtcagagaggtaggagacagaacaggagggggtggagtgaaggaaaggaagaaaagtaagggcttaagaaggacttggccattctttacacaaacaaggcagacaaattcagagcagagacctgggatagtgatgagtgggtttcttagtgaccatagtgagaatggttcattggcttggtgaggacagatgcttatttatggggctcaggaagaatgggaagaaagacgtggattttataaatgtgtgctattcccttaagcagattggcaataaaaggaaggaaaactttgaaagaaacagggtaaagaaatgatctgtctccaaaagaggcaattgtcttggtcatccaggaggtaaaggcaaaggcttgaagatgcaggaaatggtggggacgatggagagagctggcagggatagaatcaggagcatggctggagggattggtctcaggaagaaatagagacactgcttcaagattggagggaangctgggcacagtgggtggctcatgcctgtagtcccacaatttttggaggctgaagtaggaggattgcttgagtncnggagttcaagatcagcctggccacatagtagatcccatctttgcaaaaaggaaaaaagttgccannctggggcncatgtttatcttcccctcttaaaagtaccctgctnttaaaaaaactgaggcanaaaaaactngtngataccttaactt

SEQ ID NO: 22490 - DNA, 779 bp, Homo sapiens
  misc_feature 9, 12, 540, 627, 630, 709, 767, 774: n = A,T,C or G
aggtagggnagnaagcgctgttccttctggctgggaagtgcgagccggtggggggagagagaggagtagagcattatgtggaggtacttcccggttcccttgcgtctgagggtcttatgccagaggggatagaaagcccaacagaaactcaagatagaagaaggagaatctgcgagtgtctgtctcctgtcaagcttccctaatacagccctggtagaacttcatcaacagtggaaggcatttgcaaaggtgagcccaaaccagcacccctttccacacaggctgtccatgtagaaggcccagatgcttctcagggtctctgagaggatacaaagctactgagggggccagagggcacagcacctgggatttggatgagaagctgcaggaagggaactttgcaccccaagggcatggtgtggagtcaatagtggcaagttcagtctggttttttacatcagccggttcagaggaagagtgaaatccccaagatcagcagggcaaaatgctggaagttgtcgaggatgcagagagtagcangaagacacctctgagaactcactcacacaccctgcccctgtgtagagatgtcatcctggggatgagaaggaggaagacagagaaacncanaaaagcctaagcaggcaccacaaaagaccgagcccgtctgaaagagctgctctaacctggggaaactattttagtgccncagacattcattccaagccttgaaaaaaaaaaaaaaaaaaaccctgggcccttttacnaaaacanataat

SEQ ID NO: 22491 - DNA, 685 bp, Homo sapiens
  misc_feature 655, 666: n = A,T,C or G
gaggctgaggtgggcggattacctgaggtcaggagttcgagaccagcctggccaacatggcgaaaccccatctctactaaaaatacaaaaattagctgggcgtggtggcatgcgcctgtaatcccagctactcaggaggctgagacaggagaattgcttgaacccaggaggcggaggttgcagtgagccgagtcccaccattgcactccagcctggggaacaagagcaaaactttgtctcagaaaaaaataaaaataaataaataaaaataaataaataaaggaggccaaagcatgctttacacaaaggaagccctgtttggtaagggagtgagacctgttggtttatagttaacactgtcttatgttttttcgattgaattgctaatgagtagttttctttggctctaaataacaatgttacataagtaggttgagagcctatattacctagtataaactcagtgctgctgcagttgataaatggagctatgatacaaaaacagatggctcaagtgggatttcagattgattatctgagggttgttactcacctgagtatgtctcctctttgtcacagagctggtaacagagagcaagctgtttttggctcaaagctctacagcaatattcttcaactgcctggtaaggatcantttttgttttnatttttatttcatcctacc

SEQ ID NO: 22492 - DNA, 746 bp, Homo sapiens
  misc_feature 15, 168, 169, 170, 628, 657, 680, 711, 720, 741: n = A,T,C or G
gggggaaaatagggntagctattatataatagggaaaataaatgatcctattttggcatttgtaaaactaatttattgaataattcatatttctggactttgcaaaatcactgaaagcatttagtctcacttaaggaacttaagttatccaaacccctcggtctcggnnnttttttaaaaatctatcaaaaatgaagtatttgaattaaacttcagtgatatcttgtattcgtttctcctttagggttcaatcccatttttggatttccagactgaagtttcgctttcactataatcttaaaagcatgttaagaaaagaactgtgtgtttacaaatgttaacaagtcatctgttcacatttagcagcacactaatatttttagtaatttcagtaaaaataggtcgggtgcaatggctcacatctgtaatcctagcactttgagaggccaaggtaggggggtcgcttgagccccaggagtttgagactagcccgggcactgtagtgagaccctatctctataaaaataataagtaaaaatggtagagtaatttcagtaacattatgtggttcactctatgtcttaaaataaggatgataagttagtgtaaggattttagactttcttgngaggggcctgtattaatattcagggactnaacaatatggttctaatgagagnggccacatttggcacgttccttttcatttcnaaacagggntatgattctcgagcccaaaanatgcc

SEQ ID NO: 22493 - DNA, 761 bp, Homo sapiens
  misc_feature 534, 596, 615, 633, 641, 648, 656, 710, 729, 736, 744, 748,749, 751, 752: n = A,T,C or G
ggggttataactatcttttgggaaaggatgccattcctaaaattaactcccttctggcaaatttctccctgccaggtacctaacctccccagcatgatgtttttctaccatttgccttttggattcctagaagtattttatttggatgtgactggtttgaatttggagcttttagagcaagacatttggaaagatagcatgtgagtgaatttatgtatggaatgaatgacatgtgagaaaactcttgttagacatgatgtttcctatacagaagaaaagatacaaacttgattgcttcagtaaaaacacttttagagattgtgtttccttttttgtgagacagcatctcgctccgccacatacactggagtgtagtggcacaatcttggcttactgcaacctctgcctcctgggttcaagtgattctcgtgccacagctacccgagtagctgggattggatgcacccaccaccacacccagctaatttcgtatttttagtagagacggggttttaccatgttgaccaggctggnctcgaacccctggcctcaagtgatccacctgccttggcctccacagtgttgggattacaggngttagccaccacgcctggnctagacatatttctaaanaaattaanatcttangctgaggnggtggatcacaaggcaggagacgagaccttctggctacacgggaaacccatctntctaaatacaaaaaaatanccagggngggggggngccnnannccactcttg

SEQ ID NO: 22494 - DNA, 613 bp, Homo sapiens
  misc_feature 292, 388, 404, 411, 423, 442, 447, 466, 485, 508, 510, 519,532, 585, 586, 587, 589, 606, 610: n = A,T,C or G
tatgttgtagtcccaaattaatagtaatgtactagattttcttctcctctcttgtgaatttccagcaacagcttgattttaacctccacagaaacacaaatgagagctgtgatggaaacaataattactagagtccagttttaactccaagtcaaaattttagtcacattcagccctgaataagaaataaggcaaagcatgcaacaggactttataactttttaattttaaggcattataaatataaatttttattttatcttatttttttagagatggggtcttgctctgntgcccagacaggagtgtagtggcaccttcttagcttactgcagccttgaactgttgggctcaagcgatccttctgcctcagcctgctgagtatgangatgccaaggcctaanaatgacncatggactttanggactccgggggaaaaggngtganggataaaaactccaattgnggcagggatactgctcagngtgagtgccccaatctccaatcncnctaagactnctctgtaccaacncccctgttcccataccttgaaaaaaaaaaaaaaaaaaaccctggcccttttcnnnanccactgaaaaacttgtngtgnccc

SEQ ID NO: 22495 - DNA, 773 bp, Homo sapiens
  misc_feature 429, 443, 451, 487, 522, 538, 606, 638, 663, 701, 711, 712,714, 727, 734, 742, 754: n = A,T,C or G
gggatttccaaaggggattctttcatttttattaaatgagcttctggtgatgcaaattaaggctctcataaaacttgacctctgaggcaatattaaaatgatgaaatttaggcttagtgaattctactgttatcatgttcaataacatttaaggacataaaagaattttataaaaacattttatatattttaagattgaaaagtttaggcaaatgtaagggcagagcatcaccaaacattatagtgggaaaggatgtaagaaacaaagtctagtgacttcatttttaaataagcaaattgaggcacagggtagggcacaaaggttacacaaaccatattgaccaccatcgcagatcatccttagagacctagacgtgatagtctatctgaatttacaatctgaggcttcaatctttccactacaatcanggtctaagcaatgnttcctgangagcaaattgccttgggctcattttttgagacttgntgaattgtagtccccttcatcagaatctcaaattntatataaaggagtatnctgaaacattgggtggtatcaaagagggttttttggggggtttttttggtttttggtttttggttttnaatttggcctaaatcagcctttgggtggcacnagtcctgtaaggaaaattattgggngcctaaattcttttgaggattacaaaggggcctaaacntttaaactcnngnttattgggctccnactgagnaaccgatntgacaaaccttnggggggatcacctccaggg

SEQ ID NO: 22496 - DNA, 833 bp, Homo sapiens
  misc_feature 2, 3, 9, 12, 19, 20, 31, 42, 44, 51, 61, 64, 71, 653, 701,708, 739, 756, 788, 792, 795: n = A,T,C or G
anntttggnctncgataannctttcttgttncttttggccgnancggcctncggctgcganagncgacagnagggaaaaacattttaacaggagaataattgctagattttaatttttcaatgatgtttctataatgtagagaaaggattgtgttggagtgaggcaaagataatatttattttgattaccgaattttttgatacttgcttaaatttagtgcttgagatgagtgcttcactcagtttaccctaatctggccctggttgaattaacaaaccttagaatggttagatatgttaagtgagggagaagataagccaaggtttaatgtagtgttctgaaccttgaacaactgggtaggtagtggggttattaactgagatagtgaggaaaagccagtttggggcaatgttgataaatttagttttgaacatgttgcattttatatgttcttggaatatttaattggagttaccaaacagttatttggaaatacaggattagagcttagaagaaatgtttgcactatagatatagatctggagtcattagtatatgggtagcataaaccatgaaatgaagatagataactaaaagctagaagagtaagggtaaaaaaaaagtggggtggggggataggttcaaacttcanaaaccgcccggatttaaaagacaggcaagaggaaaagccccaaattanagcttanaaaaatgttgcactatagatatagatctggngtcattagttttgggtngcataaccctgaaatgaagatagatactaaancttnaanagaaggtaaaaaaaaaaaaaaaaaaaaccccgggccct

SEQ ID NO: 22497 - DNA, 663 bp, Homo sapiens
  misc_feature 62, 384, 464, 494, 495, 507, 511, 512, 531, 553, 556, 563,575, 586, 596, 601, 608, 623, 636, 638, 647, 649, 654, 662: n = A,T,C or G
aggtacctgggagaccctaggaatgttgatatatagatatgaaactccataaaagtgtgatnacctcatcacctataaaaagttgatctgggctgactaatcaatatttggaagtcagaggcagtaaaatgacaaataaaggccttgggtgatgatgagctctctcagggaaaatgtttaaactgcaacaagagaagaaccttagggaagtatcaacatttaaggaatcagttggaaaatgggagcctacacagtagactatgaaggaccaaccaaaaagaacaagaactgggtggtatcatggaaacccagggaagagagggcttcaaaaaggaggatgtggtcagctgtagtgaatattactgagagattgtgatggctgangcctgagaagagactactagttttaacaacagtgttggtggtaacattggtcataatagtttctctgaaggggtgaccanagagctccagaatgaggagaggtgagtgcnnaagtgaagaaangacnnagacacacttgtaagtttnactgtaatggaataaaggaacnagnctaccangggcatggttgnaggccttttcnttttttttanaaganaacttgntgtgttgaatctgtnggaatgaccaaangnggaaagttnantccanaacaaggng

SEQ ID NO: 22498 - DNA, 745 bp, Homo sapiens
  misc_feature 1, 9, 25, 632, 681, 717, 730, 738: n = A,T,C or G
nacgacagnaggggaaagcagcagnatagtctgagaggtaacaggatacagtatactgtaggatcatctacatcacccaaccaagtagggttggactttgacttttaccctgagtgagatgaaggcactgaatggatttttagcttatttaacagttgtttaatttaatatctaaactaaatcctctctatccacattctgtaattcaactcctaaatgtttcttcctaggcctttttaagaatgataactatatcatataagtttaagaacttttttagtcaataagttcagtaattattatatcataaggaccctcaactcaaacctcaaagtggtttcccctaagtataatctttagtagcagttgacaaaaataccaagggggtaaaatttcaaattttaccatttttattcagtactagtcacgtcataaaactggagtgttatcactactgtttagagatcctcttagtgttctatcaataaagagtacatgtatataaacaaatattttatcaaagattaaatgcatacctataattacatctatcatcttagatctgtaaaaaccaggttttcttccaggaccattagtttgatgaagattttttttaaactactaattctcangctgggcatggtggctcacacctgtatcccagcactttgggaggcctangtgggtggatcactggaagtcaggagttcagaccanctggccacatggngaaccccntcctact

SEQ ID NO: 22499 - DNA, 878 bp, Homo sapiens
  misc_feature 13, 14, 15, 16, 23, 26, 51, 60, 63, 83, 84, 85, 88, 95, 109,114, 120, 123, 265, 273, 275, 537, 593, 622, 649, 673, 678,679, 730, 755, 765, 766, 775, 784, 789, 806, 809, 815, 823,827, 829, 830, 839, 843, 847, 848: n = A,T,C or G
ttttgtttttttnnnnggaatantgngggttaaaaaacccccttttttggncttttggancgnctcggcccttacggctgcgnnnagnagacagnaggggttgcaaagnggggngagggntgngcagttttgcaaatatatctcaccgcagaaagatctcctttcctaagaagactgggaagaacggctttccacttgccagtaatgtgtcctctggtttcaattgagccatcagtgtctgtactccagcctgggctaccaagcnatgggggnanctctgaaaaaagggtagcaaggggacagagaagagctgtctggatacacgagattccaaaaacctaatcctgagataaaattccctagggaattgctctaccgagagtagagatttgacctggaaagagaagggagagaagtatttaatcattaactcttttaatcctcccaacaacctttttagtatcatttttcaaatgaggaaactgaaatgtagaaagattatgtacactgttgaaggtaacactaagccactgcctncttcatatcaagaatagttggtcatcgagcaaataaagggagggaaagacattacnagcagagaaatcaacatacacactattgnggctggacttcaggctacaggggggtnccaatatttattgcaaggccctgngtacnngctgaggatccagagataataaaccagctgtcctaagccggtgaccctagngagagaaccttaaaaaaaacatgcngactaaaaanngctggaaanagctatgtnccggnttggaaagataaaaaanccnccgggnaaatgganaaancnngaagggtgntttncaanncaaaaaaaaaaaaaaaccccgggggctttt

SEQ ID NO: 22500 - DNA, 769 bp, Homo sapiens
  misc_feature 558, 614, 669, 688, 692, 707, 717, 719, 721, 724, 733: n = A,T,C or G
gggggtgtggtctcggtgtagcacgatggaatctggtggcttaaacctagctgtccacatttcactatctgaagagcagaaaatgtgttaataggagcctggtgagtggaggagactgaagatggagagagagcctggacctcaacatgagcatctggagccatttggcagcattaggctgtgaccgcttagagaaccgaaagatggagtctcgctctgtcgccaggctggagtgcagtggcgtgatctcggctcactgcaacctctgcctcccgggttcaagtgattctcctgcctcagcctcctgagtagctgggattaccggcacctgccaccacacccagctaatttttgtatttttggtagagacggggtttcaccatgttggccaggatggtctccatctcctgacctcgtgactcgcctacctcagcctcccaaagtgatgggattatgggcgtgaaccactgtgcctggctacactggtatttctatgtgtgtgctaccagcaaagactagacacaagctaatgtttatagggggcaaaaatccatgtgntatatgtatgcttgcacttctattttcagaagattctatgggagaaagttctttantaaatcagatcaaaatgtaaacaaaacctagtttgcatgttggaaaatgtaaaanggaaattaaacataattgngaangcagacagacttttnttacttagtncntnttntaatccagngattaggcccaggctttcttgataaacaaaccttgg

SEQ ID NO: 22501 - DNA, 628 bp, Homo sapiens
  misc_feature 325, 495, 577, 578, 615, 616, 627: n = A,T,C or G
gggatctgagaagcacactaaagtccagcaaaataatgtatggttatatttcctccggtagaggctgtctccacagaaagccaatactattgtaaggaaagtgaatttgtatttgcccctaagattaatactataatttctaatttaattttatgctccaggaaattttcagaggtattgctacttaaaggtatttttagaagtctctagcttaattcttttggaaagaatcaaagatcaacccaatgccaaattcattctttggaaattagtcttatgactccctttcattgtaaatgggaatttggctttgtgacctaaagangtcgcctgtccatttaccatcatggtaatagcttaatagcttttgtgacctgtgaaatatggtagaatttaaagctattgatttaaacaaaaacttataggcaaactgacataatagatcctaagatgaactgattcatgtatttgataattttaaaaaatattagctcncatatactacttatattaagatagaccttctttgtcttggctcaggactctttctatttacattttattttattttgaagcnnatttccgtactgggcactggaaggtctcttacatgtnnaaaaaaaacant

SEQ ID NO: 22502 - DNA, 737 bp, Homo sapiens
  misc_feature 1, 624, 697, 708, 726, 734: n = A,T,C or G
nggattgatctgttaggactgcttaagagctaacttgtcacctgtgaaatggttggcttgatattttgatatttaaaggtttgccttttgcttctcgtgggtacaagccagagagagcagtggttacatgggggtagaatggtgactcgtttttacctgactgtggatcagctgggtggttcctgaatctcactgggctcattgtggctctttgcttgtcctgtatttactgtctgtggtagtgagatagaagaaccaccatgttcttctggttctagactcaaactacagggagaaggaagagatgtgtctggcatcatttccgtgttggagtaactttgtggtagattgctgtggcctttctttgtggcctgccacttgtcttacattcttcagagcatttatgcacaggagcataaatatatgattttcatcttgccattgaaagtagactttccggccgggcgtggtggctcatgcctgtaatcctagcactttgggaggccaaggtgagcagataacttgaggtcaggagtttgagaccagcccggctaacatggtgaaaccccatctctactgaaaatacaaaaaagtagccgggtgtggtggtatgcacctgcaatnccagctactcagtaagctgaggcaggagaatcgcttgaacctgagggtggaggttgctgtgagctgaaatgcnccactgcactncagcctggtgatacagcngactccgncct

SEQ ID NO: 22503 - DNA, 705 bp, Homo sapiens
  misc_feature 37, 596, 682, 685, 696: n = A,T,C or G
gggtacggctttttgagaaaacattttagtttcaagnattcctggagttgaggtatgacctccctccatttacctcttatctccaccttgaagacagtagctgtcacctctgaaagctgcagtagcgttttctgtttgtgtcaatgagtgggaactgaagagtagatacctctcattcctttaatgattccatttgcccaaaaaatgtttcggggtggggagtgcatatacagctcctgacttagggaagcacatatctttccactcagaatttcaaggggaaaatgttgatagtttttagcaaaggtgtgtccaaatctgaaagttggggtttgctttcattatttctttcttttctgtatttcttcacctatcttgatcaagaaaataaacagcttatatttttctaaatttcacacgatgtaataaaatttagaagtaaaagactaggaattctgacatggtctgtacgatggtctatacagggcattaaacaatgcccagggtcaacaaatgccatatttgcaatccaaacttctctctgcagtagctgccggtaatccaacctgcaaactgaagttaaaagcttcaaatgntactcaggaagacaaatgaataacaatgacacttctaatatgccatagtcaaataataacaccaccaacaacactaaccacccctncanaaaaaggaggntatgaaagt

SEQ ID NO: 22504 - DNA, 630 bp, Homo sapiens
  misc_feature 442, 449, 522, 551, 558, 568, 577, 593, 595, 599, 603, 628: n = A,T,C or G
acgagcacatatagcaaactagatgaaatatttcatggaaaaacacatagaacgtgagttttatgtaaacaagaaatatttttcagtattccaaagtgctgggattacaggcgtgagccactgtgcccagccatctcttcttttaaaaatgattttgcatctgtacttctgtctgagttgcattaaattttgccagaattagacattttattgtgttaagcttttggaagggatgactgagctaacccccccctcttttttacttttaaacaaattttattttatttatttatttattttacctttgtcctgaactctcttacattgatgtgtcattatctatatatagagcactaaggtatactcttattggatgtgggaggatggaaagttactaattttctaatggtcgctcttgctgggtctagcatataaaatgggngggttgntacaggaccttgttagacttacatagaaatataaaatttgggagactgaagacgaaaatattttggtaaatgntattgttcaaattaaaaggcataatctanccatctnttgaatagtngattacttnacccccgcccaaaggngnctgntacnctttcttttgtctcaaaaaattcanaa

SEQ ID NO: 22505 - DNA, 557 bp, Homo sapiens
  misc_feature 542: n = A,T,C or G
gctggattgaatttggtggaccacatgctcccatctgtccccttctccagtaaccacccatgaccctaggctggggagaccatgtgcaaatggtgttgacttttgtggccagacctggatttgcatcttggctctgaaacctaatacctatttgagttgactttgctgggcctctgtttttgtatctggaaactgaagagaacacctacattgtagggtacctggcagaaagtaagcatccaagaaattataactattattttaattttaattagctaaaggcatcataaaacattgcaaagagctaatggattaattcatttatttaaataaaaaatactgatggaggccctttatgtgccatacactatactgtgtacattttaggggagagagcagtcaatgggagaggcagggcggtctcaagcgccaatttcttttgcttccttcttggtttaatggtctttttctcatctattaggaaaaaagaagatactaatgctatttaaacaattgaatgtagcaaaggttctttgattaancacatgaatatcagt

SEQ ID NO: 22506 - DNA, 800 bp, Homo sapiens
  misc_feature 2, 11, 25, 32, 46, 48, 55, 57, 732, 743, 777, 796, 799: n = A,T,C or G
tnttttgaccnaaaaacccaccttncttgttncttttggaccgcangnagacagnangggtgacttggccaagtaacacaacctgcctgaccctctggccatgcacacgtgtggagtttgttcccgggccctgtgcctgttcaaagaatggctggacgtcggtattgcccttggtttctgccctgaagtccagtcagtcagcagttctgcttattctgaccctctctgtgcagtattacccaacacacatgcatttcctccttgccttctcagtattgccatcgtgaaccagaattgtcacctccaatttaaacagtgaaggcctttgttaggaagaggggcagggtgcagagggggatggttgctttttctaaatcacagctctgatcaaatccctcctaagcagaagccttccaggctcccctccataaggctccaggtgtttacttaccttgcctgtcaggggcttctgcagcttgcttcctacctgctatctccactcctctccaaaccaccatatcctgaggcttctagaaagcaaactctggcggcatggggttaatgggtctgtgtacccaagacactgtacctgggtgctgtcatctgcctgactgaccttcctgtgtcctggtccgatggtgtctttgatcctatagctaagatcaagacactgaaaatctctagactcaagtctgtgcttttgctggataaagttgtgttgagtacatctangctggggtggnagctacgcctgtaatctcacactttggaggcaangcaggggatatctgagtangant

SEQ ID NO: 22507 - DNA, 451 bp, Homo sapiens
  misc_feature 340, 370, 373, 393, 421, 422, 447: n = A,T,C or G
ggggagatgaaatgattgaaagcatttgagtgcagaaaacatgaaaaacatgaaaaaagttttcatcattgtatgtaaagtgttcttgtgattataaaatagcctcatggttccttgtttgcatgttcgcttgtttttttgtagccacagcaccacaagttattgttccagattctaagttgatacagcatatgaatgcatcaaacatggtaagactcagaatgtagcagtttgattggctgtacttaattctaaccccactaaaacactcaccaagacctcaacccctgacccccatgcctcaggatactcctcaatagccatcgctgtagtatatccnaagacaaccatcattccccctaataattanaanactattaaaccatatacctnccccaaattcagataataccacccgacnnccgctacatcatactaacccccttnttga

SEQ ID NO: 22508 - DNA, 706 bp, Homo sapiens
  misc_feature 554, 665, 681, 682, 683, 692: n = A,T,C or G
ccttacttccttgtgactgcagcatgaagcaattaccagccttctctggctgacatatacctgagggagtgtggaaagtgccgaatgcctgaagataaatcaactcttcctctgggagggcacggataaacaacttcatcgatgtgcttcaggttaccatttgaaaaggcagtagagatatgtataaaggcttccagctttggcatctgactagccgtaagagcttctgggtggcagtgatgttaagttgcacagcatgtctacagaagattaagcagaaggaaatacagtgagataagtcagcatcatgccttgctataactgcacctactcccataactggcatacctatcagattttggtggctgcaccaaaacaccagtaagaaaaggatgggtcacgcctgcacagttatgtgatacttggaatgtcttatgtattgatgatgtgtttgtgtacataaaccctattcactgatgcactgtatggcatatttagaggtcacttggctctaatcaactggaaaaagaatcacaatcctctgaattacaaangtgcttctataagcagccattaaaagaacaaaacatgtaattaagcatctactgaagaattggaaatataataactggagagagcacagtggattttaatgagcatatagntgtataagttcaggcnnnatgaaattntgtcaaatctgaat

SEQ ID NO: 22509 - DNA, 761 bp, Homo sapiens
  misc_feature 2, 9, 298, 313, 320, 325, 335, 337, 345, 349, 355, 375, 377,389, 393, 395, 400, 462, 470, 509, 526, 531, 534, 541, 553,558, 567, 577, 593, 605, 615, 641, 642, 649, 655, 669, 684,694, 697, 706, 709, 731, 749, 755: n = A,T,C or G
gncgacagnaggggattagggggctaagcatttagttactgcatggggcagccaataataaaatcacagccctgtgtatttacctccacagtgtgtgctgataagtgcaaaaggtttgtgcaaattcttttgaagttatattgtaaccatggtatatgtattgaaaacttggccattttaccccattcctatgaatgaaaactatttggtgaatcagaggatagtctgaattgggatatgaaggccagtataagtgtcagttagcaaagtcagctctagtttagtttttttttttttnttttaaggcgtaccnttactanaagtntagctttggnanccttgtancatnttaaanacttttaaagggttgacagntnttggcaaattgnctantncaganaactaaactttggttcatgtattcaatgtctaaatgaaaaatgggaagataaaagagctaanaatgaaangggatttcatgggcttctcctttttagctcttataatanattgaacagatttgatntttgnggnaaatccnctcaggcagagngacanaggcttggntgtcatttancctttagggtcttagnggagttaatganaactgcaaanggcatcaagtcttggggcttatgggnnaaccccncttttnaagggggggggtancttaggggtttgggntactgcgggncgnggtccttanggnaaaacgttcggctggggcagcntaaagcaatccttggggngggttntgctac

SEQ ID NO: 22510 - DNA, 778 bp, Homo sapiens
  misc_feature 24, 683, 772: n = A,T,C or G
gggggaaactcactgtgcccaggngaggagaaaagaagaacacaaaaaactctacccatggggaaggggcaggaatgtgcgctacctaacattacggtatatctggagaaagctcaggaacacttgtgaaggacacaccaccaagactcttgttcagagtgcctacctgaggctgaggcttaatcggaacatcagataccatcttctctcctccactctccaaccaccacactaacaagctttgagaagaataacagtggaatacaacttggagaaccatgcaaagggagacccaaagccaaggagggacactcatagccaagcagatagcagtcttcacaaacaactagactcctgaccacattaacagaaacctccacactgaagaactaacagaggaggaaggcatcctcatctccaagcatgcaatgtgcttacctggaatccactgtcctagatgacatgtttggctttcaacaaaaaattacaagacttacaaaacagcaagaaataacagtctgaagggataaagcagtcatcagaagtagaattagatttgacacagatgttagaactctcagacaaagaatttaaatggctacaatcaatatgttaatggctcttatggagaaggtaaacagcatgcaagatttataggccatgtcgccaagagatgggaactncagagagagccaataaaaaatttttaaatggaaaacagaaataaagatgcttttatgagttctcaatagactggcatcttgacatcagnggcatg

SEQ ID NO: 22511 - DNA, 737 bp, Homo sapiens
  misc_feature 2, 9, 667, 711, 717, 724, 736, 737: n = A,T,C or G
gnagacagnagggggaacattttagccaggtagtataagtacaggtgcgggtaacctcagataaatcaaggtgttatgcagctgtctctatattaaaaatatttgctgacatcagtgtagacttcatcttgtagttcttcagtgttttctttccttatcttttgctcataagatggctttgtgtttggtttgatattatactgagaaagcatattagaatcaaagcaccaagatttcaaaagtccagactactcttcccaaagagaaatgtgcaatcacaatagcatgacatgggtacaaatatagaagtatgttattaaagtattgagaattagctttcctaacctccccacctgcaatcttttactcctaatctccaaaaaatgaacaaatcattggctcaaaatggtcacaaattgtatgtggtgttaaaaatctattatttttattgtatataaaatgttgccaggtgtggtggctcatgcctgtaatcccagcactttgggaggccaaggcaggtggatcactaggtcaggagttcaagaccagcctggccaacatggtgaaaccccatctctactaaaaatcaaagattagctgggtgtggtggcgtgtgcctgtaatcccagcttctcgggaggctgaggcatgagaatcacttgacctnggaggcagaggctacagcgagccaagatgggccattgcactccncctaangacagancagactcatctnn

SEQ ID NO: 22512 - DNA, 758 bp, Homo sapiens
  misc_feature 15, 16, 171, 173, 563, 635, 641, 697, 715, 719, 721, 729,731, 736, 742, 744, 755: n = A,T,C or G
ggggatagcattccnngtgtttcccttatattttatgtttctttatgtgtcatatttccctcactggactgtatgtccttgagattaggattcccatacagccatcctcatgctccaactctcagagcttggcagtggactttgtacattttaggttctctttaaatgctntntgagtgaaccagtcagtcaaccaagtaactaagaaatttgggtgttggattgtagaagccacggtaggaatattgactccacccatggaaatgggcaaatgtcacaaattagaccctccccaacagctggagagctggttatgaagcagttaccagcacccccctgggcatatctgacattgaagcaaatttgcatttggtagacaggtttgggaaagggctttaaaagtaacaaagcctatatattggaggagcttcagagtcatccttttctccaccagtgagattccatgtacattgatttatgtcttggaaatatgtgaaagatgtttctattaaatctttcaggccgggctcagtggctcacgcctgtaatcccagcactttggnaggccagtcacacagatcacctgaagtcgggagttcaagaccccctaccaacacagtgaaacccatctctgncaaaanacaaaaatagccggcatggggcagatgtggtaatccagctacttggagctgaggcngagaattgctaaaccagngggngngggtgcgngngccanatgaanangaactccgctnata

SEQ ID NO: 22513 - DNA, 647 bp, Homo sapiens
  misc_feature 65, 66, 67, 294, 394, 410, 418, 484, 508, 524, 526, 533,547, 569, 570, 573, 576, 586, 587, 605, 607, 612, 623, 624,625: n = A,T,C or G
tgtaccacttcagatcagttttcactggagagacttgtaattggtagctgtagctcgtatccatnnntagtcactttgccaggatgaatgctgttgggcagcagtagcctaagttacggaaggggagcagattgaatggggttttgagacatcttctctgataccttagctttccttctgctctggtcgctatccactcagtcgtgtgctagaaatgtttaacaaccaggatctctggggtgggggtgggggggagcgctgaatttgtagcatttgctgcaaatataaattatnaataaaattctaatataaattagaattttatatcaaattctttgatataaattagttactcctcctgtggctgatttcaagctaccaccttagagttcanaaaggatgtgcacagntggctcanagccagtgctggcaaaccattgcatttactccacccaagagtggattttcacataatttctaaaanaattttttcttatttatatactgncttttcaaatacaaantnaaatatntggctgacttcagngatcttttttttttcttttttnnaanggngactttcagnntccttaatttatttttananagggngtcttgggggnnnccagggggactcacctccgggc

SEQ ID NO: 22514 - DNA, 777 bp, Homo sapiens
  misc_feature 9, 28, 381, 402, 492, 550, 563, 612, 615, 617, 639, 653,675, 678, 682, 689, 693, 696, 697, 701, 705, 711, 720, 735,749, 758, 761, 766: n = A,T,C or G
gacgacagnaaggatcaagggggatgcncgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggctctgaaaaaaaaaaaggtctgatgaccctgtcgaagatgataaagaaaaaaaanaacttggttatttaacagtanaaaatggaattgcaccaaaccatgggctgacttttcctttaaattcatgcctcaagtatatgtacccaccaccttccagcacaatcctancaaacattgtaaatgccttggcaagcgtgcctaagttctatgtacagggcctttattnttatgaataaaangaatttgccccaccttttggaccaattactgccgacctccctgttgaanacntntgcctttgatgcccctttttcnccccattttcttancccctgagaaccttctttgccnacnaggntgaggantttnttnngaanatcnaatttnaaacccttntgatgagggcccccnaaaatgaacaattntgggacttncanttttnccccaaaacct

SEQ ID NO: 22515 - DNA, 696 bp, Homo sapiens
  misc_feature 583, 598, 605, 611, 640, 652, 655, 661, 665, 668, 669, 671,677, 679, 684, 687, 690, 693: n = A,T,C or G
ggggttccccaagtttttctgtactagttttatagttcgaggtcttggctttacatctttaaacaactttgattttacttttgtatttggtgatagatactagtctgttttcattcttctgcatatggatatccagttttttcaataccatttcccaccagtgtatgttcttggcacctttgtcaaaaatgagttcactgtaggtacatttgtacatttgttactgggttctctattctgttccattgatctatgagtctatttttatgccagtaccatactcttttggttgctataattctgtggtataatgtgaagtcagaaaatataattcctccagttttattatttatttatttttgcttaggatagtattatttcctatagtgaaagcattctatgttatttattattagtctaattttgtagttttacaatgctatcctcttttacaaagctatgatcaactcagtgtgtccagatcaggatcatttgtagctatttgcaaaagtagcaatattctgggctgggcatgggggctcatgcttgtattcccagcactttgggaggccaagacaggcanatcacctgagggcanaggtcangaccancctggcaacatggggaaacctgtctccanaaaaaacaaaantanccgggnaganggnnangcctgnancccanctntcnggnggc

SEQ ID NO: 22516 - DNA, 584 bp, Homo sapiens
  misc_feature 6, 8, 179: n = A,T,C or G
gacagnangggttgttgttttgtttgtttgttttttgagatggagtttcactcttgttgcccaggctggagtacgatggcactatctcagctcactgcaacctctgcctcccagattcaagcgattctcctgcctcagcctcccaaggagctgggattacaggcatgtgccaccatgtncggctaattttgtatttttagtagagatggggtttctccatgttggtcaggctggtctcgaactcccgacctcagatgatccacccgcctcagcctcccaaagtgttgggattacaggcgtgagccacggcacccagacaaatgaatacattttatgtctatgtgtgtgtgtgtgtgtgttttaaaagtaatccctcctttttagagattccatctcagattttgaaactacctattcattagcacttgggttttcttagctataaaatttcaccgaatagttggtttacctctttaaggtatatttgatgtatttgtgagttttttcaactttctactttgacttgcgagaaataaagaactcatactcagaatttatttggctacctttacaatgctgctagt

SEQ ID NO: 22517 - DNA, 609 bp, Homo sapiens
  misc_feature 136, 140, 417, 436, 514, 522, 523, 535, 540, 541, 550, 563,564, 566, 574, 576, 588, 592, 594, 605, 608: n = A,T,C or G
gtgaatgtgactttatccattttgcaggaaaaaaaagcctgcacaatgtgaatcactaggcaattggctgttagaagaggatgtacaacctattatgctataggattcctgccctcaaggaatttactatcatgcnatcnaattcagtgggaaagagagaaactttaatgaatgactttatgaaagtaactctaaaaccactaagatatggtcatattgggggagttgcaggtggagagaagtagggagaagggttgtcctctttctttctaacctcccctcagtctatcctgtagtttaaattccatgaaggtgctggccatgtctattttgatcactgcattgtccttagcacctatcataacatctagacaatagcaggtattcaataaatgttggaatgtgtgaatgaataanaatttcaggctgaaaatanagggaagttggtttctgcattcttgaatcatatcatattcctgtccggggactgactaaactctgggtctttaggcanatttgganngtccttggccanattcnntcctttgcnggtttgggttcanngngcctgtcntntgctggcccctncccngncctgggagggnccng

SEQ ID NO: 22518 - DNA, 617 bp, Homo sapiens
  misc_feature 172, 279, 322, 377, 385, 400, 476, 485, 493, 501, 505, 514,541, 545, 565, 569, 576, 578, 583, 591, 601, 607, 611, 616: n = A,T,C or G
gggatctttgttgatgtgtcagctccgcaggggtttggggaaacggccgctgagtgaggcgtcggctgtgtttctcaccgcggtcttttcctcccactcttggctggttggaccccgctatggaaaagttggcccctgagccagagctccagcagccttgttagggcgtggnctgaggcttggataagtgggaggaaaaagtcctggatttcgagtcagaacatctggattagaatcctacttctttcacttgataatcttgttacctgtggaaatcanaagagagaatatagtaaaaatacgcagtacagtcccagatgtnaaacgaagatcaggagcagatttgaagaattacaaagtgaattggtgccagtcancatgtcanagacagaccacatancctctacttcctctgataaaaatgttgggaaaacacctgaattaaaggaagactcatgccacttgttttctggcantgaaagccncaaattanaaaatgantccnaactattgncatttaacactgataaactttatgtcncctnatgagcttatatcaattgancccngaaattntnttccnatcttggnggagggagantctttngccnaacana

SEQ ID NO: 22519 - DNA, 750 bp, Homo sapiens
  misc_feature 1, 9, 695, 703, 710, 720, 725, 749: n = A,T,C or G
nacgacagnagggagtctagaaagatcagctcacctgctcaatgaaacaggtgcagatttcataacaattttggagagtgatgcttctaagccctatatggggaacaatgacttaaccatgtggctaggggaaaagttgggtttctatacagactttggtccaagcacaaggtatcacacttgggggattatggctttgtcaagatacccaattgtgaaatctgagcatcaccttcttccgtcaccagagggcgagatcgcaccagccatcacattgaccgttaacatttcgggcaagctggtggattttgtcgtgacacactttgggaaccacgaagatgacctcgacaggaaactgcaggctattgctgtttcaaaactactgaaaagtagctctaatcaagtgatatttctgggatatatcacttcagcacctggctccagagattatctacagctcactgaacatggcaatgtgaaggatatcgacagcactgatcatgacagatggtgtgaatacattatgtatcgagggctgatcaggttgggttatgcaagaatctcccatgctgaactgagtgattcagaaattcagatggcaaaatttaggatccctgatgaccccactaattatagagaccaccagaaagtggtcatagaccacagagaagtttccgagaaaattcattttaatnccagattngatcctncaagaagacncattntgaaacaccctattttctatgaanc

SEQ ID NO: 22520 - DNA, 494 bp, Homo sapiens
  misc_feature 219, 258, 292, 305, 329, 355, 414, 417, 424, 443, 445, 452,455, 456, 460, 462, 469, 472, 473, 477, 490: n = A,T,C or G
ctgagcatatggcggatggcaaggtgaactcctgccccgaacaatcagctcgtctcacttgatgatgggatgaggcagggcttgtctcttcttagttggctggtgagagtgggggagagatgtacttagtcagatattattagcagagtgacccggctgacggggcgagtataaatagaagaaagctcgcgttgataatagtgcttggcactcaacacngcgcttcatcttcaaagccatttacagatgcgggtcttnctggtactgctgcgattcccggctgttgcttgtntgctgcttcttangaacatgggaacagtgattttcanagaccaagattcggctcaaatttggnggtcctcttttcagaatccttgagattttccttttgattgaatttttgaaaggctcacnttnatgctgnctcttttgaattcctgggngngaatganacnntttntnttttttnacnngctnattccaggggggntcag

SEQ ID NO: 22521 - DNA, 651 bp, Homo sapiens
  misc_feature 17, 24, 177, 179, 215, 341, 365, 367, 368, 405, 430, 438,444, 453, 454, 472, 489, 522, 539, 540, 544, 549, 550, 562,570, 593, 595, 596, 602, 610, 614, 616, 624, 637, 644: n = A,T,C or G
gggggaaaatcctgtgntcagganatcaggtctcattaaacatcaaagaattcacacagggagagaaaccctttgaatgtagtgaatgtgggaaagcctttagcacaaagcaaaagctcattgtccatcaaaggactcatacaggagagataccctatggctgtaacgagtgtgggngngcgtttgcgtatatgtcgtgtctggttaagcataanagaatacacacaagggagaaacaagaggcagccaaggtggaaaatcctcctgcagagaggcacagctcattacacaccagtgatgtcatgcaggagaaaaactctgctaacggggcgactacacangtgccttctgtggcccctcagacntnnttaaacatcagcggcctcctcgcaaacaggaacgtantccttgtgggacagccagtggtcanatgtgccncctcangagataacnnaggatttgcacaggacanaaaccttgtgaatgcantgaatgtgggtgggccttccctgatcaattatntcttattttatgtttcnnaaantcctnngaaaaaaactcnaatctatntggaaaagggtgagccaaatttntnntctttntgcgggcnaaancntcccttanaaaacatttttanggctganatacctg

SEQ ID NO: 22522 - DNA, 434 bp, Homo sapiens
  misc_feature 14, 16, 33, 173, 174, 277, 323, 335, 336, 337, 408: n = A,T,C or G
gggagcaccattgngntccagcctgagtgacanagtgcaactctgtctccaaaaaaaaaattagaaatgtataataggtaaacatgttacatatataaagtatcaattatcatgtactttgatttttaaaagatgagagagtatatgtcattatgatattctaaccaagaagnngacctttttctgtctccatttttactgattcagaacatatattttaattgtagtgaggttttatgcctcaacttgttaactctggtatttacagaatttttgntctttgtatattagcatataatgtcatagttggcatttgggtttgngtattcactaannnttgttttaaaatctttgaagaatataaactagttgcagggccgatcacttgaggcaaatcaccagcctggncaacatggcaaaaccgtgtctctact

SEQ ID NO: 22523 - DNA, 593 bp, Homo sapiens
  misc_feature 15, 173, 395, 412, 472, 476, 516, 534, 546, 551, 556, 559,561, 562, 568, 571, 572, 574, 575, 580, 581, 583: n = A,T,C or G
gggatgtccttattncccatatgatataatctcctgctcggtaagtagattatttggttgagtgtaaaatggctgttaaaaagatactgcttctacttattaagccatccatctacccatcctgctcacgtatgtgtcagacttttagtgcccactgcgtgtgtggctctgcnctgtgttcttggggtctaacataatgtaggcaatctgaaggttactgtccagtgtgggaagcaaaaggaaatcacggtataagttttgctttctttaatagcagaaggggctacatcctactgtgggaatgcagaaaagggagtgataagctgccttcatagactgtgctttcattttttgcaaaagtaaatgtaatcaatatgaatttgtggaaagtgtancatatattgccatgtgntatgactttgagcttattttaaaataaagatggatgcctgtttctgcctaacatgttagncagnggtatcaaagacaagaggcagaccattcattcctcatttnccaaaacactgaatgccnttctgggcctancgctntacanacntnngaaatncanngnnataanncntttgctttcc

SEQ ID NO: 22524 - DNA, 313 bp, Homo sapiens
  misc_feature 190, 249, 250, 251, 254, 276, 277, 286, 289, 290, 291, 292,295, 301, 306, 309, 310: n = A,T,C or G
gggggggcgggggcctggttgagtagttgtacctctctggggctcagctcagctttttgcctgtaggaaaagaggcctaaactggaggaattccagtttctttccagctctgagcatgtgtgatattatcagtggaagtgttccagatgatcttcccaggtcaagatgtggtccaggggtttgccatgtntcttagctttcacgctgaggaactttgtttacatacttaaaacgcttgcttcttgggcnnnaanaaaaaaaaaaaaaaaaaaaagnnggccttttntcnnnntcncccccnttttnaannttt

SEQ ID NO: 22525 - DNA, 473 bp, Homo sapiens
  misc_feature 2, 3, 4, 5, 12, 17, 24, 25, 32, 48, 58, 61, 62, 63, 66, 67,68, 69, 153, 161, 176, 194, 214, 218, 220, 245, 264, 265,299, 306, 314, 321, 331, 360, 370, 385, 401, 402, 403, 406,414, 415, 423, 424, 428, 437, 442, 449, 470, 471: n = A,T,C or G
cnnnngaaacgncccgnctcttcnnctgcganaatatttttcaaggtnaaattctttnggnnntannnngttgataaaaaaaattgagcatatgtttaatgaattcattttattttataaggctgagtacatatacagatgatcccattttantttctcanctattttactatatnttaaatattttgatgctntatttacatattatcttttngggncntaatttttctgataacttttcaagntcagccaaatcatatcctnnacaagtcacactttttctctgaagttttccatanaaccctnattaaaantgatctnacacttgtancattttacaaatctacccttcctttatcntttatatatnctttttaaggggganggttcttctatatatnnnttntttttttnnttaccacnncacntttttcccnctttnccctttnttaatttctcttccaaccttnntt

SEQ ID NO: 22526 - DNA, 593 bp, Homo sapiens
  misc_feature 172, 173, 403, 421, 489, 493, 502, 517, 521, 523, 524, 537,542, 556, 562, 570, 577, 578, 584, 585, 590, 591: n = A,T,C or G
gggaacaagcacagggctaacactcccctgactgaacagttatacaaaaggctaagggtcttagaatttattgtctttcttgctgaaagatgattctaataacaataaggttttccccctcctataattttgtgtttccaaaaacaaatggtgaggaaacaatagagtatgnntaccctttctggactcagggacagggtctctaatttggtctctgatttggacagctgctatttgccttagaccttttaggttgtgtttctaaagactgaggctaaattgaacatgacagagaggattcaggtgaacagattagctcatctgtcttccatcagcacacctgttgcccccaacagagggcagaaccatttctctttcaagcatgggctactgataaattcanctaggcgagctagttcanccttctcattaagggaagttaagagagaagtgatgaaatcttaaaattaggagtacctggacatttcnttanggagatgcnttacttcttacagcnctangnntgagttgaagtcnatgcnttttaaacatgggnttcctnaattgaantctttannaataannctttnnaa

SEQ ID NO: 22527 - DNA, 704 bp, Homo sapiens
  misc_feature 1, 2, 10, 28, 29, 42, 186, 187, 188, 345, 507, 551, 574,579, 591, 599, 602, 604, 621, 624, 630, 656, 661, 668, 680,688, 695, 698, 699: n = A,T,C or G
nnacgacagnaaggggggcagcgcttgnngtcgggctacggnaggccgggttgccagattacgggaaagccatttaagaagttcctggaataatattagtcagagtaatataggatctgcaggaagtgtctcaagatagttggaaaagaagaatttctagactcttcatcaagatcttcatttatnnngctgttaaatccaaggctactttggtgaaagcatgaataaaaatacatctactgtagtatcacccagtctacttgaaaaggatcctgcctttcagatgattacaattgccaaggaaacaggccttggcctgaaggtactaggaggaattaaccggantgaaggcccattggtatatattcaggaaattattcctggaggagactgttataaggatggtcgtttgaagccaggagatcaacttgtctcagtcaacaaggaatctatgattggtgtatcatttgaagaagccaaaagcataattaccagagccaagttganggtagaatctgcttgggagatagcattcataagacaaaaatccnacaacattcacccgaaaatctgnctgtncatcacttatanaagcttcngananattggacctcaagcctnacnttaagncttttttcttctcctcctgaatcctntcccnagacctntcccctcccaanaaaaaaanaaaaaanccnnggggg

SEQ ID NO: 22528 - DNA, 280 bp, Homo sapiens
  misc_feature 148, 178, 182, 184, 189, 193, 196, 197, 202, 207, 211, 214,216, 231, 234, 249, 254, 257: n = A,T,C or G
gggatgtaaattttgtatatcaaaaataattggtctaaatttcctagacttagacttgatttcttaacattagggtatcgcatactcaaatggtagacaatgaccccaactaaatcttcctgatgttacactgctttatcaagaggangggctttttttttttgaaacaaacaaagtnttgntntgtcncccnggnnggagngcagnggcncantntcgggtcactgcaanctntgcctcccaagttcntgccnttntcctgcctcagcctcccaagtag

SEQ ID NO: 22529 - DNA, 682 bp, Homo sapiens
  misc_feature 14, 17, 34, 173, 472, 523, 588, 595, 604, 620, 626, 628,629, 643, 646, 652, 653, 659, 663, 664, 673, 679: n = A,T,C or G
gggactgatagagnggnggaggagctctggtcgngttaggaggaaaggcgatgagccccaggcctcgggataccacagtgaaggagaaacactgaaagagaagcaggctcctagaaatgcctccaaaccatccagcagcaccaacaggctgagagattttaaagagacagtcnggggtatgatccataacagaccatccctggcttctcagaccaatgtaggctctcactgcaggggcagaggaggagaccagcctgacaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagantttataccagatgaaccaagcaagccaccttcttacgacattaaatttggnggaccaagcccccagtacaagcgctggggcccagcacgggcaggctctccctttttagagcagcncccccgnctaatccancgaatggatctggctntgaaancnngagaggaacagcancancctgtnncctggntgcnncctgcctgngagctnaat

SEQ ID NO: 22530 - DNA, 581 bp, Homo sapiens
  misc_feature 37, 173, 174, 176, 177, 338, 362, 363, 445, 468, 478, 482,490, 500, 505, 506, 511, 552, 553, 554, 555, 556, 562, 571,575, 577: n = A,T,C or G
ggggaaacatttattggtaggattttttatttcaaanaccagtagatctcagcatcagcatcatttgggaatttgttagaaatgtggaatctcagaatcaagttctggggtcagggcccacaattggtggtttaacaaatcatccagatgaaattgatgcacactaaagattnngnnccactgttttaactactaccctgtcatagtccattttctagtgcttatcacagaatatctgaaagtgggtaatttataaagaagagaaatttatttcttctagttatgactgaggagtcccaggtcatggggctgcatctgttgagagcctccttacttgnggggactctctgagaagtgccaannttagagcaggagtgccaaaagttagagcaggaaccagatttcctggtcttagcatacaagaaaatggaggcgatgggaatanagtgtgcgtttctaaagtttaanaagtccggangganagaaatanagcctactangtacnnagggngactgtgccaaccagggtttcaagttggggggggcggaccnnnnnaactcntggaatggnggangngctg

SEQ ID NO: 22531 - DNA, 466 bp, Homo sapiens
  misc_feature 4, 173, 176, 335, 346, 355, 368, 391, 401, 403, 413, 429,431, 444, 445, 450, 453, 464: n = A,T,C or G
aggnatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgnggncaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtnctttgccacangaagtgcanatgctttggtcancctctgggatgtggatgatttantgtgtgttcngngcttttccangctggattggcctgtnanaaccctcatttcnnccctnatnggaaaatgctngc

SEQ ID NO: 22532 - DNA, 844 bp, Homo sapiens
  misc_feature 2, 10, 11, 16, 18, 30, 41, 43, 62, 65, 72, 244, 246, 248,648, 659, 711, 766, 771, 775, 781, 790, 791, 806, 810, 818,825, 831, 837, 838, 843: n = A,T,C or G
tnacttgggnncgaananctttttttgttncttttggccgnancggcccttcggctgcgagnagncgacagnaggggtctcaaggaaccaggaaataaataaggatggtgatagagaggttgaagaagaaatgaagaagcatgaaagtaataatgtgggattactagaaaacctgactaatggtgtcactgctggcaatggtgatgatggattaattcctcaaaggaagagcagaacacctganantnagcaatttcctgacaacgaaagtgaagagtatcacagaatttgcgaattagtttctgactacaaagaaaaacagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacggaagtactcacgtcggattcccagaaaacctgactaatggtgccactgctggcaatggtgatgatggattaattcctccaaggaagagcagaacacctgaaagccagcaatttcctgacactgagaatgaagagtntcacagtgacnaacaaatgatactcagagcatttttgtgaagacagacactggattttacacnatgagattctgattctgaagaaagcagatagaatggttgaaaaatgattctgacnttctntaantgtaanaaaaaaaannttttgcttgaaatantccntgcggganaattgcntgctanactggnnctaanc

SEQ ID NO: 22533 - DNA, 733 bp, Homo sapiens
  misc_feature 12, 13, 14, 15, 18, 20, 32, 43, 45, 52, 62, 65, 72, 476,487, 548, 569, 621, 622, 629, 647, 667, 668, 671, 688, 696,699, 710, 712, 719, 722, 729: n = A,T,C or G
atatcttggggnnnnaancnccttttttgttncttttggccgnancggcctncggctgcganagncgacagnagggaagtacaataaggactgtcccattaatttgtttaaaaatctctaattggttggccatagctgactatgtaaataaatatttatgcttgccttcagtcaacctgtattacttcaataatgagaaatctttaaaaaaatgtccttcaaaacctaaaagtatggtcaagttttatagtcatataaagctagcctagacaggaggatattttatcacaatgttacaaattggattattttattaatctctttattaatcatagaattctatggagttcaactggaaattgtagattgttaaataaacaacttttaacacataaaaccctgatgatggaataggaaagatcagaaaaatagaaggattttttaaatccggaagaagaagaaaaaaaaaaacaggngactgaagaanaataaaccctaagcagaaaacagtctactttctgctacagtataacatattttaaaattcnctatttgacaagacatatacncaagttaaactgagttctcctctgggttttttttttctttttggtccctccnngggggcncccatttttggcccagtngttaaaaaattgccctcggnnganccaataaaaaaaaaggnaaaccggncgnttttttttctncnatttccnggngggcccnaaaa

SEQ ID NO: 22534 - DNA, 755 bp, Homo sapiens
  misc_feature 1, 2, 5, 10, 12, 16, 57, 188, 190, 377, 417, 508, 534, 599,620, 624, 641, 645, 657, 664, 680, 691, 696, 697, 698, 709,719, 726, 727, 731, 749, 751: n = A,T,C or G
nntcnacagnangggnaaaagcagtggggttttaccactctgcggaaaaaagctaangttgctaaccaaacaaaataactttacactgacaatgccaatttttacatttctttcagaacaagggacactcaaactaccagaggtaagattaacattttaaatattttttataacctttgcatttgggngntgtttgctaacttaatcaggcttgggcttttacactgttaaatgtgccttttaaaataaatagaaataaacagaaacagagggaacaaccaagtgattgtgaacaaaatgcaaaagttaaatccaaggaatgttcactgtcactgtccgaaggtcttaggtagagaaaaaatgtgaatatttaatcnaagactgtgtatgaaatgggactgtaagtacagagggaanggtggcccttatcgccagaagttggtagatgcgtccccgtcatgaaatgttgtgtcactgcccgacttttgccgaattactgaaattccgnagaattagtgcaaattctaacgttgntcatctaagattatgggtccatgtttctagtacttttccattagagccgaagatgatgattatcncatcctattgttcaatgaagnctantacattttcttttgggntacntagagtcttctnatggttnaaagtttttattcatngttcctctcanattannntcttttaaaanccaaaaaaanttttttnnaaanttcaaagatatgggattntngaaa

SEQ ID NO: 22535 - DNA, 738 bp, Homo sapiens
  misc_feature 494, 511, 558, 589, 591, 621, 636, 662, 664, 670, 681, 684,697, 698, 704, 715, 717, 720, 724, 731: n = A,T,C or G
ggggtcaatgagagctattatttttgttgttattgtgtttatgattacaagagaccataagagacaaggaatcaaaagctgtgtttctccattatcagattatcaagggaacatcagtgaagaatatacataagacctcatgtaaggaacaaattaagcatgattgtgtctgtattctagcagtttatcatctacaacatacaattatttgagagaggaggcgtaggaagagggagcgagggagcgagaacatgcatataggtaaatagaccagtatacatgctattctgttctgttttgtaagcatgttttctggaaaatgactgttagacagcagatgtagcactcacatttatgagttttcatttcagcagtttactgaagtgaaatttagagaaatgggataaagtctctaacatttctagtaagttctatcaatcagaaaaccctggagtttggtaaagtcattgttgaagatgatcattggtaaaagnttctactgcattatggnataagccaggatccatgccagatttttttaaaaaaattatgcttcangccaggggcgggggctcacgcctgtatccancnctttggaagctgagcaggtggatcatgagngaggagtttgaaccnccctgaccacctggggaacccctctntntgaaancaaaatcaccnccngggggctgccctnnatctcnctcctaggggngnggngganatccttnacccggg

SEQ ID NO: 22536 - DNA, 462 bp, Homo sapiens
  misc_feature 9, 10, 11, 171, 175, 198, 201, 204, 249, 284, 298, 320, 333,352, 360, 386, 398, 416, 422, 423, 427, 428, 430, 437, 440,446, 449, 452, 461: n = A,T,C or G
ggggccctnnnggacataatagaggctggaaatgtgatccccacctgaaatgccagttcccaattacatccctacagcttggatggagagcatagatctttggtggatcaatagctgtgtgtcatgaccgcagagagctctacagcagatccagcaatttatggtcaaaantggntgtgtaaaaataagagtacattnttntcntgcgggcatcaaacaccatccatgttctgctgtttaccctaaggngacaaagtcaacgacctgccccagacacagcttcncgcagctgaataanaacttgtctttttctgcagcanactcacctgccanaatctgttgctgttccccnctgggganggaagggagtgactgctccttcttcnaatgccccaaanggttcatgtgaggagggngaatcnnactnngnccctacnggnttttcnagntanaaggggttnt

SEQ ID NO: 22537 - DNA, 744 bp, Homo sapiens
  misc_feature 1, 9, 24, 27, 181, 184, 550, 577, 633, 638, 642, 645, 664,673, 684, 700, 701, 715, 716, 734, 738, 741, 744: n = A,T,C or G
nacgacagnagggatatgaaaaangcncatcactaatcatcagaaaaaatgcaaattaaaactacagtgagatatcatctcacagtagtcagaatggctatattccaggctcgaggcaagcgtgctcttcacgagttctgtcattctcttgagtgaagctcacctggtatggtaagttgtnctnattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaaccttttccacacatttcagaccattctggttttattcttttctacacaaattttactctttataggtgttcaataaataaatataaacattaattttaaaaataatttattaatttgatctcttcatttaaagataatatccaatgcctccaagttcccacccaanaattctgttggatagggctggaaaagntctggagaacattcttccagactctctaggcatcatgtcacaggatgtcctcgccnagccngaanagngctctgagttttgaatgangggctcagnggactgggcanacctagggagggagannagggctgcatgaannctgggggattagagatcnttgntgnccn

SEQ ID NO: 22538 - DNA, 734 bp, Homo sapiens
  misc_feature 2, 12, 19, 22, 23, 29, 160, 511, 524, 544, 550, 632, 647,654, 685, 716: n = A,T,C or G
gnggcctacggntgcgagnagnngacagnaggggaaaacaattacaactgaatatagaaagtagactatcatatgtacataaactaaaacacacataaaacagtgctgtatatcgttctaggtttatgcatacacagtagaaatataatttatgcacagnaagaatgctttcctactacaggggagtggctattgctggagagaaggtaggatagaataggggaatggggctacaactacatctacagtgcttttattacttaaaagagaggaaagattaaagcaaatatggcacaagattaatctgtgttaaatacagggtagtaggtacatgaatctctgttgctttatgtacttttcagtatgtttaactttttaaaaatgaaacattttaaagcactatagagattcaagaatgtataaaaaaattcctcaatctggtaattggtagctacaaagaaatcaatcccattcttatggataaaaacattactactaattctactggagncaggagcaaaagnttctgctaaaaacttgcttncctggncaatgctctatgaccagaaatgaacaggacttgtagtatcggcaggaaaagccaaaacgtgcaattttctatgtaaaaatcngtagaaaaatagccnttagacngaagaggctcagaagtcctagagagttaagntatatcatggctattctgcctgcttaccatngaaaaaaaaaaaaaaacc

SEQ ID NO: 22539 - DNA, 769 bp, Homo sapiens
  misc_feature 1, 2, 3, 9, 11, 25, 26, 179, 183, 185, 508, 581, 595, 619,621, 625, 677, 693, 709, 714, 739, 740, 741, 747: n = A,T,C or G
nnngacagnangggtacttttttcnntagacctgagctgtcccatagaactttctgcagtgatgaaaatgttctatatctacactatccactatgatagctgattgccacatgtggcttttgacactggaaatatgactggtgcaattgaggaactgaatttttagttatatttagttntaangnatttaaacttaaaagccacatgtggctaatgactactgtttttcatagcccagatgttgatatgagcttcttgagggcagcggcctagttttattcatgtttttattccatatagtacagaatggtgttccctaaagtctgctaaacaacggaatgaatgatgtaagagttgtatcaaaaattttcatcttttgtagtttatacacctctctacacatatacaaataaaaatcctgcttatgagtataacacatattctcacatctgacacacagatctcattaccccattttcccgatgaagaaagggaagatcagcaaagntaagtgacgcaggccactttataatcatgaaaaaaacattgaggctggcacagtggctcacgcctgtatccancactttgggaggcnaggcaggcggatcacaggcagganancaanacatctggctacatgaagaaaccttggctctaaaaacaaaaaataaccgggnggggggccccttgagncccctcttggaggggngcggngaatacttgacctggagcaagttcnnnaagaanccccctgcctcgctggcaaaag

SEQ ID NO: 22540 - DNA, 714 bp, Homo sapiens
  misc_feature 553, 590, 601, 610, 623, 661, 668, 673, 683, 692, 699, 700,706, 711, 712, 713, 714: n = A,T,C or G
gacagaaggataggcagtcagcatgcccctctgcgtgtccctgtgttacggggacgccggctgggagccgcagagctatctcagaactagggcgctctcctttgggcacctccaggccattttcctttcattcgagcccacagggttagagataaaccctcactccgttgcttggggacaagggcttcactccctgtcccgagcttgcggctgagcttgagggtggctgggtcatcctggccccccactggatgggaattggctgctctggtgatttctgtgacatcccagaccccaactgtggggctctggagcggactgcgcttcacttcgtggggagggtgtttccacctaggccactcttatttctcttcacatccccagatctgtcttctgagactttgcccttctccaggaagagcactcaggagaccaggaaaatggccacagggctcctgagagccaaaaaagaggtgagaattaactgtaattctatcttggctgtcaacagaatgggtcccattaccttttcttgtcctggaggctgccttgntggtattgggcaaagtcattcctagccctagtcattnctagtccatanaacaaggangattttgatatantcttgtaaagcgtccgattctgtccctgttaaggcgcncttgtanctgcncggacctggnggctgaccnaggattnnagaccnaaccnnnn

SEQ ID NO: 22541 - DNA, 76 bp, Homo sapiens
  misc_feature 14, 16, 17, 42, 44, 46, 47, 48, 49, 53, 54, 56, 62, 64, 65,67, 72: n = A,T,C or G
tttttttttttttngnngggggggttggttttaaaacccccngncnnnnaaanncntttttnannanccttngaaa

SEQ ID NO: 22542 - DNA, 777 bp, Homo sapiens
  misc_feature 654, 681, 691, 695, 701, 736, 744, 746, 748, 754, 755, 756,769, 770, 774: n = A,T,C or G
gggatccaaattcaaaaaggcatctgaaaaatttaacagctgaaaaacactttctccttgctgggaaaacttaaaccttgctaggctttatgcaacttaaaaaaaaatcacttctgtgctgagaactagcatgagaaatctcagcatgaaaggttggtggattttttttcttcataaaactaagcccaattgttggttttaagagtgatgccacaatatacatatgctttgttaggaacaaatataatctaatttcaagggcatcttcaacaaaaattagggggaaaagataaaggctacttaagcagtgatccagtgtctgaaagcaaaggttgagaacatcattgtaccatcaaggtctagaaatgctgctaaccctgagcgggttgttactgtttgaaaagcctatgggtatttgttttattgttgtctcactcaattcttacttagctgagagtatctcacaagggaagtactgctctgtgatggtgttctggactttgttttctatttgtttcagcacttcaataaatggtctgttacctgccattatgacctgtatgcatttgctgagcagtttttcaaaacaaaacaaattatgtggctgtatttctagaacgctgagccattttcagatagtttagaattagaacnccatagacccgtccccccattggatgntatactgaancatntttcanactattcaggaaaaaaaaaaaaaaaaaaacccggngccctttncngnaacccnnngaaaaaacttggnngtgnccc

SEQ ID NO: 22543 - DNA, 783 bp, Homo sapiens
  misc_feature 171, 172, 173, 174, 309, 536, 570, 601, 613, 615, 648, 661,688, 714, 720, 722, 723, 732, 741, 756, 762, 764: n = A,T,C or G
agggagggcggtcttccccggctcgccaactcggctgctctgggggattcgtgcgcggtgtgtttccattgtagaaaacctggtcatggaattgcagattgccccgccgcccttgaaaatcaagacatgggcactgggatatgttacaggtgtgggtccacagagcacgannnnaccaagtgtaaggctaaagtagacccggctcttggcgaatttccttttgcaaaatgttttgtttgtggagaaatggggcacctgtctagatcttgtcctgataatcccaaaggactctatgctgatggtggcggntgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaaacccaaaacaaaaatacctaaagttgttaatttttgataacagctagcactatcatgagttactacctcatttttactttctnaaccaggcccgcttcacgagttagagttgagctnccctgtagccaggactatgctgtaatatcantatgatctgggngnggccaaaacaatttcttattctggctatcaaanagtacttctaccnctggttggagaaattgagaaaaaatanatgattaatgattctttaaaaacatntttaanannagaacttanactaccagnagtggttcctgttgnacatcntnttttaagcaaaaatgctaa

SEQ ID NO: 22544 - DNA, 489 bp, Homo sapiens
  misc_feature 302, 343, 348, 358, 388, 404, 405, 409, 410, 420, 421, 430,433, 476, 477: n = A,T,C or G
gggcaacttgcatattctggggaagtgagaggtaatatacagtgtaaatgaatgaacagttagcatgttggtaatacaaaatatgtttgcttatttatggtaagtcatatgattccctagaggtaaacctgtctaaattgtttacgtgtttataatctaagtgattattttaaaaatggatactacgggccaggcgtggtggctcacgcttgtaatcccagcactttgggaggccaaggtgggctgatcatgagatcaagagatcgagaccatcctggccaacatggtgaaaccccatcttnctaaaatccaaaatagctggcatggggtgcatgtctgttgntccanctctcaggangctgagcaggagatcgcttgacccggaggnggggttgagtgagccnnatcnncactgcctcnncctgcacanacnagattcgtcccaaaaaaaaaaaaaaaaaacccttggccttttnntattcaaaatat

SEQ ID NO: 22545 - DNA, 839 bp, Homo sapiens
  misc_feature 3, 11, 12, 14, 17, 21, 22, 28, 34, 45, 47, 54, 64, 67, 74,201, 214, 240, 244, 249, 326, 337, 356, 406, 419, 446, 500,508, 510, 540, 568, 577, 594, 598, 657, 669, 685, 701, 722,774, 784, 785, 815, 820, 825, 836: n = A,T,C or G
atnacttgggnntncgntaanncttgtnttgttncttttggccgnancggcctncggctgcganagncgacagnaggggataatacctaccttaaaaattgctgtgaagaactaaatccaataacttacgtaaaagctctaggtaaaagcacatcaaggccatgataaatgttttttttttttcctggaatataactgctnttcttctcatacncatatggatctgagttgaaataaaanacanacatngttaaacttcatccttaacttggaaacttctggattttgtcacagcttaacattaaccaaatgaaattttgggtctntataaatatanaccataggtttgtcttatnttttacagagcacttataaaactgaggatttcctgggggaatatggctgnggggttttaaaanaaaattctgcaagggaaaacaggaaanactgaaaaatttaagccctgttcctttgcctctggaagcccctgggtgtcctgngggttcananattcactatcctcgctgacagcaaaatcanatctcctcgttggaacaactacctgagngggcttganacttgttaaaatccttntttnttaaacgtccaaatgaaaaccataggcccaaaagcttggtttcaaaatctaacaaacanaagcctttgctnggtttctctggctctntttggccaaaagctcnctgagtttttttgggttcaanatgcctttttgtttgttttacttttaaacaaccttaaaaagggcctgtaaangaagggaggnnggcttcccaaaaaaaaaaaaaaaaaaaaanggccnttttnttaatcaaaanaaa

SEQ ID NO: 22546 - DNA, 753 bp, Homo sapiens
  misc_feature 2, 9, 23, 553, 609, 642, 661, 679, 691, 702, 705, 712, 715,727, 728, 740, 752: n = A,T,C or G
gncgacagnagggatttattgantatttatggagagccagtgccaagaattctgagggatatgaaaatgcttgttagtaggctaccatgggaacttagtttagtaggtgagaaagtcttgaatgtgaatagctgaacaagtaatacaagttggcagtattttatgggtgttacaagtgatgacttaggttcaaaggaataagcagttatttctagctggaggaatcagaaggcttcatggatgtaggacttgaaaggcatcttatggacatattagtagaagatgtactaattggagcaaacaacactgggaaagtcctgatgatttaaagcttctctgatgtatcttaattttattacataaccgatgtttaacaaatgattggattattaatattaccattttttggtcttaaaaagaatattgttgtgttagatgattcagcatagtattgtagttctcaaagtgtgatccttggcagcatcaacatctcctgctaacttgttggaaatgcagattcttggctgaatcccatatctagccgttgagtcanaaagtggtgtgggattcagcaccctgtgctttaacaggtcttattttgcagagccncttctacttaatgactaccttttaaaatgcggnactgatgctcactttggcncactttgttaaattggangatccaaaatanatgtccctgcncangtgcccnagnttccaagggttnntatttttattcncctgctgcctgnt

SEQ ID NO: 22547 - DNA, 742 bp, Homo sapiens
  misc_feature 488, 572, 604, 633, 675, 689, 701, 705: n = A,T,C or G
ggggatataattaataataaactactttccagtcttacacttgtcattttgccttaaaacagaagcttaataggacctaattgtgaattacatcaatttttaaatcataatgatatagctacagtgtagtttaattttctcatttcagaaaaaagtgaactgttgttcaaaaaatgaagtagagttctgatttgcaaattctacagaactaaatggacactactggctattctgattccaatattgcaagtaaatcgggcagacaggaatatagtacagaagtcaacctagatcagaagtcaacagcaatgccttttaaaccttcatatgcctacattaaatcttggtaaaatgtatatttttattcagaaggtgtagggtagacctgagattctgcattgctaataagcagtcagtgatactgatctgctgccccatggaccacacctgggatagcaagaaactaaaggaagcacatctgaaaaggnggccatgaatcttgctttcttatcattaactgtccccaaagacaatttcacattggttttgcatttgagaatacacatactggntttccatataaaggaagaatatgaatatgctntagtaatttatataaatctgtgaataagnttttgcattatctgccatattaaggctaggatcatatggagnatttattacatctnattcaacttttntttnttaacaaaaaaaaaaaaaaaaaaggccttttctaaac

SEQ ID NO: 22548 - DNA, 783 bp, Homo sapiens
  misc_feature 2, 9, 608, 641, 659, 667, 678, 691, 710, 726, 738, 742, 751,759, 760, 768, 779: n = A,T,C or G
gnagacagnaggggttttctgtgtgtttctccattatgttgttgcatttttctctatttacgttatctccctttccctttttctctctgtccctccctccttcttcctctctattcttcccctccccttgtttttatgcctgattatgtggacacagacaaggattaaaacagggcacctgcccttgaggagtttacaatctgctgggctgaggatcaacacatgttcaaaaagagaggaaagaagtcaagggagatcatgccagatggacttaatttcaatgaagaacaggagtcctaaagattaagaagagaggtcttcctgcctgtaagaaggaggcactctctgcttctgtcatgtgctaagcttcgtcaaacagattatctctctaaaggtagaggcctgtgattgaccgctgtaccaatgactgagcagacataaaagtcagcctggatggctaccaccactaatcagatttgtctgctgatgcaaggcccttcagtcattccagaactggtaaatggagtcaccctgaggacaggccctgctgctgattgatgtccagtgtgggcagctctcttggctgctcaacattcagagaggctctncttgtttcagtgctaatgattgacagtcagggngagtatttcaggaggaanagtccccncccctccaccntgtggcaaaggtnttgcttccttggaaggagngattatctggggaaanctggttggcaanttgntaggaacancgtttgtnntgcacatnggggatggaangggg

SEQ ID NO: 22549 - DNA, 841 bp, Homo sapiens
  misc_feature 12, 15, 19, 20, 24, 31, 42, 44, 51, 62, 65, 73, 557, 558,561, 673, 674, 698, 754, 770, 789, 811, 821, 822, 832, 840: n = A,T,C or G
ttttttggcctncgntaanncttncttgttncttttggccgnancggcctncggctgcgagnagnacgacagnagggcaggccaaccccttcctcccactgggttctgtaatactgcttgggagtcatatacccaaagccctttcattgctctctgtatttccttggtcaataaggtatatattctattcaaagtaagacatgttctaatataaatattcccatttttccttaatctaagaactactggaaagctgaaaaaaaaagttttgaaaccacactatacagataatatagaaagaacagagggaacgtttgtaatcatatgaaaataataggaaatatacaattaaaagaagtttaaaaataacataaaataattttctattattacaaagaaactttctaggggtttgaattgtgtgtgtgtgtgtgtgtgtgtgtgtgtgtaaatgaatcatgaaccactctgggactaagatactttatctttgtaacaggtagtgaataattagaaaatcccaaacatcccattaaaccttaactttctaggactgnnggnactatagtcattataagtaaatgtaggtcagtgtattagttcattttcatactgctataaagatactacctgagactggatattataaaggaaagagttttaattgactcanntccacatggggggggaagcctcangaacttacaatcatggtggaaggcaggggtgtgtagggacatcttacttggcacangaaaaaagagggagcncaaggaactgcccttttancaatcagatctctggactcctntatgaaacgnngggggaaccncccctganc

SEQ ID NO: 22550 - DNA, 659 bp, Homo sapiens
  misc_feature 4, 30, 578, 587, 593, 635, 636, 637, 638, 639, 643, 644,648, 650, 651, 652, 653, 657, 658: n = A,T,C or G
gggnaagagcgaattccgtctcaaaaaagnaaagaaaaatgaaagaaaatacaaatattagccgggcatggtaagtgtccccctgtagtcccagctactcaggaggctaaggtatgagaatcccttgtgccctggaggcggaggttgcagtgagccaagatcgtgccactgcactgcagcctgggtgacagagcgagattctgtctccagaaaaaacaaaaaatataagtgatgttaacagagggacataaggtattttcagttcttgagaaaaagtcgtaactggattcatttcagaatcttgggagtaggagatggattggtggagggtataaaagaaaccatgtcggctgggcgcggtggctcatgcctgtaatcccagcactttgggaggccaaggcaagtggattgcctgagcttaggagtttgcgaccagcctgggcaacatggtcaaacccagtctctactaaaataaaaaaattagccaggcacggggggtgtgcgcctatagtcccagctacttgggactgaggctgaggcaggagaatcgcttgaacctgggatgccggaggttgcantaagctganatcacnccactgcacttcagcctgggcgacagagcaagattccgtctnnnnnattnnaaanannnnaaanna

SEQ ID NO: 22551 - DNA, 745 bp, Homo sapiens
  misc_feature 585, 588, 594, 644, 649, 686, 703, 736: n = A,T,C or G
ggggtcatgaaaacgaatgaattaatggcatttgcagcaacctggatgggtctggagactattattctaagtgaagtgactcaggaatggaaaatcaagcgtcgtgtgttctcactcctaagtgggagctaagctgtgaggatgcaaaggcataagaatgatacaatggactttggggatttgggggaaaggtgggaggggagtgagggatcaaagactacaaattgggctcagtacatactgctagggtgatgggtgcaccaaaatctcataaatcaatgctaaagagcttactcatgtaaccaaatgccacctattcccctcccccccaaaaacctatggaaataaaaaattaaaaaaacaaatcctaaggttaaaaaaataaagaaaaaaatacaaaatggtgtttggtaactgctctgtctatggagtagcccattcttttattcctttactttcttaataaacttgctttcactttaagaaaaaaaggtgggctgaggaagtgagagtgtttggttcaccccttgtttgtccctggcctgctagtctaaattcctgagtgggtaaacttcttctgggtgnggnctctantttttctattttatattgagccatctcaaaacatgtaataatggacatanatcanaggtctcaaaatggggcccccaggcctcttcttaccncgtgggtttcttccaangggttcattgctaaatcaatgaacctttcttgntaactttca

SEQ ID NO: 22552 - DNA, 779 bp, Homo sapiens
  misc_feature 2, 9, 597, 678, 699, 719, 727, 751, 753, 766: n = A,T,C or G
gncgacagnagggatcatggctgatgtaagcaaagtacttaatggagttgtgtttttgcagagaagcaaaatgttatcaacaagtgtcatttgaggtccttttcccaaaaacaccagagtatgaggttataggctgcctggagggcggagatattttatcacagagttaagggtggagaaatggggagaagaaattgataggttttccaaaccttgctttgccttctggtgtcagatgataattgtttttgcaaaatgctgcagggtgagagagagtgagactgacttactcttttcagcattaaactggagggaaagaattacagtgggagctgaagagtgacctggtatgtgtgggtgatgaatagaagaacactttaccccaattcttctgaagcacagtaaagaggaggagaaatgaaccagtttgcaaaagtgggtctacgttagctgaaaatatgcagcccttgagtttatatggagttctagacagatggacacatgtaggtactgccgctgagtgggcaggtgtattacaccttgctgggagtgaatgatggcttatttgtcagcgatttacaatcctaagatggagangtagcacgggagtcaaaggccatgcagcctcaggttcccgtgcttttgagatgattaagaatgcaagttaggctggcaagnggctcatgcctatgatcgtanccttgggagatcatcctacnctttggangcttagctaaagattgctagctangnggaggatccttgnctcagagtcaaac

SEQ ID NO: 22553 - DNA, 577 bp, Homo sapiens
  misc_feature 418, 490, 539, 549, 572: n = A,T,C or G
ggggacttaacggtggtggctggttctgcgccggatccgggagaggggcgggcgccattgtgcttcgctgccgactgcatttcctcagtcacgggcctagaactccaaggagaaaggcggcgaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactnctgtcaaactgtactacctcagctgggagaaatgttggaaatggtttaacacattatcagattcatcttgtngcatagtcaagttctagatcttctcatggtccttggatctttggaacancttatgaganaaaggaagatttgagaaaaacanattct

SEQ ID NO: 22554 - DNA, 788 bp, Homo sapiens
  misc_feature 1, 8, 17, 23, 580, 643, 693, 705, 731, 761, 765, 767, 772,779: n = A,T,C or G
nggctagnagcccccanaacagnaacgtggtcttgctagcaccttggttttcatgcattttaaacttttagcggtcaaactctaagatcatatatctgtgttgttttcagccactatgtttgaggtgatttgttaagcggagatggaaagccaacacacacacacacacactcacacacttgaactaaagtggatagacaagatatttcagatactactttaaaaggccctaaagccaagactaatgtgtgaccacaattacctggaggatttaagaacctaatgcttctgcgggtggcacgtttgcccaggtatttgtactaatcctctgctttgctgtagcttgatttcctggcttaagtaagcaataggtttattgctctgtgccctgtgggcattccataaatacttgttgactgcctgacacagtaagtgttgtaattatctctcagatgggggaacaggtgtggtgaggttaaagcggccaggtaagacaagggacttctctggggttgcatagcaaccgggaggatgctgagctgacatcaagttgtctttgcctataattgtctgccctttncataaccacagcattccacttcacgttatccatcttttttgctcatttagttaggctgtgagnaccagtattggttcaagccccccaggatcctgagtaaaaatcactggtcntcagcatatcangaaactttgaattcctgagtgctgangtgattttgacctattttgagccttactgnatcnangcggngtgaaanacctggaat

SEQ ID NO: 22555 - DNA, 556 bp, Homo sapiens
  misc_feature 356, 394, 415, 421, 434, 440, 458, 459, 467, 470, 492, 493,497, 516, 521, 522, 537, 547, 553: n = A,T,C or G
gggggaatatgtgcttgcctccttttcaccttctgccatgattgtaagtttcctgaggcctccctataagcataagtctgtacagcccacagaactgtgagccaattcaatcccttttctttttcaattacccactctcatgtatatctttataacagcgtgagaacagattaatacactcctcctcagaaagcattcaatttagttgtgtctaaagtatgccaggtgttctagggtgttatcttagccaataattcttcctcttcagcaaagatctatttgcctatgacagcttgacctacatttcctaccatacttgtcagtaacaagtagcccataacatctgatggactttnttgaatcacagaggttctttagttctctactttattancaggcatccgggaaacacatnactttntatttaataaggngcctgntgctttgaaaactgctcnnagaaatanganggcttacttaaagatattactnngacntgctgctggtcacacctgnatccnncctttgggaggctgngggagaggtncttggntcc

SEQ ID NO: 22556 - DNA, 799 bp, Homo sapiens
  misc_feature 14, 21, 22, 33, 46, 47, 52, 62, 219, 220, 634, 689, 692,694, 721, 724, 756, 781, 782, 786, 794: n = A,T,C or G
ttactttgggtttncgaacannctttcttgttncttttggccgcannggggnatgtaggggncaggagcctttgttaggaaactcgagttggattccattttctaggtgttgactctttttcacctagggagacagacagtgctcttgaacctctttttgcatcacttgaatacagccgcttcttagaataggaggctgtttctttcccacctactcanngggtctcctttcctctggggctcctgtatgcctctgctgtcatctcccctattttgctgaacagaaagaaaccagaaaagaaaagagagcaaaacacacaaaggaagaaggtgagggagggcaggaggtagagggagaggttgacaccaaggaaaaaagaatttctcctctgagagttagaggttggataaatagctaattggatggattttggttttagttacctcacctttgtcttaatgaataaatcatgtcaaatgacttcacctccaaggagtaaagcattctaccagtgggtagaatgagttcacgtttggaaaattttagctcttcaaacgagacattctgtggaatgaactgatagcacgcggcctgtgtggctcagaggtgaagcgttggaagggtttgtggganatgttctttgtgtgcttgttaaccaaagcagaattctgctcctctttgggagaantgncncattgacgtggtttctctttatgtggnttnggaagggacccttgggctctggaggggaaaanggcctcagttttcaatgagactcannaaangggtctangctgg

SEQ ID NO: 22557 - DNA, 766 bp, Homo sapiens
  misc_feature 1, 157, 534, 605, 613, 655, 685, 702, 723, 740, 746, 753,756: n = A,T,C or G
nggctgccatgaaggaaacaggattgtagaatggagggcaccaaccaaagaggtctctgctgccatctggcctttcaggtttggatatgacaatgaagggtggtctagtctagaaagatcagctcacctgctcaatgaaacaggtgcagatttcatngcaattttggagagtgatgcttctaagccctatatggggaacaatgacttaaccatgtggctaggggaaaagttgggtttctatacagactttggtccaagcacaaggtatcacacttgggggattatggctttgtcaagatacccaattgtgaaatctgagcatcaccttcttccgtcaccagagggcgagatcgcaccagccatcacattgaccgttaacatttcgggcaagctggtggattttgtcgtgacacactttgggaaccacgaagatgacctcgacaggaaactgcaggctattgctgtttcaaaactactgaaaagtagctctaatcaagtgatatttctgggatatatcacttcagcacctggctncagagattatctacagctcactgaacatggcaatgtgaaggatatcgacagcactgatcatgacagatggngtgaatcnttatgtatcgagggctgatcaggttggggtatgcaaaatctncatgctgaactgagtgattcaaaaattcanatggcaaatttaggatncctgagaccccctattttganaaacccaaaggggctanacccanaaaattntanaaattctttt

SEQ ID NO: 22558 - DNA, 236 bp, Homo sapiens
  misc_feature 162, 163, 189, 190, 195, 197, 204, 206, 207, 208, 210, 211,216, 217, 218, 220, 221, 230: n = A,T,C or G
ggggaatgataaaataataatttgccatgtcttctaataagagtgaaaaagtgaaaatgaatctgtatgcaacattatttttatttcttaatacattttgggaaacttaattgcaactgtgtggttcagggatttagtgcaagaagaagaacagttgatacnnaaaaaaaaaaaaaaaaaaaaaccccnnggggncnttttttncnnnanncccannntnnaaaaaaccnttgggg

SEQ ID NO: 22559 - DNA, 801 bp, Homo sapiens
  misc_feature 554, 573, 615, 621, 638, 693, 709, 741, 749, 772, 775, 779,780, 781, 790, 795: n = A,T,C or G
gggataatatgttttaatcattttgggtgttttcaaaacaaatggtgagattaggggttttttttctcttctatttttggcccctttcctctggagagtccttctcttgtgtttagttcttggtgttcttagtatatttgaagaatgcttttaagtatttgaaatgtgtgtacatggttgaaaggggatgaggaagaagaaaccgaaaacttcatgaccctgctcaaaccaatacccataccccagccctaaagcagtgtccgggcaccacatcttcaaggaaggccccttggaaacccctcatgggccagtcctctgacccaggtgatctcctaaccccctttatgtattcttatgaggatatatgataaagaacggactgtgagatttgttgttcaaatttttccccttagaatgtgagctcagtgggtaatagtaccatgttggctctgtccacagttctactatcttcagcatagggcctggtatacagtaagcgcttaaaaatacatgtcaaatggctgggtgcagtggctcacacctgtaatcctagnctttggaggccaggcgggngatcatgaggcaggaatcaaaccacctggccaaatgggaaancctctntctaaaaacaaaattanccggcatggaacagggcctgtatcccactctaggaggctgagcaaaaatgcttanccggagcaaagggcanggcccaatctgtccaacctttaccggcacaanaaaattgncaaaaaaaaaaaaacccgggccnttncctnnncaattaaantttgnttgacc

SEQ ID NO: 22560 - DNA, 757 bp, Homo sapiens
  misc_feature 2, 8, 12, 18, 19, 20, 28, 39, 44, 52, 67, 75, 567, 576, 633,646, 647, 652, 655, 672, 677, 681, 696, 708, 710, 730, 736,737, 738, 748, 754, 756: n = A,T,C or G
antactgnggtncgatannncttgcttnttgcttttggnccganccggcctncggctcgacgacagnagggaagnaatgaagaattataaaaaagttaagaattttattttgaagactgatattctaagttgcatatagcaaagaagttacgaacttttatagtcaaggacctcataacacatgatagatgctaattttaattaaatttattatttcaactttgaaaaatggggtaggaggagagtatgaatcagaggatgaagtaactcacaatttaggctataggggccacatttttctaacttaatattccatgattatttccaaaggttacttaaatccaatatatgactcagagcttcagacttaacgtcatacattttcacataggttttaatttgtggagaaaggacatattctgatattattatagaaaagccattggattctatggtgtgataataagagatttcaggtctgggtcttctttatcagtcagcttttgtattgcaataacctacaatctcaattctcaaaggcttagagcaagatcatttgctttttgntcatctgangactgccggtgagtttgggttggctggctcaatttcactgggcttttgattcaggancccagagtgaacnncaccnctnttctgcagtttcacgcnaggcntccngggagacgaggctgncccaatcaatancnattgaacctttgcttatctnccatgnnngggtgctatntcttancna

SEQ ID NO: 22561 - DNA, 320 bp, Homo sapiens
  misc_feature 81, 84, 95, 108, 121, 186, 198, 209, 220, 230, 232, 237,241, 249, 258, 269, 286, 287, 288, 306, 312, 315, 317: n = A,T,C or G
ggggctcttcccttttgcggccatcaccgaagcgggagcggcccaaatgaagtttaatccctttgtgacttccgaccgaancangaatcgcaaangcatttcaatgcnccttccccattcnaaggagattatgtcttccctctttccaagagctgaacagagtacacgtccatcctgcccttcganggatatgagttntgttgtcgtgncctttaagtcncaattgcaantntccgnttcngaagattntttttcttnacggtgctggnaagctttgccacttccnnngcttcccccaggggtttnttgttnctncnaac

SEQ ID NO: 22562 - DNA, 725 bp, Homo sapiens
  misc_feature 2, 14, 483, 505, 541, 553, 573, 592, 603, 610, 613, 661,676, 682, 684, 685, 694, 697, 700, 710, 718, 719, 720, 722,723: n = A,T,C or G
cngctgcgagtaanacgacagtaagggagggagtatataatgaaattaagtaaatgaggaattgcctaaaactaagggagtttcacctccatgtaggtagaagaatgtgaaatggtctgtgtccagaagccagatcagaaatggtccatagcaaggtggggagggcagcgggtacccacctggcagtgtagggggttggattcagcttcatcttcctgaccccttgtcaagtggacgagctccagccaaacaaaggaagtgtgttggagtggccaccagcacagaagtgtacctttctgggtaatgtgtcacccagtcccctggccatgtgagaggacaggcacagttgccacacagtactaatagttggtctcttctttaagggtcaaaaaaaaggaggtggagcacttttaagaaagtgttaaggttccatgaagatgttatggtggcgtgctggcaggtgcatatcaaccctgccctgangccctcagcagccttcggtctncccaaagcaatatggctccttataaaaagtctttanggctggctcggnggctcatgcctgtatcccancctttggaggcaagcggcngatccaagtcngagtcanacngctgatcatatggggaatccatctttctaaaatcaaaattactggcgngggcgtgcccttatnccactntnngagctagcnganatncttaaccagnggggggtnnngnncc

SEQ ID NO: 22563 - DNA, 682 bp, Homo sapiens
  misc_feature 4, 479, 498, 537, 585, 587, 591, 598, 623, 629, 635, 637,649, 654, 657, 659, 663, 665, 666, 677: n = A,T,C or G
cagnagggatcttacatttttaataaaaatatatgtgtacatggtttatcttgaagtattaatattttaaagtatttgtttaaagtgaatttagcaaagccatttgttttctttgataaatgtcatcggtaatgtaaaagttcctttatttccaaaataaattttacttagaaattatatattcctaataggtgtgccaagccatttgaatgtagactatatcaaagaagccttgatgaaaatagaagatgtatattcagtcgaagatttaaatatctggtctctcacttcaggaaaatctactgccatagttcacatacagctaagtatgttgctggtagtaaatgtgggcctggggttggtggacttctgcctttgaaactaaacatccctgcttataattatgtaggaagacttttctgctgaaaagatttgttttaagacaaaagcctttgtctttaaaaaacaaaggcttttgntaacagccttaaacaaaangctctttaagggtaagttgcaggtcagtattgataccanaacataattttctatctctttgaatattaccaactgatttaaccttanantaanggattanaattttcctgctggcatggggctcnccctgnatcctncncttggaagctgngcggnggncnctgngnngagttgaaccnccggc

SEQ ID NO: 22564 - DNA, 738 bp, Homo sapiens
  misc_feature 3, 9, 14, 17, 18, 19, 20, 26, 562, 568, 587, 603, 605, 623,648, 652, 674, 704, 720, 721, 738: n = A,T,C or G
ttnacgtanggtanaannnncctttntttggtgcttttggaccgaaccggggttttacattagggaaaaagcattattgttactggcatagggagggccccagttaaaatagcagtccaattcagagaccttcgtatttgtcgttaagatcaaaaggactcttggaataatggactatgctacaggattattttaagttcagatagataaattagcttcttcccaaattctcattctgcttttcctgtggtactgtatagtatcatgaagttatatctttaaactcttagtttgtactatgtggtgtcttatgaaaaccttgatttgtttatacttagtgaatgaaacacttgggtttaaagttctttaactgatgtcacttcttaggctagaaagctgttgaaagaacttagtgttccacccttagaccaaggttcatgtcaccatatttaacagcagctttgtattacggtcaagattgtttgaagaattcagcatacaaacttaatttacagatgcaagcctgcagatggacctccccacccccacttttttgctttanataggntgtgactggaggaaattanttttcctttccttcantnttgcagctgttccatttntgatgatgagatgatgatgatgatnatgntttagatcatgtgagagaaaanaactatttttttcttctatagttattcccnttctatttcctcttgnnttgcttcttctcccgcn

SEQ ID NO: 22565 - DNA, 674 bp, Homo sapiens
  misc_feature 1, 2, 10, 460, 492, 570, 575, 594, 607, 609, 625, 628, 634,652, 653, 661, 666, 669, 670, 672: n = A,T,C or G
nnacgacagnagggcacgtactcccaaatcatcatcatcattatcgtcatcattatcaccatctgataaaattaaggaaacagtaaatcatgagaaaaaaaaatgaaagaggagattcagaaagttgtggagatgaatcaaaagtacaaaatacagaaaccctggggaatcaagattttaaaaatgctataatcagtggccaggcattggtggctcacgcctgtaatcccagcactttgagagacagaggcaggcggatcccctgaggtctcctgacctcagagaccagcctggccaacatggtgaggcccggcctctactaaaaatacaaaaattagttggacgcaatggcacacgcctgtaatcccagctactctggagactgaggctggagaatcacttgaacccgggagagggaggttgcagtggcgcggtctcggctcaccacaggctccgtctnccgggttcacgccattctcctgtctcagcctnccgagtagctgggactacaggcacccaccacctcaccgggctaattttttgtattttcagtaaagaccacagggtttnaccgnggtaggcaggatgggctcnatctcctgacctngngatctgccccctcggnctnccaaanggtgggatactggggggnncccccctncccgnccnngntt

SEQ ID NO: 22566 - DNA, 286 bp, Homo sapiens
  misc_feature 61, 77, 155, 170, 226, 228, 236, 237, 244, 247, 253, 255,256, 271, 278, 281, 282, 284, 285: n = A,T,C or G
ggggaaactgggcattctcaattccgagtactttattgcctgaaaaattttaggacttatntaacatagtcaattanatttagaaatgggttgttagctctcttagagagagcagtctttggatgataagggtcatagtgagtcacagtgggcanaagagtgatgggaangtgaggaaccaaaatagaaaagcttgaccactcttcccaaaaaaaaaaaaaaaaancnctggggcnnttttccnaantccccntnnaagatccttggaganttggcanccnntnnt

SEQ ID NO: 22567 - DNA, 740 bp, Homo sapiens
  misc_feature 659, 738: n = A,T,C or G
gggagttcacatacagctaagtatgttgctggtagtaaatgtgggcctggggttggtggacttctgcctttgaaactaaacatccctgcttataattatgtaggaagacttttctgctgaaaagatttgttttaagacaaaagcctttgtctttaaaaaacaaaggcttttgttaacagccttaaacaaaaggctctttaaagggtaagttgcaggtcagtattgataccagaacaataattttctatctctttgagatattacaaactgattttaaccttcagattaaaggtattaagaatatttcctgactggcatggtggctcgcacctgtaatcctagcactttggaaggctgaggcgggtggatcacctgaggtcaggagtttgagaccagcctggccaacatggtgaaaccccgtctctactaaaaatacaaaaattagctaggcgtggtggtgcatgcctgtaatcccagctacttgggaggctgaggcaggagaattgcctgaactcatgaagcggaggttgcagtgagccgagattgcgccactgcagtctagtctgggtgacagagcaagactccatctcgggaaaaaaaagaatatttcccggcctggcgcgttgactccgcctgtatcccacactttggaggcaagngggtggatcacctgagtcaggagtcagacagcctggccacatgatgaaaccctctctctaaaaatccaaattagccagncg

SEQ ID NO: 22568 - DNA, 772 bp, Homo sapiens
  misc_feature 702, 717, 735: n = A,T,C or G
gggggtagagttttcagattgctcttgggaaccatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactacgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggttttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgaacaagaggcgactgcaagagctggctgaattggaagccaagaagcgaaatgaagggaccttgattgacaaccagttcaataccagnctttttctagcctanactagaggcagcatttanatcaggaggcaagtatttcttgattcataacggatct

SEQ ID NO: 22569 - DNA, 748 bp, Homo sapiens
  misc_feature 664, 687, 715, 730: n = A,T,C or G
ggggaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaggtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaacttaaggaaataaacttttggttgcatnttgatggatgtctcaccatggcncattttgttcaggagaccaaagaatatntcttatgatgtaaanagctttgggataagttat

SEQ ID NO: 22570 - DNA, 721 bp, Homo sapiens
  misc_feature 1, 2, 10, 15, 22, 704, 712: n = A,T,C or G
nntagacagnagggnaacaagnaagcagggtggggggtgcattcatccctgccttcctgagtagtctattcacccaaagacaaaaggatgaccagcttccatcagggatattcaaagacacagtcaccctgccatgcagccagaggctggcaaaggtccaatcccctttttaagaagcttgttggatgagctctttaaacatacaaccacaaaggaaaggcacagccagtgtgagggaggctgataagatgggcattttgtttgcttcaaggttagaatgcaacttgtctatcaaaatgtggttatctgacctccacaatgctgcagtccagttaaatactgcaaatattcatccaccatttactatggataaaacaataatgtgctgtggggaatccaattacacagacacacacacacccaagaaagtgcacacacacgtgggcacacacactgctcctgctgcctcagagcttccaggccggcaaggagtaagtgcaaacattagtaggtaagtctgctaccaggaagaatatgataagtagatccaacagggtacaacgcagtatgatagaagcaaacaaggttgagatgagttctgactccctttccttataaaactgattatggaatagtttatgaaagactcgcctggatgaatctcatattttccagggttttctatcccaggattggaactttantcatcttnacattggcc

SEQ ID NO: 22571 - DNA, 763 bp, Homo sapiens
  misc_feature 706, 744: n = A,T,C or G
gacgacagagggcagtgggaaagagagaaactttaatgaatgactttatgaaagtaactctaaaaccactaagatatggtcatattgggggagttgcagggggagagaagtagggagaagggttgtcctctttctttctaacctcccctcagtctatcctgtagtttaaattccatgaaggtgctggccatgtctattttgatcactgcattgtccttagcacctatcataacatctagacaatagcaggtattcaataaatgttggaatgtgtgaatgaataagaatttcaggctgaaaaatagagggaagttgttttctgcattcttgaaatcaatatcatattcctgtccggggaactgactaaactctgggtctttaggcagatatggaagtgtccttggcacagattcagttccatttgcaggtttgtgttcagtgtgtcctgtcatcatgactgtaccactacgccagtccctgggaagtggacctggcaccttccttcaccctcacatcaacaggaggacagttggagcctgagttcaagtttacctcaaataaaagcatgaatggttagtcaccagtatccaacttcagaccaaagtggccaaatattaaacagttagttttacagttggatttcaaaataatgtaaagtatgttgctttgctgaatatgagtcagctaactcttatagtatgattgngaacatttatacaattttttgggttgaaatttttctanatttgagctcagaatgcac

SEQ ID NO: 22572 - DNA, 725 bp, Homo sapiens
  misc_feature 2, 9, 601, 657, 677, 697, 703, 711, 715: n = A,T,C or G
gncgacagnaaggatatatggcttatttataagtagtatttgaatagaatactgccctaggaaaaacagagtgaaagagatgctagaagcatggactactggagtgttttacacccaattttcggaatgatttacctgtgtatatacagtataaatgactaaaagttaaacttgtggaagcaaatttcttggctagttaagaaggaaagaatgggagtttatacttttcagaaaaagaaggaacacttaggtgattataggcagaagggtagtaactatgtagaagcaacagaggaaagaatttggaataggatttccattccatgctttgcagttttttcacatctgtgcccttcttggagtgcactttcttcccccagaaggattttctctaatctgattttgttgcttctacccataatcgtactcttgatgctgaatgctgattggcaagtcagaaacttggccaggcatggtggtgcacctgtaatccaagctacttgagaggcagagtcaggattgttagagcttaagagttctgggctgtgatgcactatgccagtcggatgtctgtactctttggcatcagtatggtgacctnccaggagcaggaccaccaggttgcctaaggaggggcgaactggcccaggttggaanggagcaggtaatactactgngccgatcagtagtgcattgngcttgngattagcnctgncttcagctgg

SEQ ID NO: 22573 - DNA, 748 bp, Homo sapiens
  misc_feature 513, 577, 623, 640, 657, 662, 692, 696, 726, 729, 732, 738,747: n = A,T,C or G
ggggctatactcatatagagaagagacagagcaaggcaagctttaacagtgggcatctgttccctgtggtcagtgggcccctcccaacaaaactcaaaaaaggaattacgggacaggacaattatgagtcctgtctaactcatgagtgtagaagtagaaattctaaacaaataattagcgaatcgaattcagctatgcatcctgctgaatgagcttaatcagaaattcaaagttgtttaatgtttcttaatttttaagggtaatgcgccacattaatggaataaaagaagaaaatcatttcaattaatacagaaaaagtgtttgataaaattatttcagagtttaaaagttcttactaatcaacaagataatttctttaatctaatacattatattggccaaaaccataaatagatattatatttaatggttaaatattgaccccctccccattcccttagagtctgggactaacaaaagatgcctgctataaacattattttttaatggtgnatccttggccctagatagttcagtaatgcaagaaaaaaataaggattggcaatgaagaaataancattcatgattgacagatgtaaaataattaataggtgaattagcanggtgctgaataggtaanttaaaatcattaaattnctctntgcccaaataacagaaaaatgattaaaatnccgntttaaaaaaaaaaaaaaaaaaaaggggccnttnccnaatccnacagaaaant

SEQ ID NO: 22574 - DNA, 447 bp, Homo sapiens
  misc_feature 8, 31, 39, 53, 59, 73, 76, 81, 87, 88, 92, 94, 97, 125, 130,131, 145, 147, 165, 196, 206, 214, 215, 219, 328, 329, 331,332, 358, 362, 372, 373, 380, 394, 401, 405, 417, 423, 426,435, 436, 443: n = A,T,C or G
ggccgagncggctcttacggctgcgcatcantagacagnaggggatttgttgntggggngggtggtagggctncangcctnggcttnngganantanccgagccccacgctttggcaactggtcnggaanntagactatgtatgntnatggggagtgctgctgtntgcgttgtaagctactaaacgtgttggaccngtgacatatntaagaaanngggngcgggcaaaacgctgaggctcataggaggctctgtggtcaatattcaattaaaaggctcttacctggctcctcagactgggagcagctgtcccccggttggagaggcgnntnngaagagttgtaagagagactcggtcnggtncgaaagcagnnctcacgngtaagaacgtgatnctcgacntgtngtggtgttattnacgaanttntcctcctgnnggacaangcat

SEQ ID NO: 22575 - DNA, 729 bp, Homo sapiens
  misc_feature 678, 698, 701, 708, 728: n = A,T,C or G
aggggacaacaaagggcatgtcttgacatgcagagatgcgtagactacctgcaaataggcgcatatttttttaaagacagtagttagttccaaatatattattttatggatgaacaatttaatctaaaggggactatatcaggatattggaatcacttattgggccgtaagaattgaaacctagatcaaataaatttgagtagaaggaaaaggtaagagaatgacacaaaaagcacccagaggagagtatttctgtgtaaacaggtaaattaataggtggatatttaatacacaaattcacatttgtttcaagattggccttgtgtgtatggatactaaaaaggaaataacactaatgcttcattcatttttttattccaaataattttgctaagccccattacatagccaactcactgttagacactttgttttaaaggtgaaagagttaatacatttgcttccaaagaacttactagtaaagttacacacacacacacacacacactcacacacacacacatacacacacagagaatgagagagagaattacgtattctataggaaataaaggtaatatagaaaatctaactaccattcactgtaaattttttaaaaggaggattttacttatcaattttgaggataaaaaggacatcttcaatatgagtctaaanatatgcagggtgtccggggnggnggctacncctggatcccacacttggang

SEQ ID NO: 22576 - DNA, 774 bp, Homo sapiens
  misc_feature 620, 655, 662, 741, 742, 762, 765: n = A,T,C or G
gacgacagagggtgcccaggaccccattttcttcctctttcgcaggaactttgactcatagttgtccagaaggtctctcacacacctttgtgacagcaccttccacgctgtcccactatctgattacctgtctgtccaccttgctaaaaggcatatcttagacacacaactggtgtgtacagtccccttctgttgaatgtggctaggccctgtgaatatgatgggatatcatgccattgattaggttaccctatattggcagaggtgatatgatacactctgtgactaccataagttaggtaaggctctcatagcagcctgtaggaatgcagccttgccagtgccttgatgttagcccactgagattgattgtggacttctgaatgctacaactgtaaaacaataaattcgtggtgtttaaagtgtgtggtaatttgtcgtagcagcaatatgagattaatagatttcaattcctatcccattcaatataatcttggaggaactatccatcacaaggctgactctcctttctcccaaggaaaaacatgacccagattttccgagaccagaatcagaatggaaggccattgctgctgggtcaccccagcaacaacactcangataaggttccgcatgaaggctgggttccctgtangcccatncctccccaaatgatcttattaccttgagctattagtgacccaggatctttatgatgaacttatttttttttgcttgatnnctaaagcatttttttactcnagncaaaaactc

SEQ ID NO: 22577 - DNA, 795 bp, Homo sapiens
  misc_feature 555, 579, 595, 656, 696, 732, 740, 744, 756, 767, 773, 786,788, 790: n = A,T,C or G
gacgacagagggatacattgaacatgtattgagagcctaccactgtacttagtgctgggggttggggtggcaaaaaaataagaattagtctcttccctctagaaagaaacttagagtctaataaagaaagatggaaaaataagatgttccatccttgttgtagagttgtagaagtctctgttgggtacatgggtaacaaatgtgaaaaaatataattctgaggaagggagatacaagaaagctttcatttaaggtagttgacacctaagtcttgctctgtggttgacgggtaacaggtgtaagttgttcaagccagagattactagtttggcttcagaagacatttgtcaaggtagaagagtacaatttagaatctgtgtattcatgataataaaagctctggggaaaatggggacaaataaaaaatagaatcctaacagatactactgggtagagcaagaacatatggacagaaagataatgttggcagtctttggatatgtaatctatttaaaaatacaccttctaagtaagtgtcttatagaaaagatagangctgggtgtgatggctcatgccancaatcccagcactttnggaggcagaagcaggaggatcacttgagctcaggagtccagacagcctggcacatacgatncccccctttcacaaaatccaaaattagctggcatggtacnccatgtccgtgttcagcttctcaggggctgacctgnaggatccntganccccgaagtganctctggagccngatccncctgcccccaccngngnaaaag

SEQ ID NO: 22578 - DNA, 764 bp, Homo sapiens
  misc_feature 7, 452, 556, 562, 607, 618, 673, 685, 724, 754, 759: n = A,T,C or G
cacaggnagccagtaaagtacttccctggcggtcagattctggagggctgaatgtgtgtgtgcatgaataatcacagacaaccctgcttgtggtgttgtttgtgtggatggtgacaagtcctactgctggacagagtgagtaggtcctctctgcattttcttagctacctcatatggcttagggtggatcctgctgtgggatttataccagcgtgccaatgctaagaggggcctaattctccctctggggagtggccagagaggataacatgactgagaagtgtgcgagggaccttcagagggggaaagtgaggaaacagttcaacctcccagggcaggcaaagcaagacatccctggtttaaggggttgagtcttctggggcaggcaaggcgagacatccctggtttgaggggttgagtcttccagtaatttcaggagattgaacctgacnagtacccaacatgggaaatgtttctagtaaaacaaggacagggagtaaagatgactcagggaaaggtgaaggtgatcagatttcttctagtagtccttcagggngtatgntaatatattagaaggataatgaaaggaccaaatcaagaaaaaccnctgctgtccanacccttctcctatccctggtggcctcctcttataccctgcctcttgggaatcatnccaaagctcctnctaccagcctaagacccaggggccaaacctataagaccngaacccactcttcagcattaaggggaaagnaagcnggaac

SEQ ID NO: 22579 - DNA, 340 bp, Homo sapiens
  misc_feature 28, 117, 189, 208, 238, 245, 249, 251, 329, 334: n = A,T,C or G
gaaggcgaagaaaagaatagagaagatngggaaattagaagataaaaacatacttttagaagaaaaaagataaatttaaacctgaaaagtaggaagcagaagaaaaaagaccagctnggaaacaaaagcttaggccaaatgtccaacttagaagaaattgggagattgaaccagattgaaaatgaaatnttgtccagagtttcagatngaaaatgaaaacagctagaccagttttggngaagttngaantngaaaattttagcccaattggttaaattcctgtaaaaaaaaaaaaaaaaaacctgggcctttttcgatccaattaatcntgtgncccccc

SEQ ID NO: 22580 - DNA, 671 bp, Homo sapiens
  misc_feature 1, 9, 547, 553, 572, 603, 610, 648, 660, 662, 671: n = A,T,C or G
nacgacagnaggggatggcaaaatcaggcaagcccagcagaagaaaagaaaaaatctaattgcaactttagcaaagatgaaattctaaaccagtgatagaaaatagaatccagtcataaatgtaataaaaggtactgtatcataatcaatctagatttattccagtaatgaaagaatagtttaatattagtgtgatggctaatactgagtgtcaacttgattggattgaaggatacaaagtattgatcctggatgtgtctgtgagggtgttgccaaaggagattgacatttgagtcagtggagtgggaaaggcagacccacccttgggtgggcacagtccaatcagctgccggcatggctagaatataagcaggcagaaaaatgtgaaaagagagagactggcgtagcctcccagcctacatctttctcccgtgctggatgcttcctgccctcgaacactggactccaaattcttcagttttggaactcagactggctctccttgctccttagcctgcggtggcctactgtgggaccttgtgattgngtgagntaacaatccttgataactncccttttatattacctattcattagttctgncctctanaaaccctatacattaggaagcccttttaacacacaccncacccacccacncncgactttan

SEQ ID NO: 22581 - DNA, 800 bp, Homo sapiens
  misc_feature 2, 10, 15, 515, 646, 664, 680, 684, 703, 708, 711, 717, 718,724, 725, 730, 740, 768, 780: n = A,T,C or G
gnacgacagnagggnattcactgaataagcttttatgtgtatcagaatcacctggagggcttgttaaactacaaactgcttaactctactcccagaatttctgattcggtaggtctgggatggtgatggggatgggacctgagaatgtatattgctaacatgctcccaggtaatgctgatgcttcaagtcttggaaccacacttcgagaatcactgttataatgtacagcagaactgcatgatcaggtaagtgtgctgagctgttgatcctcctcattcctgagctgggtgtgtagagacaagagcaggagactaggggctgatgatcttttagtcacatccatttaccccagagtgctctatacaaatagcatttttatgtattccccggcatgaaaaagctggaaagcaccaagagaaggttgggtgttaaacaacatgaagttttggaatctcagaaagtctgaatgagttaatttttttgagctttaacatacttatcattttataatgangataattccttaaagcaattctgtccaatagactttgagatatagaatggtctgatctgagctgtccatggtgagccactagtcacatgtggcttttcagcattaaaatggctagtaaggtggggcacagngctatgcctgtataccanctgttggaggccaggngganactgcttagggtagagctnggctnagnagcttnntatggnncagtnctcaactggngcagagggacttgctaaaaaaaaaaacncgggcctttccnatcactaaacttatgccccc

SEQ ID NO: 22582 - DNA, 753 bp, Homo sapiens
  misc_feature 498, 513, 518, 567, 592, 599, 602, 611, 635, 644, 674, 684,689, 695, 709, 727, 734, 736, 738, 741, 742: n = A,T,C or G
gggagcttacttttcaatggaacattttagccaggtagtataagtacaggtgcgggtaacctcagataaatcaaggtgttatgcagctgtctctatattaaaaatatttgctgacatcagtgtagacttcatcttgtagttcttcagtgttttctttccttatcttttgctcataagatggctttgtgtttggtttgatattatactgagaaagcatattagaatcaaagcaccaagatttcaaaagtccagactactcttcccaaagagaaatgtgcaatcacaatagcatgacatgggtacaaatatagaagtatgttattaaagtattgagaattagctttcctaacctccccacctgcaatcttttactcctaatctccaaaaaatgaacaaatcattggctcaaaatggtcacaattgtatgtgggtggtaaaaatctattatttttattgtatataaaatgttgccaggtgtggtggctcatgcctgtaatnccagcactttgggangccangcaggtggatcactaggtcaggagttcaagaccagcctggccacatggngaacccctctttactaaaatccaanatagctnggnggggggcgnggcctgtatccacctctcgggagntgagctganatacttgacctggagcaagctcacagccanatgggcctgnctcanccaatncaacagactagctnaaaaaaaaaaaaaaaaangcctttncnanccnntaaatttggcc

SEQ ID NO: 22583 - DNA, 428 bp, Homo sapiens
  misc_feature 103, 114, 142, 144, 145, 146, 147, 156, 166, 178, 184, 201,203, 219, 221, 229, 242, 254, 255, 265, 271, 274, 317, 320,371, 373, 374, 377, 384, 424: n = A,T,C or G
ggggggagtcagttccgcggtagaggtgacctgactctctgagctcattttgcagttgttgaaattgtccccgcagtttcatctgtctgaaccatcaaatccntgggactggancactgggcaaattggcttttccctggtngnnnncaatttggnaaggattttnttttggaaaaanaccctnatttttgggggggggantncccccctttggggggncnggaggggnccttaagaaacanaaaatggccccnnccccccctanaaaagnttnccccccaaaaaaaaaaaagtccccttaaaaacccggggggggnccntttggggccccccccccaaaagggggggggggggaaaaaaatttttttccncnnggngggtttntttttcccccgggggggcccttttttatttcccccccagnggtg

SEQ ID NO: 22584 - DNA, 773 bp, Homo sapiens
  misc_feature 491, 514, 532, 598, 670, 671, 682, 706, 713, 719, 765: n = A,T,C or G
gggcagtgggaaagagagaactttaatgaatgactttatgaaagtaactctaaaaccactaagatatggtcatattgggggagttgcagggggagagaagtagggagaagggttgtcctctttctttctaacctcccctcagtctatcctgtagtttaaattccatgaaggtgctggccatgtctattttgatcactgcattgtccttagcacctatcataacatctagacaatagcaggtattcaataaatgttggaatgtgtgaatgaataagaatttcaggctgaaaaatagagggaagttgttttctgcattcttgaaatcaatatcatattcctgtccggggaactgactaaactctgggtctttaggcagatatggaagtgtccttggcacagattcagttccatttgcaggtttgtgttcagtgtgtcctgtcatcatgactgtaccactacgccagtccctgggaagtggacctggcaccttncttcaccctcacatcaacaggangacagttggagcctgagntcaagtttacctcaaataaaagcatgaatgggtagtcaccagtatccacttagaccaagtggcaanttaacagtagtttacaggtggattcaaatatgtaagatggtgcttgctgaaaatgagcactaactctttagnntgattgggacnttttacatttttttggttgaaaanttttcanatttgnctcagaatgcaccaaaaaaaaaaaaaaaccgggcgtttctaacaanaaataagg

SEQ ID NO: 22585 - DNA, 693 bp, Homo sapiens
  misc_feature 1, 376, 457, 465, 481, 503, 505, 555, 558, 563, 567, 573,584, 604, 628, 634, 637, 639, 643, 650, 666, 667, 672: n = A,T,C or G
nggggccttttcctgccctgggtctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgaccggggaggtggagggaganaaaaaacccctactgaagggggtgcattgtctctgaaaccaaggctccccatcaagggcatcagaatgaaatttgccgtgntgacccgnttggttgaagttgganaaatatcccataaggatattgnanaaactgtcttttacctgttgtaagaagacagtttgatctggaatgaattnttntccanaagngagagnttactgctggnggacctactggaaaatgganattcctgccagcaaaatctggaantgtttnaancntttnaaaaaantaccgatcttaatctnnctganaagcctgttgaaaaagcttgg

SEQ ID NO: 22586 - DNA, 859 bp, Homo sapiens
  misc_feature 12, 16, 19, 32, 43, 45, 61, 64, 72, 551, 564, 572, 592, 658,689, 692, 698, 714, 728, 741, 763, 765, 773, 784, 789, 796,830, 838, 839, 849, 851, 853, 858: n = A,T,C or G
taacttggggtncganaanccttgctttgttncttttggccgnancggcctacgctgcganagnacgacagnaggggtcttttggggcctattgtgaatgctttagtctttcagaaagtcaaaagtctgccttgaacacaaggccaccgtacactctgttcccacaacaacatcctttccccgacctcatacatttttgtccaaagcaaaatgcagccagtgacttctgtacaggaacctgcaccctccccagttgcgtctgtccctgtagcagagggaaaaatactcttggtttgttccctgttcttctgggttccagaattctttccaaagtcataagtcatgctccgctgtttagttgtgggcagcagcctaacaagctggggacttgggtgtctgtcacatcagtggccccgtcccccctgctggcatgatgagctctttcaagaaaccggactctgggtgtagcctcacgtttgtgactttccagttctgtgtctttgtagcagccacccatgttgtcactcatctcgtagtactccttggagaangtagtgatagacngatatgangtgggaccacaagcgacgangttgagaagattcagggccttcacgtccacgggcttgagcacacagcttgttttgcattcacttgntgactcccagcttggaccggacttgtcccgnggngcccantctagctatgctgggngggggaccctaganaattataacgggnaaatggctcatgtaaaactagngntttgcaanaatggccttgntttgnggaggtntgggactgaaaggggcccttatacccattgaaanttttactnnggtgggaagnananagaant

SEQ ID NO: 22587 - DNA, 444 bp, Homo sapiens
  misc_feature 3, 8, 27, 38, 40, 47, 67, 73, 81, 199, 220, 287, 307, 311,326, 341, 391, 397, 398, 415, 416, 417, 420, 424, 435, 436,438, 439, 441: n = A,T,C or G
ttnccgtncgctaaaccttgcttgttncttttggccgnancggcctncggctgcgatagacgacagnaggggnattcaagnaaatgtgatgtagatttttgagaatgccaaaaatcaggtttcagaaaagctacagtatgaaatctgaaaagcaacagaaattgaaagtgaccttaaagaataaatttcctaatttttncccagttttcctatgtttatnacctattattaaagagtttaacctttctgggacctggaaggagaaaaacctgaaaaaatgttttatnttggcttcttggttaaaccnggtnaacccaaattccccntttcaggaattttcntccctaccaaaaatttggggtgaaccttttttttaaaagggaaaaacctntaaatnnttttatttttttttccnnnttnaaanttttttttttnntnntnggg

SEQ ID NO: 22588 - DNA, 124 bp, Homo sapiens
  misc_feature 12, 14, 43, 45, 64, 76: n = A,T,C or G
gcagcagaagananaagaacaggatgaactgaacggattgcananattgcagaaatgacagctnttaagtgagtgncctgcacccctcttgaccacacggatattaagcttctgtgttgtgtaa

SEQ ID NO: 22589 - DNA, 819 bp, Homo sapiens
  misc_feature 3, 20, 33, 46, 53, 63, 66, 73, 75, 246, 247, 603, 710, 728,768, 772, 797, 798: n = A,T,C or G
ttnttttgacctacgatacnaccttgcttgttncttttggccgcancggcctncggctgcganagncgacagnangggttatcaacaagtgtcatttgaggtccttttcccaaaaacaccagagtatgaggttataggctgcctggagggcggagatattttatcacagagttaagggtggagaaatggggagaagaaattgataggttttccaaaccttgctttgccttctggtgtcagatgatnnttgtttttgcaaaatgctgcagggtgagagagagtgagactgacttactcttttcagcattaaactggagggaaagaattacagtgggagctgaagagtgacctggtatgtgtgggtgatgaatagaagaacactttaccccaattcttctgaagcacagtaaagaggaggagaaatgaaccagtttgcaaaagtgggtctacgttagctgaaaatatgcagcccttgagtttatatggagttctagacagatggacacatgtaggtactgccgctgagtgggcaggtgtattacaccttgctgggagtgaatgatggcttatttgtcagcgatttacaaatcctaagatggagangtagcacgggagtacaaaggccaatgcagcctcaggttcacgtgcttttgagatgattaagaaatgcaaagttaggctggccaggtggctcatgcctatgatcgtancacttggggagatcaatnctacactttggaggcttaggctaaagatgcttagctaggnggangatcgcttgactcagagtcaaaccnnctggcacatatgaaacctctc

SEQ ID NO: 22590 - DNA, 713 bp, Homo sapiens
  misc_feature 2, 9, 549, 601, 667, 696, 709: n = A,T,C or G
gnagacagnaggggagttactcacagcatgcaatttatatttagtggggatgaggttgaagaaaatacataatttcatgctgctcctcacatatacctaacgtttatgttgcagttcccaagtggttgcaaattcttattctaaaatggtagcttatcaaagttaaaggaatccaaaaatgccatttactgagaagggaagtggtcataacataggaatttttttttttaacatgcttagtgcctttctacttgcacctatgtcccttctcccctagtgtgggggtctgtgggctccccagggtagtgcttaagcactttgcaagaggtgcaggctgctcatttctccgattcccagttccctctgtttcctgggagggacgctttgctgcagcttcacctgcttatccctactctctacagctagatcattgtccaggccttaagctctgtcagtcgggcacgtgtgcacacacagacacacacacgcacagctggatgtgaactcttgactccagtgtgtttctaggccagcctgcttgttgttccnggttgctccgagaaaggagggtgctgattgctcctctggatccagcccgacncatggaatgctgcaacatactaagcctgtgctctggggcctaattacgtgggacttggggcaagcncaagtgacttcagcgcttggttgatccancggggattttgcnaagc

SEQ ID NO: 22591 - DNA, 704 bp, Homo sapiens
  misc_feature 427, 516, 540, 546, 554, 557, 598, 605, 620, 647, 665, 668,677, 698, 699, 700, 702, 703: n = A,T,C or G
gggaaattagtctattatgtttcttttattcaatatactgaatttttagtttagcattattttaaataattattatatatgtaataagatacggtaattcaagaaagtgtagaaatacataaagatagaaaaaacacccaccacccgagtataaacaccattaacacttggctgcgtttccttccagttctttttctttctgtgcaaagacttgctgttagttcaactagtgttttgaactaatgaaagctagacagtcgttaagccttgtgttctgattataaaagaggtgcccccttgaaatcccacttggattgccaagaagccaatatgggggatctaaaagctgtcacggggccacacgcggtggctgccccctgtagtcccagcactttgagaggccaaggtgggcggatcacctgaggcngggagttcgagaccagcctggccaacacgatgaaaccctgtctctactaaaaaatgtttttaaaaaattggccggcatggtggcagacncctgtagtcccagctgctcgggangctgangcgggaantcncttgacttcggaggccaggttgcagtgagcccaaatgaacnctgactntacctgggccccaancagactccgcgaaaaaaaaaaaaaacncttggggcccttttcctnaanccactgaanaacttggggttgacccccccnnnanna

SEQ ID NO: 22592 - DNA, 746 bp, Homo sapiens
  misc_feature 4, 7, 643, 653, 681, 698, 701, 704: n = A,T,C or G
gggnagnatcactctggcttcttcctgctgataggggacattgtgggaatgggagtgaaccccaaggtgagaagagtggaaccaccttgtaactgtctgagtgtactcatgcaggcctggctaggattccaaggcttgtgtgggaaaaacattactactctcatctatagttttactacagtgtttaagtgaacagcctactgtaaggtaaataacgagtcctaggatgaggagtacaattcccaattttaaaagcaaagatttgaaagcattagtttggggacttccaacccacaaagaatttagaatttcatctaaactgcagaaaaaaacctcaagaacagctaacaacagtatactatagtttttcttttgaagcgtaatttttctctctccagtccccatttttattaaaaacaaatcatgatagaactgatttatttataaaataaacttattcttactgtacttggcctgattatttgcataaagtgcagcaagagtagttatttttcacttaggctttttaaattggctttgacagaactctgttccatgaagaatctcagataagactgttaaaaagtcgagcccagccatgggtttgtaccctcaatacttacgagttgggcaaattcctctnctcttgagtnccaagatacttggggttctggctgttanaagtgcattcttagcangcncgngctccacctgtaacccacctttggaggctgagcggtggtcct

SEQ ID NO: 22593 - DNA, 732 bp, Homo sapiens
  misc_feature 7, 8, 13, 24, 30, 43, 60, 63, 71, 76, 79, 646, 661, 706,711, 712, 716, 717, 719, 721, 722, 723, 724, 727, 729, 730,731: n = A,T,C or G
tttttgnnctacnaaccccttgtnttgttncttttggccgcancggcctacggctgcagnagnacgacagnagggnagnaggtaaagtgcgttgccagtgaacggattggtgtttgtcattgtctggatagtagggaagctagcactactgggtttacctcattttagtaaaactggaaatataaagcatatacaacataaattcatttgggataaaaataaaccaccaagtcagaaaagagttcttagcttgtctaaaggacagagggtaataacatacaatggaattgttatttatagtggaatactcgttcatgggttggaagaggttgaaatgggactaagctcataagatgccactttaaaaatctagagacactgttttctctccaaatcgggaaaaatccagtcttttgatatgactaactcttggaaatagctctgattttagaacccactaaagtttttggtttttcaaagcttagagcacatgaatttgtcagcaatgtatatatatttcaggaccagatggaagaaattcaataacagaatgaagaatgctctaaggcttataggtatctgcttaaaaatactttgacagggagttaatgtaggaactgttttcacgtcatagtgcttttatggngttttttgttgttgntgttgttgttttttgagacggagtctctctcttcaccagctgggngggcnngggnncntnnnnggntnnng

SEQ ID NO: 22594 - DNA, 734 bp, Homo sapiens
  misc_feature 7, 10, 11, 38, 677, 693, 719, 721, 726, 727, 729: n = A,T,C or G
gggcagnagnnaaatttatttagactattcctcacagnatctcatttgtaggccatttattgaaaggatgatattagattctaccaaaacttttccctaccttacgcgtaactgttatagtgaccagctaagactcttttctctttaaggaatagcatttcatcattatttactctcactttaaaaaatccttttgcttattttactttttcttaaaacaagtagtaatttttgactatacaaaggctaatatatttctagaagttgcttcagttaaattcacattggtccagtgatacttttgccaggaaatatttgttggctctatgtctaactacttgttctgatattcaatatggcctgtacggtatgcacttatgtttttgtattgtgtgttttgtcagtaatacaaatataatccaagtgagctatatgtttttcctgattgcatcctaattttgtgcctttaataatgttttttcttacatattttcttctttttactagatcatccattatcttctctctctctctcttaatatactcataattcaaggcctatggggctcaaaaacagtactaatacaagaaatgggtcaattacctttatgcaggaaaattaatattaagccatagggttgccctcttttgggctttctcagaatacatggtatggncccaagagagcagctnccattctatgggaaatcacataaccncnccccnncnctgcc

SEQ ID NO: 22595 - DNA, 660 bp, Homo sapiens
  misc_feature 1, 9, 407, 424, 445, 446, 451, 454, 457, 459, 460, 492, 523,525, 538, 539, 544, 548, 552, 564, 575, 584, 587, 591, 622,624, 627, 630, 655, 658: n = A,T,C or G
nacgacagnagggatactcacaatgaattggtcaaatgagtgaaagggccaggtggtttcaattaattagataaggaggctactggcccattaagacctttggttttaatactatgatgacttgtaattaatgacttacctctttctgtgctacaccttcatctaaatatacatattaaaggctacaaatatgttaataattaaaaatgagaagagtgtaatgtgacgcaatccttgaccaaaaccaaatagataggtttcatcatttattctcagtaaatggcaaattatatgatcttcaataggttttcagaaccagtgtgtgatgttcctatgcaagatgttcaaatacaatgttaaacacacacacacacacacacacacacacacacacacacacacacaanaaaagtatttgcatagngctctagcgggagtcccttcnntcatnatntgntnngatagttcaacagttttaagtatgctctgggntgggggcaggggctcatgcctataatcccancnctttgggaggccnnggcgngtgnatcncttaccccccanagttcacaccngcctggcantgngggngaaccctgtctctacaaaaatacaaaattancnggnggngggccacccctgtttccctctctcnggngg

SEQ ID NO: 22596 - DNA, 582 bp, Homo sapiens
  misc_feature 551: n = A,T,C or G
ggggtttaagttgaatttaatttaaagtgagggctgagaattcgtacagagtagttaactgttggagcatattgtgagaatccacagggtaacccccttaggagtatttgggttgatactttcatagaaaaatgaaggagcacagtgaaaatgctttcagattcattacctcattccaccaccaccagatgacaactttatggcttggattccactatttgaattgcgtgagctttcactcgtcagttcatttctcaattcagctaatcttctcaagtgcctactaagtgtgctgcattgtgctatgcactgaagatgctagcagttaataaacagggttccttccagggcagacagtctaatggggaacataaatgggtgaaagacaatgaaaccctgtgggatgagctcagtggccaacaaagtgtctacctaaccaagactagggcaggaggaagttttcaagagaaaatatgttaatactgagataattggaataggaatcttgcagaggaagagtcaagagtcattctattcaaggagggcatgtntgaggagtaggagtcagatgggtaaattgtt

SEQ ID NO: 22597 - DNA, 522 bp, Homo sapiens
  misc_feature 1, 9, 11, 264, 287, 290, 345, 349, 391, 407, 440, 447, 452,456, 463, 464, 471, 474, 480, 499, 506, 511, 512, 515, 517,521: n = A,T,C or G
ntagacagnangggttcagtgtacttactttttcgtaaatactgctttctttctattaaatatagtccttatctgacaaaaagtccgtcagaagtagagcttatctttaggccaggcacggtagctcacaactgtaatcccagcacactgggaggctgaggcgggcggatggctttgagcccaagagttcgagactagcctgatctcagctcactgcaagctccacctcccgggttcacgccattctcctgcctcagcctcccngagtagctgggactacaggtgcncgncaccatgcccggctaattttttgggtggggggttttttagtggagacggggtttnaccntgttagccagggtgggctctgtctcctgaccttgtgatctgnccaccttggactcccnaaggggtgggatacaggcgtgagcccctcgtgnccatccntctgnttgnctttttnnccccctnttngtgggncagtttccaggttgaagcntggtctntctgnngantnttcnc

SEQ ID NO: 22598 - DNA, 740 bp, Homo sapiens
  misc_feature 14, 31, 35, 48, 49, 57, 59, 71, 76, 229, 230, 389, 614, 625,653, 656, 662, 663, 685, 704, 707, 712, 713, 717, 731, 739,740: n = A,T,C or G
aattcaatggggtnaaaaaccaacttttttngttncttttggccgtanntagacagnangggtcatccaanagttntagggagccttagttctgagggtcttcttcttgaggccttaaccttacttttagacagttgtcattatctttgtctaaaggtcatagctaaattgaataaaaggaaagctgtgttttcctgttgatgcacaaaggcagtattgacttccctannccagtttgctgaggggtgagagaattaaattagatatctaagcacagaaattgagagcctttgaaaacaaaggataaggagacaagactgtattttcccttttcctgggagctctgggctcaagattttgcaggtgtgtcatctgatccatggcttgcntcgatcaaaactgtgccaatgcctatttaattagcaaggggaccctggatgcattatagccatcatccctatattgaatggactgtcagactctccgcacacttctccacctccaccgtcccctgaacccgtgctcccctcccttgcctcgttggttgggaagcctctgcatttttgtctgagcagctaaaaagtttctttggtttagctgctgatgcacacagngcccctggggngaatccaacaagtagagtcctaaaaggnttnttttgnntaggaagacaggcttaacccanttgattcttggtagatttncanccctnngaancccgccgggaaacnaaaggaann

SEQ ID NO: 22599 - DNA, 729 bp, Homo sapiens
  misc_feature 9, 182, 505, 538, 581, 606, 653, 654, 664, 671, 672, 698,702, 703, 719: n = A,T,C or G
gtagacagnaggggacatggccctgatcattctttgaccacttccttccttccttagtacaaaatattccaagctcatcttgtactttgccttctcagtcctagaataagtcatttctccaatgaggctggttatttttagtggggaatggtatttaaaaatcaagatcttggcactagttntgctcgttgctacaggagggctcttgcttcttggctctttggatggaactagggaacacactatgttcttcatactggtatcaccaattaacaccctcatcacaaggttttcctggtctcctttcatatattctctctctctctatgtatatatatgtgtgtgtgtgtgtgtgtatgtatgtgtttgtgtattatgcacatatatatacacatatatacacacatgtgtatatacacacgcatatacatgtatatcttccagtgagaacctctgttcccaagaacatcaaattatttattcattttgctgggtcctgtaatgnacacaaacaaattttaggattaatatacccagngctattatcaacaataagacaacagtctttaagatcttgaagntttttttaccttagatataaactcncttagataccaaacccccgccaccaaaatttacaaattttataatgnntcagatcttnctatatnnaaatccccagttttccccaaactttnttgnnctttttgcccatgganaagaaaaaag

SEQ ID NO: 22600 - DNA, 697 bp, Homo sapiens
  misc_feature 25, 48, 54, 167, 375, 487, 505, 587, 610, 614: n = A,T,C or G
gggggccttggtcattgtgggaganttctctgttgttaattactgaangctttnagtctctgaatattgcctggttttatacttcctatcactggttgccccccacccaaatgtgccatcatctcatgctagacctttctaattacagtacacccaggacctgtggnctgctacacttcatttgtaatactccgttctgtctcatatgctttttatttcctaccagtgtaggtatctgcgactgaccttcccctaccatctgccatttctcaatgatcagggtctaatcctggccccacccctaccccttacatggccttgttctttgctacataatccaagcagtgacctaagaacgtaagaatcactgtgtgnagttgggtgatacatgtcacagaagtacattgaacagagttgtaagagatcttagtaggtcccctagcctaagcctctcatattatgtatgaggagactgagcaaagctttnactctgtatcacagtggnggcagagatagaactggaattatagaacctcatttaaaattctggtatatccattttgacaatagcccatcagtatgacagnttggatgacaaaaatattttagnatgnctatcaaggctgttagagttacccttggaattctggtttacttgggaaacccaaaggaatatttgaaattggctgtaccatat

SEQ ID NO: 22601 - DNA, 528 bp, Homo sapiens
  misc_feature 8, 10, 32, 38, 41, 70, 73, 77, 100, 140, 167, 178, 264, 278,294, 332, 358, 397, 463, 474, 482, 483, 484, 486, 489, 496,502, 513, 520, 526: n = A,T,C or G
ggggacantntccttggtgatgctttgtctgnaaattnctncttcttatttggcagcttagagaaactgngangcanggatgttgagagaaatatgacanggtaagaccatttggggcccagcagatgtgctcaattgangtatgacattgcaacccatgaggtcantgaccttgtanctatgcagccagggcatagttccctagagaatgacaaaggcttgagatctgtcctttaaggatggatggtcaatggtgaaatgcancctggagaatccanactgggagtgccacangaagggagcactatgggtcagcaaggcctgggagacantgtgcttgcctggaaccggagctcancacaggtagatgcagtgtgtaagtgcgagagacaatcanaggaggtgtgagtttccctcggaggatagcaaggagggctctttcagcagtataagcatgtatganctgtcaagccngagcctcnnntnaanaaaaaanaaaggngcgcttttttnttaaccnagttanat

SEQ ID NO: 22602 - DNA, 155 bp, Homo sapiens
  misc_feature 144, 145, 146, 148, 149, 150, 151, 152, 153, 154: n = A,T,C or G
gggaagataattgaattgagtttctgttctgattaatataggttatttgtattttcttattgatttgtagaaaacctttgtaattttaaattctagactttatgcactatataagttaataaaattagcatggccttccctgannnannnnnnna

SEQ ID NO: 22603 - DNA, 756 bp, Homo sapiens
  misc_feature 5, 45: n = A,T,C or G
ggggnaaacctgtgacttaaggcttaaaataagcacaatctcagnataagttgaaggcctttggtttccatcaaagcaaactccacaaacttgtcaatctctatcaatcacaagggtatctcaaaatctctggcctcttagttgaggattttcaaattaagcatagcgtaggcccaatagaataatcctagcacagcaggtgtttcttgtgtgcctcctgggcacacaagtgtctaggcactggggatatggcggacaagactgacaagttatccagcttagcagtggttatatttcagtgggaagaatcagagaagaaacaagcatgcaaataaatcaattagataatgctaattgtggcataattactgtgaaggatgatagtggagggagtttgctcctttgtacaggatggtcaagaaagaccttactgagcatgtgacgtgtatgtgagactttatggatgaaaggaaggtagcctatgaaaattcgaggaagaaaatacctccattttttccattatgttttattttgagttactgttttgttgggctttgaatttttctatgattatatgcacgtcattttcctttactgaacattatgataggtggtctttctatagcagacctatggctattctaaggtaaagtcagtgacagtgtgatgatatgtgtagctagatttcagggattttggtttcatgcagagttacagcaatactttttctattttatcatcagccaaatccattat

SEQ ID NO: 22604 - DNA, 812 bp, Homo sapiens
  misc_feature 10, 12, 19, 20, 26, 32, 43, 45, 52, 63, 66, 73, 79, 108,116, 732, 805, 810, 811: n = A,T,C or G
tattttgggntncgataanncttgtnttgttncttttggccgnancggcctncggctgcgagnagncgacagnaggggnaaaaagtccgttgtgactgggggacaagnaccggggnatattatgtataaaatgactcctggggacatactattaatatgtatgtaaaagatggggacaaagatggtagagataatccaaaattatttattttatatatatttgatgggaaatatgaatatgattgggactgcagatgaagggatgaaggattgatgaattatctatcatgtacaaagttaatagataatatctaaaacagaaaagaataacaatagagagatgttagagatgcagaggtaaatacagaaagatatatctaaagtgttgaaaaaagttgcctctagagatggggaggtggtagggaggaacacaaatagtttcttaacagtcttataaacctagtcaaatcttttaatggtgtgatttataactttgctaaaaacaaaaatttaagacttaaaaaaaaagcagttgtatatcttttgtcctgacagtttcacatttaggaatttctcctaatgaaatagtttgactagggaacaaagagtacttacacagggatattaattatatggtttataacagtttaaagtggaaaaatatcaaatgtggtagggaggaacccaaatagtttcttaacagtctataaacctagtcaaatctttaatggngtgatttataactttgctaaaacaaaatttaagacttaaaaaaaaaaaaaaaaaaaaaaaccttggggccttnttacnna

SEQ ID NO: 22605 - DNA, 753 bp, Homo sapiens
  misc_feature 1, 9, 11, 534, 668, 683, 715, 748, 751: n = A,T,C or G
ntagacagnangggtaatcccggcgttttaggagaccaaggtgggaagattgcttgaggtctggaatttgagaccagcctgggcaacagagtgagactccatctctacaaataaaaaaattagttgaggccgggcgcggtggctcatgcctgtaatcccagcactttgggaggccaaggcgggtggatcacgaggtcaggagttcaagaccagcctggccaagatggtgaaaccccgtctctcctaaaaatacaaaaattagctgggcgtggtggcgggcacctgtaatcccagctactcaggaggctgaggcagagaattgcttgaacttgggaagcggaggttgcggtgagctgagatgcgccactgcactccagcctgggcgacagagcgagactccgtcttaagaaaaaaaaatggttgaatgtggtggtgtgcacctgcagtcctagctacttgagaggctgaggtaggaggattgcttgagcccaggaattcaaggctgcagtgagctgtaattgtgccaccacgctncagcccggacgacagagcaagactgtttctcttaaaacaaacacacacactcacactctaataggagacttgatcatttagttggtatttagtaatgttgatttatctttttttagtccttgcatttgctttanggaaacaaaaaaagnggcaagcacagtttattactattcctatttcnttggtgttctgacataaaatataatgatcttanaanac

SEQ ID NO: 22606 - DNA, 771 bp, Homo sapiens
  misc_feature 1, 9, 11, 18, 20, 532, 652, 698, 724, 740: n = A,T,C or G
nactacagnanggagaanangaggaatctgcgagtgtctgtctcctgtcaagcttccctaatacagccctggtagaacttcatcaacagtggaaggcatttgcaaagagatgtcatcctggggatgagaaggaggaagacagagaaacgcagaaaagcctaagcaggcaccacaaagagaccgagcccgtctgaaagaggctgctctaacctggtggaaactattttaagttgccaccagacattacattccagagccttgagaaaaactgatgaaaaaaaagtcatgaaaaaaagtcattcgcacaagtgacaccatggtgtgaagtcaaggagcacagactctggagtcagagggcttgagtcaacctgagcatcttcagctttgactgtgaagacacagctttgactctctgtgttgcagagatggtagtgcccactccagtgacgcttgtgaggattagttgagataataaatacaaaatgctgagcatcaaacctagagtagagaaaggtctcaacctggctaatgntatccagacatatctgaaacctcatgagtggcatggaatggcagtccctgcttgaaccatttacctcctttcctaacaccaacaatcacacacacctgacactgacctgaagcctctggnctgtcctcggaggcaaagactgggtagacaagatgcctggtaccancaatcttctgcaattcctctgagctnttgagatgcttttctntttgctcaaatatgggagaactttaaaagat

SEQ ID NO: 22607 - DNA, 765 bp, Homo sapiens
  misc_feature 13, 14, 19, 21, 22, 26, 33, 44, 46, 48, 55, 74, 651, 687,689, 746, 756, 760: n = A,T,C or G
ttactttggggcnncgatnanncttncttgttncttttggccgnangnagacagnaggggtctttatcccaggnatgcagccatattgtttgttgtttcccaagctgcctgcttccaaaaaagcacattcatccatggtcatccacctgggctggggaggtctccagtaactaaacagtcactatttgggagatagtaattgttgcaggcaagaattataagtgggtgctaaaatttgcaggtgaaagtatgacgatgagaaacagagtgtttacatagtttaaaagtttatcccccacatgattcttatttgttacgaaggtaaaaatagtaattttactttgggaaacctcatagatccagccttgaccaagtgatcagaattaacatgatcagtaatggcacatgcacctcatatgactcttggtagaatgcaccaaggagggcgcaatgtgacttcagtggtgggcttgccaaaatgcacaatctggatttagtcaggaggaagcattaggcaaacccagattgagggacattctacaaaataaatggccagtcctcttcaagtgtcaaggtcatgacagacaaagtgccccaggttggaggagacatgacaagtatatgtaacacaaggtcttggaccaaaaaaangacattagtgggggtaattggcaaaatttggaggangntgtctataggttatttaataaactgggttgatgggtaatttcttggtttggcattgnactgggggantaanaatat

SEQ ID NO: 22608 - DNA, 773 bp, Homo sapiens
  misc_feature 666, 712, 731, 748, 769, 772: n = A,T,C or G
ggggtggttatacaggaatttgtatagcagaatgatttaaaaggaaagagagaatgctttttattatttgggttttgaggggctagcagccatctaagtagagatattctgaagagaaagtgttatctaagttaactaacttagttaaccctaactaaaagaggtagattatgagaaaagatggatgagtgcatcagcccttcagatgcatgagtataagaagaaaaaactatggccttaagatagttctttgagggacagcatatttaagagttacaaaaggtaatattgaggaaataaatgaagggagaagattgagccaagattataaattatagaagccaaagacatagaaagaaatcattttgagcgttttagggtaaaaaagcaaaaaagggctagaaggaaccctgcaggatcgtctcagtcagtattcaaattttgtgtattgggaaaaggagacctagaagacagatgtggtcgaagtaagcagagacaacgtgtagaagaaataggacttcaagtgccccttcacctctgctatgctgcctcagtgggggacttgtccagtcatctcttgcaaatgtcatgatttaagcaagaacagctaaatttgtagagggccaggctgccccaactggcttttgtaatccttgccaagagtanggagaagcgattttaaatctcttcactgcttcagctgtaacagggnggcagctgaaaattatggntttcaaattcaagcgcncttgtgcctctagttcaaatncgnc

SEQ ID NO: 22609 - DNA, 830 bp, Homo sapiens
  misc_feature 9, 12, 18, 21, 22, 33, 44, 46, 61, 63, 66, 73, 643, 648,673, 677, 680, 689, 725, 746, 753, 765, 770, 792: n = A,T,C or G
tttttttgngcnaacganccnnctttcttgttncttttggccgnancggcctacggcgcgngnagncgacagnaggggaaaactaattcctttggagtgtttgataccagtgaatttacagttattctagtttattaaggaaatttttgtttcttaataaatagaacaaaactgcttatttttgaaggccacaattttttacataaaactgcattaataatatttataatttctctttttttcctgaggctcagagaggcttaatagtaattattatttctgaaaattgaattataatcattaaaaaaattttacaatcctaactgtaattttatagtaattttcacatttcttccctccaaaaaagatagttttgcatttgcctttagaaaaaaaaaaattgaattcaataacatacctgtgatggtagatggcatggattatgcagtgttgctttgctgaacatcatagtaaagaaatagtaacaggctgtgaatttaaaaatgtgcttctaacatcatttaatgtatccttctgattgatttttagatttttattagttaattaacttgaaactaccagaggaagatgctgcttacgttaaatataggacatacttggtattttactgcattggaatagnttcanggagaaccaggattaaaaaaaaacncccntanttaaaagtnttcttcaggagtttttgacctgcaggggctgggggngggggctccaccttaatcccnggctcanagagcttatagnaattntatttcggaattgattttatcntaaaaaatttacatcctactgaatttaaagaattcaca

SEQ ID NO: 22610 - DNA, 693 bp, Homo sapiens
  misc_feature 90, 95, 416, 482, 539, 544, 553, 589, 621, 638, 652, 669,672, 677, 683, 688: n = A,T,C or G
gggagtatttttctcaaacaatattattgcagtattaaactaagaaaataaacttgagcttaaaaagtcataaatatttttgaatatgtngggantagcaaatataacttttccccccacagatgcaggatcaggatctggagatggaggtaggagttgcctttttacatatttgaagatttactggtggatattattatgtatatttacttatgtatgttccatttcagatatttaagacaaatttcatattttgcattttaggaaaggtgaaaccataaaaaattgtcaccatattaagtacatgtatataccgtgcaaattatttggcatacttatgaatcatactctatctccagttaaccttccttgttcatttgtttgtttgtttgtttgtaaggtatctttgatatggntaggcataatgtaaaaacttctgaagagaagcatgtaagcatatttggcagggaagaaagaattcntgaggaaatctttaatattggatttttaaatatatgacactgctctcaatactaggngctantagactacntacctaccatatagccaaggtttaattatcagattntaatttgaacctgaaggactttagttctaaantgaaaaagaaaaatgangtcaatgaagaaanattatctttgcttcctnatnaaaanaaaganaatanacaag

SEQ ID NO: 22611 - DNA, 786 bp, Homo sapiens
  misc_feature 575, 583, 600, 602, 613, 629, 640, 641, 661, 669, 678, 704,729, 731, 733, 738, 780: n = A,T,C or G
gacgacagagggggaaaagaaaactctttctggacataggtcctgtggaccctttactatatatcactctggctagaggcgagccccgtggcagctctgtcacccaatgccttgtcttatccttcttgtaccttccccaagcatggttcgtagcatgtgcgtgcatggttcatagtgtgtgagtactaaggaattaaaaaaacaaaaagtagtagagcaggttgactcttctttaaaaataaacatattgacctgcatggaaggtgaggctgaccctccccattctccattcatcactggattcccagcagggtgtgtgaattcagtggaatgggaagcattgaccaacctctgtgtttctgaagaagtgagagcttttgtaggtgagcagataatgtatttaaatagctctaattttacagtgaaaaacacccacagtgtgacaacatggaaagaatataatcaacttcaacccaatatactcaactccaatcccaattttggcagatagaacaaaaagtcaatacatgttatctgacattaaacagagcttatggaagacagaagtgggtgangcagatangccgacttggtcagatncngatgaacaccngacaaaataggagtanagccggtgcanngcttatgcctgtaatcccancctttggnaaccgagcnggagatggcttgagcccagggttcanacacccttgtaattaggagaccttntntnaaaantgaatactactagctggggggctgccttatccactcttgggnatgaga

SEQ ID NO: 22612 - DNA, 671 bp, Homo sapiens
  misc_feature 14, 149, 154, 164, 166, 168, 170, 172, 174, 176, 186, 190,222, 224, 233, 245, 257, 263, 308, 343, 346, 351, 403, 424,441, 447, 454, 473, 478, 501, 509, 511, 531, 550, 555, 558,582, 597, 606, 616, 618, 621, 642, 663: n = A,T,C or G
gggggaaattctgntaattatactgcccttcccctttataggttttctgtaggagttaaaatacactttttcaattgcttgacataatgctcaacactggtaggggagctaaaaatgtcagctattgtcctatgtgccaaaaaaaaaanccacncagacagacncncncncncncncacaaagacncacntggggggagaggaagtaaagattaaaaagcancncatagtgtntcggtaggcaangggaccactagngatttncatattcttttttattttcttctttatactgcttacattttcagngttatataatgagcatgtattacttctgtaatcanaanaaggnggtataaacctgaccttaatataataaaacaaaattactggtcaggcacggngtctcatgcctgtaatcctancactttggaaggctganactggnggatctnttgagctcaggaatttganaccancctgagctcagtgagacagtganacctcgtntntggaaaaaaacaaaaattanccatgataggggggatacncctgnagncctaagttacctggaggctgaggngggagggggcttgancccagaagnggctgcagtnanctngactgcccccttgccctttancctgggggaaaaacccaaccngtctctac

SEQ ID NO: 22613 - DNA, 729 bp, Homo sapiens
  misc_feature 1, 9, 26, 27, 419, 422, 435, 438, 497, 534, 592, 610, 624,637, 652, 680, 703, 709, 727: n = A,T,C or G
ntagacagnaggggccaccaaaccanntatttaatgtatgagtgaacttcttttaatctatacgatttttctccttgtttgaagtaaaggaaggaaattcggaaggaaggaatactgtaggaaaagagctaggctcccctcgactaaagtggccagatgtcttgaattgtttgcaagtttgcccataatgccttttcttagagtctattcaaactcctctatagtctattgatcacagtcttctgtctctaactgaaggtgagtgtgtggaagtatatatgtgtgtgtgtgtgtgtgtgtgtgtatatatatatatatggagatatatatatatatatgtgtggatatatatatatgtatccctctttctctcctctggaaatgcagaaaaactgcatgctgagggagggaggggttgngangattcatgggcantcnctaggtcatgaggattagcaaccatcgataactctgaagatatcatgctcatttcctanacactaaccctcagatatgcacaaccgtcattcacanacccacttaaaatataaatctatcaattttactttagcttagaagcattctgaaagtnctgtacacagagcacgtnctttaaacaagtanatagagaccccanataacacatacacanaagggggagagaagtaatgctttgctantgagctaaaataggttccttttnttcagngtctgttagggcttaacncc

SEQ ID NO: 22614 - DNA, 811 bp, Homo sapiens
  misc_feature 7, 9, 12, 14, 16, 17, 28, 39, 41, 48, 59, 62, 69, 783: n = A,T,C or G
tttgggntncgntnanncttgcttgttncttttggccgnancggcctncggctgcgagnagncgacagnagggattcctcataattttttagagcacatacagcagttttatattacatggtttcgtaaatatttgttgtcttcttcattggatcgtaagctcctcaaggcatagttcatgtctcgtttacttgccttgtaccctcaacctctgtcccagtccctagcacatagtgcccatgctacaaattccagaatgaatgaaaggatgaataaaggagtgagtgtttactatgattaagggactggactagttgtatattaaaatgataaatgtaagacacatcatctgctttcaagaagcatacagtctaccttgagccaggagtgaaagaaggagaacatatattataactagaatacagggcataaatgttatgtgataaatcataggtgaaaataaagcaatatagcaagagaagacattagttatttatagcataattttaatgggaaaatatacaagttttggaaacctgatttacaaactgaattttgcaacataatgtaagtggaaaaatgctcacttatgatttaggtataacccttctataatgttcattcatttcaaaactggtatagaaatatattgttggctgggtgtgttggctcgtgcctataatcccacactttgggaggccagacaggtgggtcatctgtggtcagaagttctagaccacctggcaacatggtgaaaccctattctataaaatccaaaattgngggggcagtgcctgtagtcccactacct

SEQ ID NO: 22615 - DNA, 823 bp, Homo sapiens
  misc_feature 4, 14, 16, 18, 26, 33, 44, 46, 53, 63, 66, 74, 103, 249,646, 652, 668, 708, 715, 728, 749, 751, 765, 770, 779, 781,784, 800, 820, 822: n = A,T,C or G
tttnttttggggtncnanaacccttntttgttncttttggccgnancggcctncggctgcganagnacgacagnaggggtgtttgattattttcggggccggnagcagcatctatccagcacctttgggatttggtggttattgacttaggcacagggcttctaagatcagaacttggttcttcttcccacaagtgctctgttttggaaatgtgctaatgacacacattgaattatgtcagaggtttgnggccttaagttgtcgagggaggtgttttcatttggcgagaatctgtaatttgtggaacaataggattaagttctaaaggaaataggcccgatgaatctgtatagatggctagtttcgcaaagtaaagcacagagccagtgaactgggggcaaactacacgttttggataatgtgagcctaaaaagaaaaaccctaaaacttttaaataaatttctaaaaaccaaaaccttttagtatatgtaatttactggcttaaaactataaatattatagttttaataattttgtagatcaggaatttaggtgggactcagctggccatttgtttccatgtcatgtatccaaagctcactctgtagtatcacctggtagatgggttgacctgaaaggtccaggnggcttnccttatgtgtctggcnccttccggagatgggtgggaagctggctcatctggggctnttaccanaaactggctttgncctgtctttgggggggattgncntcaaacttgaagtntagcnggcagggananctnctacttagttccactnctgggagctgagcagaggantnt

SEQ ID NO: 22616 - DNA, 748 bp, Homo sapiens
  misc_feature 15, 221, 293, 511, 513, 546, 578, 589, 598, 629, 643, 645,661, 673, 692, 696, 703, 709, 716, 724, 730: n = A,T,C or G
gggaatgcgtatgtntgtaagtaatgtggtaattagcctaagtctgtggtaaaccattcatttggatcctctccttcctccaccaaacttaattccctgctgtttactcatccttatttggagaaaaaaaaaatccaaaagaaaattttgtctaatgaggcttgcatggaatctcatttttttttcctcttttgataatgaaaaccttggcaccagcaganatttcttttgcaagttctcggacaccaggatccccacagagaaactggatctaaatgaggctgtagttttanagcttaaaggactgtcatttattataactgatttggttttctgagaatgcattttgcataaaaccgtacctcaaaccttgcctttgcctaggcaaaggcctaattaacggagagagaaagggtcccaggctggtctcccagctccacgaagggatgagcagatgggacaccgtgccacccctgcttttgcctggccactcctctgccctctttcctgngncttcaccttctgctctggggaaaccacctccanaaccaggaagtggactgggaaggcctgctggnccaaaagtgtncagttaagnaaatatttgggacttcaaagaatccaccctncaagtgaaatgcancngcttaaggaggccatnctggcgctcctntcaaagtacatgggggaanggtntatcganaagtcnccaggcncctttggngggcanctgtggcccaggtttcac

SEQ ID NO: 22617 - DNA, 284 bp, Homo sapiens
  misc_feature 5, 14, 90, 95, 101, 129, 146, 164, 184, 207, 229, 232, 242,253, 257, 268, 270, 275, 280, 282, 283: n = A,T,C or G
tgggnagaagagcnttgttttaaacatttggacccatagctcttactttttctcatagattacttagtttgaaatggtgactctgcttcnggaanaaaacnaacaggggaaccatcctttgtgcagctngtctttcgagggcgganagttcaattagaatattnttaaactgttgctgataatnaaggtaggcttcttggttggcanttcccctgcccttttggagttnganaacatttttncctatgggtcnaaantttaagttagntnattcnactgntnng

SEQ ID NO: 22618 - DNA, 813 bp, Homo sapiens
  misc_feature 12, 17, 20, 32, 43, 45, 61, 63, 70, 93, 766, 806: n = A,T,C or G
ttactttggccnacgancantcttgcttgttncttttggccgnancggcctaggctgcgananagacagnaggggtattcctcaagttctagnagctggaagtccaaggtcaaggtgtcagctaatttggatcttagtgagggctctctttctggcttgcagacagctgccttctcactgtgtcctcacatggcatagagagagagcacgtgcacaagctctctggtgtctctttttctaaggacacaaattctatcataaagactctaccctcatgacctcatctaaacccaattacctccccaaaatttcatctacaaataccatcacattgggaattgggagtccaacatatgaattttgggggtacacaaactttagtccgtaatacattgtgctataagtttgatccaattagatagctcaaataacagattaatattctttactgggcatagaccctgtcccagagcatatcagggcatccgttattattttgtgggttaaatgggacctcatctaggactttttggaatggaaatagcacttataaaataagttcattagtacatatgcacttagtaaacatgtactttgaatctccctgaatcccaccccaaagagttgaaaaatgtgaacagcaaaacttaaaaccctatgattaggtgacagaagatcctcacaaatcccaaatatgaatgggaccaagcatcaacaatttcaaacctgtgtgatatcagcatttgtgaaggaagtaatggggccncctgatgccaagacaggaacctacaaggtttccaagactnctggaag

SEQ ID NO: 22619 - DNA, 739 bp, Homo sapiens
  misc_feature 541, 649, 663, 669, 729: n = A,T,C or G
ggggtagaaacggggtgtccgcatgttgcccacgctggtctctaactcctgggctcacatcgttcacccaccttggcctcccaaattgctgggattacaagcatgagccactgcgcccgtccaggaggaaagtttttagaaaaaggtgcacaagaaagagcataggattgtgccagcattgatgttatcttctggttatatgagagtgtttgccaagaatcggtcaaatgttttacattagggaaaaagcattattgttactggcatagggagggccccagttaaaatagcagtccaattcagagaccttcgtatttgtcgttaagatcaaaaggactcttggaataatggactatgctacaggattattttaagttcagatagataaattagcttcttcccaaattctcattctgcttttcctgtggtactatatagtatcatgaagttatatctttaaactcttagtttgtactatgtggtgtcttatgaaaaccttgatttgtttatacttagtgaatgaaacacttgggtttaaagntctttaactgatgtcacttcttaggctagaaagctgttgaaagaacttagtgttcacccttagaccaaggtcatgtcaccatatttaacagcagctttgtattaccgncaagattgttgaanattcanctccaacttaattacagatgcagcctgcagaggacctcccccccccttttgcttaaatangtggactgga

SEQ ID NO: 22620 - DNA, 752 bp, Homo sapiens
  misc_feature 11, 14, 21, 661, 722, 723, 736, 742, 744: n = A,T,C or G
taggctgcganagnagacagnagggattctgtggattgtctcttaactttgttgattgtatcattttctgtgcagaagctttttaacttaatgtgatccatttgtccatttttgctttggttgcctgtgcttgtggggtattgctcaagatatttttgcccagaccaatgtcctggaggtgttccccaaagtttttctgtactagttttatagttcgaggtcttggctttacatctttaaacaactttgattttacttttgtatttggtgatagatactagtctgttttcattcttctgcatatggatatccagtttttttcaataccatttcccaccagtgtatgttcttggcacctttgtcaaaaatgagttcactgtaggtacatttgtacatttgttactgggttctctattctgttccattgatctatgagtctatttttatgccagtaccatactcttttggttgctataattctgtggtataatatgaagtcagaaaatataattcctccagttttatttatttatttatttttgcttaggatagtattatttcttatagtgaaagcattctatggtatttattattagtctaattttgagttttacaatgctatcctctttacaaagctatgataactcagggggccagacangacatttgagctattgcaaaggagcaaattctgctggcatgggggctctgcttaattccanncttgggaggccanaagcananacctgagg

SEQ ID NO: 22621 - DNA, 782 bp, Homo sapiens
  misc_feature 2, 9, 680, 694, 704, 711, 740, 751, 766, 769, 775, 776, 778: n = A,T,C or G
gncgacagnaggggatttgttcaccttatgctcttgggcaatatacattgtttgattgggaggttaagaggtgacagtgaaaaccatgaattagaagacactgaatgttattgtgtgaataggaggtatttactcctagagtgcctattatccccaatagatcttatttcctagtattgaggcatgaatctgatttaagaaattagcatttcttatgccagggcagcaatttgtgtcagatttcaatctattttgagtggaaaccaatgtaagcctggttgaaaaatggtgagtaaattgctgtcctaatcaaggtaaatcaagctctgagcatatggcggatggcaaggtgaactcctgccccgaacaatcagctcgtctcacttgatgatgggatgaggcagggcttgtctcttcttagttggctggtgagagtgggggagagatgtacttagtcagatattattagcagagtgacccggctgacggggcgagtataaatagaagaaagctcgcgttgataatagtgcttggcacttaacacggcgcttcatcttcaaagccatttacagatgccggtcttcctggtactgctgcgattccgggctgttgcttgtatgctgcttcttaggaacatggaaacagtgattttcagagaccaagatccgctcaaaattggnggacctcttttcanatcctttganattttcnttttgatgaatatttgaaggctcacatanagcctggctcntttgaattctggagnggnaatgannantttc

SEQ ID NO: 22622 - DNA, 767 bp, Homo sapiens
  misc_feature 2, 9, 698, 763: n = A,T,C or G
gnagacagnaggggtgtctgcatactttcagggttcaggcttggccacttaatagttattccacttttctggaataaggctgagaagaaacagtatacagtaaccagttggtgacctgcatggagggaggcaagggcctcttagacctcgtggctctcttttgctgggtttgtcttctcagctaagggttccaacggcctgccctcacccaggcagcctgctgtcacccaggcgtgtgccaaacactgttcatctgtgtttcctttcactagtcacagcaaccccatgaggaagggtttagccccaatttataagccagaaacaaaggctctgtgagtgagctagtcacacagccctgatgagtaaggccaggtctctggcccaggtctgcccagcccacattctttttcctgcatcaaaccgcctttactgggaggtgtacaaaaatggcaaaatcaccccattcaccacttctcatgcttcagcccgcaggagcacacccacagttaggccccattgtgcgtcccgggatgcttatcatcgtactctaggtaacatataaaaactggaagcaagctaagtgtcccacagaggggtgaaatataaacaatgaagtactgtgcagccattagaaacaatcaaagtgggcctggcacagtggctcacgcttataatcccagcactttaggagacgaaanggcagatacttgaggccaggagttgagactagcctggcaaatggcgaaacccatcttactaaaancaat

SEQ ID NO: 22623 - DNA, 791 bp, Homo sapiens
  misc_feature 1, 8, 19, 22, 30, 690, 790: n = A,T,C or G
ncggcctncggctgcgagnagnacgacagnagggggccagtctggtatgtaaaagttgcctgtctcagggcaagttctaaaagcccccaaaataaacaaatctaaaaatgtgtgtttctaggtagattcttaaggcagccgctcaatatcctaagctctccctttttaagtgttctttcagttatcttgactctattagaaagaaagcttccatcagatactcaccaggaccaatgatctttaaaccctgctaatctgtcattagggagggaaaatgcagctggggctgggagcagttaattgggaccaggggcccagaacttgactgtggtggaaagggacaattatggcaggaattgaagttggaacagcgcaaggaaacaggaggcacaaaaaccactctaaaactcagaatttcctgaacctgaaagttgtcaaactatttctttaaaaagatgcaggcattttgaatttttaaccagtttttttctgttctgtaattttcacaaagaagtccaaggctgtgaggcatgaatgtaagtaatgaagatacatcaacaagggatttgtgaggaaagctgtgatttgcctggcacgtagtgtccctcatcatattaataccagattgtctttgtgttgaaaagcaattattccaacaattacatcttgttgtgccacaataatacgtangacttagtttcctgatttcagatggggacttaattttaaatataagtatcctattagtaaggggtcttaattccaaaaaaaaaaaaaaaaaacctggggnc

SEQ ID NO: 22624 - DNA, 556 bp, Homo sapiens
  misc_feature 1, 9, 14, 33, 463, 486, 535, 550: n = A,T,C or G
nacgacagnagggnattgaaatcattccacagnggtaggcatgtgcaggttgttgaattgtactattatagatcaattgtgcctggcactgttaacattttgaactgggtaattaatttgttctggaggactgtcctgtgtaccataggatgtttagcagcatctctggctacactcactagatgcgtataccactcccttgtgacaatgaaaaattgtcacgactttcagaaaaatcatcatccttctatctccaacagaagagtgaactcatgtttaacttcatgtaggtacagatgggatatttatcaatatgtatatagtacatagattaatagacacacatatttccttgttctgtcagctgacaaggtctagaagcagtgactgctcagtagcagtaagcagaccttacattcaaatcttggtttctaatattctccaacacaaggaaccaggactncttttagaaatggcagattctangactgggttggaaaaaactacaagatgagcctggagcattttgtagtgncagaactaaggaagntctcac

SEQ ID NO: 22625 - DNA, 781 bp, Homo sapiens
  misc_feature 621, 648, 662, 665, 686, 694, 704, 717, 751, 759, 763, 765,774: n = A,T,C or G
gggactctaccgagttttaatttgtcactagtttaaagggccaaaagatctgttttcttcagatattagagacacaaaccaagcatctcccactttcttggaattccttctcaaaaatgactaaagtctgagactgttttcttatttaatgtctattgaattctgttttacagaatttcaaaagagcaggttcttagcttacttttcaatggaacattttagccaggtagtataagtacaggtgcgggtaacctcagataaatcaaggtgttatgcagctgtctctatattaaaaatatttgctgacatcagtgtagacttcatcttgtagttcttcagtgttttctttccttatcttttgctcataagatggctttgtgtttggtttgatattatactgagaaagcatattagaatcaaagcaccaagatttcaaaagtccagactactcttcccaaagagaaatgtgcaatcacaatagcatgacatgggtacaaatatagaagtatgttattaaagtattgagaattagctttcctaacctccccacctgcaatcttttactcctaatctccaaaaaatgaacaatcattggctcaaaatggcacaaatgtatgtggngttaaaatctatatttttattgatatnaaaggtgcaggggnggnggctcatgcctgtatccagcncttgggangcaaggcagnggtcactaggcangagttcaaacagctggccactgggagcccctctntctaaaancaananacctggggnggggggg

SEQ ID NO: 22626 - DNA, 782 bp, Homo sapiens
  misc_feature 2, 9, 623, 662, 690, 705, 726, 741, 742, 751, 754, 757: n = A,T,C or G
gncgacagnaggggtctattggtcctatctctatgtctgtgggtgctcgatgtttagctcccacttatacgtgacagcatgcacaaacctctatttaaagtatgaataccatgaaaatattcttttacttggcacttggatattaaatcacttcggcgactagctttgttaagtattacattgaactggataattcttctaataaattcaaagcatgtgtcctgtcagattgctcatagtgttgttattctgaattgctttaagctggttttattggatattaagtacaacattgataatgcacattttctgtagctgtggtttctgtccttgatgacagcatgcttaaggtctattatatgttgttataattgggtcaaggaacatttagcactgttttcttccagaatctagcttgcgtcaagactaagaacaaacttgtgttgttaaaaattgactactgaaggattaaatatttggctggtgggatgtgagtatatgaaacatttattgttaggattttttatttcagagaccagtagatctcagcatcagcatcatttgggaatttgttagaaatgtggaatctcagaatcaagttctggggtcagggccacattggngggttaacaatcatccagatgaaattgatgccactaaanatcagaacactgtttaccactacctggntagtcattttctagngctatcacagaaatctgaagngggaattataagaannaaattattnttntantttactgagagcccaggctgggctg

SEQ ID NO: 22627 - DNA, 593 bp, Homo sapiens
  misc_feature 394, 404, 409, 411, 426, 432, 477, 499, 508, 525, 527, 539,549, 555, 567, 592: n = A,T,C or G
gggcatactgaagaggaaccctatgagtgtgaagaatatggcaaagccttcaacaagtcctcaattcttaccagacataagataattctggctgggtgcggtggctcacacctgtaatcccagcactttgggaggctgagacgggtgaattacatgaggttgggagttcgagaccagcctgaccaacatggtgaaatcctgtctctactaaaaatacaaaattagccatgcgtagtggtgcatgcctgtaatcccagctactcgggaggctgaggcaggagaattgcttgaacccgggaggcagaggttgaagtgagctgagatcgcgccattgcactccagcctgggcaacaagagtggcactccatctcagaaaaaaaaaaaagataattcntactgaaaanaactntncaacttgaaagatgngacagngcttttgacaacccctaaaacttttaaacataaaaatcttctggngaaaaatccttaaaatgtaaanaagggacanggcctttaatgggtggncncttctttttggnaaaaagttcntctganaaacttttcagnggaacagggggaaacttttatgaanc

SEQ ID NO: 22628 - DNA, 734 bp, Homo sapiens
  misc_feature 16, 18, 643, 670, 708, 709, 710, 721: n = A,T,C or G
gggaggagagactggngnagagacaagtgaattgagtcctagaaaacaggcacatatacaagaggctggggtgaaggggatttttcagtcagttccaactagttttttgtggttgaattcttgaaaggggcccatgtttcttaacagaaatatagaaatctgaacttactgatatttgatttctttatatgtgactgcacacatgctactctcagatgtgtgtgtgtgagtttagcattgtgtttcagttttatctataatctgtgattgagcaaatctcttgagagatcaacggagttaaattatcttgatactgtgcacttgaccaaaattaaactgtctcatctttgccagatttaagaaccttatcttcataagaacttggaatagagaaaaatttgtttggtatccatgtcctcttaccatgaagttgtctgggatttattctactcttccaatatttttttaaatccagctagttcatctcagaaatgtcctagatgacactgtagtagcgttgaaaatagccattcaacatttaatctgtcatatcaatttgcttccccacactatcctgagaagtgaaggtgtggaaaagaaaaaaaaatctgtttagcttggcaataatcagtagctgctgacnttcaagctatggataaaagtgaaaaantaagctctattttaggttcaggtaaacaagcctccatnnncttgaccaagncagcctcctaata

SEQ ID NO: 22629 - DNA, 659 bp, Homo sapiens
  misc_feature 2, 9: n = A,T,C or G
gnagacagnaaggggtacttgggccccagagcaggtcctccttgaaattgggggctgggggaaattgtcagagcccctttgtacgccgggagccacgtctgctctcaggatgctgaatggagtgggcttgactgtaacaggacactcctggggccccattttttctgagagtcgagggatgaggctgctgtctggtgggaattcagtgttcccaaaacatacccgtgggaaaaccctttcttttaaaaagccaagggtcctgggattaaaagcaggcagcacgagtgacagccttgcagatgtcagcctggagcttgaagcggctacttttgaggaaaggactcctggcacctggttttcctggcaacctcatctacctcatttcagttctgctgcgtctcagagattacccccggtctttctcctctggttattgcctcaaacttctggggcccagatggatgctaagttcgctctcgggaaagactgaacctggggccacccggtgtctgctcacgcgggaggcgtttcctgagagttctgggaggtgcccctgccctgggcccatctctggtggtatctacggtggcagctgtctttttaacatcacccactggccagagtcaccgagcctctgattcttcttctcaaccttttcc

SEQ ID NO: 22630 - DNA, 759 bp, Homo sapiens
  misc_feature 566, 635, 672, 676, 697, 711, 730, 738: n = A,T,C or G
gggaagttatgtacaattatatgaggaactaggtctcaaaagttttataatttcctccagctcgtagtggcagggctggactccaagctgagatgtgtctggttgtccggttctaaacctttctacaggtcaccttgtaaagaataaggatggagctcaaacacagatacataaaggaataaaattaaaacttgttcctgcttttaaaatgtagtggttgaaaagccagaagtataaataactccagttctgtataaatgatattctcaaatgctgcatcagaatcgcttgggagaatttattaaaaacatggattcctagactgcaaccaagaactcttggatgagactaaggaatttgtaaattaaaaagaaaaaaaaagtgaaattctctactaatttcaatgtccagccaattttgagaactactgtttttaatattgaaactactgactttaatattgaaagtaaatataagaaaagatgaagtagttccaaccgagaaggaatgggaattgagaatggctgtttgagggtatctttatggttttcagggttatccaggcnttagaaattacataatgatttctacaatgatcatcggtagctttagactagtacctactaatctgaagngtgatcctcaccctgctattgatagatcttgtatttnatgngccgttaattgcaactctctntaactacgagatgnctttcgggacctagctggnatctagtntcgggactttctatcatgata

SEQ ID NO: 22631 - DNA, 525 bp, Homo sapiens
  misc_feature 369, 373, 420, 429, 449, 453, 463, 493, 494, 497, 501, 505,506, 507, 512, 513, 514, 516, 517, 521: n = A,T,C or G
ggggatctttctgcccgtgccaccggaggctgctgcggcgtggacagactcagattcttcttcctgaacttgttcagctttctctctgtcctggcccacgactgcctgcctttcttcacctcctgtgctcttttcttggccaaactgctttgtgttcactcgcacccgccccctctccccagcgacgtcaaagtgcagcgtcctccataggtggcaagatttattcttgtcattttatcatggggttggcagactcgacgagtgaaggaacttgcccacatttccccacactgttatcataaagaaggcgcattaagtgtgactggctgtgaaactctgcgctttttagtttcaggatatcaaaaaagnttanctaccctggggactacagaaaagtgatggtagataggtggatggacncagatgtanaatcctgaacctgttgacanactntctgctttgncccaaaaaaaaaaaaaaaaaaaaaaccctnngcncttnttcnnnacccnnntnnaaancttg

SEQ ID NO: 22632 - DNA, 731 bp, Homo sapiens
  misc_feature 389, 465, 482, 493, 505, 538, 547, 549, 552, 555, 560, 583,593, 638, 640, 661, 675, 685, 692, 697, 703, 705: n = A,T,C or G
cttagtttagaggttattttcaatcacgtcagtataactactaacttctcagtgacagtttacaaagtgacataaaagcagggagatgattcttacatgtcatctcttaaatgatgaaccatgacaaaaacaggtggcagtccagatttaagatgtttgactggagggttctatgtgggaaaaattatatacatttcctaccttctttcataacactcctccccagggctcgcttcagccatgctggtcttctttttcctcttacaactcacaaagctctttttgcctctaaggcgttcaaagtggctggtccttctatctcagtggctttcaaacattttttgacctcactgtagtaagaaatacacttcacattgtgactcatttangcatgcatgcatacatatgtatgagaatatacacaggtcacatgtgtataaatatatgtataactgaaacaaaagntttccttcatgtgatgnatcctaatagnttcttcaattgngggcccagctcactaaatggatttcgtgtgtcnctgcagtangncanggncttancttgaaaacactgctttacatanactggctttnccaatcttttcttggcaggttcttgcattcgggcttatttaaaananccccggccggggcaggggctncccctttatccacncttgggggcnagggggnggtcncctagncngagttgaacccctgccactgggaact

SEQ ID NO: 22633 - DNA, 769 bp, Homo sapiens
  misc_feature 541, 545, 567, 578, 598, 609, 613, 635, 663, 672, 698, 701,726, 727, 728, 737, 740, 742, 748, 752, 758: n = A,T,C or G
gggaggaaacttgggcaggatttctatattacaatattgaggcagaattccttcttcaaaaacatgtttttgcttttaaggccttgagctggtgggatgagagccagccatgttatccagggtactttccctttacttaaagtcagctgattgtcaattgttaatcatctctacaaaaccttcacagtgccacctcgattagtatttgaccaactaactaggcatcattatgtagccaagctgacacataaaaattaagcacccctaggtgaaaaggtactgcctgcagcagaagagggtgtgaggggcacagagccccctcctggtcatgaaacattgaagtcatgcttcacctagtcatgaagcattaaaggttgtggcagccttgttctccatgctttttcagtacatttgatgttgtatggtgggggcaggagcatataagccagtgcaaatggtttttgttgcggtctccatacagaccaggggtctattttttttttttcaaacttgaaagaaaagtagaacattttacttatanttanagctaaaggggcttgttagatntcaaagagggntctgagttaaaaaaatgttntatttgccccnacanaaagtaggacatgttaacttgnggggggcttattagggaagttttggggngctttggangcttacttggattttaggaattgccnganctcaaaagcctcctctaaaaatgannngtttgcatnccnanaggagncttncaaacnttaaaagattt

SEQ ID NO: 22634 - DNA, 717 bp, Homo sapiens
  misc_feature 9, 545, 652, 671, 679, 684, 695, 706, 708, 715: n = A,T,C or G
gtagacagnagggctggccacacagggaagagctgttcttcctgtgtctgaatccctgtctccctgctcattcattcatcgctcgcctctatcctcagtctcttcatttattacaggctctttcttatccgtatttaaacaccgtcatgtcttggccatcctgcaggaaataagcagagttcctctgtgtccagcactttatcctaaatttgttactccatgattacttcgtagaacctgccgatgttttccaagtagacagttttgttcagttaatctttatttattcattcccacagtatttactgttttctgatgcagagatgaacaattgacagcttctgttctcaaggagcttatgggggagggaaaatgccccccaaacatccctttaataattaaaaaacaacaaaactttgattgtacgctttttctttgaagaaagaggcttactgtaagttggtgttttacctactaattgaaatatatgtctgttttttgagacagagttttcactcactctgtcgcccaggctggaatgcagnggcactatctctgctcactgcaactgctgcttaccgagttcaagtgattcttgtgctcacgcctgtaatcctaacactttcagaggctgaggcaggaggattgctanacccaaacttgagctgcangagcccancggtnctgactcaggngggcaacagangngacccgncc

SEQ ID NO: 22635 - DNA, 779 bp, Homo sapiens
  misc_feature 11, 13, 14, 21, 55, 573, 718, 724, 734, 748, 759, 765, 768: n = A,T,C or G
taggctgcganannagatagnaagggaggcgcgttaagctggttgggacccgggnaaggcctccctcttaaggtctttcccacacctctgcaccttgttacctgactttcggcttcaggatccgcagcgtgcacccgcgttccgtgagtgccctataggcagtcagcatgcccctctgcgtgtccctgtgttacggggacgccggctgggagccgcagagctatctcagaactagggcgctctcctttgggcacctccaggccattttcctttcattcgagcccacagggttagagataaaccctcactccgttgcttggggacaagggcttcactccctgtcccgagcttgcggctgagcttgagggtggctgggtcatcctggccccccactggatgggaattggctgctctggtgatttctgtgacatcccagaccccaactgtggggctctggagcggactgcgcttcacttcgtggggagggtgtttccacctaggccactcttatttctcttcacatccccagatctgtcttctgagactttgcccttctccaggaagagcactcangagaccaggaaaatggccacagggctcctgagagccaaaaaagagtgagaattaactgtaattctatcttggctgtcaacagaatgggtcccattaccttttcttgtcctggagctgccttgttggattggcaaagcattcctanccctantcattcctantccataaacaagangatttgaatantcttgnaancggccaatctg

SEQ ID NO: 22636 - DNA, 627 bp, Homo sapiens
  misc_feature 446, 521, 559, 574, 576, 584, 602, 608, 616: n = A,T,C or G
ggggacttaaaattttgcattttcctgggttggctgggatcatctgggtggctcttctgctccatttgactttggctgggtcactcaggcagctgcatgcagttgggagctcagctggggattgaatgtccaagatggcctcattgacatgcctcacagttgtctggctgttgactggagtgcctccattctcctctgtgtagcttctcattctgtacagcctctctttccatgtggattctaactggaaggcagactagcccagatttctttacagggtgattggctgaaagcctcttcaggcccagatctaaaagtcactcagccatacttctgcattctactgtcacacagggccatcccttaggcaaggagaggtgaaacaggttccagtcctggactttggaggagagaatcacattgggaaagcacatgcagagtggganggattgtgggcaggtatttctggaaatgtctaccacagtattattaaatcagcttgaaagagtaaagatacaatnccaatgaataagatgcttatcattgtcctgcttcaganttaaaatataagtancnttacattntgtgctggcataataccntggctnttttcacnaaaaaaaaaat

SEQ ID NO: 22637 - DNA, 722 bp, Homo sapiens
  misc_feature 2, 9, 28, 32, 703: n = A,T,C or G
gncgacagnagggaacccagtcctgagnaagnagtagagtttaaatggaaatagattctgtgtaaaagctgcctacagattctggagctgcaagtggtgtgtgggtgagactattttttgccttgcctgatttacaggaatatttttagtcatttctggttttaaagcctaaaaatgccataggaggtcaccagtccttatgttgtactctgaattcctaggatttcaccttggaggtcacagcagtgctatgtagaaagaagaatgtactagggggagattattcttagaaaaggacagtactttggttggagtagaatcagtccacaccattcataacacaaacaccaggctctgtgggctgtgaggtggggagcagaggcctcagctaagtcaacatcaaacttattggccttaccatggctgctgggcgatattttgggatggttattcaggaggttgaaagaaccaagaaaggctgggcgcagtggctcacacatgtaaccccaggactttgagaggctgaggcgggtagatcacctgaggtcaggatttcaagaccagcctggtcaacatggcaaaaccctgtcaccaggcatgtggcaggtgcctatagtcccaggtactgaggaggctgaggcaggagaatcacttgaacccgggaggcggaggttcagtaagctgagatcgcaccattgcgctncagtctgagcatagaggag

SEQ ID NO: 22638 - DNA, 665 bp, Homo sapiens
  misc_feature 568, 653: n = A,T,C or G
agccagccaattttggaataaggagaggtattaaaatagattgctttgatttaagtctcctgaacggtaggttacattgaggctctcgtcggagcactggccagccggctttccccttcattccatgtgttgtaatgtgttaatatgcccagctgacgtttttgtctgtttcttagtttgacatcaacaacaagatcgagttctgacgctctgcaggggcgatacgcagctcctgaattggaggtaagttcatttccttttcctgtcctgcttcatctcagaagatccatttctcaggagggccttttgtgtttgtgtctttatcagtctgcattccgtgatcctgtttttctgctgaggaaagatttttgtatagaaaaataaatgctggccgggtgtggtggctcacgcctgtaatcccagcactttgggagtccgaggcgggtggatcacctgaggtcaggagttcaagaccagcctggccaacatggtgaaaccccatctctactaaagatacaaaaattagccaggcatggttgctcacacctgtagtcccagctacttggangctgagacgcgagaatcacttgaccctggtggcagaggttgcagtgagccaagtcataccactgcactccagcctggcatagagngcactttgactc

SEQ ID NO: 22639 - DNA, 782 bp, Homo sapiens
  misc_feature 171, 172, 174, 411, 462, 488, 500, 504, 526, 611, 643, 657,669, 685, 688, 695, 696, 698, 708, 719, 727, 735, 746, 751,763, 765, 769: n = A,T,C or G
ggggggacagcattatggaggaaccgtgtagaagttcctcaaaaaattaaatatagaactgccgtaggctttatcaaatctgcttctcagtatatatctaaaggaaatgtagtccatgtctcaaatagctatctgcactaccatgttcattatggcattattcataatagnnangacgtggaaacaaccttaagtgtccattgatggatgaatggataaagaaaatgtgatgtgatacacacacacacacacacacacacacacgcacgcacacagagacaccctctgttatatgtgtgtattgtattatggaatattatttagccataaataatgaagttcactaatttttattgccaaatcatactccattttatgaatatatcacattttgtttatccattcatcagntgatgggcatcatatttttgtgacagtgaaataagacgaagtatataaagngctttatgatgtcttgaatatagaancaacgtatgttnttgntgtttcttttcgtctgggtggnagatttctggtgaattatcagccgcccctcttgccttgtgaggcaaggaaagcagtcttattgagtagaccatctgtctgccagntctctcatgttagtcctcaactcatggaaatnctggggggcactcntttgatctaaantccactgctttttcancancaaaagnntngagtggtccncaggctgttgncgttcagntgctccgncaaactgtaanctggnttaagggttggngngggnccttggggctaac

SEQ ID NO: 22640 - DNA, 826 bp, Homo sapiens
  misc_feature 2, 8, 9, 10, 26, 42, 48, 59, 61, 68, 78, 80, 82, 88, 90,114, 122, 760, 782, 804: n = A,T,C or G
tnttttgnnnaattaaacttgggttnaaaaaaccattttttnttgttncttttggccgnancggcctncggctgcganantngacagnanggggtagcccatttaaaggcaganagcctggnaattaaggaaatgcagtgttgaatagttattgcactattttcaggctttgtgacctgggcattttaaaaaggagatcataatacccatttgttaggggtgctgtgagaactaaatgaaataatgaatgcacaatgcttgacagagtgcttagcacacagatgctggaatggagaatcaacatgaagaaaataaactctctttcgctgacagcaatttccacaggagtgtgtgtgtgttcactgcggcaactacattgtaggaggaattgtcaaattgtgagtgataaatgcaatggagtaacaatttccaacaaataacactgttagaaagcagagtttcatcctactcaggcatgcatatacaaagggagaggggaggcttgtgacagaacttgctctcttcccacctagactctttcacccttagatgatctgtcattgtatgcagaaaacagtggcagacttatccccacaattcaggttgctcagtaatggttcaggtgaaagcatttcagtaatgccataaagtgggaactcataaatgacagagtcgattattgggtgacaagctccagcccagtgactttgtttgtgactttgtatagactctgcagaaatgcttacattgttatgagctncaggaggaaaaaaagcagtgtnatacaggtcagccatttagccnctatactatttaaaacattctg

SEQ ID NO: 22641 - DNA, 748 bp, Homo sapiens
  misc_feature 9, 25, 666, 683, 691, 694, 739: n = A,T,C or G
gtagacagnagggatctttaaacanctttgattttacttttgtatttggtgatagatactagtctgttttcattcttctgcatatggatatccagttttttcaataccatttcccaccagtgtatgttcttggcacctttgtcaaaaatgagttcactgtaggtacatttgtacatttgttactgggttctctattctgttccattgatctatgggtctatttttatgccagtaccatactcttttggttgctataattctgtggtataatatgaagtcagaaaatataattcctccagttttatttatttatttatttttgcttaggatagtattatttcttatagtgaaagcattctatgttatttattattagtctaattttgtagttttacaatgctatcctcttttacaaagctatgatcaactcagtgtgtccagatcaggatcatttgtagctatttgcaaaagtagcaatattctggctgggcatggtggctcatgcttatattcccagcactttgggaggccaagacaggcagatcacctgaggtcagaggttcaagaccagcctggtcaacatggtgaaccctgtctccataaaaatacaaaaattagccggggatgatggcagagcctgtaatcccagctactcaggaggctgangcaggaaactcacttgnaccccganagnggaggtgcagtgagcccaaatgtgtcattgcattccagcctggtnaccaagccg

SEQ ID NO: 22642 - DNA, 689 bp, Homo sapiens
  misc_feature 1, 9, 459, 585, 588, 594, 628, 641, 643, 668: n = A,T,C or G
nacgacagnagggggaaaactggtttcaaatctctgcagcttacatatttatggtgtgaagtacttaactccctacattttagttctcacatctgaaaaaatattgagcatgcatatgccatagaattattgtaatgattaaattacacatgtaaattgtataatacacatagtgtctggcacaggatcattcacaataaaatttttattcaatgagtactattatcgctttctgtaacattctctagtagccctttctaagctctgcttcactttacatcattacttttgtctagtccttgacattccacctgttccggctttgacttgcttccccagatagtgtacatctgtgtctgcttcaaagcctcattctgttatgttctttaagagttatacctagaattgggccaggcacggtggctcacacctgtaatcccagcactttgagaggccgangtgggcggatcacctgtagtcaggagttcgagaccagcctgtccaacatggtgaaaccccgtctctactaaaaatacaaaaattagccgggtgtggtggtgggtgcctgtagtcccagctgctcangangctgangcaggagaatcgcttgaacccgggagatggaggntgccgtgagccanancacaccattgccctccagcctgggnacaagagtgagacttcatcgc

SEQ ID NO: 22643 - DNA, 746 bp, Homo sapiens
  misc_feature 580, 639, 641, 664, 672, 682, 713, 720, 744: n = A,T,C or G
ggggatctattgcagaatcaagccccattgttgtctggaagcagactaaagggaagaaaagaaatgcttatatttgatagattaataacattccaatcactttactttttagatgcaagaaagcaaagcctagaaaaattaaatgtctaagggaactaacttcacatatcaaatcagaatgaggaatataaactaggtcttctgggtttctaaaccattttcaaagagtaagtgattcacattaaaaagacatatttcagctgctctgcctatggagtagccattccgttcttttattcctttaccttcttaataaacttgaaaaaataaaaattaaaaaatactaagacatatttgtactttccagttagtaaaatctaaaattattttccacttcttattgtagtatctaatgatagaaatcttaattcagcatttctcaatctttggtgtgaataaaactcacttgagaaatatgttaaaatgctggttctcaggccataacacagaactatgtttgtaaatttgagaaagggcccaggagaatttgcatttttaacaaaaacttagatattctgantaactggtccagatctcactttgaaatatattgccttaaggtagcagaaatactgcccncnctaataaaaaatgagattaaccntgggaagnctccctttcntgtggcttcttcttctgcactgtatacttgnctcaatncctatcggttgcatcttaagacanca

SEQ ID NO: 22644 - DNA, 753 bp, Homo sapiens
  misc_feature 3, 11, 75, 685, 722, 729: n = A,T,C or G
agnacgacagnaggggctacagtgcttgctgcaagcttgggaagctctaagccattcagtgaccagccacagggnactggctcaggaaccttctgagccaaagagacaccatgcaagattacctgaggaacttctcagggtgaggatgggagcagaaacttccttttcctttcctgaacatttcagaagtgaccgtcaattcctggaaaccttggccatcttgctccctctgtgaggatgggggttgacctacaagaattacagagagaaggaggcagaattctacatgggccaaggcgggtcacagctctatgtttaattttttagatcatctgaaccaaaatatatgcatttttctggtgttagttcaagtttgatttttctgttaaaacgagtacattccaatgaacacagtttttcttcacacagaggtgtaaaaaattgatatgacataatatgatcctataaccagaggtattttcattttaataaaggttgagtaacttcctactaaataataaaccttttatggtagaattttaagcatcggcaagctgatgaggtaaagagggtactttcctggcatttctgaaatcaattttaactaattgaacacttaacaaaaatatattgaaattgaaggactctgattcgtacctcagtcttagcttttcacttacctcgngatgacttcagttaatacttatttcagctggcgcagngctccgnctgtatcctacactttgggagctg

SEQ ID NO: 22645 - DNA, 122 bp, Homo sapiens
atagaccttgtaaaaaactatttccatctatgtccctgaatttccaagccactgaagaaaaacaatacagaggttgaaaaaacctaattgttgcctacttacttggaaatgattgttgctgg

SEQ ID NO: 22646 - DNA, 229 bp, Homo sapiens
  misc_feature 159, 162, 168, 171, 174, 175, 188, 191, 200, 202, 212, 215,217, 221, 223, 228: n = A,T,C or G
gggggcttctaactcactgctcactcaccgcttcttagcttaggaatcacctacaataacctcgtgtcactgtatcttgtgatttcaaacaaggaaccctaaaaacctgaaggcacactgggtgccgctcaacaataaggctcggctgccaagacgaanatntgaaancanaannaaaaaaaaaaccngcncttttctcncntttccccccnctngntgcntntcttnt

SEQ ID NO: 22647 - DNA, 755 bp, Homo sapiens
  misc_feature 10, 26, 617, 636, 702, 704, 709, 737, 744: n = A,T,C or G
gacgacagangggtgagttcggcagnagttagaaagtttggctgcagacagcctgaggaagatataattagagggatggagaatcctagggcctgggagatgaagttagatatctgctcctttctgacaacattgccctaaaagtcagtacttttcaacaacatataatatctcataatttatgtggaccagaatctggacacagttcagttgggtacctctgcttttaggtcttttatgacattgggactgtggtcttaactgaagctggactgggaaagcatgagcctttaagctgactcatgtgaaaattggcagggtttagtgtggctggagagcctgactttccttctctctactggtctgagcaccccctcaggctctgttatgttggtctttacatggagcatctcatagcattgaagcttgcttcctgtgtttgaggtatacaatagagagagagaattagacaaaaaggtgtacacaaaaagagacagagaaagattgagggcgcaaacaggaaaaacccagtaggagaaaaatgagagctttagaaaaatcttgacagggtgcggtggctcacacctgtaatcccaacactttgggatgctgagacnggtggatcacctgagtcangggtttgaaagcagcctggacaatatggtgaaaccatcgtctcttctaaagtacaaatgagcaggngnggggngcatgcctgtatcccactacttgggagntgcgcangggatcatttg

SEQ ID NO: 22648 - DNA, 680 bp, Homo sapiens
  misc_feature 117, 580, 612, 617, 653, 671: n = A,T,C or G
ggggttttaatcattttgggtgttttcaaaacaaatggtgagattaggggttttttttctcttctatttttggcccctttcctctggagagtccttctcttgtgtttagttcttggngttcttagtatatttgaagaatgcttttaagtatttgaaatgtgtgtacatggttgaaaggggatgaggaagaagaaaccgaaaacttcatgaccctgctcaaaccaatacccataccccagccctaaagcagtgtccgggcaccacatcttcaaggaaggccccttggaaacccctcatgggccagtcctctgacccaggtgatctcctaaccccctttatgtattcttatgaggatatatgataaagaacggactgtgagatttgttgttcaaatttttccccttagaatgtgagctcagtgggtaatagtaccatgttggctctgtccacagttctactatcttcagcatagggcctggtatacagtaagcgcttaaaaaatacatgtcaaatggctgggtgcagtggctcacacctgtaatcctagcactttgggaggccgaggcgggtggatcatgangtcaggaattcagacccacctggccagatggngaatnccatctctctaaaaacaaaatagccgggcgtacagngcctgtatccagctctanggagctgag

SEQ ID NO: 22649 - DNA, 123 bp, Homo sapiens
  misc_feature 51, 75, 95, 117: n = A,T,C or G
aatgagtggctctttttgcccttggcagtgggattccattctaggagaagnagaggaggtggaggcaggaggatntttgagcccagatgcagacngcctggcaaatgcagacctgtnttacaa

SEQ ID NO: 22650 - DNA, 725 bp, Homo sapiens
  misc_feature 1, 697: n = A,T,C or G
nacgacagtaggggatcctttttcttccttttcaatttctgtgtcatgcaagattttgtttctatttcatcagtgacaaggaatgtttagatttttgtcctgagttgatatatttgtgtgtctcaatagatcagtggtcgtgaagtgtttgaatttcgtcctgaactggtcaatgatgatgatgaggaagcagatgatacccgctacacccagggaacaggtggtgatgaggtaagaggaagctttgtgcctcatctccttatgttaattgaaagaaacaatagaaaataccacaacatggttaagagccaccaacatcagagccacagtgcctgggttcaaatccttactccaaccatgggaaattaatctaggcctccaccctcatctaatatggacataatgattatctctacatcatagtttgtgagaattaatcgagttcatgaattagtagttctttatacatcttaggacagtgcctagtatgtggttgagtgctatatgtattacctctaaaaagtatgttttgtcctccctctaaagagagagttattttttggttaatattttatgcttaaaagttatgggacaagtgcactaatttaaactgcagtgtagggagcatgagacaatagcacagtcatttggttggtgacagattagtaatacagataacttactggtcattttttgngactacaaaatctggcctctggttgaag

SEQ ID NO: 22651 - DNA, 752 bp, Homo sapiens
  misc_feature 19, 45, 735, 737, 742: n = A,T,C or G
ggggtatttttagtagagnacggggtttcaccatgttggccaggnatggtcttgatctcctgacctcgtgatccgcccacctcagcctcccaaagtgctgggattacaggcctctgcgcctggccttgcattgacaattaatttgtttatggaaagccagttatccaatgatggtgaacaaatgcaacttgactgtataatacttattttggttttggaccaaagtcaccattaaatatgccaagttcttgttcaaggaaacagctaatgtcgtggacttgcatctcatttgtagttggttctccctgaaaagtcagtggtgtgggagaaatgatacttagtcaaaatcatcagtgaaaatcattgcttggatcatcccaaaatataatgaacaaaagtgatatttatctgccacattgagaaacattcaccatatctcaataagctctcctcagccagttggtccttttgtggttgaaaaaagtgccatatctttggttgggcatccaataaaatatggtatttaggggctacctgtatggaaaatccatatccttaaaggttagctcaccaggaggatgttgagaaatggcacaaggggctgggcgcggtggctcatgcctgtaatcccagcattttggggaggctgaggtgggtggatcacttgggtcacgagttcgagacagcctggccgcatggtgaaggccatgtctgctaaaatataaaatggcaggngnggggnggcgctggga

SEQ ID NO: 22652 - DNA, 762 bp, Homo sapiens
  misc_feature 7, 10, 21, 35, 36, 49, 60, 73, 74, 75, 78, 82, 104, 227,229, 230, 444, 469, 495, 523, 604, 629, 648, 672, 675, 676,679, 680, 707, 709, 711, 718, 736, 737, 748, 754, 758, 759,761: n = A,T,C or G
cttaacngtnggggaaaaaanccggttttttgggnncttgggaccgcangacaggagggnataagtggcatgnnntgngagncggctcatgcagtatgtccggntcctttcactgagcataaggtcttcagcactcatccaggttgcagcctgtgtctgaatttcattccctcttctggctgaatcgtattccattgtgtatcttggacatatcctattctgctcangnngccgttggtgggcgtttggagtgttttcgcctttcagctgttttaagagggttgcagtgaacatttgtacaagttttggacccaatgcctgttttcaattctcttgtgtagagagcactttttagcagaaaaagaatagatttgtggcctccctttgtgtgcggtcagtgccttgagaagagtgaactgtgctgccacctccggagccgtgganagcgcggggcttgggtagcagctangacgatacaagttgggacaaggccangtgcaatggctcacgcctgtaattccancactttgggagaccgaggcagggggatcacctgaggtcaggagtcaagaccagcctggccaacatggtgaaaccccatctnttataaaacagaaaaattaactgancggggtggtggacccctgnaatcccagctattcgggaggctgnggnnggnnatacttgaaccttgtaggcggagctgntntnagtgganatagacccctgcctttannctaggtacagngcgagnttcnntnc

SEQ ID NO: 22653 - DNA, 534 bp, Homo sapiens
  misc_feature 373, 444, 488, 490, 491, 496, 522, 531: n = A,T,C or G
gggaacttcatatataatcaataaaacaaaagaagtgaaaagaggagattgcagccaagaggaattcgttacaaacatgtatgagattttttaagttttttttgtttttaattattcctatttcacgttcacatggaaaagtcagaaagcataactactctaggccgggcgccgtggcacacgcctgtaatcccagcactctgggaggccaaggcaagtggatggcttgagtccaggagttttgataccagcctggggaatatagtgaaaccccgtctgtcctaaaaatacaaaaaattagctgagcatggttgcgtgtgcctctaatcccagctacctgggaggctgaggtgggagaatcacctgagcccanaagtcaagctgcagtgagctaaattgccgactgccttttacctgaccaccaaaggggaccctgtctcaaanggaagcttactgcaaaaaaaaaaaaaaaaaaaaacccctggggncnnttttngggaaacccacttaaaaaaccttggnggttggganccc

SEQ ID NO: 22654 - DNA, 678 bp, Homo sapiens
  misc_feature 29, 38, 582: n = A,T,C or G
gagacagagggatttctgtcactgccagnagtacaagnatactgtaaaaggagcattttctctagcaaattagacttgctagctccatggatctagattgactaaaacagcttgttgccccagggatgtagctggatttggcttggtcatttcttttaaatataggacttcagaaacctgatctagagtccttttcttttggagacagtatcttgctctgttgcccaggctggggtctagtggcatgatcatggctcattgcagtctcaacctcccaggctcaagtgatcctcctgcctcactctccctagcagctgggactacagacgtgtatcaccatgactggctaatttttgtattttttatagagatgggctttgccatgttgctcaggctgttctcaaactcctagactcaagtgatccatctggctcagcactttgggaggccgaggagggtggatcacttgaggtcaggagttcaagaccagcctggccaacatggtgaaacgctgtgtccactaaaaatacaaaaattagttgggtgtggtggtatgtgcctgtaatcccaactactcaggangctgaggccggagaatcacttgagcccggaggtggaggtgcagtgtgctgaaatcatgccactgcgctcagcctagtgacagagcttactccatct

SEQ ID NO: 22655 - DNA, 639 bp, Homo sapiens
  misc_feature 544, 548, 561, 615: n = A,T,C or G
gggggcgtctgagggtcttatgccagaggggatagaaagcccaacagaaactcaagatagaagaaggagaatctgcgagtgtctgtctcctgtcaagcttccctaatacagccctggtagaacttcatcaacagtggaaggcatttgcaaaggtgagcccaaaccagcacccctttccacacaggctgtccatgtagaaggcccagatgcttctcagggtctctgagaggatacaaagctactgagggggccagagggcacagcacctgggatttggatgagaagctgcaggaagggaactttgcaccccaagggcatggtgtggagtcaatagtggcaagttcagtctggttttttacatcagccggttcagaggaagagtgaaatccccaagatcagcagggcaaaatgctggaagttgtcgaggatgcagagagtagcaggaagacacctctgagactcactcacacacctgcccctgtgtagagatgtcatcctgggatgagaaggaggaagacagagaacgcagaaagcctaagcagcncccnaagaacgagcccnctgaagagctgctttacctggtggaacttttttagtggcccaactttcattcanacctgaaaaactgtgaaaaaaaaa

SEQ ID NO: 22656 - DNA, 787 bp, Homo sapiens
  misc_feature 227, 277, 281, 327, 369, 372, 416, 439, 457, 539, 564, 635,643, 647, 690, 711, 716, 723, 725, 731, 748, 751, 758, 764,773, 776: n = A,T,C or G
gggagttctcaaaattatcattagattttcgcagtggtctttgattcagatatgattaaaagaaccgcagctctgtttgagaatcagtgtggaccagtatgagagatactttgcttttatcctgttccttttcatccttccctcctcactctctctctctctttttctctcttcacaaacaagtatataacattactttaaaaaaaaaaagcaatgctttctggagnggggcacgggggctcatgcctgtaatcccagcactttgggaggtcgaggngggnggatcacctgaggtcaggagtttgagaccaatttggccaacatggngaaaccccatctctactaaaaataaaaaaattagccaggcgnggnggcaggagctgtaatacgagctacttgggaggctgaggtagganaatcgcttgaacctggggggcanaggttgcagtgagccganatcgcaccattgcactccaacctgggcagcaagagtgaaactccatctcaaaaaataaaaatataaataaatgctttcttanaaattgaaaataacatttaaatgcncttccgatgtaaaaagtaaaagtctggtgttaatttacctaattctggggaaaagggatctattacaagtntgtaatgnggangaaccctttttaaaagttaatctaggaatctttgatttagggngggggtattttatgactgacnttttntctggananaggggnggccacttttttggaanaanaaaattntaggcntgggacatnaancttaaaaacag

SEQ ID NO: 22657 - DNA, 789 bp, Homo sapiens
  misc_feature 1, 9, 679, 687, 701, 706, 745, 749, 754, 765, 773: n = A,T,C or G
nacgacagnaggggagccagcgccggaaaagaggcggtggtgcgctgacgtcacttccgcttcaacactctggccgggcgaggctcgtgggctccagtttcagccacgtaggaccgggtagaacacagaaattctagtttcctctcgggtgggtgcagaaagggcctggggttggctcagggagggggatgcagaactaggtccagagaaaaaggatgaaaggcttcctagcacaaacaccacccctggagttcccggtacatcaataccagcctggggatcacgttctcatcaagagttggaagagggaaagcttgaaccagcttaggaggacctcatctggtactcttgatgaatgaaacagcaatctgaatggctgaaaaaggatggacccagcactccagggagaaaacttggcattctttgggaatctaacaggatgcagtgaacccaagccttttgaagagctcaccaatcagactgcccttgtctatccatgagcagatgtttgatagtattgcggaggccctctagtgggtatgctgccaagcaactggagcggcacttgggctctaatccagttgtctatccctttcaccctggcatttcatcagccaacaaaaccaactaactcagaaaaaaggaaagcccctcaaggtcctttgaccccgatatctantagatctntcggggtccctgangggtncaacgaatcaagctcgaaatcaatagctgctgattcaanctgnctttnttggggctctntaataaangtgactggataattac

SEQ ID NO: 22658 - DNA, 777 bp, Homo sapiens
  misc_feature 520, 569, 620, 635, 675, 703, 730, 740, 744: n = A,T,C or G
gggataattaagaatgaatccctgagtcatttgacttcttcaatgacagagcaagccacgtaaaaatacccttccaagggaaagccatcagggagcctcagaatgggtacagtttcaccccatttacctaaccttttctgccagtgcagctgagcctctcaacgcgactttaacaaactctctctgagccagtcttctcagtgccatctttgctttcattcaactttacatgtctagtgttgctgctcaaacctgtgtcccctcaagtcctttcccaactaaaggatggtggttaattgacaatagacaaacaagtctcagaacaattatgagggtgtaatgaagtgtgcattcgtacatgcaattaaatagaggaaagatgcaggagggaatgtgtacacaatcctcctccagctggcacgccctgcctggaggtgctcctccactggaagcctgttgtgtgctcctctggcaaggagatgaagtcccagatttttagtgcctcatgcaaggtcttttncacctccttcactagttgacttagcctgggtgacagagtcagacactgnctcaaaggaaaaaaccaaacatacctcaataatgtctgcaaataaaagacntgaacggatatgganaaagcctctagatggcccaggggagtgtaacatgtctagnctgataattggctgttgggaataatctntccaaggagtgacaaggatggtggtangtcacttggnctcncttagtaaggcaggctggagggtgctgtcagtt

SEQ ID NO: 22659 - DNA, 752 bp, Homo sapiens
  misc_feature 2, 674, 713, 738, 750: n = A,T,C or G
gnagacagaggggaagaaagtaatcaaaatgtgcatgctctctgcaggggaaagtccccactgaagctagttctacttggacgagcttgactgaaatgtgagcactagggctctttgtgttgatgcggtcaccatggttaccgcgttccccaaagacatggttacttccttgactacctatcctgcctcagtattgctggatcatatggtaattctacatttaattttttgaagaactgccgtactgatttccccagcagttataccatttgatagctgcggtcttttggcaagatagcagaagttaggtattattcctatgaggagtttatgtttatcctaattgtttcagaaacattaaggttgactacttcggggccacattgcggccccaggtcccaaatccacatctcctccaacccaccctgccgccttttcctgtctgtccttccatccatcctccccagtgaggaaaagtcacagcagtgcacttcagctttcagagtaaaagatcaagacaagcccaggatcaggtggcctgtaatgtgttccttagaatcacaatttctccattcctggtacagttttctgtaattctgttgccataccccaaaggaaaagctttgctttagagactcgcggtctattaagggtgagcaaagccttgggcatangccctggggagttctaatctcaactctgctcatatgggnggcagccccaggagtaatttacctnccaatcctctgntt

SEQ ID NO: 22660 - DNA, 720 bp, Homo sapiens
  misc_feature 498, 520, 552, 585, 640, 646, 647, 663, 668, 671, 676, 694,698, 713, 717: n = A,T,C or G
gggattttctcttagtacatttaaaaagtatagtttctaccccagtggttaaattctccaaatttattgctaaaaagtaaactttaaatttggaaaatttgctgaagtaaattgcaatttcagaaaaataagtgaatatggagacacccagtttcatgacataaatatttcaataaattattagattactggccttctagtggtctcagattctataagctgttgatacttaggatattttttataagcttaatgcaatcaaattaaaattctattaaaatacttttaaagtagaaacctaattttaatcagttgaataatagcacattttatgaatcagatttttaattttgagtggttacaacttatcttcacatcatatttattattggaacaagaaagtgataattttcctgtgaactcacttggggaagtataaaaaaaatgatagtttatatgaatgctttaatattcatttgaaaaaaggatttagcttgnccttttgcttattctagaaggnagaattaacttttggttttgttttgtttgagnggagtctcgctctgtcgcagactggagtgcagngccgtgatctcagctcaccggacctcccctccaggtcaagcattctcctgctcanctccannagctgggatacggggngcccnccngccantaattttgttttttagtnaaangggtttcccatggcngganggc

SEQ ID NO: 22661 - DNA, 740 bp, Homo sapiens
  misc_feature 627, 648, 661, 694, 695, 714, 717: n = A,T,C or G
ggggaaggcttctgctgaaggatgtttatcacagtattatttataatgtgaaaaagccaaagaggagacctaaaatgtttcaaagatgaaaatggtttgataaaattatttttttttgagacaaggtctcactcttgcccaggctggggtgcagtggtgcaatctcggcttaccacaacctccaccttccagattcaagcacttctcctgcctcagcctcccaagtggctgggaatgcgggcacaccccaccatgcctggctatttttttgtattttagtggggatggggtttcaccgtgttggctgggctggtgtcaaactcctgagctcgggcaatccaccttcctcagattcccaaaatgctgggattgcaggtgtgagccaccgtgcctggcgataaacaacatatttaaactctaaaatgttatgcaagcattccaggcatgctttggaaaaactattaatcccacaaaagatgcttatgtaattatatagactaacagaccaagattctccaggacacttactttgttaagtgtctgaagtaaaatgcaatgctgtatataaaatgtgacctgaagtcaggtcccagtcttttcatctggaaaatctggtaattatactgnccttcccttataggtttctgnaggagttaaaacnctttttcaattgcttgaatatgctaacactggnngggagctaaaagtcagctntgncctatgggccaaaaaaaaaaaaa

SEQ ID NO: 22662 - DNA, 767 bp, Homo sapiens
  misc_feature 633, 659, 670, 675, 680, 692, 745, 751: n = A,T,C or G
ggggattcatttgctcgcgtgcaggggaagtctggagaaggcattgtttcaattattaaaagtgtgggggcagtgggcggaacaaacgcgccgactacagaggctggacgtaagcttagcggtggcgcgcgtgcgcagcgccggcccgagttgccaaaacaaaggggatttggtgatggaggctttgttagaaggaatacaaaatcgagggcatggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaatccagggaagatcggtctgaattgagaggtaactgcaaatagaggaattccgtcagaatcgctgactgganaagcacgctgattatcagcacagttnttcctggagcncaagnagctntgctgacatcanaatattcagctcacttgtcatcgaacaaaattaagctgggacttttaccatcnaattcnccttaccgtaactggg

SEQ ID NO: 22663 - DNA, 770 bp, Homo sapiens
  misc_feature 28, 29, 35, 46, 49, 581, 639, 670, 678, 685, 701: n = A,T,C or G
ttactttggggcaaaaaaccccgccttnnttgttncttttggaccncangggacataaacatatgactacacccacctcttcacaccttttagaattttaaatttttagtatatgctatatatatttgccagtgtttactttactttagtgcctttaatgcaatgccttaacattgtgggagtgacttttaagttcagtctctgtacatacagtctctatggtgatactgtatcgttacatggtgaacagtccacagaaagtacttgcatgtctttcttagaaactttctggtactcctatgctatagtcctcttttgatggatgccttaggcatatgctaacaagattttgttttttaaaaatcttgtgaccccattatccaaaggcagtcaaaagcacacagccattaagggggctgaacaagaggactttatagtccatactggaaagtcaccacaaccccagtaagatcttcttttctaagaaagggatgcaattaatagaaagatgcaaaagtatgcagacattttgagagaaggcaggctgcagaatctaggatactgtagcagccatgaagaanacatcaccacgagagatgggaaaagtcgtacagagaaattagtagattagtgaagaanagtccagcatggaagaatgtaagacttgccncgactctnctcaagntgctatgtattttganggcactatattctggtcttccttacctcatcatggatccttttgggcccctcctcacctgggtactctg

SEQ ID NO: 22664 - DNA, 746 bp, Homo sapiens
  misc_feature 2, 9, 23, 26, 84: n = A,T,C or G
gncgacagnagggcaaaacaggnagnatcattcaacaacccttctgattactcccctcataaagaaactcaagttccctggagnataattacagcagtggcgccaatctctggcaccatgtgcactgctgatctttattaagtatgagttagggatgattgcgggggtgtctcccacctccattagagtgttaggaggagtaggcttgggacttattacattgctgtctcttggagccagtgcaatatttacccaataaatgtgattgaatttgtacaaagtcattgtctgcagccatctctgttaatgtgcatgttctgtaaaaaattgctcatgcatagacttagctttctattttaaatgtcacaattgagtcaataaagtaaacagagtttatgagtgtttacagttccaggaacacacaggggaatcctttattctgttttaaattaaagcgtcattcaaaaagaacaaactttcttaaatgttgcttttacatctttggctcagaacacagtatttctaactttgtttttcttattacttaggaaactagagaaatttctccttggaaatgtcagggggaaaatacagtatttcggattaactttataaaactcaggtttaaggcttattgaccagaagacctctttcttatccaagtgtagggcaattcattgcacccttgaggtagggaggagcaaataagctgcaggggtccccgcaggcaagctctagactgggat

SEQ ID NO: 22665 - DNA, 722 bp, Homo sapiens
  misc_feature 2, 9: n = A,T,C or G
gnagacagnagggcataactaagtttattgtaagccattatcaagatgcattctcatgttgtgtacctggctccaaggaccacagttgattattatcttgggggacgtttattattccctctctgtctttgtaaataaaaatgacaagtcaaagtttggtagtagttgagaaaattgttgacgtgtaattacaggaatttgcttctttggttcagtttgttactttgaatctttacactgtctgcgtagctattgtggatttattattttctgtagctgcacagaaaataatgttttaatggtttttcataataaataatattattttccattttatgtggcatgaaaactctttcacattcatcactttgatctccctgactccactaccccgtatgaggctggtagaatatggtgggacaagtgtcacaacccattgaactgatgatcaaagatgcaaagaggccacatgttttgcccaaagtcgtgcacttagcaagccagaattcaaaccctgacctgatatcaagagtttactgcctgtcaagaggacttgcaatccttccactggacacatttcagatttagtttcccctttgaactgataacaactgtttcaaaagtaagaacctttttggattaagcctgaaaaaggagaattgagggagttggagaagagttttcctgttttaccacttaataacagtatgggggaggtgggg

SEQ ID NO: 22666 - DNA, 806 bp, Homo sapiens
  misc_feature 14, 30, 43, 59, 62, 69, 71, 700, 728, 769, 770, 771, 773,787, 799: n = A,T,C or G
ttttttgacctacnaaccccttgtttgttncttttggccgcancggcctaggctgcganagnagacagnangggtacccagtgctttggggtgcttggtgccacccagcactgtgagcacaggttcttctaccttggggccacacccagttacctgtatctcactgcacagcagtggctgttggggaccaggcccacccctccatgtcccacctcctgcaactgcagcctgagccttcccatcagcctggggtggtgcagacccatgtgccattgtggatccttcaagttacctgtgtggcagagaggacgtgtgagtgccgtccaaacccaaacactgagagggtccttcccattgcccccacggaagtaaggtgccccagtgctaattccacttatacttgctggtggcaaggacacttctcctccttattaaagtgggggattggctgggtgaggtggctcacgcctgttatcccagcactttaagaggccaaggcaggtggaccacctgaggtcaggagtttgagaccacaagcctggccaacatgttgaaactccatctctactaaaaatacaaaaattagtcaggcgtggtggcgtgcacctgtaatcccagctacttaggaggctggggcaggaggatcacttgaacccaggagttggaggttgcagtgagccaagattgtgcccctgcactncagcctgggtgacagaatgagacttatnccaaaaaaaaaaaaaaaaaaaaaaccctggggccttttttnnnancccaaatgaaaaancttgggggttgnccccccc

SEQ ID NO: 22667 - DNA, 786 bp, Homo sapiens
  misc_feature 547, 596, 662, 671, 731, 739, 782, 784, 785: n = A,T,C or G
gggggacaaaatacaaagcaaaacaaaacaaaatctgaaagctctgtagaacaaccagggcagccaggacctcagggaccaagatcctggagagaaggaaaacatattgaagtgagtactgctctgagtacagctatttcgccttggaatgtttgctgattcaaggcttggggcatagaggcataaaaaatgacgcattcttgagcctgtggcagttgtactgggctgaggaaaccaaaaatggagttcagagttaaattaagcagttactacatgaggggccaagatctagagaaaagtactatggacagctaaaaccaatattctatgtgcatttttccttcaaggcattttctgatatccaacaggctaaactcaagacaagacacagaaaaaaaaacaagtaaaaaaatacctattaggaagattaaaaactggggagagaatctgtcagttccatgattctgaggagacaaaagttggagtgcaagtctcaccaaagaggagaaactcagcttttgattcacaacctggaaaatctacatcntaagagtaaggacaaattataactagattagcctcaactataccaaggngatcttctcaactcttaaaaaaattaaatctctgtagaaaacacaatatcagccagaacccccctnttttctacncatattatcattcactgaagtatcagcctggcgacattaaacttatttcccaaccccccnacaaaacngaaatgaaccatccctgtgatcaatttgcgttcaactggcttnannt

SEQ ID NO: 22668 - DNA, 457 bp, Homo sapiens
  misc_feature 1, 9: n = A,T,C or G
nacgacagnaggggataatactgcatcaaacattcttagtgtagccatccatttacaagtgttattttcaagagcaaaatttatgcctttaaactgtgataattaaattaatactggtgagaactatcagatataccactgtgacagaacagatggcctagagacagtgatacctttaaaagttaaataattgctgagcgcggtggcttacgcctgtaatcccagcactttgggaggccgcggtgtgtggatcacggggtcaggagttcaagaccagcctggccaagatggtgaaaccccatctctactaaaaatacaggtgggcgcctataatcccagctactcaggaggctgaggcagagaattgcttgaacccaggaggcggaggttgcagtgagccaagatcgcgccactgcactccagcctaggtgacagcgagactccgtctcaaaaaaag

SEQ ID NO: 22669 - DNA, 658 bp, Homo sapiens
gacgacagaggggattaatggagaagtctatggggtcacgtggaaactgtttaccttgccacctctctgtagtcattaaaactcttgaaaatgaattttcttatcctaagagtgtaaaactgatgttgtggagcattttgcacatgccagacacagatgaattcaagacgcagtccctacactccgggtttctacagtttagctggacagagatgaacaaaattgcaatggagtgtgtaaggggccatagtgtgcaaggcccaacacctccctgagcgaaggacgtcagcactggttggctggatcctggccaagcttgctgtggggaagtggtcgatgtagtgtggggaaggccatttgcactgatggcccctgtggagcggaacattctcatggctgtgtctgttacccaaataactagaggatgctctgtgtgcaaatcttgttttctttaatcagcataaaatctggaatgaggagaaatagcttctgaaatgcgctttctcaaagaaggatgagcagaatgagccacaccatctataccaggagtgtccagttttttggctttcctgggccacattggaagaagaagaattgtcttgggccacacataaaataaactaacactaacaatagctgatgagctaaaaaaaatcgc

SEQ ID NO: 22670 - DNA, 791 bp, Homo sapiens
  misc_feature 574, 662, 692, 705, 709, 768, 781: n = A,T,C or G
gggattgaaaactaattaattggatcccaaagacaagatgatgaaactactcaatgaaataaaaaaggtaattacagagccaaggaagacattggggataaaaacaatgtcattacagaaaaagttaccaggaaacataacagaatctgttgaaaatgaaattgctaacagagaaggaaggcttgaggaaaatcacagcctatgctgagaaaaaagataacgcacttaaatcagagatctaaagatcatacaaaggtgggccttcaaaagggtaattggagagtctgcggaggcacgcgtcgcttttgctcatattccattggccaagacttagtcacatagatagacacacctggctgtaagtaactctgggaaaaagtctccggctgagaggccatatgccttcttaaaactcagttttggggaaagctttctactactgaaaggaaaacctggatattgggatcaactagtatctgctttaagggaagtcatgttggtctcagacatgactgaacaggtttacagaggccaggtgaggtggctcatgcctaaaatcctagcactttgggangcagaagcctgcggatcgcttgaggccagaagtttgagaccagcttgggcacatagcgagaccctatgaaatcatcgctgggtgtggnagtgcatgcctgtagtcctagctcttgganactgatgtgggangatnccttgcccggagctcgggctgcagtgagcttgattgtgccctggctctggctggtgaanacagacctgtctnttttaaaaaa

SEQ ID NO: 22671 - DNA, 769 bp, Homo sapiens
  misc_feature 9, 10, 13, 14, 20, 25, 28, 640, 688, 747, 761: n = A,T,C or G
tagctgcgnnagnngacagnagggnagnagcgagagttattttgagattctagtatttggcatagcatttctcaatgtatgttttacagaactttatttccctgagatgctaataagcatttcacaaaaattaaaaaggattacattgtcagatgagtttgagaaagagttgatttcacttcactgtagaactcagagcctttggtatgctaatatgggcacaattaatatagtatgcgtgtttttcagacttatgctctaggacttttcagaatttcatgggattagtgatctaagaaacatactttggaaatggtcattctagagcattgctttactaattcagtaggtggcagcctttcctgacttaatattctttaatgaggtgttaaatgttaacttgaaattgtaactaatgagatttagtacctggttatagtttataacaccagaggagttgatcctacttgaatttttaatgaattaccatcttaagcctattaaatttgtctgagtataaagtacttccaggtctcatctttgatctagttattactaaaatgaaacagtaataggcaatgaaggcaagtattttaaaaccatatgatgcatactagctctcatattccaaatatatgcnaaatagtcattttaaagtattataaaaatttgttggtggccggcgcgnggctccccctgtatcccgcacttgggagccgagcagcggacacctgagtcagagtgganacagctgccactgngaaccgct

SEQ ID NO: 22672 - DNA, 739 bp, Homo sapiens
  misc_feature 687, 693, 696, 703, 704, 707, 713, 722, 723, 726, 727, 732,733: n = A,T,C or G
ggggtaattgctgctttctcacagaactgtctaggattcattcaacagaccacagaaatgaggtctggcatttaacagactaatgatagaagaaataaactggtttatacaagaatatcaaaatactgtcatgtggtttagtgtagctcaagttatgaattagtgccaactattactgtgtaaagactgtcaggcgagttctttgttaacaagtccactagaaaaactcgtgtgtaaatgacatcatagcccggcagaggcggagtagttaagcccagtaatccttttcctttgggatggtatattttacatatagtcaggaggcttgcaaggcctggattagttgtcaaacttgaggctattagtttcttaagagtttttgtggtttacagtactcagtttctgcagtggtcggcacatcaaacctatttttccgtttacacttgttttaagaatgtcttatttcttcagattttgtgtttacacagatctgtagttatcactatgattctttttgttggaatgctaaaatttaggattcataaaatgtactaagattagaaggtaactttgatgaggcacaaatacgacatgaactatgaagaaagaactaaaggaaaatgaccaaggaacatactttattctaggtttccttgggaaaaaaaaaaaaaaaaaaaaaagagggcngttttnccntaatccnnatnaaaaantttgggggnnggnnacccnntaaaaa

SEQ ID NO: 22673 - DNA, 736 bp, Homo sapiens
  misc_feature 2, 9, 596, 610, 612, 655, 674, 677, 689, 703, 712, 719, 735: n = A,T,C or G
gncgacagnagggattctattacttttcccctttgtttatctaaccctaatcccattcctgatcttctgtaagtattcactctaaggtatttgagatactttaaatcattgctaaaaatatatataggatagttgtgtaagtagcagtagaaggtagtggtacaaagcacatattctagagctctagactctggatatgatcctggctcaccacttactagccaggctactggccagtacttactgtagctgctgatcctggacaggctacttagactctgtgtttttcatttctttacttgtgaccctggcatggtatgcaggaaagtactctaaagttgagatttgtgcacatgaaacttagggatttgtgctctcaggatcagaatctgcagaagggaagaaagtaagattgggaagagggtgaatttgaattggtgcagttaaaaaaaaaagctacacagcgtggcccatatgagttctcaagatgggatggcctttatgagttgtcatcaattggaaaagcagggctgagcttttataccccaccattaatcaccatagatgtgagcagttcccaaaagggagcataccgngagccaggcagctntnttcagctgcagactggacctggggagggactcacctgtagctntctgagtgaaaactcttantanctgaggaggganaagggggcattgcnccggggatncctaaanctgtaaaataaacacna

SEQ ID NO: 22674 - DNA, 759 bp, Homo sapiens
  misc_feature 2, 9, 21, 24, 620, 652, 678, 756: n = A,T,C or G
gnagacagnagggattatagnagnatagtgcatttgcacccaaattaatgaaacaataccattaaagagaaagaaaaggggctgggcacagtggcttacgcctgtagtcccagtgctttgggaggccaaggcagggggcagcctggccaatatggtgaaaccccgtctctactaaaaatacaaaaattagctgggcgtggtggcatgtgcctgtagtcccagctgctcagcctcccaggtagctggggttacaggtatatgccactacgcctggaaaattttgtatttttggtggagacggcatttttccatgttggtcaggctggtctcgaactcctgacctcaggtgatccaccctcctcggcctcccaaagtgctggcattataggcatgagccaccgcacccggcgtcatttccagtgttttctatgtttcctaggaaggttttgcttctggaagatttcagagggcaagagaataaaggagtggagtgcagtttttcatatatgtgattctgtgagtgtgtatacacagagatttaatattttaatacatcaggaattgattatacgatctaatgcaggatgtcagacttgtttctatccaggaataaaaccagntatgccagaagtaactattattcacctttctnctactgaattaaaaactatcagttgnatattaaatgctcacatctatttctggtctcatattctagcaatccttgacacttttaatagctttattacttggaanaac

SEQ ID NO: 22675 - DNA, 335 bp, Homo sapiens
  misc_feature 179, 181, 294, 296, 300, 305, 306, 309, 311, 315, 316, 318,319, 329: n = A,T,C or G
gggagtgagccaaaagttcatatgaagacttcagcattgagtccccaaaggattttttagaaagttcattaatatcttcatttgtcttcttccaagatgagcctcttgactgactcttctcagaaagtgattgacactttatgtgagagtaaaacttaaagtgagctatgaattaatgntnaaaccagatttcgaaaaagtaagacttcatcctaccattctaccatcctattttcactcccttgtccaaaacaaatccgaacattttcaaaaaaaaaaaaaaaaaaaaccccngnggcnttttnncgnancccnntnnaaatcttggngggttg

SEQ ID NO: 22676 - DNA, 326 bp, Homo sapiens
  misc_feature 214, 233, 266, 267, 279, 289, 292, 296: n = A,T,C or G
gggcatctgactagagatccctaagcttctcccaacaacctattaaaagtctttaaaagaaaaagattgactcatagcaacactgctcatctaggatgagtaaacagaaaaaaattccaccacctcataggtttatgagaagattctacagcatataaaaagaaaacacagcactcagatgaggaagagctggcgtggtagctccccctgtatnccacactttgagagtctgngcgagtggtcatttgaggtgagggttcgaggcnngcttgccacatngcaaacctgnctntctnaaatccgaaaaaaaaaaaaaaaaaaaaaac

SEQ ID NO: 22677 - DNA, 760 bp, Homo sapiens
  misc_feature 2, 680, 723, 729: n = A,T,C or G
gncgacagaggggatttgaaagttctctgaatatgtataggaattatcatgctttgacattttgattaacattttatagaatgccccaggttgttttttgcatggattgttataagtcaggaggaaggagaagttgctccttaaaaacccttgtattatgccaagaccctaatttctgtcttaaaaaagtatgctttacaccttaaagcagcacttttattttgcacattgataatgctgtatgtatactttctttttttccattttattttatttaaaattttttttattttaatagcttttagggtacaattgcattttggttacaatgctgtatgtatacttccatgtagttttcttaatcagtaaaatgatctttcatgttaaagtctctatttgttagttttccctgactgtaattttctttctaccttgtataaatgataaaaatagactctaataaactgagtgtgctctggcatactagttattgacatgtttatattcacaaatataaactccaggctggctgtttttcttggtgaatgttctccaggctggttatttttcttggtgaatgtaatgtactgtctttttagagtaagttactaagctggtactaaatcaggaatattttagttataaactttagatttttaagagtattggccaggcacggnggctccacctgtatccagcacgtgggaggccaggcggtggatncctganacgggagtcagaccgccggctacaggggaac

SEQ ID NO: 22678 - DNA, 720 bp, Homo sapiens
  misc_feature 9, 20, 641, 697, 705, 713, 716, 718: n = A,T,C or G
gtcgacagnagggaggtagnataaggggaaagacgtgtagttgtacacatatggtttgctctaatagagtggtataaatcaaatgctattggtatacaaaaggacaaattttgtcagccaagtgtatgggtatcttcaaagagcacaggtgccatctgttctgagctaatgacccattgaagaaggccacaccaaatttgggggaaaagcagcataaacaaatgccagagtattttccaggcaggttgtatttggagaatctcctaatgttgtatatttaatttgtcctttgtccaagaataatgcaatgaactaggcaactagttgaataaaaattgaaaccaagttcaaacaagcctattgaaaaatgggcaaaagactggaaaaacatggccaataagcgtaagaagagatgttcagcttgatcagtcatcaagaaactacaaatcaagaccacactgaggctgggtgtggtggctcatgcctgtaatcccagcactttgggaggctgaagtgggcaaatcacttggacaggagttcaagaccagcctgggcaacatggtgaaaccctgtctctactaaaaatacaaaagttagctggcatggtggacacacctgtatccctgtactcgggggctgangcacagaatcccttgaactctggagagagaggtgcagtgagccgcatcagcactgnctcagatntcgatctnttntntc

SEQ ID NO: 22679 - DNA, 833 bp, Homo sapiens
  misc_feature 4, 10, 19, 26, 38, 39, 46, 56, 59, 66, 71, 104, 547, 643,668, 673, 772, 811: n = A,T,C or G
ttgncctacnaaccccttntttgttncttttggccgcnncggcctncggctgcganagncgacagnagggnatttccacctggcaattttgagttaccccaggnagtcattgtaagaataaatgaaaaatgcagtccagcaaacgtttttgttaaggttttccccaaaatgtgggaaatggaattgttttggcaatatagtttatagcatactgtacacaacctatatttaaaaacaacaagaataaaacagtcaaggattcgcagttgtgattctttacttcagtaagttaggctattccttacttcgggaatcacaactcctgataaagtcagctactttcagattatgtaccattgaggtttggtaagttaagtgcgtttatcacaaatcccttgttagctcatttgaaaagtcaatacaggaagaagcagatattgagggtacagtttaactaaaacctaagttatgactaagtaagagtcaagattaacaattaaccttagaattcacaaagaaagtggtgtcaggggttatgttggagtangaaaccttttttcctcccctttgtgactatgtgtttttttagagaaccagaggacaccttaagagaatcattttacttaagagtctgtctttgaanggcagatcaaatgaatgggaaaganaaagnggtacttttacttttaaatgaaaggctcacaccatttctgcaactcctatatcctcacagttaatggctcagagaactagaatttcttctgcttaacanggaggaggtgttctccgcctgtttgcagctacttgaaangaggttcattttatttgacctt

SEQ ID NO: 22680 - DNA, 771 bp, Homo sapiens
  misc_feature 2, 10, 181, 623, 634, 664, 667, 683, 692, 705, 711, 722,729, 731, 760: n = A,T,C or G
gnacgacagnagggatacacatatttaataaatagtacactgtactatggaaggatgagataaaatattatggaagcattagagagaaagagagaatttccaatctatgggtatcataggtggtttcttggaggaaagtggaactgaactaagcctcgaagttggtaaggaacagatggtnggctatggtagggtggagaaaagcagagttgcagaattctcttatgttgtagtcccaaattaatagtaatgtactagattttcttctcctctcttgtgaatttccagcaacagcttgattttaacctccacagaaacacaaatgagagctgtgatggaaacaataattactagagtccagttttaactccaagtcaaaattttagtcacattcagccctgaataagaaataaggcaaagcatgcaacaggactttataactttttaattttaaggcattataaatataaatttttattttatcttatttttttagagatggggtcttgctctgttgcccagacaggagtgtagtggcaccttcttagcttactgcagccttgacctggtgggctcaagcgatccttctgcctcagcctgctgagtatgaggatgccaaggcntaagaatgacncatggactttaggactcaggggaaaggggnganggataaaaactccaantggggcagngttactgctcagngtgagngccccaaactnccaatcncnctaagactactctgtaccaaccccctgtncccataccttg

SEQ ID NO: 22681 - DNA, 726 bp, Homo sapiens
  misc_feature 142, 145, 528, 559, 576, 626, 632, 639, 675, 679, 680, 682,691, 697, 713, 718: n = A,T,C or G
tccttttgctataagtttttagaagcttttttctatgtattttaacatttctgtctgtgatattttgtgtgtgaaaaaaaacacactcaatgtgttttttcctatttttctcacttgaaaacaccaatcaacacagacaganganttctgtgaccaaatatgggggatctctctgcaagaaaaggcagcccgttctgcagtagacaccagctgggtggcctccaattcagttttgacaccatctatttggagatagcatcagatcctacaggttgagggctcaggccccaaaactggccacccccaacccgccacctcagacacagatgaaagtccagacctccaaacttctgacaggctggctttaagttggggttcccacaacttcctctttgggttcgatcagtttgcaggggcagctcacagaactcagggaaacacagttattggttattacaaaggatattacaaaagatataagggaaaaggtcaaggagcttgcctgccttcttcaggaccaccacattncaggaacttctaagtgttcagctctctgaangctctctgaaccctctnccttgggctttttatggagattcattgcctaggcatgattgattaagccncagctnttggctntcaacttaaattttaactcctcccctcccaaaggtntgannanggctgaagncccacnctttatccggcctggnttttngggaccac

SEQ ID NO: 22682 - DNA, 824 bp, Homo sapiens
  misc_feature 2, 13, 14, 15, 16, 19, 20, 21, 22, 28, 34, 45, 47, 51, 54,672, 679, 752, 763, 788, 801, 804, 808: n = A,T,C or G
antaacttgggtnnnnaannnncttttnttgttncttttggccgnangggnagnattgtctacacagtagcttcccctttttttgaacatagagtagaatttgtaatgcttttcttttttctccatcagtactataaggaaaatattattaaacacccctcccctgcccaacctttttttaaaatagagatgaggttttgccatgttgcccaggctggtcttgaactcctgggctcaagcagtccgcctgctgcaacctcgcaaagtgcttgtattacaggtgtgagctaccatgtccggcccaccctttcaaacaaatttggttgtagtttgctataataatatactaaatctatgtttatttgaaaggagcctttaccttttaaagcaaaatgcactttccttaaatataaaagtaatatggtttactttaacatttaaagttcaccttatctggggaggcagaaggaattttcatagtgcttactgtgttaattattatgagagatgaaccatatgtgataggtaaagtacatgtgtaagaaagacaaaaaaattttcctctttttataatccatgaaattcgaaaacagaaaattattcaaagaataggcaaatgtcatgacagaacttagtgtgagcaagtcattgagaattaaaatctactttcangtcaganagccttgaaaactacaataaagtataaagcctaggatttttctttcttttttttgaaaggagcttgctctgcncccagctgagngcgggggcaagcctaaaattttctnaaaatttggtttntcnttanggggggattcaccaag

SEQ ID NO: 22683 - DNA, 790 bp, Homo sapiens
  misc_feature 1, 8, 18, 20, 22, 28, 33, 44, 47, 200, 203, 205, 504, 565,578, 601, 610, 653, 665, 673, 682, 688, 725, 733, 741, 751,758, 759, 765, 783, 788: n = A,T,C or G
ncggcctncggctgcganantntacagnagggnacagaatgttngangctatgaaaagctttccatatcatcaaaactaatttgtgtagatttttgcatgaaaaaaatcataaatttccctcaaaatagactgtgttgcagtacacaagtcgccataatagtataaaacagtaaaatgtgcttaaaaggccatccttttnatngncagagataacataaagatctttgcatgaggtaaatctacagcatagttcatttttagattttgttgagtcctgtaaagaggaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgntttagaatctttttatcttagatgtaggcagccatgaacaatctattttgagccactttanggagaaactttgnatttttaaaacttgcataaaagntatgccagngggttttataattggaataatacctcagtttgaggtatgcccnctaattaaatgngcataaantaatttggncaaaanactcttttaaggggctcattggagaaatctgcgcctncctttacncaaggggnctgaaaaagntgcttannaacctnccgatagccccttagctnttttntc

SEQ ID NO: 22684 - DNA, 160 bp, Homo sapiens
  misc_feature 149, 152, 153, 155, 157, 158, 159: n = A,T,C or G
ggggataacacagtaccagctatgaggaatttaataatgataattcatgatgtcacataccatttgatatttatgagagcatttaggttacatcatttaacccttaaaacatccttgtgagagatatatgtagcatccctatttgtccngannanannna

SEQ ID NO: 22685 - DNA, 788 bp, Homo sapiens
  misc_feature 8, 19, 23, 27, 29, 38, 189, 191, 192, 293, 407, 441, 492,538, 690, 762, 777, 785: n = A,T,C or G
tctacagnagggggcaagnaagncatngngcctaaganaagcaagttgtccaagtaacaaatagctgttcattatggagctaggacttatgcagaaatttgccagttactttctgactacaaagaaaaacagcatgctaaaaatctcttctgaaaacagcaatccagtaaaatgtctcaagaaccaggngnngaataaggatggtgatagagaggttgaagaagaaatgaagaagcatgaaagtaataatgtgggattactagaaaacctgactaatggtgtcactgctggcnatggtgatggtggattaattcctcaaaggaagagcagaacacctgaaaatcagcaatttcctgacaacgaaagtgaagagtatcacagaatttgcgaattagtttctgactacnaagaaaaacagatgccaaaatactcttctgaaancagcaacccagaacaagacttaaagctgacatcagaggaagagtcacaaangcttaaaggcagtgaaaatggccagccagagaaaagatctcaaganccagaaataaataaggatggtgatagagagctagaaatttatggctatcgaagaaatgaagaagcccggaagtactcacgtcggattccagaaacctgactaatggtgccactgctggcatgggatgatggattattcctccaagaaagcanacacctgaagccccatttcctgaccctggaatgagatttacaggacaacaaatgttctcgagcatttggganacaacctggatttancgataatntgt

SEQ ID NO: 22686 - DNA, 821 bp, Homo sapiens
  misc_feature 11, 21, 27, 39, 47, 57, 60, 67, 653, 672, 710, 715, 755,767, 780, 781, 785, 789, 790, 799, 802, 803, 805, 808: n = A,T,C or G
tttggcctacnaaccccttgnttgttncttttggccgcngcggcctncggctgcganagncgacagnagggttgtttaatattttgtgacaaatttggcaacttttaaaaagttgtttgaattgaatagtgcataaaattaatagatgtttttcagaaaatccattattaagagtagaggaatgaggagaaatattcgttctaaagagaatcaaaaccacaatgagagattgtcttacccccgttagaatgacagttaccaaaagacagtaacaaatgctgacgagaatgcagaggcaaaggaacgtttaaacactgttagtgggaatgtagacttgtacaaccgttatggagaagagtatggaggttcctgaacaaactaaaaatagaactaccatatgattcagcagtcccactactgggtatatatccaaaagaaaatccatatatggagacatctgcacctgccatgctcgttccagcactattcacagtaccgaagattggaatcaacctgtgtctatcagcaaatgaacagataaaatgtggtatatataccccgtggaatactatttggccattaaaaaaacaaaattctgttattctcagcaccatgtatgatcttagaagacattatgttaagtaagccaggcncagaaagataaatactccntgtactgtacttatgtggaaggtaaaaagatctcttanagtanagagtggctcatgcctctatctcgggctttaggagtctangggggaggatcncttgaggcctggnnttgnaccnnctgaccacntcnntnaantaaaaaaaaaaaa

SEQ ID NO: 22687 - DNA, 290 bp, Homo sapiens
  misc_feature 113, 123, 138, 194, 197, 203, 224, 259, 261, 262, 263, 268,270, 273, 275, 278, 279, 280: n = A,T,C or G
ggggtaattgctgacccaagaggaaacactctaggacggggaacgacaattacccttgtcttaaagaagaagcatctgattaccttgaattggatacaattaaaatctcgtcnaaaatattcncagttcataactttnctattatgtatggagcagcagactgaactgtgaggagcccttggggaagaaaagcnccnagaganaagaaaatctgtgtgaactgngtaaaaaaaaaaaaaaaaaaaaaggggcctttttngnnnccccngnaancnttnnnttgcaccccc

SEQ ID NO: 22688 - DNA, 703 bp, Homo sapiens
  misc_feature 2, 9, 22, 56, 66, 82, 144, 150, 159, 204, 207, 208, 217,233, 241, 254, 310, 317, 331, 353, 367, 369, 402, 567, 599,602, 608, 617, 632, 649, 659, 671, 700: n = A,T,C or G
gnagacagnaggggttattaanaatagctgttatttttaatagctatactaaaacntaaaaatgtntaggtcagggcgtggnggctcatgcatatcatcccaacaccttgggtaggatgaggtgggaggattgcttgaggccangagttngggatcagnctgggccactgacttttcaagctatctttgtctctggcccctctncanngcactcaangtccattgtccttagngctaagtnatggttggggatntttgctgaggatcagacaagggctcttggaggaaatggcggacccagactacattncatgcanctcaccatccttangagggagatggaatcttctgtntactaacacaccananaggtataatacaagggacaaaatgtggcaagtntcaactcttctgccttgacatgcaaaccatcccttctgagctcacttccatgcaccatgcacagtggattccatgaacccacttccatgctaccatttttgtttttgtaatcatttgcaaagagacagaatgatattaagaaagtatcagtggctgggcacaggnggtgacataaacctgtaattccagctactcangangctgangcaggaganaattgcctgaaccanggaggcggaggttgtantgagcaaaancacaccactgcnctccagcctggagacagaggagactctgnccc

SEQ ID NO: 22689 - DNA, 589 bp, Homo sapiens
  misc_feature 11, 19, 23, 25, 32, 36, 42, 44, 46, 55, 57, 60, 68, 90, 104,117, 233, 267, 302, 324, 329, 355, 365, 389, 392, 409, 416,422, 423, 434, 444, 456, 467, 478, 491, 497, 518, 537, 561,562, 563, 564, 574: n = A,T,C or G
cttttttgttncttttggnccgnancggcctncggnctgcgnanantcgtacagnanggnttacatgnatgcctgcaccccccacccagnaccaaacattctgnagggacagctggntaaaagcactaaagcaagtatatgtgaaagaaaagaggaagggactataatataaagtgggaatgttgagaagaaaagcctgggaaaaatttattttggcattgggggaaaggggnaaaaccctttaaaaggggccccccctccattttnggggggggggatggtttttaaattcccttggattnaaggggtggaccaaccgggggngaacnttttttttgcccccaaattttttttntccagggggnaaaaaccccccccccccccttttnttngggaaaaaaaaaacccncttttangggggnngaaatttcccncccaaaaggntttaaaaaaaantttttgggttngggaaaaaaanccccttggggggnaaaaanttttttttttaaggggggggnggggggaaaatcctctttnggcccccgggggaaaaaaaaaaannnnaaaatttttnccccccccccctttt

SEQ ID NO: 22690 - DNA, 787 bp, Homo sapiens
  misc_feature 491, 526, 532, 632, 652, 684, 687, 703, 706, 753, 761: n = A,T,C or G
ggggagagttttcagattgctcttgggaaccatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggttttgggaaaacgaacatatatactcagaaacaagagcctcctaagaaggtgatgatgaccaaacggaccaaagacatgggcaagntcagttctgtcaccgtgtctaccattgatgaagangaagangagattgaggctagggaagttgctgactcatatgcacagaatgccaaagtgattgaaaacagctggagcgcaaaggcatgagcaagaggcgactgcaaanctggctgaattggagccaanaagcgaaatgaagggaccttgattgcaaccanttnaataccaggccttttntancctaactaaggcagctttaatcagaggcaagtatttttgatactaancgattctntttgcctacaaagcttacgtgttcct

SEQ ID NO: 22691 - DNA, 771 bp, Homo sapiens
  misc_feature 2, 586, 625, 636, 687, 716, 721, 730, 733, 765, 769: n = A,T,C or G
gncgacagagggaagattagaagaatgtaatagtgtaagttgagtagatagaacatttctttcgtagttttaaggatttctgctaagctttgactcattgatagcaagaataacacacaaagtaatattattacttaaaattgtcacgacttattgaactaacttatttaagatttaagctacaaagattgggcctttcagttaacataaaacaaacaaagttacataattgtactgttgctcaatttttgactttagacatagtcagctcatgttcttgtcatgtgttgaagcacaatttttcaacgttagccccaaatcatagttccatgccagcaagtgaggtttccccaaaataaagaggatttctcatccagtttgaacaaaaaatagctacattgttgatttgttgaatgtttttcaaatgcaataatttttacattttggatttagagaagagagaagtaggagagaaggcaggaagggtaacacttaaagacagaagggaaaatattctaacaccattgagtattcactcagaaaacagcaatgaattacgtggcctgtgatatttaatgagccctgnataatttgctctattattagtcaatatttggctttctgngagcatttacnaaattatacctgatgacaataggtcaggcagtttttccttctgctgcaganaatcttggatcttttaaattggagagggntccanagtcttagngcnctaaattcttctgacttgggagaacccagctntctntg

SEQ ID NO: 22692 - DNA, 564 bp, Homo sapiens
  misc_feature 289, 364, 404, 410, 438, 456, 458, 460, 473, 484, 491, 518,519, 520, 521, 522, 523, 524, 525, 526, 546: n = A,T,C or G
ggggacttttaattttgaatgctgtgtgcttttctctttaacacattagcagaaaagagttggaaaatactcaggaagataaggcagtttattcaaatataatatttctttcatcttgaagaataatacattaaatattgggcaatgcagtataatgtgtaaaaggattattcctttttatggcaataattggcaatatagtatttaaaaacaaatttcaggccaggcatggtggctcatgcctgtaatcccagcactttgggaggctgaggtgggcggatcacttgangtcaggagttcgagaccagcctggccaacatgttgaaaccccatctcttctaaaaatacaaaaaaaaattagccnggcgtgatggcgggtgcctgtattcccagttacttaggangctgangcaaggagactagcttgacctggagcanaggtgcagtgagccaaancncncattgccctccancctggggacanatgagancctgtctcaaaaaaagaaaaaaaaaannnnnnnnncccctggggcctttttccgnaacccactgaaaaccttg

SEQ ID NO: 22693 - DNA, 772 bp, Homo sapiens
  misc_feature 9, 15, 21, 23, 632, 635, 636, 648, 651, 682, 689, 709, 734,751, 754, 758: n = A,T,C or G
gtagacagnaggggnataagnanagttggctctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaataaataaaaacaaagttgattaagaaaggaagtataggctaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgnggnnccaaatacgtangangacaaaaggaatgtgtaagtcttatgccgtntcttcanaaacctagcaacttacaggnctgctgaactgccactctgcagaanaatctgattagcttgcntgngcanactcatgtctaaaa

SEQ ID NO: 22694 - DNA, 816 bp, Homo sapiens
  misc_feature 1, 8, 19, 22, 30, 63, 546, 578, 584, 600, 602, 608, 633,641, 672, 682, 695, 699, 727, 744, 758, 767, 771, 783: n = A,T,C or G
ncggcctncggctgcgagnagnacgacagnagggcttctcaccttctctgtcctgtgtccggnaatcacccatggtgctgccttatttaagagttcagaatctcgctgggttttttgcctcccatgtggagttgagggtttgggaaactgaagattttgctttttttcaaaatcaacagtaagtgatatccttggttccagagatttccaaacttttttttaagcaggaggactataatagaactttctaagatgaaggaaatcttccacattttgattggggtgatatttataggggaatatactttggtcacagtccactgaatgtatatttaatatgtatatatttgaccatatgtaaattatactttgattaaactaacttttaaaaacatggaacttaagcccaataaataagatagatcttttaataataaatcatttgggttccagttctgggtaaggtagagaaagcgtaacccactttgtctctcccatagatgacaactaaaaactctggaaataatgcgtgtgaccgggcacggnggctcatgcctgtaatcccagcactttcagangccgangcaggtggatcatgangncaaganatcgagaccatcctggccacatggngaaacccntctctactaaaatactaaaatagctgggggnggaacatgcncctggagtctcanctcntgggaggctgagcaggagagtactttancccggagcgaggtgcanggaccgaatacacnctggctcanccgnaccaggagactntggctaaaaaaaaaaaaaaaacccggggccttt

SEQ ID NO: 22695 - DNA, 377 bp, Homo sapiens
  misc_feature 20, 97, 139, 146, 154, 158, 162, 194, 199, 202, 212, 229,239, 244, 246, 247, 248, 260, 265, 278, 279, 280, 282, 283,284, 285, 286, 287, 288, 289, 290, 291, 294, 314, 315, 322,338, 346, 363, 372: n = A,T,C or G
aggagtcttggccctctcangctaaacagcaacagaacaaagtttagcaaaatgatggatactatgtctaatgtgaatattaacaaaataagcatgnaaaatgacccaaaggatttggttgggttttttaaccttcctnggtttanttccgggncccntccnttttaaattttaacaagggggtttttttgggngaaanttnaaaaaaaaanttttttccccccaattnggggggggtntgtgngnnnaaaaaaaggggnttttntttaaaaaaaaannngnnnnnnnnnnggngggggggggggggttttttnnaaaaggntttttttttaaaaaanaggggggnttttttttttttttaanagggggggnccccc

SEQ ID NO: 22696 - DNA, 832 bp, Homo sapiens
  misc_feature 12, 15, 29, 42, 58, 61, 68, 763, 812, 826: n = A,T,C or G
ttttgacctacnaanccccttgcttgttncttttggccgcancggccacggctgcganagncgacagnagggggtgtataaacacatatatgtatagcatagactaaggatgttctgtattgctaatgaatgtacttttcaacatggttttgatttatcattctgagaagtgtatgttggtgacgggagaactagaacatccttttttgcatattgtatcagttttaactcacaataatgcattttatgggatctgtgacacttgagagtaacctttgtgacataaagggatgcttccaggcactaattagccaattaattttattataaaagtcttgtgatttgaaaaaatatatatgtacattataattatatatgcatgtatgtatatatacacacacatatacatatatatattgttcttaccttttcagggaatgtgtggcagtagaagcgctgataacttgtcatgcccttctccattgaatgtaatggaaccagtaagcttctttcctcttaaatcactggggaagggaatgatacaacatttcagacacatagtttccctagtttagatgaaatatatgtttattttaaatacataatttgataaattattgttgattggaagtgactttcacctttgaaagtccattgctgtctgaagccactagaaagcccctgaattgcatagtgatttatctttctgactaaaggaggtatgcaccataaaacatgtacagtggctcatgcctgtatccanacttattaaatggtgagggggaggatgcttcagccaggagttgaaacancctatcacaaaganaccttt

SEQ ID NO: 22697 - DNA, 815 bp, Homo sapiens
  misc_feature 5, 7, 8, 9, 10, 11, 12, 23, 28, 34, 41, 52, 54, 55, 63, 65,68, 580, 584, 595, 629, 635, 638, 641, 645, 647, 677, 683,684, 690, 703, 713, 729, 730, 735, 747, 764, 768, 775, 795,806, 811: n = A,T,C or G
ttttnannnnnntaacttggttnaaaancccttntttgttncttttggccgnanntagacagnanggncgttgagtaacatatatgttcaacactagctttttacttacatatgtaacaatccttataacaaccttgaaagatgagcttgattatctcattgggcatataaaacatagagctgagagatatttaattgtctaaggtcacagaactaagaaatgcaagagctcagagatttgaaccctgcattagtccgttttcatgctgctgatggggacagacctgagactgggcaatttacaaaagaaataattttaacaacttgcagttccccagccacatggaactgtaagtccaattaaaactctctcttttgtaaattgcccagtctcgggtatatcttcaccagcagcatgaagactgattaatacagtaacttacatgccaggaaaagcccctgtcaaataatagaacattgaaaaaaattattggtggaatgggtgtgtaagtaaaatatactttatcatatggtttcttctaaacagtaaaagtgacttggaatcttaaaacatcaatgngtanaccaatactgntttactaccaatctaaaatatgccaatttttagngaattnttnaanagcngntgactcacctagttttctggtacttggggnttctannccgggnaaaggtcaaaaanaatcctcggnttaatttgctttttanncctangaaaaaatcaanaaaagactttttggttnattnttttggntccctttagggaggttaggnaaaaaggtgtnaaatnaaaa

SEQ ID NO: 22698 - DNA, 756 bp, Homo sapiens
  misc_feature 558, 600, 612, 665, 719, 724, 726, 727, 733, 750: n = A,T,C or G
ggggaggaatgattggcatttgaaatggtcattatgtctcttagatattttaaattaatctctgtatctgttttcgccaatgatgcattttccctaggaataaaagacatacacgtgaatacagttaacagaaatattgttagctaaataaaattatgtctaagatcataatatatcaggaaattgtttttatacaggtaaatggttgcagttttgtgatgagaacaggaaagcctacaaatttattaagggtacagtatttaaaactacttgtgatactaatgttggatactatttaaaatcatctggcttactaacaaaactttttcctgcatgtacttctttctgtgtgtgatttcaaattaattttaatgtttactaaaacaaagttatctaccatttattataaaactcaattgtaggccaggcgtggtggcttacgtctgtaatcccagcactttgggaggccgaggcaggtggatcacctgagataaggagttcgagaccagcctgaccaacaaggtgaaaccgcatctctactataagtacaaaaattanccgggcatgggggcagccgcctgtagtcccagctccttggangctgagacaganattgcttgaccccggaggcggaggttgcagtgagctgaaatgcgccctgactncaacctggggacagagcagactctgtcaaaaaaaaaaaaaaaaacctggggccnttttncnnaacccnaagaaaaacttggggtncccccc

SEQ ID NO: 22699 - DNA, 782 bp, Homo sapiens
  misc_feature 175, 564, 607, 609, 619, 631, 654, 721, 724, 741, 744, 749,762, 777: n = A,T,C or G
ggggatttttttaaatatgatgtgtaggttgactttaaataggatcgaatgctaaggcatcagaatatgtctttaaaataatattaatcattagaaaaattacattgtttctcagtgtgattaatttgagggattaacaccaagtaattggtaggtattctggtatatttttaanaattaaatacaccattttaccttatagcctaaagtaaagctttacatcatagcttctgtaattacaacaacatatatttttaaggaagtagagttaagatgctcaaatctaggtgagacatttatcgacattccttgaggattccatctctcgaatctgccttcatgcacatgcacatgtactatttctggagaaatggaagcgaggaagtattagatgagcccaaggggagtagcgggggctgaagccaaagttttaatagctactacagttgtgtattgattgagatgtgctggaaaaacaggaaattgagctgctaaacaggaaaatgactactatcctaccattcccagacctgattggctgtgccacagtttctaggccagttnactgtaatcaagataattacaggagtcattgaatcattttctncnttgggctaanatgaatgccagntcacacaaatggaagtgtccganggtagagcactctttctcttttttatgcctgaaagcccttgctgatactgcttaacagaataggaanaanagggcctggctataganaancctgnttcctggctgggnactccaaatttaggntccgg

SEQ ID NO: 22700 - DNA, 645 bp, Homo sapiens
  misc_feature 93, 387, 390, 400, 402, 422, 465, 486, 496, 506, 511, 539,545, 576, 580, 588, 590, 602, 609: n = A,T,C or G
ggggtttttcctcgatatttgaacactcatttaaaaagttttcataataacactttgtcatttagacaatagcagagggactttgttctcagngagtaacctctatgccagctttttaagtaaagttttagaatttttttaatattaatttttctccttgatcttagggaatgattatattaaataattgagagaaccagctatctggtacatcttccaatgacttcttttaatccactgtatcttgtccttctccccatggccctctgattggttattcaatttagatttggtcattgtattattgcctgtgcctgcagctaagtcttcaaaatagccccctaatggtttagcctgcagtaagcctcaataatgtatgatagtggnganggagggtaananggcttctcttgatatgtacnttctacaggattcatttgggcaatcatttttaagctaaagttnctgggctcaagggggggtccntttaaaatantgcaacaacntctgncacattattagggtagttcctggaaaanaaccgnacttggaaaaaaataaactgcccaaattgangggngaagggantncctttaaaattnaattggnaatcttaaaaaaaaaaaaaaaccccgggcctttccc

SEQ ID NO: 22701 - DNA, 512 bp, Homo sapiens
  misc_feature 7, 13, 16, 20, 41: n = A,T,C or G
cgacagnaggggnagnaggnagccacttacggggcctcagnaatactgagttgaaggaaaagggcctttctctacctgccactaatgagactaaagttgttataaatatgtgccttatgatgaaaggggacaaccttatgatacagaattaacgctcacctcttgcatataaaaccagaatgaattgtgaaacaaatctctaaatgtaggcttctctttaaatcagatttactcaggccgggcgtggtggctcacgcctgtaatcccagcactttgggaggctgagacaggtggatcacctgaggtcaggagttcaagaccatcctagccagcatgatgaaaccccatcgctactaaaattcaaaaatcagctgggcgtggtggtgcacacctgtaatcccagctgctgcagaggctgaggcaggagaattgctcgatcccaggaggtagaggttgcagtgaacagagatcgtgctactgcgctcctgggtgacagagtgagactccatctc

SEQ ID NO: 22702 - DNA, 359 bp, Homo sapiens
  misc_feature 2, 9, 14, 27, 33, 46, 53, 63, 66, 74, 286, 305, 345: n = A,T,C or G
anccttggncctanaaacccccttttnttgttncttttggccgcancggcctncggctgcganagnacgacagnagggttaacagtgtggataataatgatagtcatttgataactgttttctgtatgccaagcaccgagttaaatatctacattccacatctcatttttgaggctggtattactttttcctcatattacagataaggaaaagatttagacagttcccgttcttttggaattgatagtctcatgtaagaggaactttaagggttggagacaatgtnaaaagtacagtggtttagnaagaaggattgaaattagggggggtccctttcccccaatngggggggggggggg

SEQ ID NO: 22703 - DNA, 784 bp, Homo sapiens
  misc_feature 1, 22, 28, 50, 499, 595, 646, 648, 660, 670, 719, 721, 725,742, 757, 767, 771, 773: n = A,T,C or G
ncggggttctgatcctgcaggnacaggnaagctggtaaccgggccagggnaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcangctttgtttgaggtcctgtatatacagcactgaaaagagagataaagtccctgcctgcatgcattctggcggaagagacaagcaagcatgaacaantagcagaaacctagttttagtgaaaatgctgtaagaaatagaatgcgatanantgctgcagctantgaaataagnggctgaaaggggttctgaaccgaggcatgtgagctgggcctaacactanangaanagcccgtgacttcgggnagggaccagcagaanaaagaatcancctngnagataacaggc

SEQ ID NO: 22704 - DNA, 727 bp, Homo sapiens
  misc_feature 23, 40, 177, 178, 533, 554, 581, 583, 702, 704, 717, 721: n = A,T,C or G
ggggtgacaaatatcatggcagnatcatgaggtcaggagnatcaagaccatcctggctaacacggtgaaatcccgtctctactaaaaatacaaaaaattagctgtgcgtgatggcatgcgcctgtagtcacagctacttgggaggctgaggcaggagaatcgcttgaaactgggagnngcggaggttgcagtgagccgagatgacgccactgcattccagcctggcaacagagtgagactctgtctcaaaaacaaaaacaaaaacaaaaaaagatgtaaaattttcattaggtattttcagaaagtcttagtgctgtttctataccttttatatgctagtcaatgtcagtagaaaaaaatggaacatccatttcattctcctgggcgatttctggaccagttagccttgattactagcagtggtatgctggtaaatgtttaaccactggctctccgggatctgtagcttttgccagtgcccatggtatactcccaccaggctgatttcaagctaccaacatgctatcacgaanagtggagttgagacaagggcncagtagccaccatctatatagtaattncncccacaggtacatggacgtaaatacctcaagagcctcagatcaaattaggagggatatgctttgatattattaccttggtttaaaggaatgattaattataagttggatgattgatttnanaagggtgctttanaacnactggc

SEQ ID NO: 22705 - DNA, 817 bp, Homo sapiens
  misc_feature 3, 10, 11, 14, 16, 18, 20, 21, 28, 30, 36, 50, 51, 58, 60,68, 322, 559, 599, 621, 641, 688, 701, 704, 707, 729, 739,765: n = A,T,C or G
gantaaacgnngcnancnannccccttntnttgttncttttggaccgcanncgacagnangggatagnattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcaaagcttactttgtatcagcctccctacgcaaggacctatgcactggagccgtaggaggctcttcagttgggccccaangataaggctactgatttgatactaaatgaatcagcagtggatgtagggatagctgattttaaaacactcggctgggcacagtggctcacacctgtaaacccagcactttgggaggctgaggcaggcagatcatgatgtcaggagtttgagaccagcctggccaatatggtgaaaccctgtctctacaaaaaatacaaaaattagctgggcatggtggtgcgtgccctgaagtcccanctactcggaagctgaggcagaaaatcacttgaacctggangcggaggttgtgttgagccganatcgcaccactgcactccancctggcgacagagcagactctgcctcaaaaaacaaaacaaacaaacnctccccctcaccnatntanactctctctcatttatcgagancctcttttcnttttttaagacttatggggaactagntcccaaacccatctttaaaaaaaaactgaccactccaaattcctttatcatt

SEQ ID NO: 22706 - DNA, 697 bp, Homo sapiens
  misc_feature 157, 260, 504, 512, 518, 544, 563, 588, 591, 598, 600, 635,650, 655, 663, 673, 678, 681, 685: n = A,T,C or G
ggggattttggaaaagtatcacaaaataattaagattgatcttgtagaataacatttgtttggttctaactttcagactttccctactttcatatcttaaaaaatgacaattaaatgcaaaatagctttggggcttggatgattaattgtaattttnaattatgtggaaaatttgaacaactgatttgaaaagttctctgaatatgtataggaattatcatgctttgacattttgattaacattttatagaatgccccangttgtttttgcatggattgttataagtcaggaggaaggagaagttgctccttaaaaacccttgtattatgccaagaccctaatttctgtcttaaaaaagtatgctttacaccttaaagcagcacttttattttgcacattgataatgctggatgtatactttctttttttccatttattttatttaaaatttttttattttaatagcttttagggacaattgcttttggtacaatgctggatgnatacttcntggagntttctaatcagaaatgatcttctggnaagctctattggtagtttncctgctgaatttcttttacctggtnaangaaaaananacctataacgaggggcctggctctagtttggctgntttttccaaataacncagcngctgtttntgggaagtcncagcnggntttntgggaaggaggc

SEQ ID NO: 22707 - DNA, 833 bp, Homo sapiens
  misc_feature 3, 11, 13, 16, 21, 33, 41, 45, 47, 54, 64, 66, 67, 75, 77,256, 257, 625, 675, 677, 684, 716, 734, 742, 755, 767, 768,809, 813, 815, 832: n = A,T,C or G
ttntaactggncnacnatccnccttgcttgttncttttggnccgnancggcctncggctgcganannacgacagnangggtcattccactgaatctcaatgtattccttttctattgctgcattacaaatcatcctacaatttagcagcttaaaacaacaatgtttatacctcagagtttatgtgggttgggaatctgggtgtggcttagctgtgcttctgacttagggttcctcctacaactgcaatcaagatgnntcagccagggctgcagttctctcaaggctcagcagggggaagatccacttgcaagctcactcatgcgtctgctggcaatactcaggctcttggtggttgttggccaaggtgtcttgacaaaatggctgaaattccctcccttcccccaacccctaagaaagagatggtaggtagagaatggacgtggggggaggggggagaagaggtggatgccagagtattatttttataatctagtcttggaagcaacatagcatcattgtggcctgttatttgtggggcccaatgcaaaagaaatatatgaagtccctagttcaaaaagcaggaagaagttcccttaaaggggtttttctttcttctggtggggnctttttcttgacttcctatggggattttacttgctttgcattctgagtananaaaggtnaaattttaaataattagcataatttaccattntttttatattgactatgncaggttanatgcaatataaancatctatttttnntagatccccaaaaaaaaaaaaaaaaaaaaaacccggggccntttncnaaaccaataaaactttna

SEQ ID NO: 22708 - DNA, 420 bp, Homo sapiens
  misc_feature 179, 192, 215, 238, 239, 253, 264, 277, 289, 309, 316, 317,318, 327, 332, 336, 338, 352, 366, 381, 390, 395, 399, 413,414: n = A,T,C or G
gggatgctacagctgtaaccccatgcctgagagttgcatgagtactgatgactgcaaattatttatttttgtatcctcaattccttgaatagttgaattggggctcaatacatgtttactaaatgatgattgcatttaactgtgagcagctttttcagatattaatcaaaatgcctgcnaagactacacagntgcaagggacatcagcttatttncccacatttattgggttcctggnncctaagttgggganacccttgggtngaatccccggaanaacaaccaaccnccctgggaaaggggaattcnaccttgnnnggggttttnaaaanaaananaaaacccggttttntttgggaaaccttnccccgggaagggggnccccctttnggggngggngccccccttttttnnggggga

SEQ ID NO: 22709 - DNA, 159 bp, Homo sapiens
agggtatttcaaaccgaatctattaatttcatgagccgtttcttgattgagtgaaatgtctgtgaccataatagatacagaactagtaagcaccttaccagactatgacccatttgttagcaactaacatacacatgtaaccatcctgcttacaaaaaa

SEQ ID NO: 22710 - DNA, 843 bp, Homo sapiens
  misc_feature 2, 6, 8, 31, 44, 51, 61, 64, 72, 77, 85, 117, 124, 701, 709,724, 787, 832, 839: n = A,T,C or G
ancctngncctacgaaccccttgtcttgttncttttggccgcancggcctncggctgcganagnacgacagnagggnagccaagnacgcgccactgcactccagcctgggcaacagnagcaagnactctgtctaaaaaaaaataaataaataaaataaaataaaataaaactgccttgattaagtaccttcaaatcagtgattaactagcaactctagccctgaattctgaatcttttatttttccttcaaaaggtaactcttaaaccatcccttctacttaatctgcatattgtactgaggttatttatcttccaacgtttgccagttcccttaggaatacccttagcaaccgcctttccatacaaattgcctgggaaagtttaaggggatcaaatcccttgtaactaaacaaaatagggcttttgaatagaaatttaatagcaaattagattggcatcattacaggaggatgaatgaaacttttgttttctttacatttacagtagaaaagtcaactaactctccaatatacaatgagctggaagagagagattttttttggcttattttatgatgtgtcttgctttcaccacattctgtcaacttccacaacaaatttaacctccaaaacaaatcttaaacctggtctctctcactcactgctgctccatttttcctaatgggagttttctcttgganaaaggagntttcatcagagaaangagtctcctccttctccaatacaactctacctacacagaaaaaaagtttctttcgttctctgnaactaaggcttctactttcttctcctcataaaaggtttcaacttntccttcncagc
